United States Patent 9,061,059 (MODIFIED POLYNUCLEOTIDES FOR TREATING PROTEIN DEFICIENCY) - sequence listing, part 86

SEQ ID NO: 167672 - DNA, 5277 bp, Artificial Sequence
  Description of Artificial Sequence: Synthetic coding sequence
atgagctgtgtgcactacaagttcagcagcaagctgaactatgacacagtgacctttgatggcctgcacatcagcctgtgtgacctgaagaagcagatcatgggccgggagaagctgaaggctgctgactgtgacctgcagatcaccaatgcccagaccaaggaggagtacacagatgacaatgccctgatccccaagaacagctctgtgattgtgcggcgcatccccatcggcggcgtgaagagcaccagcaagacctacgtgatcagcaggacagagcccgccatggccaccaccaaggccattgatgacagcagcgccagcatcagcctggcccagctgaccaagacagccaacctggccgaggccaatgccagcgaggaggacaagatcaaggccatgatgagccagagcggccacgagtatgaccccatcaactacatgaagaagcccctgggccccccaccacccagctacacctgcttccgctgtgggaagccaggccactacatcaagaactgccccaccaatggagacaagaactttgagagcggcccccgcatcaagaagagcacaggcatccccaggagcttcatgatggaggtgaaggaccccaacatgaagggggccatgctgaccaacacaggcaagtatgccatccccaccattgatgctgaggcctatgccatcggcaagaaggagaagccacccttcctgcctgaggagcccagcagcagcagtgaagaagatgaccccatcccagatgagctgctgtgcctgatctgcaaggacatcatgacagatgctgtggtgatcccctgctgcggcaacagctactgtgatgagtgcatcagaacagccctgctggagagtgatgagcacacctgccccacctgccaccagaatgatgtgtccccagatgccctgattgccaacaagttcctgcggcaggccgtgaacaacttcaagaatgagaccggctacaccaagaggctgaggaagcagctgcccccacctcctccacccatccccccaccccggcccctcatccagaggaacctgcagcccctgatgaggagccccatcagccggcagcaggaccccctgatgatccctgtgaccagcagcagcacccacccagcccccagcatcagcagcctgaccagcaaccagagcagcctggcccctcctgtgtctggcaaccccagcagcgccccagcccctgtgcctgacatcacagccaccgtgtccatctctgtgcacagcgagaagagtgatggccccttccgggacagcgacaacaagatcctgcctgctgctgccctggccagcgagcacagcaagggcaccagcagcatcgccatcacagccctgatggaggagaagggctaccaggtgcctgtgctgggcacccccagcctgctgggccagagcctgctgcacggccagctgatccccaccaccggccctgtgcgcatcaacacagcccggcctgggggcggccggcccggctgggagcacagcaacaagctgggctacctggtgtccccaccccagcagatccggcggggggagaggagctgctaccgcagcatcaacagaggccgccaccacagcgagaggagccagaggacccagggccccagcctgcctgccacccctgtgtttgtgcctgtgcccccaccacccctgtacccacctccaccccacaccctgcccctgcccccaggagtgcccccaccccagttcagcccccagttccccccaggccagcccccacctgctggctacagcgtgcccccacctggcttccccccagccccagccaacctgagcaccccctgggtgagcagcggcgtgcagacagcccacagcaacaccatccccaccacccaggccccacccctgagccgggaggagttctaccgggagcagaggcggctgaaggaggagagcaagagcccctacagcggcagcagctacagccgcagcagctacacctacagcaagagccgcagcggcagcaccaggagccgcagctacagccgctccttcagccgcagccacagccgcagctacagccgcagccccccctacccccggcggggccggggcaagagcaggaactaccgcagccgcagccgcagccacggctaccacaggagccgcagccgcagccccccctaccgccgctaccacagccgcagccgcagcccccaggccttccggggccagagccccaacaagagaaatgtgccccagggcgagacagagcgggagtacttcaaccgctaccgggaggtgcccccaccctatgacatgaaggcctactacggccgctctgtggacttccgggacccctttgagaaggagcgctaccgggagtgggagaggaagtaccgggagtggtatgagaagtactacaagggctacgccgccggggcccagccccggcccagcgccaaccgggagaacttcagccctgagcgcttcctgcccctgaacatccggaacagccccttcacccggggcagaagagaagattatgtgggcggccagagccacaggagcaggaacatcggcagcaactacccagagaagctgagcgccagagatggccacaaccagaaggacaacaccaagagcaaggagaaggagagtgaaaatgcccctggagatggaaaaggaaacaagcacaagaagcacaggaagagaagaaaaggagaggagagcgagggcttcctgaaccctgagctgctggagaccagcaggaagagccgggagcccaccggggtggaggagaacaagacagacagcctgtttgtgctgcccagcagagatgatgccacccctgtgagagatgagcccatggatgctgagagcatcaccttcaagtctgtgtctgagaaggacaagcgggagcgggacaagcccaaggccaagggggacaagaccaagaggaagaatgatggcagcgctgtgtccaagaaggagaacatcgtgaagccagccaagggcccccaggagaaggtggatggagagcgggagaggagccccaggtctgagccccccatcaagaaggccaaggaggagacccccaagacagacaacaccaagagcagcagcagcagccagaaggatgagaagatcaccggcacccccaggaaggcccacagcaagagcgccaaggagcaccaggagaccaagcctgtgaaggaggagaaggtgaagaaggactacagcaaggatgtgaagtctgagaagctgaccaccaaggaggagaaggccaagaagcccaatgagaagaacaagcccctggacaacaagggggagaagaggaagaggaagacagaggagaagggcgtggacaaggactttgagagcagctccatgaagatcagcaagctggaggtgacagaaattgtgaagcccagccccaagaggaagatggagccagacacagagaagatggacaggaccccagagaaggacaagatcagcctgagcgccccagccaagaagatcaagctgaaccgggagaccgggaagaagattggcagcacagagaacatcagcaacaccaaggagcccagcgagaagctggagagcaccagcagcaaggtgaagcaggagaaggtgaagggcaaggtgcggaggaaggtgactggaacagagggcagcagcagcaccctggtggactacaccagcaccagcagcactggaggcagccctgtgaggaagtctgaggagaagacagacaccaagaggacagtcatcaagaccatggaggagtacaacaatgacaacacagccccagcagaagatgtgatcatcatgatccaggtgccccagagcaagtgggacaaggatgactttgagagcgaggaggaggatgtgaagagcacccagcccatcagctctgtgggcaagccagccagcgtcatcaagaatgtgtccaccaagcccagcaacatcgtgaagtacccagagaaggagagcgagcccagcgagaagatccagaagttcaccaaggatgtgtcccatgagatcatccagcacgaggtgaagagcagcaagaacagcgccagcagcgagaagggcaagaccaaggaccgggactacagcgtgctggagaaggagaaccctgagaagaggaagaacagcacccagcctgagaaggagagcaacctggaccggctgaatgagcagggcaacttcaagagcctgagccagagcagcaaggaggcccggaccagtgacaagcatgacagcacccgggccagcagcaacaaggacttcacccccaacagagacaagaagacagattatgacacccgggagtacagcagcagcaagagaagagatgagaagaatgagctgaccaggaggaaggacagccccagcaggaacaaggacagcgccagcggccagaagaacaagccccgggaggagcgggacctgcccaagaagggcaccggggacagcaagaagagcaacagcagccccagccgggacaggaagccccatgaccacaaggccacctatgacaccaagaggcccaatgaggagaccaagtctgtggacaagaacccctgcaaggaccgggagaagcacgtgctggaggccaggaacaacaaggagagcagcggcaacaagctgctgtacatcctgaaccccccagagacccaggtggagaaggagcagatcaccggccagattgacaagagcacagtgaagcccaagccccagctgagccacagcagccggctgagcagtgacctgacccgggagacagatgaagctgcctttgagccagactacaatgaaagtgacagcgagagcaatgtgtctgtgaaggaggaggagagcagcggcaacatcagcaaggacctgaaggacaagatcgtggagaaggccaaggagagcctggacacagctgctgtggtgcaggtgggcatcagcaggaaccagagccacagcagccccagcgtgagccccagccgcagccacagccccagcggcagccagaccaggagccacagcagcagcgccagcagcgctgagagccaggacagcaagaagaagaagaagaagaaggagaagaagaagcacaagaagcacaagaagcacaagaagcacaagaagcatgctggaacagaggtggagctggagaagagccagaagcacaagcacaagaagaagaagagcaagaagaacaaggacaaggagaaggagaaggagaaggatgaccagaaggtgaagtctgtgacagtgtag

SEQ ID NO: 167673 - DNA, 2859 bp, Artificial Sequence
  Description of Artificial Sequence: Synthetic coding sequence
atgagctgtgtgcactacaagttcagcagcaagctgaactatgacacagtgacctttgatggcctgcacatcagcctgtgtgacctgaagaagcagatcatgggccgggagaagctgaaggctgctgactgtgacctgcagatcaccaatgcccagaccaaggaggagtacacagatgacaatgccctgatccccaagaacagctctgtgattgtgcggcgcatccccatcggcggcgtgaagagcaccagcaagacctacgtgatcagcaggacagagcccgccatggccaccaccaaggccattgatgacagcagcgccagcatcagcctggcccagctgaccaagacagccaacctggccgaggccaatgccagcgaggaggacaagatcaaggccatgatgagccagagcggccacgagtatgaccccatcaactacatgaagaagcccctgggccccccaccacccagctacacctgcttccgctgtgggaagccaggccactacatcaagaactgccccaccaatggagacaagaactttgagagcggcccccgcatcaagaagagcacaggcatccccaggagcttcatgatggaggtgaaggaccccaacatgaagggggccatgctgaccaacacaggcaagtatgccatccccaccattgatgctgaggcctatgccatcggcaagaaggagaagccacccttcctgcctgaggagcccagcagcagcagtgaagaagatgaccccatcccagatgagctgctgtgcctgatctgcaaggacatcatgacagatgctgtggtgatcccctgctgcggcaacagctactgtgatgagtgcatcagaacagccctgctggagagtgatgagcacacctgccccacctgccaccagaatgatgtgtccccagatgccctgattgccaacaagttcctgcggcaggccgtgaacaacttcaagaatgagaccggctacaccaagaggctgaggaagcagctgcccccacctcctccacccatccccccaccccggcccctcatccagaggaacctgcagcccctgatgaggagccccatcagccggcagcaggaccccctgatgatccctgtgaccagcagcagcacccacccagcccccagcatcagcagcctgaccagcaaccagagcagcctggcccctcctgtgtctggcaaccccagcagcgccccagcccctgtgcctgacatcacagccaccgtgtccatctctgtgcacagcgagaagagtgatggccccttccgcaccagcagcactggaggcagccctgtgaggaagtctgaggagaagacagacaccaagaggacagtcatcaagaccatggaggagtacaacaatgacaacacagccccagcagaagatgtgatcatcatgatccaggtgccccagagcaagtgggacaaggatgactttgagagcgaggaggaggatgtgaagagcacccagcccatcagctctgtgggcaagccagccagcgtcatcaagaatgtgtccaccaagcccagcaacatcgtgaagtacccagagaaggagagcgagcccagcgagaagatccagaagttcaccaaggatgtgtcccatgagatcatccagcacgaggtgaagagcagcaagaacagcgccagcagcgagaagggcaagaccaaggaccgggactacagcgtgctggagaaggagaaccctgagaagaggaagaacagcacccagcctgagaaggagagcaacctggaccggctgaatgagcagggcaacttcaagagcctgagccagagcagcaaggaggcccggaccagtgacaagcatgacagcacccgggccagcagcaacaaggacttcacccccaacagagacaagaagacagattatgacacccgggagtacagcagcagcaagagaagagatgagaagaatgagctgaccaggaggaaggacagccccagcaggaacaaggacagcgccagcggccagaagaacaagccccgggaggagcgggacctgcccaagaagggcaccggggacagcaagaagagcaacagcagccccagccgggacaggaagccccatgaccacaaggccacctatgacaccaagaggcccaatgaggagaccaagtctgtggacaagaacccctgcaaggaccgggagaagcacgtgctggaggccaggaacaacaaggagagcagcggcaacaagctgctgtacatcctgaaccccccagagacccaggtggagaaggagcagatcaccggccagattgacaagagcacagtgaagcccaagccccagctgagccacagcagccggctgagcagtgacctgacccgggagacagatgaagctgcctttgagccagactacaatgaaagtgacagcgagagcaatgtgtctgtgaaggaggaggagagcagcggcaacatcagcaaggacctgaaggacaagatcgtggagaaggccaaggagagcctggacacagctgctgtggtgcaggtgggcatcagcaggaaccagagccacagcagccccagcgtgagccccagccgcagccacagccccagcggcagccagaccaggagccacagcagcagcgccagcagcgctgagagccaggacagcaagaagaagaagaagaagaaggagaagaagaagcacaagaagcacaagaagcacaagaagcacaagaagcatgctggaacagaggtggagctggagaagagccagaagcacaagcacaagaagaagaagagcaagaagaacaaggacaaggagaaggagaaggagaaggatgaccagaaggtgaagtctgtgacagtgtag

SEQ ID NO: 167674 - DNA, 357 bp, Artificial Sequence
  Description of Artificial Sequence: Synthetic coding sequence
atgagctgtgtgcactacaagttcagcagcaagctgaactatgacacagtgacctttgatggcctgcacatcagcctgtgtgacctgaagaagcagatcatgggccgggagaagctgaaggctgctgactgtgacctgcagatcaccaatgcccagaccaaggaggagtacacagatgacaatgccctgatccccaagaacagctctgtgattgtgcggcgcatccccatcggcggcgtgaagagcaccagcaagacctacgtgatcagcaggacagagcccgccatggccaccaccaaggctgtgtgcaagaacaccatcagccacttcttctacaccctgctgctgcccctgtag

SEQ ID NO: 167675 - DNA, 1410 bp, Artificial Sequence
  Description of Artificial Sequence: Synthetic coding sequence
atggctgctgaggccggcgtggtgggcgctggggccagcccagatggagactggagggaccaggcctgtggcctgctgctgcacgtgcacctgagcagccggctgggccgggccgcccctgtgaggacaggccgccacctgaggacagtgtttgaggacacagtggaggagagggtcatcaatgaggagtacaagatctggaagaagaacacccccttcctgtatgacctggtgatgacccacgccctgcagtggcccagcctgactgtgcagtggctgcctgaggtgaccaagccagagggcaaggactatgccctgcactggctggtgctgggcacccacaccagtgatgagcagaaccacctggtggtggcccgggtgcacatccccaatgatgatgcccagtttgatgccagccactgtgacagcgacaagggggagtttggaggctttggatctgtgacaggcaagattgaatgtgagatcaagatcaaccacgagggggaggtgaacagagcccgctacatgccccagaacccccacatcatcgccaccaagacccccagcagtgatgtgctggtgtttgactacaccaagcacccagccaagccagaccccagcggggagtgcaacccagacctgcggctgcggggccaccagaaggagggctacggcctgtcctggaacagcaacctgagcggccacctgctgagcgccagtgatgaccacacagtgtgcctgtgggacatcaatgccggccccaaggagggcaagatcgtggatgccaaggccatcttcaccggccacagcgctgtggtggaggatgtggcctggcacctgctgcacgagagcctgtttggatctgtggctgatgaccagaagctgatgatctgggacaccaggagcaacaccaccagcaagcccagccacctggtggatgcccacacagctgaggtgaactgcctgtccttcaacccctacagcgagttcatcctggccaccggcagcgctgacaagacagtggccctgtgggacctgaggaacctgaagctgaagctgcacacctttgagagccacaaggatgagatcttccaggtgcactggagcccccacaatgagaccatcctggccagcagcggcacagaccggcggctgaatgtgtgggacctgagcaagattggagaggagcagagcgcagaagatgctgaagatggccccccagagctgctcttcatccatggaggccacacagccaagatcagtgacttctcctggaaccccaatgagccctgggtgatctgcagcgtgtctgaggacaacatcatgcagatctggcagatggccgagaacatctacaatgatgaggagagtgatgtgaccaccagcgagctggagggccagggcagctag

SEQ ID NO: 167676 - DNA, 1278 bp, Artificial Sequence
  Description of Artificial Sequence: Synthetic coding sequence
atggccagcaaggagatgtttgaggacacagtggaggagagggtcatcaatgaggagtacaagatctggaagaagaacacccccttcctgtatgacctggtgatgacccacgccctgcagtggcccagcctgactgtgcagtggctgcctgaggtgaccaagccagagggcaaggactatgccctgcactggctggtgctgggcacccacaccagtgatgagcagaaccacctggtggtggcccgggtgcacatccccaatgatgatgcccagtttgatgccagccactgtgacagcgacaagggggagtttggaggctttggatctgtgacaggcaagattgaatgtgagatcaagatcaaccacgagggggaggtgaacagagcccgctacatgccccagaacccccacatcatcgccaccaagacccccagcagtgatgtgctggtgtttgactacaccaagcacccagccaagccagaccccagcggggagtgcaacccagacctgcggctgcggggccaccagaaggagggctacggcctgtcctggaacagcaacctgagcggccacctgctgagcgccagtgatgaccacacagtgtgcctgtgggacatcaatgccggccccaaggagggcaagatcgtggatgccaaggccatcttcaccggccacagcgctgtggtggaggatgtggcctggcacctgctgcacgagagcctgtttggatctgtggctgatgaccagaagctgatgatctgggacaccaggagcaacaccaccagcaagcccagccacctggtggatgcccacacagctgaggtgaactgcctgtccttcaacccctacagcgagttcatcctggccaccggcagcgctgacaagacagtggccctgtgggacctgaggaacctgaagctgaagctgcacacctttgagagccacaaggatgagatcttccaggtgcactggagcccccacaatgagaccatcctggccagcagcggcacagaccggcggctgaatgtgtgggacctgagcaagattggagaggagcagagcgcagaagatgctgaagatggccccccagagctgctcttcatccatggaggccacacagccaagatcagtgacttctcctggaaccccaatgagccctgggtgatctgcagcgtgtctgaggacaacatcatgcagatctggcagatggccgagaacatctacaatgatgaggagagtgatgtgaccaccagcgagctggagggccagggcagctag

SEQ ID NO: 167677 - DNA, 1251 bp, Artificial Sequence
  Description of Artificial Sequence: Synthetic coding sequence
atggccagcaaggagatgtttgaggacacagtggaggagagggtcatcaatgaggagtacaagatctggaagaagaacacccccttcctgtatgacctggtgatgacccacgccctgcagtggcccagcctgactgtgcagtggctgcctgaggtgaccaagccagagggcaaggactatgccctgcactggctggtgctgggcacccacaccagtgatgagcagaaccacctggtggtggcccgggtgcacatccccaatgatgatgcccagtttgatgccagccactgtgacagcgacaagggcggcaagattgaatgtgagatcaagatcaaccatgaaggagaggtgaacagagcccgctacatgccccagaacccccacatcatcgccaccaagacccccagcagtgatgtgctggtgtttgactacaccaagcacccagccaagccagaccccagcggggagtgcaacccagacctgcggctgcggggccaccagaaggagggctacggcctgtcctggaacagcaacctgagcggccacctgctgagcgccagtgatgaccacacagtgtgcctgtgggacatcaatgccggccccaaggagggcaagatcgtggatgccaaggccatcttcaccggccacagcgctgtggtggaggatgtggcctggcacctgctgcacgagagcctgtttggatctgtggctgatgaccagaagctgatgatctgggacaccaggagcaacaccaccagcaagcccagccacctggtggatgcccacacagctgaggtgaactgcctgtccttcaacccctacagcgagttcatcctggccactggatctgctgacaagacagtggccctgtgggacctgaggaacctgaagctgaagctgcacacctttgagagccacaaggatgagatcttccaggtgcactggagcccccacaatgagaccatcctggccagcagcggcacagaccggcggctgaatgtgtgggacctgagcaagatcggggaggagcagagcgcagaagatgctgaagatggccccccagagctgctcttcatccacggcggccacacagccaagatcagtgacttctcctggaaccccaatgagccctgggtgatctgcagcgtgtctgaggacaacatcatgcagatctggcagatggccgagaacatctacaatgatgaggagagtgatgtgaccaccagcgagctggagggccagggcagctag

SEQ ID NO: 167678 - DNA, 561 bp, Artificial Sequence
  Description of Artificial Sequence: Synthetic coding sequence
atggccagccccagcaaggctgtgattgtgcctggaaatggaggaggagatgtgaccacccacggctggtacggctgggtgaagaaggagctggagaagatccctggcttccagtgcctggccaagaacatgccagaccccatcacagcccgggagagcatctggctgcccttcatggagacagagctgcactgtgatgagaagaccatcatcatcggccacagcagcggggccatcgccgccatgagatatgcagagacccaccgggtgtatgccatcgtgctggtgtctgcctacaccagtgacctgggagatgaaaatgaaagagccagcggctacttcacccggccctggcagtgggagaagatcaaggccaactgcccctacatcgtgcagtttggcagcacagatgaccccttcctgccctggaaggagcagcaggaggtggccgaccggctggagaccaagctgcacaagttcacagactgtggccacttccagaacacagagttccacgagctgatcaccgtggtgaagagcctgctgaaggtgcctgcctag

SEQ ID NO: 167679 - DNA, 519 bp, Artificial Sequence
  Description of Artificial Sequence: Synthetic coding sequence
atggccagccccagcaaggctgtgattgtgcctggaaatggaggaggagatgtgaccacccacggctggtacggctgggtgaagaaggagctggagaagatccctggcttccagtgcctggccaagaacatgccagaccccatcacagcccgggagagcatctggctgcccttcatggagacagagctgcactgtgatgagaagaccatcatcatcggccacagcagcggggccatcgccgccatgagatatgcagagacccaccgggtgtatgccatcgtgctggtgtctgcctacaccagtgacctgggagatgaaaatgaaagagccagcggctacttcacccggccctggcagtgggagaagatcaaggccaactgcccctacatcgtgcagtttggcagcacagatgaccccttcctgccctggaaggagcagcaggaggtggccgactggaagcccaactgcaccaacagcctgactgtggccaccttccgcacccagagcttcatgaactag

SEQ ID NO: 167680 - DNA, 741 bp, Artificial Sequence
  Description of Artificial Sequence: Synthetic coding sequence
atggctgctgctgccatcccagccctgctgctgtgcctgcccctgctcttcctgctgtttggctggagccgggccaggagagatgacccccacagcctgtgctatgacatcaccgtcatccccaagttccggcccggcccccgctggtgtgctgtgcagggccaggtggatgagaagaccttcctgcactatgactgtggcaacaagacagtgacccctgtgagccccctgggcaagaagctgaatgtgaccatggcctggaaggcccagaaccctgtgctgcgggaggtggtggacatcctgacagagcagctgctggacatccagctggagaactacacccccaaggagcccctgaccctgcaggccaggatgagctgtgagcagaaggccgagggccacagcagcggctcctggcagttcagcattgatggccagaccttcctgctgtttgattctgagaagaggatgtggaccaccgtgcaccctggggccaggaagatgaaggagaagtgggagaatgacaaggatgtggccatgtccttccactacatctccatgggagactgcatcggctggctggaggacttcctgatgggcatggacagcaccctggagcccagcgctggggcccccctggccatgagcagcggcaccacccagctgcgggccacagccaccaccctcatcctgtgctgcctgctgatcatcctgccctgcttcatcctgcccggcatctag

SEQ ID NO: 167681 - DNA, 741 bp, Artificial Sequence; identical to SEQ ID NO: 167680
  Description of Artificial Sequence: Synthetic coding sequence

SEQ ID NO: 167682 - DNA, 4923 bp, Artificial Sequence
  Description of Artificial Sequence: Synthetic coding sequence
atgcagagcttccgggagcgctgtggcttccacggcaagcagcagaactaccagcagaccagccaggagaccagccggctggagaactaccggcagcccagccaggccggcctgagctgtgaccggcagaggctgctggccaaggactactacaacccccagccctaccccagctatgaaggaggagctggcaccccatctggaacagctgctgctgtggccgctgacaagtaccaccggggcagcaaggccctgcccacccagcagggcctgcagggccgcccagccttccctggctacggcgtgcaggacagcagcccctacccaggccgctatgctggggaggagagcctgcaggcctggggcgccccccagcccccaccaccccagccccagcccctgcctgctggggtggccaagtatgatgagaacctgatgaagaagacagctgtgccccccagccggcagtatgcagagcagggcgcccaggtgcccttccgcacccacagcctgcacgtgcagcagcccccaccaccccagcagcccctggcctaccccaagctgcagaggcagaagctgcagaatgacatcgccagccccctgcccttcccccagggcacccacttcccccagcacagccagagcttccccaccagcagcacctacagcagctctgtgcagggcggcggccagggcgcccacagctacaagagctgcacagcccccacagcccagccccatgaccggcccctgacagccagcagcagcctggcccctggccagagggtgcagaacctgcacgcctaccagagcggccgcctgtcctatgaccagcagcagcagcagcagcagcagcagcagcagcagcagcaggccctgcagagccgccaccacgcccaggagaccctgcactaccagaacctggccaagtaccagcactacggccagcagggccagggctactgccagccagatgctgctgtgaggaccccagagcagtactaccagaccttcagccccagcagcagccacagccctgcccggtctgtgggccgcagccccagctacagcagcacccccagccccctgatgcccaacctggagaacttcccctacagccagcagcccctgagcactggagccttccctgctggcatcacagaccacagccacttcatgcccctgctgaaccccagccccacagatgccaccagctctgtggacacccaggccggcaactgcaagcccctgcagaaggacaagctgcctgagaacctgctgagtgacctgagcctgcagagcctgacagccctgaccagccaggtggagaacatcagcaacacagtgcagcagctgctgctgagcaaggctgctgtgccccagaagaagggcgtgaagaacctggtgtccaggaccccagagcagcacaagagccagcactgcagccctgagggcagcggctacagcgctgagcctgctggcacccccctgtctgagccccccagcagcaccccccagagcacccacgccgagccccaggaggccgactacctgagcggcagcgaggaccccctggagaggagcttcctgtactgcaaccaggcccggggcagccctgcccgggtgaacagcaacagcaaggccaagccagagagcgtgtccacctgcagcgtgaccagcccagatgacatgagcaccaagagtgatgacagcttccagagcctgcacggcagcctgcccctggacagcttcagcaagtttgtggccggggagcgggactgcccccggctgctgctgagcgccctggcccaggaggacctggccagcgagatcctgggcctgcaggaggccatcggggagaaggctgacaaggcctgggccgaggcccccagcctggtgaaggacagcagcaagccacccttcagcctggagaaccacagcgcctgcctggacagcgtggccaagagcgcctggcccaggcctggagagcctgaggccctgcctgacagcctgcagctggacaagggcggcaatgccaaggacttcagccctggcctgtttgaggaccccagcgtggcctttgccaccccagaccccaagaagaccaccggccccctgagctttggcaccaagcccaccctgggcgtgcctgccccagaccccaccacagctgcctttgactgcttcccagacaccacagctgccagcagcgctgacagcgccaacccctttgcctggccagaggagaacctgggagatgcctgcccccgctggggcctgcaccctggagagctgaccaagggcctggagcagggcggcaaggccagtgatggcatcagcaaaggagacacccatgaggccagcgcctgcctgggcttccaggaggaggaccccccaggagagaaggtggccagcctgcccggggacttcaagcaggaggaggtgggcggcgtgaaggaggaggccggcggcctgctgcagtgcccagaggtggccaaggctgaccgctggctggaggacagccgccactgctgcagcacagctgactttggagacctgcccctgctgccccccaccagcaggaaagaagacctggaggccgaggaggagtacagcagcctgtgtgagctgctgggcagccctgagcagaggcctggcatgcaggaccccctgagccccaaggcccccctcatctgcaccaaggaggaggtggaggaggtgctggacagcaaggccggctggggcagcccctgccacctgtctggagagagcgtcatcctgctgggccccaccgtgggcacagagagcaaggtgcagagctggtttgagagcagcctgagccacatgaagccaggagaggagggcccagatggagagcgggcccctggggacagcaccaccagtgatgccagcctggcccagaagcccaacaagccagctgtgcctgaggcccccatcgccaagaaggagcctgtgccccggggcaagagcctgcggagcagaagagtgcaccggggcctgcctgaggccgaggacagcccctgccgggcccctgtgctgcccaaggacctgctgctgcctgagagctgcaccggccccccccagggccagatggagggcgctggggcccctggccgcggggccagcgagggcctgcccaggatgtgcaccaggagcctgacagccctgtctgagcccaggaccccaggccccccaggcctgaccaccaccccagcccccccagacaagctgggcggcaagcagagagctgccttcaagagcggcaagagggtgggcaagcccagccccaaggccgccagcagccccagcaacccagctgccctgcctgtggccagtgacagcagccccatgggcagcaagaccaaggagacagacagccccagcaccccaggcaaggaccagaggtccatgatcctgcggagcaggaccaagacccaggagatcttccacagcaagagaagaagacccagcgagggccgcctgcccaactgccgggccaccaagaagctgctggacaacagccacctgcctgccaccttcaaggtgagcagcagcccccagaaggagggccgggtgtcccagagggcccgggtgcccaagccaggggccggcagcaagctgagtgaccggcccctgcacgccctgaagaggaagagcgccttcatggcccctgtgcccaccaagaagaggaacctggtgctgcggagccgcagcagcagcagcagcaatgccagcggaaatggaggagatggcaaggaggagaggcctgagggcagccccaccctcttcaagaggatgagcagccccaagaaggccaagcccaccaagggaaatggagagcccgccaccaagctgcccccacctgagaccccagatgcctgcctgaagctggccagccgggccgccttccagggcgccatgaagaccaaggtgctgccccccaggaagggccggggcctgaagctggaggccatcgtgcagaagatcaccagccccagcctgaagaagtttgcctgcaaggcccctggggccagccctggcaaccccctgagccccagcctgagtgacaaggaccggggcctgaagggagctgggggcagccctgtgggcgtggaggagggcctggtgaatgtgggcaccggccagaagctgcccaccagcggggctgaccccctgtgcaggaaccccaccaacagaagcctgaagggcaagctgatgaacagcaagaagctgagcagcacagactgcttcaagacagaggccttcaccagccctgaggccctgcagcccggcggcacagccctggcccccaagaagaggagcaggaagggccgggccggggcccacggcctgagcaagggccccctggagaagaggccctacctgggccctgccctgctgctgaccccccgggaccgggccagcggcacccagggcgccagcgaggacaacagcggcggcggcggcaagaagcccaagatggaggagctgggcctggccagccagcccccagagggccggccctgccagccccagacccgggcccagaagcagcccggccacaccaactacagcagctacagcaagaggaagaggctgacccggggccgggccaagaacaccaccagcagcccctgcaagggccgggccaagagaagacggcagcagcaggtgctgcccctggaccctgctgagcctgagatccggctgaagtacatcagcagctgcaagaggctgcggagtgacagcaggaccccagccttcagcccctttgagcccagcctgggcgcccagaaccccaggagcggccagaatgcccccccagccccagcagatgcccggcccctgtgcaccacccgggacagaagagcctacagcgcccgggagcagggccagaggtag

SEQ ID NO: 167683 - DNA, 5589 bp, Artificial Sequence
  Description of Artificial Sequence: Synthetic coding sequence
atgcagagcttccgggagcgctgtggcttccacggcaagcagcagaactaccagcagaccagccaggagaccagccggctggagaactaccggcagcccagccaggccggcctgagctgtgaccggcagaggctgctggccaaggactactacaacccccagccctaccccagctatgaaggaggagctggcaccccatctggaacagctgctgctgtggccgctgacaagtaccaccggggcagcaaggccctgcccacccagcagggcctgcagggccgcccagccttccctggctacggcgtgcaggacagcagcccctacccaggccgctatgctggggaggagagcctgcaggcctggggcgccccccagcccccaccaccccagccccagcccctgcctgctggggtggccaagtatgatgagaacctgatgaagaagacagctgtgccccccagccggcagtatgcagagcagggcgcccaggtgcccttccgcacccacagcctgcacgtgcagcagcccccaccaccccagcagcccctggcctaccccaagctgcagaggcagaagctgcagaatgacatcgccagccccctgcccttcccccagggctggtgggccggccacagctacaagagctgcacagcccccacagcccagccccatgaccggcccctgacagccagcagcagcctggcccctggccagagggtgcagaacctgcacgcctaccagagcggccgcctgtcctatgaccagcagcagcagcagcagcagcagcagcagcagcagcagcaggccctgcagagccgccaccacgcccaggagaccctgcactaccagaacctggccaagtaccagcactacggccagcagggccagggctactgccagccagatgctgctgtgaggaccccagagcagtactaccagaccttcagccccagcagcagccacagccctgcccggtctgtgggccgcagccccagctacagcagcacccccagccccctgatgcccaacctggagaacttcccctacagccagcagcccctgagcactggagccttccctgctggcatcacagaccacagccacttcatgcccctgctgaaccccagccccacagatgccaccagctctgtggacagcctgacagccctgaccagccaggtggagaacatcagcaacacagtgcagcagctgctgctgagcaaggctgctgtgccccagaagaagggcgtgaagaacctggtgtccaggaccccagagcagcacaagagccagcactgcagccctgagggcagcggctacagcgctgagcctgctggcacccccctgtctgagccccccagcagcaccccccagagcacccacgccgagccccaggaggccgactacctgagcggcagcgaggaccccctggagaggagcttcctgtactgcaaccaggcccggggcagccctgcccgggtgaacagcaacagcaaggccaagccagagagcgtgtccacctgcagcgtgaccagcccagatgacatgagcaccaagagtgatgacagcttccagagcctgcacggcagcctgcccctggacagcttcagcaagtttgtggccggggagcgggactgcccccggctgctgctgagcgccctggcccaggaggacctggccagcgagatcctgggcctgcaggaggccatcggggagaaggctgacaaggcctgggccgaggcccccagcctggtgaaggacagcagcaagccacccttcagcctggagaaccacagcgcctgcctggacagcgtggccaagagcgcctggcccaggcctggagagcctgaggccctgcctgacagcctgcagctggacaagggcggcaatgccaaggacttcagccctggcctgtttgaggaccccagcgtggcctttgccaccccagaccccaagaagaccaccggccccctgagctttggcaccaagcccaccctgggcgtgcctgccccagaccccaccacagctgcctttgactgcttcccagacaccacagctgccagcagcgctgacagcgccaacccctttgcctggccagaggagaacctgggagatgcctgcccccgctggggcctgcaccctggagagctgaccaagggcctggagcagggcggcaaggccagtgatggcatcagcaaaggagacacccatgaggccagcgcctgcctgggcttccaggaggaggaccccccaggagagaaggtggccagcctgcccggggacttcaagcaggaggaggtgggcggcgtgaaggaggaggccggcggcctgctgcagtgcccagaggtggccaaggctgaccgctggctggaggacagccgccactgctgcagcacagctgactttggagacctgcccctgctgccccccaccagcaggaaagaagacctggaggccgaggaggagtacagcagcctgtgtgagctgctgggcagccctgagcagaggcctggcatgcaggaccccctgagccccaaggcccccctcatctgcaccaaggaggaggtggaggaggtgctggacagcaaggccggctggggcagcccctgccacctgtctggagagagcgtcatcctgctgggccccaccgtgggcacagagagcaaggtgcagagctggtttgagagcagcctgagccacatgaagccaggagaggagggcccagatggagagcgggcccctggggacagcaccaccagtgatgccagcctggcccagaagcccaacaagccagctgtgcctgaggcccccatcgccaagaaggagcctgtgccccggggcaagagcctgcggagcagaagagtgcaccggggcctgcctgaggccgaggacagcccctgccgggcccctgtgctgcccaaggacctgctgctgcctgagagctgcaccggccccccccagggccagatggagggcgctggggcccctggccgcggggccagcgagggcctgcccaggatgtgcaccaggagcctgacagccctgtctgagcccaggaccccaggccccccaggcctgaccaccaccccagcccccccagacaagctgggcggcaagcagagagctgccttcaagagcggcaagagggtgggcaagcccagccccaaggccgccagcagccccagcaacccagctgccctgcctgtggccagtgacagcagccccatgggcagcaagaccaaggagacagacagccccagcaccccaggcaaggaccagaggtccatgatcctgcggagcaggaccaagacccaggagatcttccacagcaagagaagaagacccagcgagggccgcctgcccaactgccgggccaccaagaagctgctggacaacagccacctgcctgccaccttcaaggtgagcagcagcccccagaaggagggccgggtgtcccagagggcccgggtgcccaagccaggggccggcagcaagctgagtgaccggcccctgcacgccctgaagaggaagagcgccttcatggcccctgtgcccaccaagaagaggaacctggtgctgcggagccgcagcagcagcagcagcaatgccagcggaaatggaggagatggcaaggaggagaggcctgagggcagccccaccctcttcaagaggatgagcagccccaagaaggccaagcccaccaagggaaatggagagcccgccaccaagctgcccccacctgagaccccagatgcctgcctgaagctggccagccgggccgccttccagggcgccatgaagaccaaggtgctgccccccaggaagggccggggcctgaagctggaggccatcgtgcagaagatcaccagccccagcctgaagaagtttgcctgcaaggcccctggggccagccctggcaaccccctgagccccagcctgagtgacaaggaccggggcctgaagggagctgggggcagccctgtgggcgtggaggagggcctggtgaatgtgggcaccggccagaagctgcccaccagcggggctgaccccctgtgcaggaaccccaccaacagaagcctgaagggcaagctgatgaacaacagagccagcggcacccagggcgccagcgaggacaacagcggcggcggcggcaagaagcccaagatggaggagctgggcctggccagccagcccccagagggccggccctgccagccccagacccgggcccagaagcagcccggccacaccaactacagcagctacagcaagaggaagaggctgacccggggccgggccaagaacaccaccagcagcccctgcaagggccgggccaagagaagacggcagcagcaggtgctgcccctggaccctgctgagcctgagatccggctgaagtacatcagcagctgcaagaggctgcggagtgacagcaggaccccagccttcagcccctttgtgcgggtggagaagagagatgccttcaccaccatctgcaccgtggtgaacagccctggagatgcccccaagccccacaggaagcccagcagcagcgccagcagcagcagcagcagcagcagcttcagcctggatgctgctggggccagcctggccaccctgcccggcggcagcatcctgcagccccggcccagcctgcccctgagcagcaccatgcacctgggccctgtggtgtccaaggccctgagcaccagctgcctggtgtgctgcctgtgccagaacccagccaacttcaaggacctgggggacctgtgtggcccctactacccagagcactgcctgcccaagaagaagcccaagctgaaggagaaggtgcggcctgagggcacctgtgaggaggccagcctgcccctggagaggaccctgaagggcccagaatgtgccgccgccgccacagctgggaagccacccaggccagatggccctgctgaccctgccaagcagggccccctgcggaccagcgcccggggcctgagccggcggctgcagagctgctactgctgtgatggccgggaggatggaggagaggaggccgccccagctgacaagggccactgggtgcatgaggcctgtgctgtgtggacaggaggagtgtacctggtggccggcaagctgtttggcctgcaggaggccatgaaggtggccgtggacatgcatggaggcaccgtggccctggcccctggggacttcagcctgcccggcctgcgctttgccagcctcttccagggccccagctggtgtgactgccctgtgctggccaccagcacccccagctcctggagccgctgtgtgcctgctgccaagaagccaggcccccccctgggcgccgccaccaaggatgccagcacccccaccaccaccagggtgcctgccatgcaggtgcgggcccggcccggcaccggcggccactggagccccagcaagcagagccggggcaccctgcccggccacagcagccccaaccctggccccatcagcctcttctccttcccccccctgctgccccagcagttcttctaccccagcgtgtgcctggacctgtgctgggccatgcctggcacctggaagtag

SEQ ID NO: 167684 - DNA, 5721 bp, Artificial Sequence
  Description of Artificial Sequence: Synthetic coding sequence
atgcagagcttccgggagcgctgtggcttccacggcaagcagcagaactaccagcagaccagccaggagaccagccggctggagaactaccggcagcccagccaggccggcctgagctgtgaccggcagaggctgctggccaaggactactacaacccccagccctaccccagctatgaaggaggagctggcaccccatctggaacagctgctgctgtggccgctgacaagtaccaccggggcagcaaggccctgcccacccagcagggcctgcagggccgcccagccttccctggctacggcgtgcaggacagcagcccctacccaggccgctatgctggggaggagagcctgcaggcctggggcgccccccagcccccaccaccccagccccagcccctgcctgctggggtggccaagtatgatgagaacctgatgaagaagacagctgtgccccccagccggcagtatgcagagcagggcgcccaggtgcccttccgcacccacagcctgcacgtgcagcagcccccaccaccccagcagcccctggcctaccccaagctgcagaggcagaagctgcagaatgacatcgccagccccctgcccttcccccagggcacccacttcccccagcacagccagagcttccccaccagcagcacctacagcagctctgtgcagggcggcggccagggcgcccacagctacaagagctgcacagcccccacagcccagccccatgaccggcccctgacagccagcagcagcctggcccctggccagagggtgcagaacctgcacgcctaccagagcggccgcctgtcctatgaccagcagcagcagcagcagcagcagcagcagcagcagcagcaggccctgcagagccgccaccacgcccaggagaccctgcactaccagaacctggccaagtaccagcactacggccagcagggccagggctactgccagccagatgctgctgtgaggaccccagagcagtactaccagaccttcagccccagcagcagccacagccctgcccggtctgtgggccgcagccccagctacagcagcacccccagccccctgatgcccaacctggagaacttcccctacagccagcagcccctgagcactggagccttccctgctggcatcacagaccacagccacttcatgcccctgctgaaccccagccccacagatgccaccagctctgtggacacccaggccggcaactgcaagcccctgcagaaggacaagctgcctgagaacctgctgagtgacctgagcctgcagagcctgacagccctgaccagccaggtggagaacatcagcaacacagtgcagcagctgctgctgagcaaggctgctgtgccccagaagaagggcgtgaagaacctggtgtccaggaccccagagcagcacaagagccagcactgcagccctgagggcagcggctacagcgctgagcctgctggcacccccctgtctgagccccccagcagcaccccccagagcacccacgccgagccccaggaggccgactacctgagcggcagcgaggaccccctggagaggagcttcctgtactgcaaccaggcccggggcagccctgcccgggtgaacagcaacagcaaggccaagccagagagcgtgtccacctgcagcgtgaccagcccagatgacatgagcaccaagagtgatgacagcttccagagcctgcacggcagcctgcccctggacagcttcagcaagtttgtggccggggagcgggactgcccccggctgctgctgagcgccctggcccaggaggacctggccagcgagatcctgggcctgcaggaggccatcggggagaaggctgacaaggcctgggccgaggcccccagcctggtgaaggacagcagcaagccacccttcagcctggagaaccacagcgcctgcctggacagcgtggccaagagcgcctggcccaggcctggagagcctgaggccctgcctgacagcctgcagctggacaagggcggcaatgccaaggacttcagccctggcctgtttgaggaccccagcgtggcctttgccaccccagaccccaagaagaccaccggccccctgagctttggcaccaagcccaccctgggcgtgcctgccccagaccccaccacagctgcctttgactgcttcccagacaccacagctgccagcagcgctgacagcgccaacccctttgcctggccagaggagaacctgggagatgcctgcccccgctggggcctgcaccctggagagctgaccaagggcctggagcagggcggcaaggccagtgatggcatcagcaaaggagacacccatgaggccagcgcctgcctgggcttccaggaggaggaccccccaggagagaaggtggccagcctgcccggggacttcaagcaggaggaggtgggcggcgtgaaggaggaggccggcggcctgctgcagtgcccagaggtggccaaggctgaccgctggctggaggacagccgccactgctgcagcacagctgactttggagacctgcccctgctgccccccaccagcaggaaagaagacctggaggccgaggaggagtacagcagcctgtgtgagctgctgggcagccctgagcagaggcctggcatgcaggaccccctgagccccaaggcccccctcatctgcaccaaggaggaggtggaggaggtgctggacagcaaggccggctggggcagcccctgccacctgtctggagagagcgtcatcctgctgggccccaccgtgggcacagagagcaaggtgcagagctggtttgagagcagcctgagccacatgaagccaggagaggagggcccagatggagagcgggcccctggggacagcaccaccagtgatgccagcctggcccagaagcccaacaagccagctgtgcctgaggcccccatcgccaagaaggagcctgtgccccggggcaagagcctgcggagcagaagagtgcaccggggcctgcctgaggccgaggacagcccctgccgggcccctgtgctgcccaaggacctgctgctgcctgagagctgcaccggccccccccagggccagatggagggcgctggggcccctggccgcggggccagcgagggcctgcccaggatgtgcaccaggagcctgacagccctgtctgagcccaggaccccaggccccccaggcctgaccaccaccccagcccccccagacaagctgggcggcaagcagagagctgccttcaagagcggcaagagggtgggcaagcccagccccaaggccgccagcagccccagcaacccagctgccctgcctgtggccagtgacagcagccccatgggcagcaagaccaaggagacagacagccccagcaccccaggcaaggaccagaggtccatgatcctgcggagcaggaccaagacccaggagatcttccacagcaagagaagaagacccagcgagggccgcctgcccaactgccgggccaccaagaagctgctggacaacagccacctgcctgccaccttcaaggtgagcagcagcccccagaaggagggccgggtgtcccagagggcccgggtgcccaagccaggggccggcagcaagctgagtgaccggcccctgcacgccctgaagaggaagagcgccttcatggcccctgtgcccaccaagaagaggaacctggtgctgcggagccgcagcagcagcagcagcaatgccagcggaaatggaggagatggcaaggaggagaggcctgagggcagccccaccctcttcaagaggatgagcagccccaagaaggccaagcccaccaagggaaatggagagcccgccaccaagctgcccccacctgagaccccagatgcctgcctgaagctggccagccgggccgccttccagggcgccatgaagaccaaggtgctgccccccaggaagggccggggcctgaagctggaggccatcgtgcagaagatcaccagccccagcctgaagaagtttgcctgcaaggcccctggggccagccctggcaaccccctgagccccagcctgagtgacaaggaccggggcctgaagggagctgggggcagccctgtgggcgtggaggagggcctggtgaatgtgggcaccggccagaagctgcccaccagcggggctgaccccctgtgcaggaaccccaccaacagaagcctgaagggcaagctgatgaacagcaagaagctgagcagcacagactgcttcaagacagaggccttcaccagccctgaggccctgcagcccggcggcacagccctggcccccaagaagaggagcaggaagggccgggccggggcccacggcctgagcaagggccccctggagaagaggccctacctgggccctgccctgctgctgaccccccgggaccgggccagcggcacccagggcgccagcgaggacaacagcggcggcggcggcaagaagcccaagatggaggagctgggcctggccagccagcccccagagggccggccctgccagccccagacccgggcccagaagcagcccggccacaccaactacagcagctacagcaagaggaagaggctgacccggggccgggccaagaacaccaccagcagcccctgcaagggccgggccaagagaagacggcagcagcaggtgctgcccctggaccctgctgagcctgagatccggctgaagtacatcagcagctgcaagaggctgcggagtgacagcaggaccccagccttcagcccctttgtgcgggtggagaagagagatgccttcaccaccatctgcaccgtggtgaacagccctggagatgcccccaagccccacaggaagcccagcagcagcgccagcagcagcagcagcagcagcagcttcagcctggatgctgctggggccagcctggccaccctgcccggcggcagcatcctgcagccccggcccagcctgcccctgagcagcaccatgcacctgggccctgtggtgtccaaggccctgagcaccagctgcctggtgtgctgcctgtgccagaacccagccaacttcaaggacctgggggacctgtgtggcccctactacccagagcactgcctgcccaagaagaagcccaagctgaaggagaaggtgcggcctgagggcacctgtgaggaggccagcctgcccctggagaggaccctgaagggcccagaatgtgccgccgccgccacagctgggaagccacccaggccagatggccctgctgaccctgccaagcagggccccctgcggaccagcgcccggggcctgagccggcggctgcagagctgctactgctgtgatggccgggaggatggaggagaggaggccgccccagctgacaagggcaggaagcatgagtgcagcaaggaggccccagctgagcctggaggagaggcccaggagcactgggtgcatgaggcctgtgctgtgtggacaggaggagtgtacctggtggccggcaagctgtttggcctgcaggaggccatgaaggtggccgtggacatgatgtgcagcagctgccaggaggccggggccaccatcggctgctgccacaagggctgcctgcacacctaccactacccctgtgccagtgatgctggctgcatcttcatcgaggagaacttcagcctgaagtgccccaagcacaagaggctgccctag

SEQ ID NO: 167685 - DNA, 2901 bp, Artificial Sequence
  Description of Artificial Sequence: Synthetic coding sequence
atgcagagcttccgggagcgctgtggcttccacggcaagcagcagaactaccagcagaccagccaggagaccagccggctggagaactaccggcagcccagccaggccggcctgagctgtgaccggcagaggctgctggccaaggactactacaacccccagccctaccccagctatgaaggaggagctggcaccccatctggaacagctgctgctgtggccgctgacaagtaccaccggggcagcaaggccctgcccacccagcagggcctgcagggccgcccagccttccctggctacggcgtgcaggacagcagcccctacccaggccgctatgctggggaggagagcctgcaggcctggggcgccccccagcccccaccaccccagccccagcccctgcctgctggggtggccaagtatgatgagaacctgatgaagaagacagctgtgccccccagccggcagtatgcagagcagggcgcccaggtgcccttccgcacccacagcctgcacgtgcagcagcccccaccaccccagcagcccctggcctaccccaagctgcagaggcagaagctgcagaatgacatcgccagccccctgcccttcccccagggcacccacttcccccagcacagccagagcttccccaccagcagcacctacagcagctctgtgcagggcggcggccagggcgcccacagctacaagagctgcacagcccccacagcccagccccatgaccggcccctgacagccagcagcagcctggcccctggccagagggtgcagaacctgcacgcctaccagagcggccgcctgtcctatgaccagcagcagcagcagcagcagcagcagcagcagcagcagcaggccctgcagagccgccaccacgcccaggagaccctgcactaccagaacctggccaagtaccagcactacggccagcagggccagggctactgccagccagatgctgctgtgaggaccccagagcagtactaccagaccttcagccccagcagcagccacagccctgcccggtctgtgggccgcagccccagctacagcagcacccccagccccctgatgcccaacctggagaacttcccctacagccagcagcccctgagcactggagccttccctgctggcatcacagaccacagccacttcatgcccctgctgaaccccagccccacagatgccaccagctctgtggacacccaggccggcaactgcaagcccctgcagaaggacaagctgcctgagaacctgctgagtgacctgagcctgcagagcctgacagccctgaccagccaggtggagaacatcagcaacacagtgcagcagctgctgctgagcaaggctgctgtgccccagaagaagggcgtgaagaacctggtgtccaggaccccagagcagcacaagagccagcactgcagccctgagggcagcggctacagcgctgagcctgctggcacccccctgtctgagccccccagcagcaccccccagagcacccacgccgagccccaggaggccgactacctgagcggcagcgaggaccccctggagaggagcttcctgtactgcaaccaggcccggggcagccctgcccgggtgaacagcaacagcaaggccaagccagagagcgtgtccacctgcagcgtgaccagcccagatgacatgagcaccaagagtgatgacagcttccagagcctgcacggcagcctgcccctggacagcttcagcaagtttgtggccggggagcgggactgcccccggctgctgctgagcgccctggcccaggaggacctggccagcgagatcctgggcctgcaggaggccatcggggagaaggctgacaaggcctgggccgaggcccccagcctggtgaaggacagcagcaagccacccttcagcctggagaaccacagcgcctgcctggacagcgtggccaagagcgcctggcccaggcctggagagcctgaggccctgcctgacagcctgcagctggacaagggcggcaatgccaaggacttcagccctggcctgtttgaggaccccagcgtggcctttgccaccccagaccccaagaagaccaccggccccctgagctttggcaccaagcccaccctgggcgtgcctgccccagaccccaccacagctgcctttgactgcttcccagacaccacagctgccagcagcgctgacagcgccaacccctttgcctggccagaggagaacctgggagatgcctgcccccgctggggcctgcaccctggagagctgaccaagggcctggagcagggcggcaaggccagtgatggcatcagcaaaggagacacccatgaggccagcgcctgcctgggcttccaggaggaggaccccccaggagagaaggtggccagcctgcccggggacttcaagcaggaggaggtgggcggcgtgaaggaggaggccggcggcctgctgcagtgcccagaggtggccaaggctgaccgctggctggaggacagccgccactgctgcagcacagctgactttggagacctgcccctgctgccccccaccagcaggaaagaagacctggaggccgaggaggagtacagcagcctgtgtgagctgctgggcagccctgagcagaggcctggcatgcaggaccccctgagccccaaggcccccctcatctgcaccaaggaggaggtggaggaggtgctggacagcaaggccggctggggcagcccctgccacctgtctggagagagcgtcatcctgctgggccccaccgtgggcacagagagcaaggtgcagagctggtttgaggccagcctgtacagcgtgtacatctgcatccacatccacatctacaacatctatgaggactgcaagtgctag

SEQ ID NO: 167686 - DNA, 2829 bp, Artificial Sequence
  Description of Artificial Sequence: Synthetic coding sequence
atgcagagcttccgggagcgctgtggcttccacggcaagcagcagaactaccagcagaccagccaggagaccagccggctggagaactaccggcagcccagccaggccggcctgagctgtgaccggcagaggctgctggccaaggactactacaacccccagccctaccccagctatgaaggaggagctggcaccccatctggaacagctgctgctgtggccgctgacaagtaccaccggggcagcaaggccctgcccacccagcagggcctgcagggccgcccagccttccctggctacggcgtgcaggacagcagcccctacccaggccgctatgctggggaggagagcctgcaggcctggggcgccccccagcccccaccaccccagccccagcccctgcctgctggggtggccaagtatgatgagaacctgatgaagaagacagctgtgccccccagccggcagtatgcagagcagggcgcccaggtgcccttccgcacccacagcctgcacgtgcagcagcccccaccaccccagcagcccctggcctaccccaagctgcagaggcagaagctgcagaatgacatcgccagccccctgcccttcccccagggcacccacttcccccagcacagccagagcttccccaccagcagcacctacagcagctctgtgcagggcggcggccagggcgcccacagctacaagagctgcacagcccccacagcccagccccatgaccggcccctgacagccagcagcagcctggcccctggccagagggtgcagaacctgcacgcctaccagagcggccgcctgtcctatgaccagcagcagcagcagcagcagcagcagcagcagcagcagcaggccctgcagagccgccaccacgcccaggagaccctgcactaccagaacctggccaagtaccagcactacggccagcagggccagggctactgccagccagatgctgctgtgaggaccccagagcagtactaccagaccttcagccccagcagcagccacagccctgcccggtctgtgggccgcagccccagctacagcagcacccccagccccctgatgcccaacctggagaacttcccctacagccagcagcccctgagcactggagccttccctgctggcatcacagaccacagccacttcatgcccctgctgaaccccagccccacagatgccaccagctctgtggacacccaggccggcaactgcaagcccctgcagaaggacaagctgcctgagaacctgctgagtgacctgagcctgcagagcctgacagccctgaccagccaggtggagaacatcagcaacacagtgcagcagctgctgctgagcaaggctgctgtgccccagaagaagggcgtgaagaacctggtgtccaggaccccagagcagcacaagagccagcactgcagccctgagggcagcggctacagcgctgagcctgctggcacccccctgtctgagccccccagcagcaccccccagagcacccacgccgagccccaggaggccgactacctgagcggcagcgaggaccccctggagaggagcttcctgtactgcaaccaggcccggggcagccctgcccgggtgaacagcaacagcaaggccaagccagagagcgtgtccacctgcagcgtgaccagcccagatgacatgagcaccaagagtgatgacagcttccagagcctgcacggcagcctgcccctggacagcttcagcaagtttgtggccggggagcgggactgcccccggctgctgctgagcgccctggcccaggaggacctggccagcgagatcctgggcctgcaggaggccatcggggagaaggctgacaaggcctgggccgaggcccccagcctggtgaaggacagcagcaagccacccttcagcctggagaaccacagcgcctgcctggacagcgtggccaagagcgcctggcccaggcctggagagcctgaggccctgcctgacagcctgcagctggacaagggcggcaatgccaaggacttcagccctggcctgtttgaggaccccagcgtggcctttgccaccccagaccccaagaagaccaccggccccctgagctttggcaccaagcccaccctgggcgtgcctgccccagaccccaccacagctgcctttgactgcttcccagacaccacagctgccagcagcgctgacagcgccaacccctttgcctggccagaggagaacctgggagatgcctgcccccgctggggcctgcaccctggagagctgaccaagggcctggagcagggcggcaaggccagtgatggcatcagcaaaggagacacccatgaggccagcgcctgcctgggcttccaggaggaggaccccccaggagagaaggtggccagcctgcccggggacttcaagcaggaggaggtgggcggcgtgaaggaggaggccggcggcctgctgcagtgcccagaggtggccaaggctgaccgctggctggaggacagccgccactgctgcagcacagctgactttggagacctgcccctgctgccccccaccagcaggaaagaagacctggaggccgaggaggagtacagcagcctgtgtgagctgctgggcagccctgagcagaggcctggcatgcaggaccccctgagccccaaggcccccctcatctgcaccaaggaggaggtggaggaggtgctggacagcaaggccggctggggcagcccctgccacctgtctggagagagcgtcatcctgctgggccccaccgtgggcacagagagcaaggtgcagagctggttctag

SEQ ID NO: 167687 - DNA, 5982 bp, Artificial Sequence
  Description of Artificial Sequence: Synthetic coding sequence
atgcagagcttccgggagcgctgtggcttccacggcaagcagcagaactaccagcagaccagccaggagaccagccggctggagaactaccggcagcccagccaggccggcctgagctgtgaccggcagaggctgctggccaaggactactacaacccccagccctaccccagctatgaaggaggagctggcaccccatctggaacagctgctgctgtggccgctgacaagtaccaccggggcagcaaggccctgcccacccagcagggcctgcagggccgcccagccttccctggctacggcgtgcaggacagcagcccctacccaggccgctatgctggggaggagagcctgcaggcctggggcgccccccagcccccaccaccccagccccagcccctgcctgctggggtggccaagtatgatgagaacctgatgaagaagacagctgtgccccccagccggcagtatgcagagcagggcgcccaggtgcccttccgcacccacagcctgcacgtgcagcagcccccaccaccccagcagcccctggcctaccccaagctgcagaggcagaagctgcagaatgacatcgccagccccctgcccttcccccagggcacccacttcccccagcacagccagagcttccccaccagcagcacctacagcagctctgtgcagggcggcggccagggcgcccacagctacaagagctgcacagcccccacagcccagccccatgaccggcccctgacagccagcagcagcctggcccctggccagagggtgcagaacctgcacgcctaccagagcggccgcctgtcctatgaccagcagcagcagcagcagcagcagcagcagcagcagcagcaggccctgcagagccgccaccacgcccaggagaccctgcactaccagaacctggccaagtaccagcactacggccagcagggccagggctactgccagccagatgctgctgtgaggaccccagagcagtactaccagaccttcagccccagcagcagccacagccctgcccggtctgtgggccgcagccccagctacagcagcacccccagccccctgatgcccaacctggagaacttcccctacagccagcagcccctgagcactggagccttccctgctggcatcacagaccacagccacttcatgcccctgctgaaccccagccccacagatgccaccagctctgtggacacccaggccggcaactgcaagcccctgcagaaggacaagctgcctgagaacctgctgagtgacctgagcctgcagagcctgacagccctgaccagccaggtggagaacatcagcaacacagtgcagcagctgctgctgagcaaggctgctgtgccccagaagaagggcgtgaagaacctggtgtccaggaccccagagcagcacaagagccagcactgcagccctgagggcagcggctacagcgctgagcctgctggcacccccctgtctgagccccccagcagcaccccccagagcacccacgccgagccccaggaggccgactacctgagcggcagcgaggaccccctggagaggagcttcctgtactgcaaccaggcccggggcagccctgcccgggtgaacagcaacagcaaggccaagccagagagcgtgtccacctgcagcgtgaccagcccagatgacatgagcaccaagagtgatgacagcttccagagcctgcacggcagcctgcccctggacagcttcagcaagtttgtggccggggagcgggactgcccccggctgctgctgagcgccctggcccaggaggacctggccagcgagatcctgggcctgcaggaggccatcggggagaaggctgacaaggcctgggccgaggcccccagcctggtgaaggacagcagcaagccacccttcagcctggagaaccacagcgcctgcctggacagcgtggccaagagcgcctggcccaggcctggagagcctgaggccctgcctgacagcctgcagctggacaagggcggcaatgccaaggacttcagccctggcctgtttgaggaccccagcgtggcctttgccaccccagaccccaagaagaccaccggccccctgagctttggcaccaagcccaccctgggcgtgcctgccccagaccccaccacagctgcctttgactgcttcccagacaccacagctgccagcagcgctgacagcgccaacccctttgcctggccagaggagaacctgggagatgcctgcccccgctggggcctgcaccctggagagctgaccaagggcctggagcagggcggcaaggccagtgatggcatcagcaaaggagacacccatgaggccagcgcctgcctgggcttccaggaggaggaccccccaggagagaaggtggccagcctgcccggggacttcaagcaggaggaggtgggcggcgtgaaggaggaggccggcggcctgctgcagtgcccagaggtggccaaggctgaccgctggctggaggacagccgccactgctgcagcacagctgactttggagacctgcccctgctgccccccaccagcaggaaagaagacctggaggccgaggaggagtacagcagcctgtgtgagctgctgggcagccctgagcagaggcctggcatgcaggaccccctgagccccaaggcccccctcatctgcaccaaggaggaggtggaggaggtgctggacagcaaggccggctggggcagcccctgccacctgtctggagagagcgtcatcctgctgggccccaccgtgggcacagagagcaaggtgcagagctggtttgagagcagcctgagccacatgaagccaggagaggagggcccagatggagagcgggcccctggggacagcaccaccagtgatgccagcctggcccagaagcccaacaagccagctgtgcctgaggcccccatcgccaagaaggagcctgtgccccggggcaagagcctgcggagcagaagagtgcaccggggcctgcctgaggccgaggacagcccctgccgggcccctgtgctgcccaaggacctgctgctgcctgagagctgcaccggccccccccagggccagatggagggcgctggggcccctggccgcggggccagcgagggcctgcccaggatgtgcaccaggagcctgacagccctgtctgagcccaggaccccaggccccccaggcctgaccaccaccccagcccccccagacaagctgggcggcaagcagagagctgccttcaagagcggcaagagggtgggcaagcccagccccaaggccgccagcagccccagcaacccagctgccctgcctgtggccagtgacagcagccccatgggcagcaagaccaaggagacagacagccccagcaccccaggcaaggaccagaggtccatgatcctgcggagcaggaccaagacccaggagatcttccacagcaagagaagaagacccagcgagggccgcctgcccaactgccgggccaccaagaagctgctggacaacagccacctgcctgccaccttcaaggtgagcagcagcccccagaaggagggccgggtgtcccagagggcccgggtgcccaagccaggggccggcagcaagctgagtgaccggcccctgcacgccctgaagaggaagagcgccttcatggcccctgtgcccaccaagaagaggaacctggtgctgcggagccgcagcagcagcagcagcaatgccagcggaaatggaggagatggcaaggaggagaggcctgagggcagccccaccctcttcaagaggatgagcagccccaagaaggccaagcccaccaagggaaatggagagcccgccaccaagctgcccccacctgagaccccagatgcctgcctgaagctggccagccgggccgccttccagggcgccatgaagaccaaggtgctgccccccaggaagggccggggcctgaagctggaggccatcgtgcagaagatcaccagccccagcctgaagaagtttgcctgcaaggcccctggggccagccctggcaaccccctgagccccagcctgagtgacaaggaccggggcctgaagggagctgggggcagccctgtgggcgtggaggagggcctggtgaatgtgggcaccggccagaagctgcccaccagcggggctgaccccctgtgcaggaaccccaccaacagaagcctgaagggcaagctgatgaacagcaagaagctgagcagcacagactgcttcaagacagaggccttcaccagccctgaggccctgcagcccggcggcacagccctggcccccaagaagaggagcaggaagggccgggccggggcccacggcctgagcaagggccccctggagaagaggccctacctgggccctgccctgctgctgaccccccgggaccgggccagcggcacccagggcgccagcgaggacaacagcggcggcggcggcaagaagcccaagatggaggagctgggcctggccagccagcccccagagggccggccctgccagccccagacccgggcccagaagcagcccggccacaccaactacagcagctacagcaagaggaagaggctgacccggggccgggccaagaacaccaccagcagcccctgcaagggccgggccaagagaagacggcagcagcaggtgctgcccctggaccctgctgagcctgagatccggctgaagtacatcagcagctgcaagaggctgcggagtgacagcaggaccccagccttcagcccctttgtgcgggtggagaagagagatgccttcaccaccatctgcaccgtggtgaacagccctggagatgcccccaagccccacaggaagcccagcagcagcgccagcagcagcagcagcagcagcagcttcagcctggatgctgctggggccagcctggccaccctgcccggcggcagcatcctgcagccccggcccagcctgcccctgagcagcaccatgcacctgggccctgtggtgtccaaggccctgagcaccagctgcctggtgtgctgcctgtgccagaacccagccaacttcaaggacctgggggacctgtgtggcccctactacccagagcactgcctgcccaagaagaagcccaagctgaaggagaaggtgcggcctgagggcacctgtgaggaggccagcctgcccctggagaggaccctgaagggcccagaatgtgccgccgccgccacagctgggaagccacccaggccagatggccctgctgaccctgccaagcagggccccctgcggaccagcgcccggggcctgagccggcggctgcagagctgctactgctgtgatggccgggaggatggaggagaggaggccgccccagctgacaagggcaggaagcatgagtgcagcaaggaggccccagctgagcctggaggagaggcccaggagcactgggtgcatgaggcctgtgctgtgtggacaggaggagtgtacctggtggccggcaagctgtttggcctgcaggaggccatgaaggtggccgtggacatgcacggcggcaccgtggccctggcccctggggacttcagcctgcccggcctgcgctttgccagcctcttccagggccccagctggtgtgactgccctgtgctggccaccagcacccccagctcctggagccgctgtgtgcctgctgccaagaagccaggcccccccctgggcgccgccaccaaggatgccagcacccccaccaccaccagggtgcctgccatgcaggtgcgggcccggcccggcactggaggccactggagccccagcaagcagagccggggcaccctgcccggccacagcagccccaaccctggccccatcagcctcttctccttcccccccctgctgccccagcagttcttctaccccagcgtgtgcctggacctgtgctgggccatgcctggcacctggaagtag

SEQ ID NO: 167688 - DNA, 2943 bp, Artificial Sequence
  Description of Artificial Sequence: Synthetic coding sequence
atgaagagcctgaaggccaagttcaggaagagtgacaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagctgctgcagagcaaatgtcctgctgagagcgtggacagcagcggcaagacagccctgcactacgccgccgcccagggctgcctgcaggccgtgcagatcctgtgtgagcacaagagccccatcaacctgaaggacctggatggcaacatccccctgctgctggccgtgcagaatggccacagcgagatctgccacttcctgctggaccacggggctgatgtgaacagcaggaacaagagcggccgcacagccctgatgctggcctgtgaaattggcagcagcaatgctgtggaggccctgatcaagaagggagctgacctgaacctggtggacagcctgggctacaatgccctgcactacagcaagctgtctgaaaatgccggcatccagagcctgctgctgagcaagatcagccaggatgctgacctgaagacccccaccaagcccaagcagcacgaccaggtgtccaagatcagcagcgagaggagcggcacccccaagaagaggaaggcccctcctccacccatcagccccacccagctgagtgatgtgagcagccccaggagcatcaccagcacccccctgagcggcaaggagagcgtcttctttgctgagccccccttcaaggccgagatcagcagcatccgggagaacaaggaccggctgagtgacagcaccactggagctgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagctttgacagctaccacagcacccagacagacctgggccccagcctgggcaagccaggagagaccagccccccagacagcaagagcagccccagcgtgctgatccacagcctgggcaagagcaccacagacaatgatgtgcgcatccagcagctgcaggagatcctgcaggacctgcagaagaggctggagagcagcgaggccgagaggaagcagctgcaggtggagctgcagagccggcgggcagagctggtgtgcctgaacaacacagagatcagcgagaacagcagtgacctgagccagaagctgaaggagacccagagcaaatatgaggaggccatgaaggaggtgctgtctgtgcagaagcagatgaagctgggcctggtgtccccagagagcatggacaactacagccacttccacgagctgcgggtgacagaggaggagatcaacgtgctgaagcaggacctgcagaatgccctggaggagagcgagaggaacaaggagaaggtgcgggagctggaggagaagctggtggagcgggagaagggcaccgtcatcaagccccctgtggaggagtatgaggagatgaagagcagctactgcagcgtgattgagaacatgaacaaggagaaggccttcctgtttgagaagtaccaggaggcccaggaggagatcatgaagctgaaggacaccctgaagagccagatgacccaggaggccagtgatgaagctgaggacatgaaggaggccatgaacaggatgattgatgagctgaacaagcaggtgtctgagctgagccagctgtacaaggaggcccaggccgagctggaggactacaggaagaggaagagcctggaggatgtgacagctgagtacatccacaaggccgagcacgagaagctgatgcagctgaccaacgtgtcccgggccaaggccgaggatgccctgtctgagatgaagagccagtacagcaaggtgctgaatgagctgacccagctgaagcagctggtggatgcccagaaggaaaattctgtgtccatcacagagcacctgcaggtgatcaccaccctgaggacagctgccaaggagatggaggagaagatcagcaacctgaaggagcacctggccagcaaggaggtggaggtggccaagctggagaagcagctgctggaggagaaggccgccatgacagatgccatggtgcccaggagcagctatgagaagctgcagagcagcctggagagcgaggtgtctgtgctggccagcaagctgaaggagagcgtgaaggagaaggagaaggtgcacagcgaggtggtgcagatccgctctgaggtgtcccaggtgaagcgggagaaggagaacatccagaccctgctgaagagcaaggagcaggaggtgaatgagctgctgcagaagttccagcaggcccaggaggagctggccgagatgaagagatatgcagagagcagcagcaagctggaggaggacaaggacaagaagatcaatgagatgagcaaggaggtgaccaagctgaaggaggccctgaacagcctgagccagctgagctacagcaccagcagcagcaagaggcagagccagcagctggaggccctgcagcagcaggtgaagcagctgcagaaccagctggccgagtgcaagaagcagcaccaggaggtgatctctgtgtacaggatgcacctgctgtatgctgtgcagggccagatggatgaagatgtgcagaaggtgctgaagcagatcctgaccatgtgcaagaaccagagccagaagaagtag

SEQ ID NO: 167689 - DNA, 2922 bp, Artificial Sequence
  Description of Artificial Sequence: Synthetic coding sequence
atggtgaagggcaagaccaatgagtggaacaagaatgatgaccggctgctgcaggccgtggagaatggagatgctgagaaggtggccagcctgctgggcaagaagggggccagcgccaccaagcatgacagcgagggcaagacagccttccacctggccgccgccaagggccacgtggagtgcctgcgggtgatgatcacccacggcgtggatgtgacagcccaggacaccaccggccacagcgccctgcacctggccgccaagaacagccaccacgagtgcatcaggaagctgctgcagagcaagtgcccagctgagagcgtggacagcagcggcaagacagccctgcactatgctgctgcccagggctgcctgcaggccgtgcagatcctgtgtgagcacaagagccccatcaacctgaaggacctggatggcaacatccccctgctgctggccgtgcagaatggccacagcgagatctgccacttcctgctggaccatggagcagatgtgaacagcaggaacaagagcggccgcacagccctgatgctggcctgtgagatcggcagcagcaatgctgtggaggccctgatcaagaagggagctgacctgaacctggtggacagcctgggctacaatgccctgcactacagcaagctgtctgaaaatgccggcatccagagcctgctgctgagcaagatcagccaggatgctgacctgaagacccccaccaagcccaagcagcacgaccaggtgtccaagatcagcagcgagaggagcggcacccccaagaagaggaaggcccctcctccacccatcagccccacccagctgagtgatgtgagcagccccaggagcatcaccagcacccccctgagcggcaaggagagcgtcttctttgctgagccccccttcaaggccgagatcagcagcatccgggagaacaaggaccggctgagtgacagcaccaccggggctgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagctttgacagctaccacagcacccagacagacctgggccccagcctgggcaagccaggagagaccagccccccagacagcaagagcagccccagcgtgctgatccacagcctgggcaagagcaccacagacaatgatgtgcgcatccagcagctgcaggagatcctgcaggacctgcagaagaggctggagagcagcgaggccgagaggaagcagctgcaggtggagctgcagagcagaagagctgagctggtgtgcctgaacaacacagagatcagcgagaacagcagtgacctgagccagaagctgaaggagacccagagcaaatatgaggaggccatgaaggaggtgctgtctgtgcagaagcagatgaagctgggcctggtgtccccagagagcatggacaactacagccacttccacgagctgcgggtgacagaggaggagatcaacgtgctgaagcaggacctgcagaatgccctggaggagagcgagaggaacaaggagaaggtgcgggagctggaggagaagctggtggagcgggagaagggcaccgtcatcaagccccctgtggaggagtatgaggagatgaagagcagctactgcagcgtgattgagaacatgaacaaggagaaggccttcctgtttgagaagtaccaggaggcccaggaggagatcatgaagctgaaggacaccctgaagagccagatgacccaggaggccagtgatgaagctgaggacatgaaggaggccatgaacaggatgattgatgagctgaacaagcaggtgtctgagctgagccagctgtacaaggaggcccaggccgagctggaggactacaggaagaggaagagcctggaggatgtgacagctgagtacatccacaaggccgagcacgagaagctgatgcagctgaccaacgtgtcccgggccaaggcagaagatgccctgtctgagatgaagagccagtacagcaaggtgctgaatgagctgacccagctgaagcagctggtggatgcccagaaggagaacagcgtgtccatcacagagcacctgcaggtgatcaccaccctgaggacagctgccaaggagatggaggagaagatcagcaacctgaaggagcacctggccagcaaggaggtggaggtggccaagctggagaagcagctgctggaggagaaggccgccatgacagatgccatggtgcccaggagcagctatgagaagctgcagagcagcctggagagcgaggtgtctgtgctggccagcaagctgaaggagagcgtgaaggagaaggagaaggtgcacagcgaggtggtgcagatccgctctgaggtgtcccaggtgaagcgggagaaggagaacatccagaccctgctgaagagcaaggagcaggaggtgaatgagctgctgcagaagttccagcaggcccaggaggagctggccgagatgaagagatatgcagagagcagcagcaagctggaggaggacaaggacaagaagatcaatgagatgagcaaggaggtgaccaagctgaaggaggccctgaacagcctgagccagctgagctacagcaccagcagcagcaagaggcagagccagcagctggaggccctgcagcagcaggtgaagcagctgcagaaccagctggccgagtgcaagaagcagcaccaggaggtgatctctgtgtacaggatgcacctgctgtatgctgtgcagggccagatggatgaagatgtgcagaaggtgctgaagcagatcctgaccatgtgcaagaaccagagccagaagaagtag

SEQ ID NO: 167690 - DNA, 2943 bp, Artificial Sequence; identical to SEQ ID NO: 167688
  Description of Artificial Sequence: Synthetic coding sequence

SEQ ID NO: 167691 - DNA, 2943 bp, Artificial Sequence; identical to SEQ ID NO: 167688
  Description of Artificial Sequence: Synthetic coding sequence

SEQ ID NO: 167692 - DNA, 345 bp, Artificial Sequence
  Description of Artificial Sequence: Synthetic coding sequence
atgaagagcctgaaggccaagttcaggaagagtgacaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagctgctgcagagcaaatgtcctgctgagagctag

SEQ ID NO: 167693 - DNA, 2919 bp, Artificial Sequence
  Description of Artificial Sequence: Synthetic coding sequence
atggaggccaagaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagctgctgcagagcaaatgtcctgctgagagcgtggacagcagcggcaagacagccctgcactacgccgccgcccagggctgcctgcaggccgtgcagatcctgtgtgagcacaagagccccatcaacctgaaggacctggatggcaacatccccctgctgctggccgtgcagaatggccacagcgagatctgccacttcctgctggaccacggggctgatgtgaacagcaggaacaagagcggccgcacagccctgatgctggcctgtgaaattggcagcagcaatgctgtggaggccctgatcaagaagggagctgacctgaacctggtggacagcctgggctacaatgccctgcactacagcaagctgtctgaaaatgccggcatccagagcctgctgctgagcaagatcagccaggatgctgacctgaagacccccaccaagcccaagcagcacgaccaggtgtccaagatcagcagcgagaggagcggcacccccaagaagaggaaggcccctcctccacccatcagccccacccagctgagtgatgtgagcagccccaggagcatcaccagcacccccctgagcggcaaggagagcgtcttctttgctgagccccccttcaaggccgagatcagcagcatccgggagaacaaggaccggctgagtgacagcaccactggagctgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagctttgacagctaccacagcacccagacagacctgggccccagcctgggcaagccaggagagaccagccccccagacagcaagagcagccccagcgtgctgatccacagcctgggcaagagcaccacagacaatgatgtgcgcatccagcagctgcaggagatcctgcaggacctgcagaagaggctggagagcagcgaggccgagaggaagcagctgcaggtggagctgcagagccggcgggcagagctggtgtgcctgaacaacacagagatcagcgagaacagcagtgacctgagccagaagctgaaggagacccagagcaaatatgaggaggccatgaaggaggtgctgtctgtgcagaagcagatgaagctgggcctggtgtccccagagagcatggacaactacagccacttccacgagctgcgggtgacagaggaggagatcaacgtgctgaagcaggacctgcagaatgccctggaggagagcgagaggaacaaggagaaggtgcgggagctggaggagaagctggtggagcgggagaagggcaccgtcatcaagccccctgtggaggagtatgaggagatgaagagcagctactgcagcgtgattgagaacatgaacaaggagaaggccttcctgtttgagaagtaccaggaggcccaggaggagatcatgaagctgaaggacaccctgaagagccagatgacccaggaggccagtgatgaagctgaggacatgaaggaggccatgaacaggatgattgatgagctgaacaagcaggtgtctgagctgagccagctgtacaaggaggcccaggccgagctggaggactacaggaagaggaagagcctggaggatgtgacagctgagtacatccacaaggccgagcacgagaagctgatgcagctgaccaacgtgtcccgggccaaggccgaggatgccctgtctgagatgaagagccagtacagcaaggtgctgaatgagctgacccagctgaagcagctggtggatgcccagaaggaaaattctgtgtccatcacagagcacctgcaggtgatcaccaccctgaggacagctgccaaggagatggaggagaagatcagcaacctgaaggagcacctggccagcaaggaggtggaggtggccaagctggagaagcagctgctggaggagaaggccgccatgacagatgccatggtgcccaggagcagctatgagaagctgcagagcagcctggagagcgaggtgtctgtgctggccagcaagctgaaggagagcgtgaaggagaaggagaaggtgcacagcgaggtggtgcagatccgctctgaggtgtcccaggtgaagcgggagaaggagaacatccagaccctgctgaagagcaaggagcaggaggtgaatgagctgctgcagaagttccagcaggcccaggaggagctggccgagatgaagagatatgcagagagcagcagcaagctggaggaggacaaggacaagaagatcaatgagatgagcaaggaggtgaccaagctgaaggaggccctgaacagcctgagccagctgagctacagcaccagcagcagcaagaggcagagccagcagctggaggccctgcagcagcaggtgaagcagctgcagaaccagctggccgagtgcaagaagcagcaccaggaggtgatctctgtgtacaggatgcacctgctgtatgctgtgcagggccagatggatgaagatgtgcagaaggtgctgaagcagatcctgaccatgtgcaagaaccagagccagaagaagtag

SEQ ID NO: 167694 - DNA, 378 bp, Artificial Sequence
  Description of Artificial Sequence: Synthetic coding sequence
atgaagagcctgaaggccaagttcaggaagagtgacaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagctgctgcagagcaaatgtcctgctgagagcgtggacagcagcggcaagacagccctgcactactag

SEQ ID NO: 167695 - DNA, 324 bp, Artificial Sequence
  Description of Artificial Sequence: Synthetic coding sequence
atgaagagcctgaaggccaagttcaggaagagtgacaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagctgctgcagtag

SEQ ID NO: 167696 - DNA, 453 bp, Artificial Sequence
  Description of Artificial Sequence: Synthetic coding sequence
atgaagagcctgaaggccaagttcaggaagagtgacaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagctgctgcagagcaaatgtcctgctgagagcgtggacagcagcggcaagacagccctgcactacgccgccgcccagggctgcctgcaggccgtgcagatcctgtgtgagcacaagagccccatcaacctgaaggacctgtag

SEQ ID NO: 167697 - DNA, 381 bp, Artificial Sequence
  Description of Artificial Sequence: Synthetic coding sequence
atgaagagcctgaaggccaagttcaggaagagtgacaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagctgctgcagagcaaatgtcctgctgagagcgtggacagcagcggcaagacagccctgcactacgcctag

SEQ ID NO: 167698 - DNA, 315 bp, Artificial Sequence
  Description of Artificial Sequence: Synthetic coding sequence
atgaagagcctgaaggccaagttcaggaagagtgacaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagtag

SEQ ID NO: 167699 - DNA, 420 bp, Artificial Sequence
  Description of Artificial Sequence: Synthetic coding sequence
atgaagagcctgaaggccaagttcaggaagagtgacaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagctgctgcagagcaaatgtcctgctgagagcgtggacagcagcggcaagacagccctgcactacgccgccgcccagggctgcctgcaggccgtgcagatcctgtgctag

SEQ ID NO: 167700 - DNA, 381 bp, Artificial Sequence; identical to SEQ ID NO: 167697
  Description of Artificial Sequence: Synthetic coding sequence

SEQ ID NO: 167701 - DNA, 2952 bp, Artificial Sequence
  Description of Artificial Sequence: Synthetic coding sequence
atgcagcccacctacctgccctggctgagcgccaaggagaagaagaccaatgagtggaacaagaatgatgaccggctgctgcaggccgtggagaatggagatgctgagaaggtggccagcctgctgggcaagaagggggccagcgccaccaagcatgacagcgagggcaagacagccttccacctggccgccgccaagggccacgtggagtgcctgcgggtgatgatcacccacggcgtggatgtgacagcccaggacaccaccggccacagcgccctgcacctggccgccaagaacagccaccacgagtgcatcaggaagctgctgcagagcaagtgcccagctgagagcgtggacagcagcggcaagacagccctgcactatgctgctgcccagggctgcctgcaggccgtgcagatcctgtgtgagcacaagagccccatcaacctgaaggacctggatggcaacatccccctgctgctggccgtgcagaatggccacagcgagatctgccacttcctgctggaccatggagcagatgtgaacagcaggaacaagagcggccgcacagccctgatgctggcctgtgagatcggcagcagcaatgctgtggaggccctgatcaagaagggagctgacctgaacctggtggacagcctgggctacaatgccctgcactacagcaagctgtctgaaaatgccggcatccagagcctgctgctgagcaagatcagccaggatgctgacctgaagacccccaccaagcccaagcagcacgaccaggtgtccaagatcagcagcgagaggagcggcacccccaagaagaggaaggcccctcctccacccatcagccccacccagctgagtgatgtgagcagccccaggagcatcaccagcacccccctgagcggcaaggagagcgtcttctttgctgagccccccttcaaggccgagatcagcagcatccgggagaacaaggaccggctgagtgacagcaccaccggggctgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagctttgacagctaccacagcacccagacagacctgggccccagcctgggcaagccaggagagaccagccccccagacagcaagagcagccccagcgtgctgatccacagcctgggcaagagcaccacagacaatgatgtgcgcatccagcagctgcaggagatcctgcaggacctgcagaagaggctggagagcagcgaggccgagaggaagcagctgcaggtggagctgcagagcagaagagctgagctggtgtgcctgaacaacacagagatcagcgagaacagcagtgacctgagccagaagctgaaggagacccagagcaaatatgaggaggccatgaaggaggtgctgtctgtgcagaagcagatgaagctgggcctggtgtccccagagagcatggacaactacagccacttccacgagctgcgggtgacagaggaggagatcaacgtgctgaagcaggacctgcagaatgccctggaggagagcgagaggaacaaggagaaggtgcgggagctggaggagaagctggtggagcgggagaagggcaccgtcatcaagccccctgtggaggagtatgaggagatgaagagcagctactgcagcgtgattgagaacatgaacaaggagaaggccttcctgtttgagaagtaccaggaggcccaggaggagatcatgaagctgaaggacaccctgaagagccagatgacccaggaggccagtgatgaagctgaggacatgaaggaggccatgaacaggatgattgatgagctgaacaagcaggtgtctgagctgagccagctgtacaaggaggcccaggccgagctggaggactacaggaagaggaagagcctggaggatgtgacagctgagtacatccacaaggccgagcacgagaagctgatgcagctgaccaacgtgtcccgggccaaggcagaagatgccctgtctgagatgaagagccagtacagcaaggtgctgaatgagctgacccagctgaagcagctggtggatgcccagaaggagaacagcgtgtccatcacagagcacctgcaggtgatcaccaccctgaggacagctgccaaggagatggaggagaagatcagcaacctgaaggagcacctggccagcaaggaggtggaggtggccaagctggagaagcagctgctggaggagaaggccgccatgacagatgccatggtgcccaggagcagctatgagaagctgcagagcagcctggagagcgaggtgtctgtgctggccagcaagctgaaggagagcgtgaaggagaaggagaaggtgcacagcgaggtggtgcagatccgctctgaggtgtcccaggtgaagcgggagaaggagaacatccagaccctgctgaagagcaaggagcaggaggtgaatgagctgctgcagaagttccagcaggcccaggaggagctggccgagatgaagagatatgcagagagcagcagcaagctggaggaggacaaggacaagaagatcaatgagatgagcaaggaggtgaccaagctgaaggaggccctgaacagcctgagccagctgagctacagcaccagcagcagcaagaggcagagccagcagctggaggccctgcagcagcaggtgaagcagctgcagaaccagctggccgagtgcaagaagcagcaccaggaggtgatctctgtgtacaggatgcacctgctgtatgctgtgcagggccagatggatgaagatgtgcagaaggtgctgaagcagatcctgaccatgtgcaagaaccagagccagaagaagtag

SEQ ID NO: 167702 - DNA, 2856 bp, Artificial Sequence
  Description of Artificial Sequence: Synthetic coding sequence
atgaagagcctgaaggccaagttcaggaagagtgacaccaatgagtggaacaagaatgatgaccggctgctgcaggccgtggagaatggagatgctgagaaggtggccagcctgctgggcaagaagggggccagcgccaccaagcatgattctgagggcaagacagccttccacctggccgccgccaagggccacgtggagtgcctgcgggtgatgatcacccatggagtggatgtgacagcccaggacaccaccggccacagcgccctgcacctggccgccaagaacagccaccacgagtgcatcaggaagctgctgcagagcaaatgtcctgctgagagcgtggacagcagcggcaagacagccctgcactacgccgccgcccagggctgcctgcaggccgtgcagatcctgtgtgagcacaagagccccatcaacctgaaggacctggatggcaacatccccctgctgctggccgtgcagaatggccacagcgagatctgccacttcctgctggaccacggggctgatgtgaacagcaggaacaagagcggccgcacagccctgatgctggcctgtgaaattggcagcagcaatgctgtggaggccctgatcaagaagggagctgacctgaacctggtggacagcctgggctacaatgccctgcactacagcaagctgtctgaaaatgccggcatccagagcctgctgctgagcaagatcagccaggatgctgacctgaagacccccaccaagcccaagcagctgagtgatgtgagcagccccaggagcatcaccagcacccccctgagcggcaaggagagcgtcttctttgctgagccccccttcaaggccgagatcagcagcatccgggagaacaaggaccggctgagtgacagcaccaccggggctgacagcctgctggacatcagcagcgaggccgaccagcaggacctgctgagcctgctgcaggccaaggtggccagcctgaccctgcacaacaaggagctgcaggacaagctgcaggccaagagccccaaggaggccgaggccgacctgagctttgacagctaccacagcacccagacagacctgggccccagcctgggcaagccaggagagaccagccccccagacagcaagagcagccccagcgtgctgatccacagcctgggcaagagcaccacagacaatgatgtgcgcatccagcagctgcaggagatcctgcaggacctgcagaagaggctggagagcagcgaggccgagaggaagcagctgcaggtggagctgcagagcagaagagctgagctggtgtgcctgaacaacacagagatcagcgagaacagcagtgacctgagccagaagctgaaggagacccagagcaaatatgaggaggccatgaaggaggtgctgtctgtgcagaagcagatgaagctgggcctggtgtccccagagagcatggacaactacagccacttccacgagctgcgggtgacagaggaggagatcaacgtgctgaagcaggacctgcagaatgccctggaggagagcgagaggaacaaggagaaggtgcgggagctggaggagaagctggtggagcgggagaagggcaccgtcatcaagccccctgtggaggagtatgaggagatgaagagcagctactgcagcgtgattgagaacatgaacaaggagaaggccttcctgtttgagaagtaccaggaggcccaggaggagatcatgaagctgaaggacaccctgaagagccagatgacccaggaggccagtgatgaagctgaggacatgaaggaggccatgaacaggatgattgatgagctgaacaagcaggtgtctgagctgagccagctgtacaaggaggcccaggccgagctggaggactacaggaagaggaagagcctggaggatgtgacagctgagtacatccacaaggccgagcacgagaagctgatgcagctgaccaacgtgtcccgggccaaggcagaagatgccctgtctgagatgaagagccagtacagcaaggtgctgaatgagctgacccagctgaagcagctggtggatgcccagaaggagaacagcgtgtccatcacagagcacctgcaggtgatcaccaccctgaggacagctgccaaggagatggaggagaagatcagcaacctgaaggagcacctggccagcaaggaggtggaggtggccaagctggagaagcagctgctggaggagaaggccgccatgacagatgccatggtgcccaggagcagctatgagaagctgcagagcagcctggagagcgaggtgtctgtgctggccagcaagctgaaggagagcgtgaaggagaaggagaaggtgcacagcgaggtggtgcagatccgctctgaggtgtcccaggtgaagcgggagaaggagaacatccagaccctgctgaagagcaaggagcaggaggtgaatgagctgctgcagaagttccagcaggcccaggaggagctggccgagatgaagagatatgcagagagcagcagcaagctggaggaggacaaggacaagaagatcaatgagatgagcaaggaggtgaccaagctgaaggaggccctgaacagcctgagccagctgagctacagcaccagcagcagcaagaggcagagccagcagctggaggccctgcagcagcaggtgaagcagctgcagaaccagctggccgagtgcaagaagcagcaccaggaggtgatctctgtgtacaggatgcacctgctgtatgctgtgcagggccagatggatgaagatgtgcagaaggtgctgaagcagatcctgaccatgtgcaagaaccagagccagaagaagtag

SEQ ID NO: 167703 - DNA, 1593 bp, Artificial Sequence
  Description of Artificial Sequence: Synthetic coding sequence
atggatgacctgcagagccagaacctgtccatggacatgacagacagccccccagccctggccaacaaccggctggagaatggcatggcccagctgatcaccacagaggcctggaacatcaacagcacagacctggtgaagaaggccctggtgacagtgcctgcccccagcatcctgaaccccccagctgagagccagagcggcatggccctgaaggtggccgccaccgtgctgcagcccctgtgcctgggggagagccctgtggtgatgcccatccacatgcaggtggagggcagcagcgcccctgagctgaaccccaatggaaatgccacctacgtgatgaccacccagggccctgtgcagctgcctgtggtgctggagcagcacgtgttccagcacctgaacagccccctggtgctgccccaggaggccccctgcagcagcagcaccatccacaacaacctcttccagggcgctgaggaccctgaggcccagccccagctgctggacctgcgcatccccagccagccccaggagcccaccctgccctttgaggccgtgctgcagaacctcttccccagccagggcaccctgggccccccaccctgccagcccccacctggctacgcccctgtgcccccccagcccttcagcagccccctgagccccctggtgcccccagccaccctgctggtgccctaccctgtgattgtgcccctgcctgtgcctgtgcccatccccatccccatccccatgccccagagcagcgagagcaagttcagcagcagcttccccaagccacccagcagctttggcctgcaccccttcaagggcacccagacccccctggagaaggatgagctgaagccctttgacatcctgcagcccaaggagtacttccagctgagccgccacacagtcatcaagatgggctctgaaaatgaggccctggacctgtccatgaagtctgtgccctggctgaaggccggggaggtgagcccccccatcttccaggaggatgctgccctggacctgtctgtggccgcccacaggaagtctgagcccccacctgagaccctgtatgattctggggcctctgtggacagcagcggccacacagtgatggagaagctgcccagcggcatggagatcagctttgccccagccaccagccatgaggccccagccatgatggacagccacatcagcagcagtgatgctgccacagagatgctgagccagcccaaccaccccagcggggaggtgaaggccgagaacaacatcgagatggtgggggagagccaggccgccaaggtgattgtgtctgtggaggatgctgtgcccaccatcttctgtgggaagatcaagggcctgtctggagtgtccaccaagaacttctccttcaagagagaagattctgtgctgcagggctatgacatcaacagccagggcgaggagagcatgggaaatgctgagcccctgaggaagcccatcaagaacagaagcatcaagctgaagaaggtgaacagccaggagatccacatgctgcccatcaagaagcagaggctggccaccttcttccccaggaagtag

SEQ ID NO: 167704 - DNA, 1593 bp, Artificial Sequence; identical to SEQ ID NO: 167703
  Description of Artificial Sequence: Synthetic coding sequence

SEQ ID NO: 167705 - DNA, 1443 bp, Artificial Sequence
  Description of Artificial Sequence: Synthetic coding sequence
atggatgacctgcagagccagaacctgtccatggacatgacagacagccccccagccctggccaacaaccggctggagaatggcatggcccagctgatcaccacagaggcctggaacatcaacagcacagacctggtggagggcagcagcgcccctgagctgaaccccaatggaaatgccacctacgtgatgaccacccagggccctgtgcagctgcctgtggtgctggagcagcacgtgttccagcacctgaacagccccctggtgctgccccaggaggccccctgcagcagcagcaccatccacaacaacctcttccagggcgctgaggaccctgaggcccagccccagctgctggacctgcgcatccccagccagccccaggagcccaccctgccctttgaggccgtgctgcagaacctcttccccagccagggcaccctgggccccccaccctgccagcccccacctggctacgcccctgtgcccccccagcccttcagcagccccctgagccccctggtgcccccagccaccctgctggtgccctaccctgtgattgtgcccctgcctgtgcctgtgcccatccccatccccatccccatgccccagagcagcgagagcaagttcagcagcagcttccccaagccacccagcagctttggcctgcaccccttcaagggcacccagacccccctggagaaggatgagctgaagccctttgacatcctgcagcccaaggagtacttccagctgagccgccacacagtcatcaagatgggctctgaaaatgaggccctggacctgtccatgaagtctgtgccctggctgaaggccggggaggtgagcccccccatcttccaggaggatgctgccctggacctgtctgtggccgcccacaggaagtctgagcccccacctgagaccctgtatgattctggggcctctgtggacagcagcggccacacagtgatggagaagctgcccagcggcatggagatcagctttgccccagccaccagccatgaggccccagccatgatggacagccacatcagcagcagtgatgctgccacagagatgctgagccagcccaaccaccccagcggggaggtgaaggccgagaacaacatcgagatggtgggggagagccaggccgccaaggtgattgtgtctgtggaggatgctgtgcccaccatcttctgtgggaagatcaagggcctgtctggagtgtccaccaagaacttctccttcaagagagaagattctgtgctgcagggctatgacatcaacagccagggcgaggagagcatgggaaatgctgagcccctgaggaagcccatcaagaacagaagcatcaagctgaagaaggtgaacagccaggagatccacatgctgcccatcaagaagcagaggctggccaccttcttccccaggaagtag

SEQ ID NO: 167706 - DNA, 1593 bp, Artificial Sequence; identical to SEQ ID NO: 167703
  Description of Artificial Sequence: Synthetic coding sequence

SEQ ID NO: 167707 - DNA, 1593 bp, Artificial Sequence; identical to SEQ ID NO: 167703
  Description of Artificial Sequence: Synthetic coding sequence

SEQ ID NO: 167708 - DNA, 885 bp, Artificial Sequence
  Description of Artificial Sequence: Synthetic coding sequence
atgcagccccggcggcagaggctgcctgccccctggagcggcccccggggcccccggcccacagcccccctgctggccctgctgctgctgctggcccctgtggccgccccagctggcagcggggaccctgatgaccccggccagccccaggatgctggggtgccccggcggctgctgcagcaggccgcccgggccgccctgcacttcttcaacttccgcagcggcagccccagcgccctgcgggtgctggccgaggtgcaggagggccgggcctggatcaaccccaaggagggctgcaaggtgcacgtggtgttcagcacagagcgctacaaccctgagagcctgctgcaggagggggagggccgcctgggcaaatgttctgcccgggtcttcttcaagaaccagaagccccggcccaccatcaacgtgacctgcacccggctgattgagaagaagaagaggcagcaggaggactacctgctgtacaagcagatgaagcagctgaagaaccccctggagatcgtgtccatcccagacaaccacggccacatcgaccccagcctgcggctcatctgggacctggccttcctgggcagcagctatgtgatgtgggagatgaccacccaggtgagccactactacctggcccagctgacctctgtgcggcagtggaagaccaatgatgacaccatcgactttgactacacagtgctgctgcacgagctgagcacccaggagatcatcccctgccgcatccacctggtgtggtacccaggcaagcccctgaaggtgaagtaccactgccaggagctgcagaccccagaggaggccagcggcacagaggagggcagcgctgtggtgcccacagagctgagcaacttctag

SEQ ID NO: 167709 - DNA, 687 bp, Artificial Sequence
  Description of Artificial Sequence: Synthetic coding sequence
atgcagccccggcggcagaggctgcctgccccctggagcggcccccggggcccccggcccacagcccccctgctggccctgctgctgctgctggcccctgtggccgccccagctggcagcggggaccctgatgaccccggccagccccaggatgctggggtgccccggcggctgctgcagcaggccgcccgggccgccctgcacttcttcaacttccgcagcggcagccccagcgccctgcgggtgctggccgaggtgcaggagggccgggcctggatcaaccccaaggagggctgcaaggtgcacgtggtgttcagcacagagcgctacaaccctgagagcctgctgcaggagggggagggccgcctgggcaaatgttctgcccgggtcttcttcaagaaccagaagccccggcccaccatcaacgtgacctgcacccggctgattgagaagaagaagaggcagcaggaggactacctgctgtacaagcagatgaagcagctgaagaaccccctggagatcgtgtccatcccagacaaccacggccacatcgaccccagcctgcggctcatctgggacctggccttcctgggcagcagctatgtgatgtgggagatgaccacccaggtgagccactactacctggcccagctgacctctgtgcggcagtgggtgaggaagacctag

SEQ ID NO: 167710 - DNA, 1008 bp, Artificial Sequence
  Description of Artificial Sequence: Synthetic coding sequence
atggtgagaagagaccggctgcggaggatgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccacagggtcatcgccctggacttcctgggcttcggcttcagtgacaagccccggccccaccactacagcatctttgagcaggccagcatcgtggaggccctgctgcggcacctgggcctgcagaacagacgcatcaacctgctgagccatgactatggagacatcgtggcccaggagctgctgtaccgctacaagcagaacagaagtggccgcctgaccatcaagagcctgtgcctgagcaatggaggcatcttccctgagacccaccggcccctgctgctgcagaagctgctgaaggatggcggcgtgctgagccccatcctgacccggctgatgaacttctttgtgttcagccggggcctgacccctgtgtttggcccctacacccggcccagcgagagcgagctgtgggacatgtgggccggcatccggaacaatgatggcaacctggtgattgacagcctgctgcagtacatcaaccagaggaagaagttcagaagacgctgggtgggcgccctggcctctgtgaccatccccatccacttcatctacggccccctggaccctgtgaacccctacccagagttcctggagctgtacaggaagaccctgcccaggagcacagtgtccatcctggatgaccacatcagccactacccccagctggaggaccccatgggcttcctgaatgcctacatgggcttcatcaacagcttctag

SEQ ID NO: 167711 - DNA, 492 bp, Artificial Sequence
  Description of Artificial Sequence: Synthetic coding sequence
atgaggcggctgctgatccccctggccctgtggctgggcgctgtgggcgtgggcgtggccgagctgacagaggcccagaggcggggcctgcaggtggccctggaggagttccacaagcacccccctgtgcagtgggccttccaggagacctctgtggagagcgctgtggacacccccttccctgctggcatctttgtgcggctggagttcaagctgcagcagaccagctgcaggaagagggactggaagaagccagagtgcaaggtgcggcccaacggcaggaagaggaagtgcctggcctgcatcaagctgggcagcgaggacaaggtgctgggccgcctggtgcactgccccatcgagacccaggtgctgcgggaggccgaggagcaccaggagacccagtgcctgcgggtgcagagagctggggaggacccccacagcttctacttccctggccagtttgccttcagcaaggccctgcccaggagctag

SEQ ID NO: 167712 - DNA, 492 bp, Artificial Sequence; identical to SEQ ID NO: 167711
  Description of Artificial Sequence: Synthetic coding sequence

SEQ ID NO: 167713 - DNA, 495 bp, Artificial Sequence
  Description of Artificial Sequence: Synthetic coding sequence
atggccagcccccaccaggagcccaagccaggggacctgattgagatcttccggctgggctatgagcactgggccctgtacatcggagatggctacgtgatccacctggccccacccagcgagtacccaggagctggcagcagctctgtgttttctgtgctgagcaacagcgctgaggtgaagcgggagcggctggaggatgtggtgggcggctgctgctacagagtgaacaacagcctggaccacgagtaccagcccaggcctgtggaggtgatcatcagcagcgccaaggagatggtgggccagaagatgaagtacagcatcgtgtccaggaactgtgagcactttgtgacccagctgcgctatggcaagagccgctgcaagcaggtggagaaggccaaggtggaggtgggcgtggccacagccctgggcatcctggtggtggccggctgcagctttgccatccgccgctaccagaagaaggccacagcctag

SEQ ID NO: 167714 - DNA, 495 bp, Artificial Sequence
  Description of Artificial Sequence: Synthetic coding sequence
atgggcctgcctgagcccaagcccaagccaggggacctgattgagatcttccggctgggctatgagcactgggccctgtacatcggagatggctacgtgatccacctggccccacccagcgagtacccaggagctggcagcagctctgtgttttctgtgctgagcaacagcgctgaggtgaagcgggagcggctggaggatgtggtgggcggctgctgctacagagtgaacaacagcctggaccacgagtaccagcccaggcctgtggaggtgatcatcagcagcgccaaggagatggtgggccagaagatgaagtacagcatcgtgtccaggaactgtgagcactttgtgacccagctgcgctatggcaagagccgctgcaagcaggtggagaaggccaaggtggaggtgggcgtggccacagccctgggcatcctggtggtggccggctgcagctttgccatccgccgctaccagaagaaggccacagcctag

SEQ ID NO: 167715 - DNA, 1389 bp, Artificial Sequence
  Description of Artificial Sequence: Synthetic coding sequence
atggccagcaacagcagcagctgccccaccccaggcggcggccacctgaatggctaccctgtgcccccctatgccttcttcttcccccccatgctgggcggcctgagccccccaggggccctgaccaccctgcagcaccagctgcctgtgtctggctacagcacccccagccctgccaccatcgagacccagagcagcagcagcgaggagatcgtgcccagcccccccagccccccacccctgccccgcatctacaagccctgctttgtgtgccaggacaagagcagcggctaccactacggcgtgtctgcctgtgagggctgcaagggcttcttcagaagaagcatccagaagaacatggtgtacacctgccaccgggacaagaactgcatcatcaacaaggtgaccaggaaccgctgccagtactgccgcctgcagaagtgctttgaggtgggcatgagcaaggagagcgtgagaaatgacaggaacaagaagaagaaggaggtgcccaagccagaatgttctgagagctacaccctgaccccagaggtgggggagctgattgagaaggtgaggaaggcccaccaggagaccttccctgccctgtgccagctgggcaagtacaccaccaacaacagcagcgagcagagggtgtccctggacatcgacctgtgggacaagttcagcgagctgagcaccaagtgcatcatcaagacagtggagtttgccaagcagctgcccggcttcaccaccctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgtttgcctttgccaaccagctgctgcccctggagatggatgatgctgagaccggcctgctgagcgccatctgcctgatctgtggggaccggcaggacctggagcagcctgacagagtggacatgctgcaggagcccctgctggaggccctgaaggtgtatgtgaggaagaggcggcccagccggccccacatgttccccaagatgctgatgaagatcacagacctgcggagcatcagcgccaagggagctgagagggtcatcaccctgaagatggagatccctggctccatgcctcctctcatccaggagatgctggagaacagcgagggcctggacaccctgagcggccagcccggcggcggcggcagagatggcggcggcctggcccctcctcctggcagctgcagccccagcctgagccccagcagcaacagaagcagccctgccacccacagcccctag

SEQ ID NO: 167716 - DNA, 1902 bp, Artificial Sequence
  Description of Artificial Sequence: Synthetic coding sequence
atgtatgagagcgtggaggtgggcggccccacccccaaccccttcctggtggtggacttctacaaccagaacagagcctgcctgctgcctgagaagggcctgcctgcccctggcccctacagcacccccctgcggacccccctgtggaatggcagcaaccacagcattgagacccagagcagcagcagcgaggagatcgtgcccagcccccccagccccccacccctgccccgcatctacaagccctgctttgtgtgccaggacaagagcagcggctaccactatggagtgtctgcctgtgagggctgcaagggcttcttccgccgcagcatccagaagaacatggtgtacacctgccaccgggacaagaactgcatcatcaacaaggtgaccaggaaccgctgccagtactgccgcctgcagaagtgctttgaggtgggcatgagcaaggagagcgtgagaaatgacaggaacaagaagaagaaggaggtgcccaagccagagtgcagcgagagctacaccctgaccccagaggtgggggagctgattgaatgtgccaagaggaccaggaagcccagcctgcccagcgcctcctgggccaacaccctgcggaccacagcccagaacaacgtgtccctgtggaccctgaccagcggcaccagctctgtgaacagccccaagtgcatcatcaagacagtggagtttgccaagcagctgcccggcttcaccaccctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgtttgcctttgccaaccagctgctgcccctggagatggatgatgctgagaccggcctgctgagcgccatctgcctgatctgtggggaccggcaggacctggagcagcctgacagagtggacatgctgcaggagcccctgctggaggccctgaaggtgtatgtgaggaagagaagacccagccggccccacatgttccccaagatgctgatgaagatcacagacctgcggagcatcagcgccaagggagctgagagggtcatcaccctgaagatggagatccctggctccatgccacccctcatccaggagatgctggagaacagcgagggcctggacaccctgagcggccagcccggcggcggcggcagagatggcggcggcctgccccggcaggccgctgtggccccagccagcgccccagcccccacagaagctgcccggccccccaccccccgggaccggcccaggcacatggacacagccctggccctgcggcccggcttcagcctgcccttctaccggccctgtgaccctgccccagccctgcccccaccagccctgcccggcagcactggagacctgccctggggcaccggccgggaggaggccgccaccccctggacagaggcctgggccctgagcggcctgcctgcccccacagcctgggcagatgtgcggggccggggccaggagctgtctgaggcccctggccctggcagccaggacggctcctggggcccccgggtgcaccaggacacccccctgcccagcagcccccacctgcaccaccagcagaccccaggcctgggcagccccatcctgcggacccacaagcccctgctgcccagctggggcaccagcaccagccccctgccccggctggtgacagagggcgtgggccagggccggggcgtgccccctgtgcacaccctgccctaccagccccaggtgctgatcctggccggctttgtgttcatcctgatcttcctgttctag

SEQ ID NO: 167717 - DNA, 1374 bp, Artificial Sequence
  Description of Artificial Sequence: Synthetic coding sequence
atgtatgagagcgtggaggtgggcggccccacccccaaccccttcctggtggtggacttctacaaccagaacagagcctgcctgctgcctgagaagggcctgcctgcccctggcccctacagcacccccctgcggacccccctgtggaatggcagcaaccacagcattgagacccagagcagcagcagcgaggagatcgtgcccagcccccccagccccccacccctgccccgcatctacaagccctgctttgtgtgccaggacaagagcagcggctaccactatggagtgtctgcctgtgagggctgcaagggcttcttccgccgcagcatccagaagaacatggtgtacacctgccaccgggacaagaactgcatcatcaacaaggtgaccaggaaccgctgccagtactgccgcctgcagaagtgctttgaggtgggcatgagcaaggagagcgtgagaaatgacaggaacaagaagaagaaggaggtgcccaagccagagtgcagcgagagctacaccctgaccccagaggtgggggagctgattgagaaggtgaggaaggcccaccaggagaccttccctgccctgtgccagctgggcaagtacaccaccaacaacagcagcgagcagagggtgtccctggacatcgacctgtgggacaagttcagcgagctgagcaccaagtgcatcatcaagacagtggagtttgccaagcagctgcccggcttcaccaccctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgtttgcctttgccaaccagctgctgcccctggagatggatgatgctgagaccggcctgctgagcgccatctgcctgatctgtggggaccggcaggacctggagcagcctgacagagtggacatgctgcaggagcccctgctggaggccctgaaggtgtatgtgaggaagagaagacccagccggccccacatgttccccaagatgctgatgaagatcacagacctgcggagcatcagcgccaagggagctgagagggtcatcaccctgaagatggagatccctggctccatgccacccctcatccaggagatgctggagaacagcgagggcctggacaccctgagcggccagcccggcggcggcggcagagatggcggcggcctggcccctcctcctggcagctgcagccccagcctgagccccagcagcaacagaagcagccctgccacccacagcccctag

SEQ ID NO: 167718 - DNA, 1437 bp, Artificial Sequence
  Description of Artificial Sequence: Synthetic coding sequence
atgatgagccagaccatgacccaggccggcgtgtccttccgccacagcgtgcgggccgcccagtgccacaccagggtgcccaacacctggccccgggccacccggccctatgccagctgcagaagaagcccccggctgcggggccgctggccaggcagcgctggccagggcgctgggggccgggcccccagggctggctggagggctggagatgtgactggaagtgccatcgagacccagagcagcagcagcgaggagatcgtgcccagcccccccagccccccacccctgccccgcatctacaagccctgctttgtgtgccaggacaagagcagcggctaccactacggcgtgtctgcctgtgagggctgcaagggcttcttcagaagaagcatccagaagaacatggtgtacacctgccaccgggacaagaactgcatcatcaacaaggtgaccaggaaccgctgccagtactgccgcctgcagaagtgctttgaggtgggcatgagcaaggagagcgtgagaaatgacaggaacaagaagaagaaggaggtgcccaagccagaatgttctgagagctacaccctgaccccagaggtgggggagctgattgagaaggtgaggaaggcccaccaggagaccttccctgccctgtgccagctgggcaagtacaccaccaacaacagcagcgagcagagggtgtccctggacatcgacctgtgggacaagttcagcgagctgagcaccaagtgcatcatcaagacagtggagtttgccaagcagctgcccggcttcaccaccctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgtttgcctttgccaaccagctgctgcccctggagatggatgatgctgagaccggcctgctgagcgccatctgcctgatctgtggggaccggcaggacctggagcagcctgacagagtggacatgctgcaggagcccctgctggaggccctgaaggtgtatgtgaggaagaggcggcccagccggccccacatgttccccaagatgctgatgaagatcacagacctgcggagcatcagcgccaagggagctgagagggtcatcaccctgaagatggagatccctggctccatgcctcctctcatccaggagatgctggagaacagcgagggcctggacaccctgagcggccagcccggcggcggcggcagagatggcggcggcctggcccctcctcctggcagctgcagccccagcctgagccccagcagcaacagaagcagccctgccacccacagcccctag

SEQ ID NO: 167719 - DNA, 1389 bp, Artificial Sequence; identical to SEQ ID NO: 167715
  Description of Artificial Sequence: Synthetic coding sequence

SEQ ID NO: 167720 - DNA, 1041 bp, Artificial Sequence
  Description of Artificial Sequence: Synthetic coding sequence
atgggccaggagatcctgcctgcccggagccccaccctgcggctgggcagccccaccccccacctgccccaggagctgctgcgggccagccccaagggccccccaggccgcctgcagctgggcggcctggccgtgagaaatgacaggaacaagaagaagaaggaggtgcccaagccagagtgcagcgagagctacaccctgaccccagaggtgggggagctgattgagaaggtgaggaaggcccaccaggagaccttccctgccctgtgccagctgggcaagtacaccaccaacaacagcagcgagcagagggtgtccctggacatcgacctgtgggacaagttcagcgagctgagcaccaagtgcatcatcaagacagtggagtttgccaagcagctgcccggcttcaccaccctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgtttgcctttgccaaccagctgctgcccctggagatggatgatgctgagaccggcctgctgagcgccatctgcctgatctgtggggaccggcaggacctggagcagcctgacagagtggacatgctgcaggagcccctgctggaggccctgaaggtgtatgtgaggaagagaagacccagccggccccacatgttccccaagatgctgatgaagatcacagacctgcggagcatcagcgccaagggagctgagagggtcatcaccctgaagatggagatccctggctccatgccacccctcatccaggagatgctggagaacagcgagggcctggacaccctgagcggccagcccggcggcggcggcagagatggcggcggcctggcccctcctcctggcagctgcagccccagcctgagccccagcagcaacagaagcagccctgccacctag

SEQ ID NO: 167721 - DNA, 1098 bp, Artificial Sequence
  Description of Artificial Sequence: Synthetic coding sequence
atggccagcaacagcagcagctgccccaccccaggcggcggccacctgaatggctaccctgtgcccccctatgccttcttcttcccccccatgctgggcggcctgagccccccaggggccctgaccaccctgcagcaccagctgcctgtgtctggctacagcacccccagccctgccaccgtgagaaatgacaggaacaagaagaagaaggaggtgcccaagccagagtgcagcgagagctacaccctgaccccagaggtgggggagctgattgagaaggtgaggaaggcccaccaggagaccttccctgccctgtgccagctgggcaagtacaccaccaacaacagcagcgagcagagggtgtccctggacatcgacctgtgggacaagttcagcgagctgagcaccaagtgcatcatcaagacagtggagtttgccaagcagctgcccggcttcaccaccctgaccatcgctgaccagatcaccctgctgaaggccgcctgcctggacatcctgatcctgcgcatctgcacccgctacaccccagagcaggacaccatgaccttcagtgatggcctgaccctgaacagaacccagatgcacaatgccggcttcggccccctgacagacctggtgtttgcctttgccaaccagctgctgcccctggagatggatgatgctgagaccggcctgctgagcgccatctgcctgatctgtggggaccggcaggacctggagcagcctgacagagtggacatgctgcaggagcccctgctggaggccctgaaggtgtatgtgaggaagagaagacccagccggccccacatgttccccaagatgctgatgaagatcacagacctgcggagcatcagcgccaagggagctgagagggtcatcaccctgaagatggagatccctggctccatgccacccctcatccaggagatgctggagaacagcgagggcctggacaccctgagcggccagcccggcggcggcggcagagatggcggcggcctggcccctcctcctggcagctgcagccccagcctgagccccagcagcaacagaagcagccctgccacccacagcccctag

SEQ ID NO: 167722 - DNA, 1149 bp, Artificial Sequence
  Description of Artificial Sequence: Synthetic coding sequence
atggtgcccagcagccccagccccccacctccaccccgggtgtacaagccctgctttgtgtgcaatgacaagagcagcggctaccactacggcgtgagcagctgtgagggctgcaagggcttcttcagaagaagcatccagaagaacatggtgtacacctgccaccgggacaagaactgcatcatcaacaaggtgaccaggaaccgctgccagtactgccgcctgcagaagtgctttgaggtgggcatgagcaaggaggccgtgagaaatgacaggaacaagaagaagaaggaggtgaaggaggagggcagcccagacagctatgagctgagcccccagctggaggagctgatcaccaaggtgtccaaggcccaccaggagaccttccccagcctgtgccagctgggcaagtacaccaccaacagcagcgctgaccaccgggtgcagctggacctgggcctgtgggacaagttcagcgagctggccaccaagtgcatcatcaagatcgtggagtttgccaagaggctgcccggcttcaccggcctgagcattgctgaccagatcaccctgctgaaggccgcctgcctggacatcctgatgctgcgcatctgcacccgctacaccccagagcaggacaccatgaccttcagtgatggcctgaccctgaacagaacccagatgcacaatgccggcttcggccccctgacagacctggtgtttgcctttgctggccagctgctgcccctggagatggatgacacagagaccggcctgctgagcgccatctgcctgatctgtggggacaggatggacctggaggagcctgagaaggtggacaagctgcaggagcccctgctggaggccctgcggctgtatgccaggagaagaagacccagccagccctacatgttccccaggatgctgatgaagatcacagacctgcggggcatcagcaccaagggagctgagcgggccatcaccctgaagatggagatccctggccccatgcctcctctcatccgggagatgctggagaaccctgagatgtttgaagatgacagcagccagcccggcccccaccccaatgccagcagtgaagatgaggtgcctgggggccagggcaaaggaggcctgaagagccctgcctag

SEQ ID NO: 167723 - DNA, 1332 bp, Artificial Sequence
  Description of Artificial Sequence: Synthetic coding sequence
atgtatgactgcatggagacctttgcccctggcccccggcggctgtatggagctgctggccctggagctggcctgctgcggcgggccaccggcggcagctgctttgctggcctggagagctttgcctggccccagcctgccagcctgcagagcgtggagacccagagcaccagcagcgaggagatggtgcccagcagccccagccccccacctccaccccgggtgtacaagccctgctttgtgtgcaatgacaagagcagcggctaccactatggagtgagcagctgtgagggctgcaagggcttcttccgccgcagcatccagaagaacatggtgtacacctgccaccgggacaagaactgcatcatcaacaaggtgaccaggaaccgctgccagtactgccgcctgcagaagtgctttgaggtgggcatgagcaaggaggccgtgagaaatgacaggaacaagaagaagaaggaggtgaaggaggagggcagcccagacagctatgagctgagcccccagctggaggagctgatcaccaaggtgtccaaggcccaccaggagaccttccccagcctgtgccagctgggcaagtacaccaccaacagcagcgctgaccaccgggtgcagctggacctgggcctgtgggacaagttcagcgagctggccaccaagtgcatcatcaagatcgtggagtttgccaagaggctgcccggcttcaccggcctgagcattgctgaccagatcaccctgctgaaggccgcctgcctggacatcctgatgctgcgcatctgcacccgctacaccccagagcaggacaccatgaccttcagtgatggcctgaccctgaacagaacccagatgcacaatgccggcttcggccccctgacagacctggtgtttgcctttgctggccagctgctgcccctggagatggatgacacagaaacaggcctgctgagcgccatctgcctgatctgtggggacaggatggacctggaggagcctgagaaggtggacaagctgcaggagcccctgctggaggccctgcggctgtatgccaggagaagaagacccagccagccctacatgttccccaggatgctgatgaagatcacagacctgcggggcatcagcaccaagggagctgagcgggccatcaccctgaagatggagatccctggccccatgccacccctcatccgggagatgctggagaaccctgagatgtttgaagatgacagcagccagcccggcccccaccccaatgccagcagtgaagatgaggtgcctgggggccagggcaagggcggcctgaagagccctgcctag

SEQ ID NO: 167724 - DNA, 1365 bp, Artificial Sequence
  Description of Artificial Sequence: Synthetic coding sequence
atggccaccaacaaggagcggctgtttgctgctggggccctgggccctggcagcggctacccaggagctggcttcccctttgccttccctggggccctgcggggcagccccccatttgagatgctgagccccagcttccggggcctgggccagcctgacctgcccaaggagatggccagcctgtctgtggagacccagagcaccagcagcgaggagatggtgcccagcagccccagccccccacctccaccccgggtgtacaagccctgctttgtgtgcaatgacaagagcagcggctaccactacggcgtgagcagctgtgagggctgcaagggcttcttcagaagaagcatccagaagaacatggtgtacacctgccaccgggacaagaactgcatcatcaacaaggtgaccaggaaccgctgccagtactgccgcctgcagaagtgctttgaggtgggcatgagcaaggaggccgtgagaaatgacaggaacaagaagaagaaggaggtgaaggaggagggcagcccagacagctatgagctgagcccccagctggaggagctgatcaccaaggtgtccaaggcccaccaggagaccttccccagcctgtgccagctgggcaagtacaccaccaacagcagcgctgaccaccgggtgcagctggacctgggcctgtgggacaagttcagcgagctggccaccaagtgcatcatcaagatcgtggagtttgccaagaggctgcccggcttcaccggcctgagcattgctgaccagatcaccctgctgaaggccgcctgcctggacatcctgatgctgcgcatctgcacccgctacaccccagagcaggacaccatgaccttcagtgatggcctgaccctgaacagaacccagatgcacaatgccggcttcggccccctgacagacctggtgtttgcctttgctggccagctgctgcccctggagatggatgacacagagaccggcctgctgagcgccatctgcctgatctgtggggacaggatggacctggaggagcctgagaaggtggacaagctgcaggagcccctgctggaggccctgcggctgtatgccaggagaagaagacccagccagccctacatgttccccaggatgctgatgaagatcacagacctgcggggcatcagcaccaagggagctgagcgggccatcaccctgaagatggagatccctggccccatgcctcctctcatccgggagatgctggagaaccctgagatgtttgaagatgacagcagccagcccggcccccaccccaatgccagcagtgaagatgaggtgcctgggggccagggcaaaggaggcctgaagagccctgcctag

SEQ ID NO: 167725 - DNA, 1365 bp, Artificial Sequence; identical to SEQ ID NO: 167724
  Description of Artificial Sequence: Synthetic coding sequence

SEQ ID NO: 167726 - DNA, 306 bp, Artificial Sequence
  Description of Artificial Sequence: Synthetic coding sequence
caccaccaggatgaatttgccaagaggctgcccggcttcaccggcctgagcattgctgaccagatcaccctgctgaaggccgcctgcctggacatcctgatgctgcgcatctgcacccgctacaccccagagcaggacaccatgaccttcagtgatggcctgaccctgaacagaacccagatgcacaatgccggcttcggccccctgacagacctggtgtttgcctttgctggccagctgctgcccctggagatggatgacacagagaccggcctgctgagcgccatctgcctgatctgtggctag

SEQ ID NO: 167727 - DNA, 1299 bp, Artificial Sequence
  Description of Artificial Sequence: Synthetic coding sequence
atgctggccctgcccctgcccccctgctggagcggggcccctcctggagaggagggggagagcgctgctggcccctggtgcttccagcaccctgtgtccctgcaggccggcagccgctgcaccaccgtgtggaagaggctgccccgggtgagagatggctgcaccggccggcccggccctggccctgcctgctgtgccgagcccccagctgcccctgtgtccccagacctgaacctgctgcctggaagaaatcctccagcctgcaatggcttcttcagaagaagcatccagaagaacatggtgtacacctgccaccgggacaagaactgcatcatcaacaaggtgaccaggaaccgctgccagtactgccgcctgcagaagtgctttgaggtgggcatgagcaaggaggccgtgagaaatgacaggaacaagaagaagaaggaggtgaaggaggagggcagcccagacagctatgagctgagcccccagctggaggagctgatcaccaaggtgtccaaggcccaccaggagaccttccccagcctgtgccagctgggcaagtacaccaccaacagcagcgctgaccaccgggtgcagctggacctgggcctgtgggacaagttcagcgagctggccaccaagtgcatcatcaagatcgtggagtttgccaagaggctgcccggcttcaccggcctgagcattgctgaccagatcaccctgctgaaggccgcctgcctggacatcctgatgctgcgcatctgcacccgctacaccccagagcaggacaccatgaccttcagtgatggcctgaccctgaacagaacccagatgcacaatgccggcttcggccccctgacagacctggtgtttgcctttgctggccagctgctgcccctggagatggatgacacagagaccggcctgctgagcgccatctgcctgatctgtggggacaggatggacctggaggagcctgagaaggtggacaagctgcaggagcccctgctggaggccctgcggctgtatgccaggagaagaagacccagccagccctacatgttccccaggatgctgatgaagatcacagacctgcggggcatcagcaccaagggagctgagcgggccatcaccctgaagatggagatccctggccccatgcctcctctcatccgggagatgctggagaaccctgagatgtttgaagatgacagcagccagcccggcccccaccccaatgccagcagtgaagatgaggtgcctgggggccagggcaaaggaggcctgaagagccctgcctag

SEQ ID NO: 167728 - DNA, 1389 bp, Artificial Sequence
  Description of Artificial Sequence: Synthetic coding sequence
atggacaccaagcacttcctgcccctggacttcagcacccaggtgaacagcagcctgaccagccccaccggccggggctccatggccgcccccagcctgcaccccagcctgggccctggcatcggcagccctggccagctgcacagccccatcagcaccctgagcagccccatcaatggcatgggcccccccttcagcgtcatcagcagccccatgggcccccacagcatgtctgtgcccaccacccccaccctgggcttcagcacaggcagcccccagctgagcagccccatgaaccctgtgagcagcagcgaggacatcaagccacccctgggcctgaatggagtgctgaaggtgcctgcccaccccagcggcaacatggccagcttcaccaagcacatctgtgccatctgtggggacaggagcagcggcaagcactatggagtgtacagctgtgagggctgcaagggcttcttcaagaggacagtgaggaaggacctgacctacacctgccgggacaacaaggactgcctgattgacaagaggcagaggaaccgctgccagtactgccgctaccagaagtgcctggccatgggcatgaagcgggaggccgtgcaggaggagcggcagaggggcaaggacagaaatgaaaatgaggtggagagcaccagcagcgccaatgaagacatgcctgtggagcgcatcctggaggccgagctggccgtggagcccaagacagagacctacgtggaggccaacatgggcctgaaccccagcagccccaatgaccctgtgaccaacatctgccaggccgctgacaagcagctgttcaccctggtggagtgggccaagaggatcccccacttcagcgagctgcccctggatgaccaggtgatcctgctgcgggccggctggaatgagctgctgattgccagcttcagccacaggagcattgctgtgaaggatggcatcctgctggccaccggcctgcacgtgcacaggaacagcgcccacagcgctggggtgggcgccatctttgacagagtgctgacagagctggtgtccaagatgagggacatgcagatggacaagacagagctgggctgcctgcgggccatcgtgctcttcaacccagacagcaagggcctgagcaacccagctgaggtggaggccctgcgggagaaggtgtatgccagcctggaggcctactgcaagcacaagtacccagagcagcccggccgctttgccaagctgctgctgcggctgcctgccctgcggagcatcggcctgaagtgcctggagcacctgttcttcttcaagctgattggagacacccccatcgacaccttcctgatggagatgctggaggccccccaccagatgacctag

SEQ ID NO: 167729 - DNA, 1098 bp, Artificial Sequence
  Description of Artificial Sequence: Synthetic coding sequence
atgaaccctgtgagcagcagcgaggacatcaagccacccctgggcctgaatggagtgctgaaggtgcctgcccaccccagcggcaacatggccagcttcaccaagcacatctgtgccatctgtggggacaggagcagcggcaagcactacggcgtgtacagctgtgagggctgcaagggcttcttcaagaggacagtgaggaaggacctgacctacacctgccgggacaacaaggactgcctgattgacaagaggcagaggaaccgctgccagtactgccgctaccagaagtgcctggccatgggcatgaagcgggaggccgtgcaggaggagcggcagaggggcaaggacagaaatgaaaatgaggtggagagcaccagcagcgccaatgaagacatgcctgtggagcgcatcctggaggccgagctggccgtggagcccaagacagagacctacgtggaggccaacatgggcctgaaccccagcagccccaatgaccctgtgaccaacatctgccaggccgctgacaagcagctgttcaccctggtggagtgggccaagaggatcccccacttcagcgagctgcccctggatgaccaggtgatcctgctgcgggccggctggaatgagctgctgattgccagcttcagccacaggagcattgctgtgaaggatggcatcctgctggccaccggcctgcacgtgcacagaaattctgcccacagcgctggggtgggcgccatctttgacagagtgctgacagagctggtgtccaagatgagggacatgcagatggacaagacagagctgggctgcctgcgggccatcgtgctcttcaacccagacagcaagggcctgagcaacccagctgaggtggaggccctgcgggagaaggtgtatgccagcctggaggcctactgcaagcacaagtacccagagcagcccggccgctttgccaagctgctgctgcggctgcctgccctgcggagcatcggcctgaagtgcctggagcacctgttcttcttcaagctgattggagacacccccatcgacaccttcctgatggagatgctggaggccccccaccagatgacctag

SEQ ID NO: 167730 - DNA, 1602 bp, Artificial Sequence
  Description of Artificial Sequence: Synthetic coding sequence
atgtcctgggccgcccggccccccttcctgccccagagacatgctgctggccagtgtggccctgtgggcgtgaggaaggagatgcactgcggcgtggccagccgctggaggagaagaagaccctggctggaccctgctgctgctgctgctgctgctgtggccggcggggagcagcagaccccagagcctgagcctggagaggccggcagagatggcatgggagacagcggccgggacagccgcagcccagacagcagcagccccaaccccctgccccagggcgtgcccccacccagccccccaggcccccccctgccccccagcacagcccccagcctgggcggcagcggggcccctcctcctccacccatgcctcctccacccctgggcagccccttccctgtgatcagcagctccatgggcagccctggcctgcccccaccagcccctcctggcttcagcggccctgtgagcagcccccagatcaacagcacagtgtccctgcccggcggcggcagcggccccccagaagatgtgaagccccctgtgctgggcgtgcggggcctgcactgccccccacctcctgggggccctggggccggcaagaggctgtgtgccatctgtggggacaggagcagcggcaagcactatggagtgtacagctgtgagggctgcaagggcttcttcaagaggaccatcaggaaggacctgacctacagctgccgggacaacaaggactgcaccgtggacaagaggcagaggaaccgctgccagtactgccgctaccagaagtgcctggccaccggcatgaagcgggaggccgtgcaggaggagcggcagaggggcaaggacaaggatggagatggagagggcgctgggggcgcccctgaggagatgcctgtggaccgcatcctggaggccgagctggccgtggagcagaagagtgaccagggcgtggagggccctgggggcactggaggcagcggcagcagccccaatgaccctgtgaccaacatctgccaggccgctgacaagcagctgttcaccctggtggagtgggccaagaggatcccccacttcagcagcctgcccctggatgaccaggtgatcctgctgcgggccggctggaatgagctgctgattgccagcttcagccacaggagcattgatgtgagagatggcatcctgctggccaccggcctgcacgtgcacagaaattctgcccacagcgctggggtgggcgccatctttgacagagtgctgacagagctggtgtccaagatgagggacatgaggatggacaagacagagctgggctgcctgcgggccatcatcctcttcaacccagatgccaagggcctgagcaaccccagcgaggtggaggtgctgcgggagaaggtgtatgccagcctggagacctactgcaagcagaagtacccagagcagcagggccgctttgccaagctgctgctgcggctgcctgccctgcggagcatcggcctgaagtgcctggagcacctgttcttcttcaagctgattggagacacccccatcgacaccttcctgatggagatgctggaggccccccaccagctggcctag

SEQ ID NO: 167731 - DNA, 1614 bp, Artificial Sequence
  Description of Artificial Sequence: Synthetic coding sequence
atgtcctgggccgcccggccccccttcctgccccagagacatgctgctggccagtgtggccctgtgggcgtgaggaaggagatgcactgcggcgtggccagccgctggaggagaagaagaccctggctggaccctgctgctgctgctgctgctgctgtggccggcggggagcagcagaccccagagcctgagcctggagaggccggcagagatggcatgggagacagcggccgggacagccgcagcccagacagcagcagccccaaccccctgccccagggcgtgcccccacccagccccccaggcccccccctgccccccagcacagcccccagcctgggcggcagcggggcccctcctcctccacccatgcctcctccacccctgggcagccccttccctgtgatcagcagctccatgggcagccctggcctgcccccaccagcccctcctggcttcagcggccctgtgagcagcccccagatcaacagcacagtgtccctgcccggcggcggcagcggccccccagaagatgtgaagccccctgtgctgggcgtgcggggcctgcactgccccccacctcctgggggccctggggccggcaagaggctgtgtgccatctgtggggacaggagcagcggcaagcactatggagtgtacagctgtgagggctgcaagggcttcttcaagaggaccatcaggaaggacctgacctacagctgccgggacaacaaggactgcaccgtggacaagaggcagaggaaccgctgccagtactgccgctaccagaagtgcctggccaccggcatgaagcgggaggccgtgcaggaggagcggcagaggggcaaggacaaggatggagatggagagggcgctgggggcgcccctgaggagatgcctgtggaccgcatcctggaggccgagctggccgtggagcagaagagtgaccagggcgtggagggccctgggggcactggaggcagcggcagcagccccaatgaccctgtgaccaacatctgccaggccgctgacaagcagctgttcaccctggtggagtgggccaagaggatcccccacttcagcagcctgcccctggatgaccaggtgatcctgctgcgggccggctggaatgagctgctgattgccagcttcagccacaggagcattgatgtgagagatggcatcctgctggccaccggcctgcacgtgcacagaaattctgcccacagcgctggggtgggcgccatctttgacaggagcctgagccgggtgctgacagagctggtgtccaagatgagggacatgaggatggacaagacagagctgggctgcctgcgggccatcatcctcttcaacccagatgccaagggcctgagcaaccccagcgaggtggaggtgctgcgggagaaggtgtatgccagcctggagacctactgcaagcagaagtacccagagcagcagggccgctttgccaagctgctgctgcggctgcctgccctgcggagcatcggcctgaagtgcctggagcacctgttcttcttcaagctgattggagacacccccatcgacaccttcctgatggagatgctggaggccccccaccagctggcctag

SEQ ID NO: 167732 - DNA, 1614 bp, Artificial Sequence; identical to SEQ ID NO: 167731
  Description of Artificial Sequence: Synthetic coding sequence

SEQ ID NO: 167733 - DNA, 1602 bp, Artificial Sequence; identical to SEQ ID NO: 167730
  Description of Artificial Sequence: Synthetic coding sequence

SEQ ID NO: 167734 - DNA, 861 bp, Artificial Sequence
  Description of Artificial Sequence: Synthetic coding sequence
atgccccagggctctgtgggccgctggggctgtgagaagaagtgcatcgtgggcagcaggcctgggggcggcggagatggccctggctggatcccccagaggagaagaagaagacgctggcaggccgagaacaacaagcccaggagccgcagccagggccgcctggatggcaccggctgggccacagctgggggcatcaacagcacagtgtccctgcccggcggcggcagcggccccccagaagatgtgaagccccctgtgctgggcgtgcggggcctgcactgccccccacctcctgggggccctggggccggcaagaggctgtgtgccatctgtggggacaggagcagcggcaagcactatggagtgtacagctgtgagggctgcaagggcttcttcaagaggaccatcaggaaggacctgacctacagctgccgggacaacaaggactgcaccgtggacaagaggcagaggaaccgctgccagtactgccgctaccagaagtgcctggccaccggcatgaagcgggaggccgtgcaggaggagcggcagaggggcaaggacaaggatggagatggagagggcgctgggggcgcccctgaggagatgcctgtggaccgcatcctggaggccgagctggccgtggagcagaagagtgaccagggcgtggagggccctgggggcactggaggcagcggcagctctgtgtctgtgggcgtgaaccccctgagctttgtgatgggcgtgggcggcggcagcctgggcctcttctacatccccagccccagcttccccctcatcaccttcctgaccctgctgggcactggaggagctgccaagcagggcctgagcaacatctag

SEQ ID NO: 167735 - DNA, 1602 bp, Artificial Sequence; identical to SEQ ID NO: 167730
  Description of Artificial Sequence: Synthetic coding sequence

SEQ ID NO: 167736 - DNA, 291 bp, Artificial Sequence
  Description of Artificial Sequence: Synthetic coding sequence
tgaagccccaatgaccctgtgaccaacatctgccaggccgctgacaagcagctgttcaccctggtggagtgggccaagaggatcccccacttcagcagcctgcccctggatgaccaggtgatcctgctgcgggccggcctgcacgtgcacagaaattctgcccacagcgctggggtgggcgccatctttgacagagtgctgacagagctggtgtccaagatgagggacatgaggatggacaagacagagctgggctgcctgcgggccatcatcctcttcaacccagactag

SEQ ID NO: 167737 - DNA, 1602 bp, Artificial Sequence; identical to SEQ ID NO: 167730
  Description of Artificial Sequence: Synthetic coding sequence

SEQ ID NO: 167738 - DNA, 291 bp, Artificial Sequence; identical to SEQ ID NO: 167736
  Description of Artificial Sequence: Synthetic coding sequence

SEQ ID NO: 167739 - DNA, 1614 bp, Artificial Sequence; identical to SEQ ID NO: 167731
  Description of Artificial Sequence: Synthetic coding sequence

SEQ ID NO: 167740 - DNA, 1602 bp, Artificial Sequence; identical to SEQ ID NO: 167730
  Description of Artificial Sequence: Synthetic coding sequence

SEQ ID NO: 167741 - DNA, 1602 bp, Artificial Sequence; identical to SEQ ID NO: 167730
  Description of Artificial Sequence: Synthetic coding sequence

SEQ ID NO: 167742 - DNA, 291 bp, Artificial Sequence; identical to SEQ ID NO: 167736
  Description of Artificial Sequence: Synthetic coding sequence

SEQ ID NO: 167743 - DNA, 291 bp, Artificial Sequence; identical to SEQ ID NO: 167736
  Description of Artificial Sequence: Synthetic coding sequence

SEQ ID NO: 167744 - DNA, 1614 bp, Artificial Sequence; identical to SEQ ID NO: 167731
  Description of Artificial Sequence: Synthetic coding sequence

SEQ ID NO: 167745 - DNA, 291 bp, Artificial Sequence; identical to SEQ ID NO: 167736
  Description of Artificial Sequence: Synthetic coding sequence

SEQ ID NO: 167746 - DNA, 1614 bp, Artificial Sequence; identical to SEQ ID NO: 167731
  Description of Artificial Sequence: Synthetic coding sequence

SEQ ID NO: 167747 - DNA, 1614 bp, Artificial Sequence; identical to SEQ ID NO: 167731
  Description of Artificial Sequence: Synthetic coding sequence

SEQ ID NO: 167748 - DNA, 1044 bp, Artificial Sequence
  Description of Artificial Sequence: Synthetic coding sequence
atgagagaatgtggcggcggccctggggccggcaagaggctgtgtgccatctgtggggacaggagcagcggcaagcactatggagtgtacagctgtgagggctgcaagggcttcttcaagaggaccatcaggaaggacctgacctacagctgccgggacaacaaggactgcaccgtggacaagaggcagaggaaccgctgccagtactgccgctaccagaagtgcctggccaccggcatgaagcgggaggccgtgcaggaggagcggcagaggggcaaggacaaggatggagatggagagggcgctgggggcgcccctgaggagatgcctgtggaccgcatcctggaggccgagctggccgtggagcagaagagtgaccagggcgtggagggccctgggggcactggaggcagcggcagcagccccaatgaccctgtgaccaacatctgccaggccgctgacaagcagctgttcaccctggtggagtgggccaagaggatcccccacttcagcagcctgcccctggatgaccaggtgatcctgctgcgggccggctggaatgagctgctgattgccagcttcagccacaggagcattgatgtgagagatggcatcctgctggccaccggcctgcacgtgcacagaaattctgcccacagcgctggggtgggcgccatctttgacaggagcctgagccgggtgctgacagagctggtgtccaagatgagggacatgaggatggacaagacagagctgggctgcctgcgggccatcatcctcttcaacccagatgccaagggcctgagcaaccccagcgaggtggaggtgctgcgggagaaggtgtatgccagcctggagacctactgcaagcagaagtacccagagcagcagggccgctttgccaagctgctgctgcggctgcctgccctgcggagcatcggcctgaagtgcctggagcacctgttcttcttcaagctgattggagacacccccatcgacaccttcctgatggagatgctggaggccccccaccagctggcctag

SEQ ID NO: 167749 - DNA, 1179 bp, Artificial Sequence
  Description of Artificial Sequence: Synthetic coding sequence
atgggcagccctggcctgcccccaccagcccctcctggcttcagcggccctgtgagcagcccccagatcaacagcacagtgtccctgcccggcggcggcagcggccccccagaagatgtgaagccccctgtgctgggcgtgcggggcctgcactgccccccacctcctgggggccctggagctgggaagaggctgtgtgccatctgtggggacaggagcagcggcaagcactacggcgtgtacagctgtgagggctgcaagggcttcttcaagaggaccatcaggaaggacctgacctacagctgccgggacaacaaggactgcaccgtggacaagaggcagaggaaccgctgccagtactgccgctaccagaagtgcctggccaccggcatgaagcgggaggccgtgcaggaggagcggcagaggggcaaggacaaggatggagatggagagggcgccggcggggcccctgaggagatgcctgtggaccgcatcctggaggccgagctggccgtggagcagaagagtgaccagggcgtggagggccctgggggcaccggggcccccagccccaatgaccctgtgaccaacatctgccaggccgctgacaagcagctgttcaccctggtggagtgggccaagaggatcccccacttcagcagcctgcccctggatgaccaggtgatcctgctgcgggccggctggaatgagctgctgattgccagcttcagccacaggagcattgatgtgagagatggcatcctgctggccaccggcctgcacgtgcacaggaacagcgcccacagcgctggggtgggcgccatctttgacagagtgctgacagagctggtgtccaagatgagggacatgaggatggacaagacagagctgggctgcctgcgggccatcatcctcttcaacccagatgccaagggcctgagcaaccccagcgaggtggaggtgctgcgggagaaggtgtatgccagcctggagacctactgcaagcagaagtacccagagcagcagggccgctttgccaagctgctgctgcggctgcctgccctgcggagcatcggcctgaagtgcctggagcacctgttcttcttcaagctgattggagacacccccatcgacaccttcctgatggagatgctggaggccccccaccagctggcctag

SEQ ID NO: 167750 - DNA, 1170 bp, Artificial Sequence
  Description of Artificial Sequence: Synthetic coding sequence
atgggcagccctggcctgcccccaccagcccctcctggcttcagcggccctgtgagcagcccccagatcaacagcacagtgtccctgcccggcggcggcagcggccccccagaagatgtgaagccccctgtgctgggcgtgcggggcctgcactgccccccacctcctgggggccctggagctgggaagaggctgtgtgccatctgtggggacaggagcagcggcaagcactacggcgtgtacagctgtgagggctgcaagggcttcttcaagaggaccatcaggaaggacctgacctacagctgccgggacaacaaggactgcaccgtggacaagaggcagaggaaccgctgccagtactgccgctaccagaagtgcctggccaccggcatgaagcgggaggccgtgcaggaggagcggcagaggggcaaggacaaggatggagatggagagggcgccggcggggcccctgaggagatgcctgtggaccgcatcctggaggccgagctggccgtggagcagaagagtgaccagggcggcagccagcacatcagcaagagccccaatgaccctgtgaccaacatctgccaggccgctgacaagcagctgttcaccctggtggagtgggccaagaggatcccccacttcagcagcctgcccctggatgaccaggtgatcctgctgcgggccggctggaatgagctgctgattgccagcttcagccacaggagcattgatgtgagagatggcatcctgctggccaccggcctgcacgtgcacagaaattctgcccacagcgctggggtgggcgccatctttgacagagtgctgacagagctggtgtccaagatgagggacatgaggatggacaagacagagctgggctgcctgcgggccatcatcctcttcaacccagatgccaagggcctgagcaaccccagcgaggtggaggtgctgcgggagaaggtgtatgccagcctggagacctactgcaagcagaagtacccagagcagcagggccgctttgccaagctgctgctgcggctgcctgccctgcggagcatcggcctgaagtgcctggagcacctgttcttcttcaagctgattggagacacccccatcgacaccttcctgatggagatgctggaggccccccaccagctggcctag

SEQ ID NO: 167751 - DNA, 1044 bp, Artificial Sequence; identical to SEQ ID NO: 167748
  Description of Artificial Sequence: Synthetic coding sequence

SEQ ID NO: 167752 - DNA, 1179 bp, Artificial Sequence; identical to SEQ ID NO: 167749
  Description of Artificial Sequence: Synthetic coding sequence

SEQ ID NO: 167753 - DNA, 1170 bp, Artificial Sequence; identical to SEQ ID NO: 167750
  Description of Artificial Sequence: Synthetic coding sequence

SEQ ID NO: 167754 - DNA, 861 bp, Artificial Sequence; identical to SEQ ID NO: 167734
  Description of Artificial Sequence: Synthetic coding sequence

SEQ ID NO: 167755 - DNA, 1170 bp, Artificial Sequence; identical to SEQ ID NO: 167750
  Description of Artificial Sequence: Synthetic coding sequence

SEQ ID NO: 167756 - DNA, 861 bp, Artificial Sequence; identical to SEQ ID NO: 167734
  Description of Artificial Sequence: Synthetic coding sequence

SEQ ID NO: 167757 - DNA, 1179 bp, Artificial Sequence; identical to SEQ ID NO: 167749
  Description of Artificial Sequence: Synthetic coding sequence

SEQ ID NO: 167758 - DNA, 1044 bp, Artificial Sequence; identical to SEQ ID NO: 167748
  Description of Artificial Sequence: Synthetic coding sequence

SEQ ID NO: 167759 - DNA, 1179 bp, Artificial Sequence; identical to SEQ ID NO: 167749
  Description of Artificial Sequence: Synthetic coding sequence

SEQ ID NO: 167760 - DNA, 1179 bp, Artificial Sequence; identical to SEQ ID NO: 167749
  Description of Artificial Sequence: Synthetic coding sequence

SEQ ID NO: 167761 - DNA, 861 bp, Artificial Sequence; identical to SEQ ID NO: 167734
  Description of Artificial Sequence: Synthetic coding sequence

SEQ ID NO: 167762 - DNA, 1170 bp, Artificial Sequence; identical to SEQ ID NO: 167750
  Description of Artificial Sequence: Synthetic coding sequence

SEQ ID NO: 167763 - DNA, 1044 bp, Artificial Sequence; identical to SEQ ID NO: 167748
  Description of Artificial Sequence: Synthetic coding sequence

SEQ ID NO: 167764 - DNA, 1170 bp, Artificial Sequence; identical to SEQ ID NO: 167750
  Description of Artificial Sequence: Synthetic coding sequence

SEQ ID NO: 167765 - DNA, 1044 bp, Artificial Sequence; identical to SEQ ID NO: 167748
  Description of Artificial Sequence: Synthetic coding sequence

SEQ ID NO: 167766 - DNA, 861 bp, Artificial Sequence; identical to SEQ ID NO: 167734
  Description of Artificial Sequence: Synthetic coding sequence

SEQ ID NO: 167767 - DNA, 1392 bp, Artificial Sequence
  Description of Artificial Sequence: Synthetic coding sequence
atgtatggcaactacagccacttcatgaagtttcctgctggctatggaggcagccctggccacacaggcagcacctccatgagccccagcgctgccctgagcacaggcaagcccatggacagccaccccagctacacagacacccctgtgtctgcccccaggaccctgtctgctgtgggcacccccctgaatgccctgggcagcccctacagagtcatcaccagcgccatgggccccccatctggggccctggccgcccctcctggcatcaacctggtggccccacccagcagccagctgaatgtggtgaacagcgtgagcagcagcgaggacatcaagcccctgcccggcctgcccggcatcggcaacatgaactaccccagcaccagccctggcagcctggtgaagcacatctgtgccatctgtggggacaggagcagcggcaagcactatggagtgtacagctgtgagggctgcaagggcttcttcaagaggaccatcaggaaggacctgatctacacctgccgggacaacaaggactgcctgattgacaagaggcagaggaaccgctgccagtactgccgctaccagaagtgcctggtgatgggcatgaagcgggaggccgtgcaggaggagcggcagaggagccgggagcgggcagagagcgaggctgaatgtgccaccagcggccacgaggacatgcctgtggagcgcatcctggaggccgagctggccgtggagcccaagacagagagctatggagacatgaacatggagaacagcaccaatgaccctgtgaccaacatctgccacgccgctgacaagcagctgttcaccctggtggagtgggccaagaggatcccccacttcagtgacctgaccctggaggaccaggtgatcctgctgcgggccggctggaatgagctgctgattgccagcttcagccacaggtctgtgtctgtgcaggacggcatcctgctggccaccggcctgcacgtgcacaggagcagcgcccacagcgctggggtgggcagcatctttgacagagtgctgacagagctggtgtccaagatgaaggacatgcagatggacaagtctgagctgggctgcctgcgggccatcgtgctcttcaacccagatgccaagggcctgagcaaccccagcgaggtggagaccctgcgggagaaggtgtatgccaccctggaggcctacaccaagcagaagtacccagagcagcccggccgctttgccaagctgctgctgcggctgcctgccctgcggagcatcggcctgaagtgcctggagcacctgttcttcttcaagctgattggagacacccccatcgacaccttcctgatggagatgctggagacccccctgcagatcacctag

SEQ ID NO: 167768 - DNA, 2619 bp, Artificial Sequence
  Description of Artificial Sequence: Synthetic coding sequence
atggccacagcctgcaagaggtctggagagccccagagtgatgacatcgaggccagcaggatgaagagagctgctgccaagcacctgattgaaagatactaccaccagctgacagagggctgtggaaatgaggcctgcaccaatgagttctgtgccagctgccccaccttcctgaggatggacaacaatgctgctgccatcaaggccctggagctgtacaagatcaatgccaagctgtgtgacccccaccccagcaagaagggggccagcagcgcctacctggagaacagcaagggggcccccaacaacagctgcagcgagatcaagatgaacaagaagggggccagaattgacttcaaggatgtgacctacctgacagaggagaaggtgtatgagatcctggagctgtgccgggagcgggaggactacagccccctcatccgggtcatcggccgggtcttcagcagcgctgaggccctggtgcagagcttcaggaaggtgaagcagcacaccaaggaggagctgaagagcctgcaggccaaggatgaggacaaggatgaagatgagaaggagaaggccgcctgcagcgctgctgccatggaggaggacagcgaggccagcagcagcagaattggagacagcagccagggcgacaacaacctgcagaagctgggcccagatgatgtgtctgtggacattgatgccatcagaagagtgtacacccggctgctgagcaatgagaagattgaaacagccttcctgaatgccctggtgtacctgagccccaacgtggagtgtgacctgacctaccacaacgtgtacagccgggaccccaactacctgaacctcttcatcatcgtgatggagaacagaaacctgcacagccctgagtacctggagatggccctgcccctcttctgcaaggccatgagcaagctgcccctggccgcccagggcaagctgatccggctgtggagcaagtacaatgctgaccagatccggaggatgatggagaccttccagcagctgatcacctacaaggtgatcagcaatgagttcaacagcaggaacctggtgaatgatgatgatgccatcgtggccgccagcaagtgcctgaagatggtgtactatgccaacgtggtgggcggggaggtggacaccaaccacaatgaggaggatgatgaggagcccatccctgagagcagcgagctgaccctgcaggagctgctgggggaggagaggaggaacaagaagggcccccgggtggaccccctggagacagagctgggcgtgaagaccctggactgcaggaagcccctcatcccctttgaggagttcatcaatgagcccctgaatgaggtgctggagatggacaaggactacaccttcttcaaggtggagacagagaacaagttctccttcatgacctgccccttcatcctgaatgctgtgaccaagaacctgggcctgtactatgacaaccgcatccgcatgtacagcgagcggcgcatcaccgtgctgtacagcctggtgcagggccagcagctgaacccctacctgcggctgaaggtgagaagagaccacatcattgatgatgccctggtgcggctggagatgattgccatggagaacccagctgacctgaagaagcagctgtatgtggagtttgaaggagagcagggcgtggatgaaggaggagtgtccaaggagttcttccagctggtggtggaggagatcttcaacccagacatcggcatgttcacctatgatgagagcaccaagctgttctggttcaaccccagcagctttgaaacagagggccagttcaccctcatcggcatcgtgctgggcctggccatctacaacaactgcatcctggatgtgcacttccccatggtggtgtacaggaagctgatgggcaagaagggcaccttccgggacctgggggacagccaccctgtgctgtaccagagcctgaaggacctgctggagtatgagggcaatgtggaggatgacatgatgatcaccttccagatcagccagacagacctgtttggaaaccccatgatgtatgacctgaaggaaaatggagacaagatccccatcaccaatgaaaataggaaggagtttgtgaacctgtacagcgactacatcctgaacaagtctgtggagaagcagttcaaggccttcagaagaggcttccacatggtgaccaatgaaagccccctgaagtacctgttccggcctgaggagattgagctgctgatctgtggcagcaggaacctggacttccaggccctggaggagaccacagaatatgatggcggctacacccgggacagcgtgctgatccgggagttctgggagatcgtgcacagcttcacagatgagcagaagaggctcttcctgcagttcaccactggaacagaccgggcccctgtgggcggcctgggcaagctgaagatgatcatcgccaagaatggaccagacacagagcggctgcccaccagccacacctgcttcaacgtgctgctgctgcctgagtacagcagcaaggagaagctgaaggagcggctgctgaaggccatcacctacgccaagggcttcggcatgctgtag

SEQ ID NO: 167769 - DNA, 75 bp, Artificial Sequence
  Description of Artificial Sequence: Synthetic coding sequence
atgacccgggaccagaatggcacctgggagatggagagcaatgaaaattttgagggctacatgaaggccctgtag

SEQ ID NO: 167770 - DNA, 312 bp, Artificial Sequence
  Description of Artificial Sequence: Synthetic coding sequence
atgacccgggaccagaatggcacctgggagatggagagcaatgaaaattttgagggctacatgaaggccctggacatcgactttgccaccaggaagattgctgtgcggctgacccagaccaaggtgattgaccaggatggagacaacttcaagaccaagaccaccagcaccttcagaaattatgatgtggacttcaccgtgggcgtggagtttgatgagtacaccaagagcctggacaacagacatgtgaaggccctggtgacctgggagggagatgtgctggtgtgtgtgcagaagggggagaaggagtag

SEQ ID NO: 167771 - DNA, 1494 bp, Artificial Sequence
  Description of Artificial Sequence: Synthetic coding sequence
atgggcctgcctgccctgctggccagcgccctgtgcacctttgtgctgcccctgctgctcttcctggccgccatcaagctgtgggacctgtactgtgtgtctggccgggacaggagctgtgccctgcccctgcccccaggcaccatgggcttccccttcttcggggagaccctgcagatggtgctgcagaggaggaagttcctgcagatgaagaggaggaaatatggcttcatctacaagacccacctgtttggccggcccaccgtgcgggtgatgggcgctgacaacgtgcggcgcatcctgctgggggagcaccggctggtgtctgtgcactggccagcctctgtgaggaccatcctgggcagcggctgcctgagcaacctgcatgacagcagccacaagcagaggaagaaggtgatcatgagggccttcagccgggaggccctggagtgctacgtgcctgtgatcacagaggaggtgggcagcagcctggagcagtggctgagctgtggggagcggggcctgctggtgtacccagaggtgaagaggctgatgttccgcatcgccatgaggatcctgctgggctgtgagccccagctggccggagatggagacagcgagcagcagctggtggaggcctttgaggagatgaccaggaacctcttcagcctgcccattgatgtgcccttcagcggcctgtaccggggcatgaaggccaggaacctgatccacgccagaattgagcagaacatccgggccaagatctgtggcctgcgggccagcgaggccggccagggctgcaaggatgccctgcagctgctgattgagcacagctgggagcggggggagcggctggacatgcaggccctgaagcagagcagcacagagctgctgtttggaggccacgagaccacagccagcgctgccaccagcctcatcacctacctgggcctgtacccccacgtgctgcagaaggtgcgggaggagctgaagagcaagggcctgctgtgcaagagcaaccaggacaacaagctggacatggagatcctggagcagctgaagtacatcggctgcgtcatcaaggagaccctgcggctgaacccccctgtgcctgggggcttccgggtggccctgaagacctttgagctgaatggctaccagatccccaagggctggaatgtcatctacagcatctgtgacacccatgatgtggccgagatcttcaccaacaaggaggagttcaacccagaccgcttcatgctgccccacccagaagatgccagccgcttctccttcatcccctttggaggcggcctgcggagctgtgtgggcaaggagtttgccaagatcctgctgaagatcttcaccgtggagctggcccggcactgtgactggcagctgctgaatggaccacccaccatgaagaccagccccaccgtgtaccctgtggacaacctgcctgcccgcttcacccacttccacggggagatctag

SEQ ID NO: 167772 - DNA, 600 bp, Artificial Sequence
  Description of Artificial Sequence: Synthetic coding sequence
atgaactacagcaagatcccagcccaggtggacctgcggcggcagacagagcgggactgccgggtgagcagcttccgggtgaaggaaaattttgacaaggcccgcttcagcggcacctggtacgccatggccaagaaggaccctgagggcctcttcctgcaggacaacatcgtggccgagttctctgtggatgagaccggccagatgtctgccacagccaagggccgggtgcggctgctgaacaactgggatgtgtgtgccgacatggtgggcaccttcacagacacagaagatcctgccaagttcaagatgaagtactggggcgtggccagcttcctgcagaagggaaatgatgaccactggatcgtggacacagattatgacacctatgctgtgcagtacagctgccgcctgctgaacctggatggcacctgtgccgacagctacagctttgtgttcagccgggaccccaacggcctgcccccagaggcccagaagatcgtgcggcagaggcaggaggagctgtgcctggcccggcagtaccgcctcatcgtgcacaacggctactgtgatggccgctctgagaggaacctgctgtag

SEQ ID NO: 167773 - DNA, 606 bp, Artificial Sequence
  Description of Artificial Sequence: Synthetic coding sequence
atgaagtgggtgtgggccctgctgctgctggccgccctgggcagcggccgggcagagcgggactgccgggtgagcagcttccgggtgaaggaaaattttgacaaggcccgcttcagcggcacctggtacgccatggccaagaaggaccctgagggcctcttcctgcaggacaacatcgtggccgagttctctgtggatgagaccggccagatgtctgccacagccaagggccgggtgcggctgctgaacaactgggatgtgtgtgccgacatggtgggcaccttcacagacacagaagatcctgccaagttcaagatgaagtactggggcgtggccagcttcctgcagaagggaaatgatgaccactggatcgtggacacagattatgacacctatgctgtgcagtacagctgccgcctgctgaacctggatggcacctgtgccgacagctacagctttgtgttcagccgggaccccaacggcctgcccccagaggcccagaagatcgtgcggcagaggcaggaggagctgtgcctggcccggcagtaccgcctcatcgtgcacaacggctactgtgatggccgctctgagaggaacctgctgtag

SEQ ID NO: 167774 - DNA, 606 bp, Artificial Sequence; identical to SEQ ID NO: 167773
  Description of Artificial Sequence: Synthetic coding sequence

SEQ ID NO: 167775 - DNA, 600 bp, Artificial Sequence
  Description of Artificial Sequence: Synthetic coding sequence
atgaactacagcaagatcccagcccaggtggacctgcggcggcaggccgagcgggactgccgggtgagcagcttccgggtgaaggaaaattttgacaaggcccgcttcagcggcacctggtacgccatggccaagaaggaccctgagggcctcttcctgcaggacaacatcgtggccgagttctctgtggatgagaccggccagatgtctgccacagccaagggccgggtgcggctgctgaacaactgggatgtgtgtgccgacatggtgggcaccttcacagacacagaagatcctgccaagttcaagatgaagtactggggcgtggccagcttcctgcagaagggaaatgatgaccactggatcgtggacacagattatgacacctatgctgtgcagtacagctgccgcctgctgaacctggatggcacctgtgccgacagctacagctttgtgttcagccgggaccccaacggcctgcccccagaggcccagaagatcgtgcggcagaggcaggaggagctgtgcctggcccggcagtaccgcctcatcgtgcacaacggctactgtgatggccgctctgagaggaacctgctgtag

SEQ ID NO: 167776 - DNA, 408 bp, Artificial Sequence
  Description of Artificial Sequence: Synthetic coding sequence
atgccacccaacctgaccggctactacagatttgtgtcccagaagaacatggaggactacctgcaggccctgaacatcagcctggccgtgaggaagatcgccctgctgctgaagccagacaaggagattgagcaccagggcaaccacatgacagtgaggaccctgagcaccttcaggaactacacagtgcagtttgatgtgggcgtggagtttgaggaggacctgcggtctgtggatggcaggaagtgccagaccatcgtgacctgggaggaggagcacctggtgtgtgtgcagaagggggaggtgcccaacagaggctggaggcactggctggagggggagatgctgtacctggagctgacagccagagatgctgtgtgtgagcaggtgttcaggaaggtgaggtag

SEQ ID NO: 167777 - DNA, 1026 bp, Artificial Sequence
  Description of Artificial Sequence: Synthetic coding sequence
atgaacatcgtggtggagttctttgtggtgaccttcaaggtgctgtgggcctttgtgctggccgccgcccgctggctggtgcggcccaaggagaagtctgtggccggccaggtgtgcctgatcaccggggccggcagcggcctgggccgcctgtttgccctggagtttgccaggagaagagccctgctggtgctgtgggacatcaacacccagagcaatgaggagacagctggcatggtgcgccacatctacagagacctggaggccgcagatgctgctgccctgcaggccggaaatggagaggaggagatcctgccccactgcaacctgcaggtgttcacctacacctgtgatgtgggcaagagagaaaatgtgtacctgacagctgagcgggtgaggaaggaggtgggggaggtgtctgtgctggtgaacaatgctggggtggtgtctggccaccacctgctggagtgcccagatgagctgattgaaagaaccatgatggtgaactgccacgcccacttctggaccaccaaggccttcctgcccaccatgctggagatcaaccacggccacatcgtgacagtggccagcagcctgggcctcttcagcacagctggggtggaggactactgtgccagcaagtttggagtggtgggcttccacgagagcctgagccatgagctgaaggctgctgagaaggatggcatcaagaccaccctggtgtgcccctacctggtggacaccggcatgttccggggctgccgcatcaggaaggagattgagcccttcctgccccccctgaagccagactactgtgtgaagcaggccatgaaggccatcctgacagaccagcccatgatctgcaccccccggctgatgtacatcgtgaccttcatgaagagcatcctgccctttgaagctgtggtgtgcatgtaccgcttcctgggcgctgacaagtgcatgtaccccttcatcgcccagaggaagcaggccaccaacaacaatgaggccaagaatggcatctag

SEQ ID NO: 167778 - DNA, 957 bp, Artificial Sequence
  Description of Artificial Sequence: Synthetic coding sequence
atggtggagctgatgttccccctgctgctgctgctgctgcccttcctgctgtacatggccgccccccagatcaggaagatgctgagcagcggcgtgtgcaccagcacagtgcagctgcccgggaaggtggtggtggtgactggagccaacacaggaattggcaaggagacagccaaggagctggcccagagaggagcccgggtgtacctggcctgcagagatgtggagaagggggagctggtggccaaggagatccagaccaccactggaaaccagcaggtgctggtgaggaagctggacctgagtgacaccaagagcatccgggcctttgccaagggcttcctggccgaggagaagcacctgcacgtgctgatcaacaatgctggggtgatgatgtgcccctacagcaagacagcagatggctttgagatgcacatcggcgtgaaccacctgggccacttcctgctgacccacctgctgctggagaagctgaaggagagcgcccccagccgcatcgtgaatgtgagcagcctggcccaccacctgggccgcatccacttccacaacctgcagggcgagaagttctacaatgccggcctggcctactgccacagcaagctggccaacatcctcttcacccaggagctggcccggcggctgaagggcagcggcgtgaccacctacagcgtgcaccctggcaccgtgcagagcgagctggtgcgccacagcagcttcatgcgctggatgtggtggctgttctccttcttcatcaagaccccccagcagggcgcccagaccagcctgcactgtgccctgacagagggcctggagatcctgagcggcaaccacttcagtgactgccacgtggcctgggtgtctgcccaggccagaaatgagaccatcgcccggcggctgtgggatgtgtcctgtgacctgctgggcctgcccattgattag

SEQ ID NO: 167779 - DNA, 918 bp, Artificial Sequence
  Description of Artificial Sequence: Synthetic coding sequence
atggtggagctgatgttccccctgctgctgctgctgctgcccttcctgctgtacatggccgccccccagatcaggaagatgctgagcagcggcgtgtgcaccagcacagtgcagctgcccgggaaggtggtggtggtgactggagccaacacaggagcccgggtgtacctggcctgcagagatgtggagaagggggagctggtggccaaggagatccagaccaccaccggcaaccagcaggtgctggtgaggaagctggacctgagtgacaccaagagcatccgggcctttgccaagggcttcctggccgaggagaagcacctgcacgtgctgatcaacaatgccggcgtgatgatgtgcccctacagcaagacagcagatggctttgagatgcacatcggcgtgaaccacctgggccacttcctgctgacccacctgctgctggagaagctgaaggagagcgcccccagcagaattgtgaatgtgagcagcctggcccaccacctgggccgcatccacttccacaacctgcagggcgagaagttctacaatgccggcctggcctactgccacagcaagctggccaacatcctcttcacccaggagctggcccggcggctgaagggcagcggcgtgaccacctacagcgtgcaccctggcaccgtgcagagcgagctggtgcgccacagcagcttcatgcgctggatgtggtggctgttctccttcttcatcaagaccccccagcagggcgcccagaccagcctgcactgtgccctgacagagggcctggagatcctgagcggcaaccacttcagtgactgccacgtggcctgggtgtctgcccaggccagaaatgagaccatcgcccggcggctgtgggatgtgtcctgtgacctgctgggcctgcccatcgactag

SEQ ID NO: 167780 - DNA, 951 bp, Artificial Sequence
  Description of Artificial Sequence: Synthetic coding sequence
atgctggtgaccctgggcctgctgaccagcttcttctccttcctgtacatggtggcccccagcatcaggaagttctttgctggaggagtgtgcaggaccaacgtgcagctgcccgggaaggtggtggtgatcactggagccaacacaggaattggcaaggagacagcccgggagctggccagcagaggagcccgggtgtacatcgcctgcagagatgtgctgaagggggagagcgctgccagcgagatccgggtggacaccaagaacagccaggtgctggtgaggaagctggacctgagtgacaccaagagcatccgggcctttgctgagggcttcctggccgaggagaagcagctgcacatcctgatcaacaatgctggggtgatgatgtgcccctacagcaagacagcagatggctttgagacccacctgggcgtgaaccacctgggccacttcctgctgacctacctgctgctggagcggctgaaggtgtctgccccagcccgggtggtgaatgtgtcctctgtggcccaccacatcggcaagatccccttccatgacctgcagagcgagaagcgctacagccggggctttgcctactgccacagcaagctggccaacgtgctcttcacccgggagctggccaagaggctgcagggcactggagtgaccacctatgctgtgcaccctggggtggtgcgctctgagctggtgcgccacagcagcctgctgtgcctgctgtggaggctcttcagcccctttgtgaagacagcccgggagggcgcccagaccagcctgcactgtgccctggccgagggcctggagcccctgagcggcaagtacttcagtgactgcaagaggacctgggtgagcccccgggccaggaacaacaagacagctgagcggctgtggaatgtgtcctgtgagctgctgggcatccgctgggagtag

SEQ ID NO: 167781 - DNA, 951 bp, Artificial Sequence; identical to SEQ ID NO: 167780
  Description of Artificial Sequence: Synthetic coding sequence

SEQ ID NO: 167782 - DNA, 951 bp, Artificial Sequence; identical to SEQ ID NO: 167780
  Description of Artificial Sequence: Synthetic coding sequence

SEQ ID NO: 167783 - DNA, 957 bp, Artificial Sequence
  Description of Artificial Sequence: Synthetic coding sequence
atgtggctgcccctgctgctgggcgccctgctgtgggccgtgctgtggctgctgcgggaccggcagagcctgcctgccagcaatgcctttgtgttcatcaccggctgtgacagcggcttcggccgcctgctggccctgcagctggaccagaggggcttccgggtgctggccagctgcctgaccccatctggagctgaggacctgcagagggtggccagcagccggctgcacaccaccctgctggacatcacagacccccagagcgtgcagcaggccgccaagtgggtggagatgcacgtgaaggaggccggcctgtttggcctggtgaacaatgctggggtggccggcatcatcggccccaccccctggctgaccagagatgacttccagagggtgctgaatgtgaacaccatgggccccatcggcgtgaccctggccctgctgcccctgctgcagcaggcccggggccgggtcatcaacatcacctctgtgctgggccgcctggccgccaatggaggcggctactgtgtgtccaagtttggcctggaggccttcagtgacagcctgcggagagatgtggcccacttcggcatccgggtgtccatcgtggagcccggcttcttccgcacccctgtgaccaacctggagagcctggagaagaccctgcaggcctgctgggcccggctgcccccagccacccaggcccactatggaggagccttcctgaccaagtacctgaagatgcagcagaggatcatgaacctgatctgtgaccctgacctgaccaaggtgagccgctgcctggagcacgccctgacagcccggcaccccaggacccgctacagccctggctgggatgccaagctgctgtggctgcctgccagctacctgcctgccagcctggtggatgctgtgctgacctgggtgctgcccaagccagcccaggccgtgtactag

SEQ ID NO: 167784 - DNA, 957 bp, Artificial Sequence; identical to SEQ ID NO: 167783
  Description of Artificial Sequence: Synthetic coding sequence

SEQ ID NO: 167785 - DNA, 936 bp, Artificial Sequence
  Description of Artificial Sequence: Synthetic coding sequence
atggctgctgcccccaggacagtgctgatcagcggctgcagcagcggcatcggcctggagctggccgtgcagctggcccatgaccccaagaagcgctaccaggtggtggccaccatgagggacctgggcaagaaggagaccctggaggccgccgccggggaggccctgggccagaccctgactgtggcccagctggatgtgtgcagtgatgagagcgtggcccagtgcctgagctgcatccagggcgaggtggatgtgctggtgaacaatgccggcatgggcctggtgggccccctggagggcctgagcctggccgccatgcagaatgtgtttgacaccaacttcttcggggctgtgcggctggtgaaggctgtgctgcccggcatgaagagaagacggcagggccacatcgtggtgatcagctctgtgatgggcctgcagggcgtcatcttcaatgatgtgtatgctgccagcaagtttgccctggagggcttctttgagagcctggccatccagctgctgcagttcaacatcttcatcagcctggtggagcccggccctgtggtgacagaatttgagggcaagctgctggcccaggtgtccatggccgagttccctggaacagatcctgagaccctgcactacttccgggacctgtacctgcctgccagcaggaagctgttctgcagcgtgggccagaacccccaggatgtggtgcaggccatcgtgaatgtcatcagcagcaccaggcctcccctgcggcggcagaccaacatccgctacagccccctgaccaccctgaagacagtggacagcagcggcagcctgtatgtgaggaccacccaccggctgctcttccgctgcccccggctgctgaacctgggcctgcagtgcctgagctgtggctgcctgcccaccagggtgcggcccaggtag

SEQ ID NO: 167786 - DNA, 675 bp, Artificial Sequence
  Description of Artificial Sequence: Synthetic coding sequence
atgagcaggaagattgagggcttcctgctgctgctgctgtttggctatgaggccaccctgggcctgagcagcacagaagatgaaggagaggacccctggtaccagaaggcctgcaagtgtgactgccagggcggccccaatgccctgtggagcgctggggccaccagcctggactgcatccctgagtgcccctaccacaagcccctgggctttgaaagtggagaggtgaccccagaccagatcacctgcagcaaccctgagcagtatgtgggctggtacagctcctggacagccaacaaggcccggctgaacagccagggcttcggctgtgcctggctgagcaagttccaggacagcagccagtggctgcagattgacctgaaggagatcaaggtgatcagcggcatcctgacccagggccgctgtgacattgatgagtggatgaccaagtacagcgtgcagtacagaacagatgagcggctgaactggatctactacaaggaccagacaggcaacaacagagtcttctacggcaacagcgacaggaccagcacagtgcagaacctgctgcggccccccatcatcagccgcttcatccgcctcatccccctgggctggcacgtgcgcatcgccatccgcatggagctgctggagtgtgtgtccaaatgtgcctag

SEQ ID NO: 167787 - DNA, 4077 bp, Artificial Sequence
  Description of Artificial Sequence: Synthetic coding sequence
atgattgagcccagcgaggacagctttgagaccatgatggagcacaagaaccccagcagcaagcagatggagagcagcgagggcagcagcaacaccacagaggccaccagcggcagcggcgtgcggggggaggccggccctgccagcggccctgcccaggagaagaaggagccccccagcggccccctgcaggagatggaggagctgcccacagacctgctgcaggacatggaggagcccagcagcggccccaggaaggagattgaagatcctccaaatgacctgctgcaggacctggaggagagctgcaatggcagccaccaggcccggggggaccccctgagcggggccagtgacaggatgaaggaggcctctgtgaaccccagcggggcccgggaggagcaggaggcccacacagacctgaaggagagcggccgggaggagaccccccaggagcagaaccagacagagcacagcacagctgagctgatggccatggtgcgcagcatcatcagcctgtacttcaggatgcaggacctgaaggagcagcagagggtggccgaggagatcctgatcaagggcatcaatgccggccagctgcctgcccccaagcacttcagcggggaccggcgggagttccacgagttcatcgtgctgtgccagctgaccctgcagagctaccccaggatgttctacaatgaccggctgcgggtgggctacgtgatcaaccacctgagcggcctggccctggagtgggccaaggccctgctgcaggagaacagccccctcatcggggacttccctgccttcctggaggccatgtctgaggtgtttgagtaccggcaggccctgcgggtggccgaggaggccatgttcaccatccggcagggcggccgcagcgccacagagtacattgatgagttccagagcctggtgcccatcctgggctggccagatgaggtgctgcaggcccacctgtgccagggcctgaatgaggagatccgccactacctgttccgggtgccccagcctgacagcctggacagcctgattgtgctgatcctgcagatcgaggagaagctggccgagcggcgggccatgctgcggctgcccccagaggcccggcccaggaacctgacctggattgacagccctgcccctgagcgctggatggtgtcctcctggctgcccagcgaggtgcacccagacatcaacagagcccacctgttcctgctgctgatggtgcgggtgaacccctaccacagcgtggccgtgcaggccctggtggacagcggggctgatggcaacttcatggatgagaagtttgcccaggagcactacgtggagctgtatgagaagccctacccccagcctgtgcagagcgtggatggcagcctgattggaaatgaacctgtgtggctgtacacagagcccctggtgtgcatccaccagaaccaccaggagagcattgaatttgacatcgtgcccagccccaacttctctgtggtgctgggcatccgctggctgcgggtgcacgcccctgaggtggactggatcaagggccgctgcaccttccacagcccctactgcctgaagaactgcttccggcccccaccaccctgcatcgccctggagagacatggcatgagcctgctgcccggcctgccccacccctacagcgacctggctgatgtgttcaaccccaaggaggctgatgatgagaccagtgaccagcccagcagtgatggcagtgatgacctgtctgagagcgagcccagcgagctgcagcaggccggggacagcgaccacagcgagaccttctatgaatgtcccagcacagccccctgggagcctgtgggcgccaggatgcaggagcgggcccggctgcaggaggagtactgggacctgcaggacatgctgaccaaccggcaggactacatccagatgatccctgagctgtttgaccagctgcacggggctgagtggttcaccaagctggagctgcggggcaccatcgtggaggagagcgtgaatggccacaggacagaagatgtgtggaaggccgccttcggcctggagctggaggagatgaagagctaccagccctttgccctgagcccagaccccatcatcccccagaatgtcatccacttcatcctgaaggacatgctgggcttctttgtgctgtcctatggccaggaggtgctgatctacagcatgagccaggaggagcacctgcaccacgtgcggcaggtgctggtgcgcttccgccaccacaacgtgtactgcagcctggacaagagccagttccaccggcagacagtggagttcctgggctttgtggtgacccccaagggcgtgaagctgaacaagaatgtgatgaccatcatcaccggctaccccaccccaggcagcaagctgagcctgaggaacttcattgaatttgtgttcccctaccgccactttgtggagcgcttcagcatcatcgccgagcccctggtgcggcagctgctgagcagctaccagttctactggggcgtggaggagcaggaggcctttgagtgcctgaagagggccttcaggaaggcccccctgctgcaccaccccaagccccagaaccccttctacctggagactggagtgactggaacagccctgcacgccagcctcatccagattgatgaccagacaggcaagagggcctgctgtgccttctacagcaggaacatcagccccatcgaggtggagtacagccaggccgagatgaagatcctgcccatccgggccgccttcatggtgtggtgccgctacctggagaacacagaggagcccatcatgatcctgctgaacacagaggacctggccagcctgaacaatgaccggctgactgtgctgctgcccggccactgggtgttcttcttcagccacttcaactttgatgtgatggagctgcctgagcaggacggcggccgggccctgccccctgtgaggaacctgcgctggaggcgggccttccagaggaacacagctgcccggcagaccctgctgctggccagccggggcttcccccgggaccccagcacagagagcggggaggaggagaatgaggagcaggatgagctgaatgagcagatcctgcggcaggagctgctggccatgatccccatcgaccagatcctgaacagcttcctggcccacttctccatggcccagatccgggccgtcatcctgcacttcttccggggcctgctgtactggaagaacaccctggccctggccgccatcctggtgctgctgcgggtgcggcagtgcctgagcctgcggcctgccccagccatgagggtggcccggccccagccccagaggagcctgcggctcatcctggacagcagcctgattgctggcagcagcatcaccacagccatcacccagctgctgacccagatgcctgccctggtgggcgccaacaccatcccagcccaggagctggccgagctgttcctgggccctggccgctggcagagaaatgccctgcacagccaggcccaccggggcctgcagttcaccccaggcttctggctgaccctgtgtgagttcttcggcgtgcgggtgaccccccaggagggccacctgcctgccctgcggcagaaccgctacctggagctgcacgtggtgggagatgaagatgtggtgctgcgggaggccctgcaggatgacctgcagcgctaccggcagtgtggcctgcatgatggcctgcaggacaccagccaggacaagcaggacaatgatgtgcaggaggccccacccagccacacagctgccacccaccccccccggcccaggcacctgatggacccccaggtgctggagttcctgggcagccggctgctgcacatccacagcgcagatggccagctgcacctgctgagccgggagcaggccgcccgggccctgagccagttcctgaccctcatctacagaagagccctgcccatcccagcctgggagagccagccccgggagcaggcccggctggaggagctgcctgatgaagatgaagatgccaacctggactag

SEQ ID NO: 167788 - DNA, 9393 bp, Artificial Sequence
  Description of Artificial Sequence: Synthetic coding sequence
atgttttctgtgcgcatcgtgacagctgactactacatggccagccccctgcagggcctggacacctgccagagccccctgacccaggcccctgtgaagaaggtgcctgtggtgcgggtgtttggagccaccccagctggccagaagacctgcctgcacctgcacggcatcttcccctacctgtatgtgccctatgatggctacggccagcagcctgagagctacctgagccagatggccttcagcattgaccgggccctgaatgtggccctgggcaaccccagcagcacagcccagcacgtgttcaaggtgtccctggtgtctggcatgcccttctacggctaccacgagaaggagcggcacttcatgaagatctacctgtacaaccccaccatggtgaagaggatctgtgagctgctgcagagcggggccatcatgaacaagttctaccagccccatgaggcccacatcccctacctgctgcagctgttcatcgactacaacctgtatggcatgaacctgatcaacctggccgctgtgaagttcaggaaggcccggaggaagagcaacaccctgcacgccaccggcagctgcaagaaccacctgagcggcaacagcctggccgacaccctcttccgctgggagcaggatgagatccccagcagcctcatcctggagggcgtggagccccagagcacctgtgagctggaggtggatgctgtggccgctgacatcctgaaccggctggacatcgaggcccagattggaggcaaccctggcctgcaggccatctgggaggatgagaagcagaggagaagaaacagaaatgagaccagccagatgagccagcctgagagccaggaccacagatttgtgcctgccacagaaagtgagaagaagttccagaagaggctgcaggagatcctgaagcagaatgacttctctgtgaccctgagcggctctgtggactacagtgatggcagccaggagttctctgctgagctgaccctgcacagcgaggtgctgagccctgagatgctgcagtgcaccccagccaacatggtggaggtgcacaaggacaaggagagcagcaagggccacaccaggcacaaggtggaggaggccctgatcaatgaggaggccatcctgaacctgatggagaacagccagaccttccagcccctgacccagaggctgtctgagagccctgtgttcatggacagcagcccagatgaggccctggtgcacctgctggccggcctggagagtgatggctacagaggagagaggaacaggatgcccagcccctgccgcagctttggaaacaacaagtacccccagaacagtgatgatgaagaaaatgagccccagatcgagaaggaggagatggagctgagcctggtgatgagccagcgctgggacagcaacatcgaggagcactgtgccaagaagaggagcctgtgcaggaacacccacaggagcagcacagaagatgatgacagcagcagtggagaggagatggagtggagcgacaacagcctgctgctggccagcctgagcatcccccagctggatggaacagcagatgagaacagcgacaaccccctgaacaatgaaaacagcaggacccacagcagcgtcatcgccaccagcaagctgtctgtgaagcccagcatcttccacaaggatgctgccaccctggagcccagcagcagcgccaagatcaccttccagtgcaagcacaccagcgccctgagcagccacgtgctgaacaaggaggacctgattgaggacctgagccagaccaacaagaacacagagaagggcctggacaacagcgtgaccagcttcaccaatgaaagcacctacagcatgaagtacccaggcagcctgagcagcacagtgcacagcgagaacagccacaaggagaacagcaagaaggagatcctgcctgtgagcagctgtgagagcagcatctttgattatgaggaggacatccccagcgtgacccggcaggtgcccagcaggaagtacaccaacatcaggaagattgagaaggacagccccttcatccacatgcaccgccaccccaatgaaaacaccctgggcaagaacagcttcaacttcagtgacctgaaccacagcaagaacaaggtgtcctctgagggcaatgagaagggcaacagcacagccctgagcagcctcttccccagcagcttcacagagaactgtgagctgctgagctgcagcggggagaacagaaccatggtgcacagcctgaacagcacagcagatgaaagtggcctgaacaagctgaagatccgctatgaggagttccaggagcacaagacagagaagcccagcctgagccagcaggccgcccactacatgttcttccccagcgtggtgctgagcaactgcctgacccggccccagaagctgagccctgtgacctacaagctgcagcccggcaacaagcccagccggctgaagctgaacaagaggaagctggccggccaccaggagaccagcaccaagagcagcgagaccggcagcaccaaggacaacttcatccagaacaacccctgcaacagcaaccctgagaaggacaatgccctggccagtgacctgaccaagaccaccaggggggcctttgagaacaagacccccacagatggcttcatcgactgccactttggagatggcaccctggagacagagcagagctttggcctgtatggcaacaagtacaccctgcgggccaagaggaaggtgaactatgaaacagaggacagcgagagcagctttgtgacccacaacagcaagatcagcctgccccaccccatggagattggagagagcctggatggcaccctgaagagcaggaagaggaggaagatgagcaagaagctgccccctgtgatcatcaagtacatcatcatcaaccgcttccggggcaggaagaacatgctggtgaagctgggcaagattgacagcaaggagaagcaggtgatcctgacagaggagaagatggagctgtacaagaagctggcccccctgaaggacttctggcccaaggtgcctgacagccctgccaccaagtaccccatctaccccctgacccccaagaagagccacaggaggaagagcaagcacaagagcgccaagaagaagacaggcaagcagcagaggaccaacaatgaaaacatcaagaggaccctgtccttcaggaagaagaggagccacgccatcctgagcccccccagccccagctacaatgctgagacagaggactgtgacctgaactacagtgatgtgatgagcaagctgggcttcctgtctgagaggagcaccagccccatcaacagcagccccccacgctgctggagccccacagaccccagggctgaggagatcatggctgctgctgagaaggaggccatgctgttcaagggccccaacgtgtacaagaagacagtgaacagccgcatcggcaagaccagccgggcccgggcccagatcaagaagagcaaggccaagctggccaaccccagcatcgtgaccaagaagaggaacaagaggaaccagaccaacaagctggtggatgatggcaagaagaagccccgggccaagcagaagaccaatgagaagggcaccagcaggaagcacaccaccctgaaggatgagaagatcaagagccagagcggggctgaggtgaagtttgtgctgaagcaccagaatgtgtctgaatttgccagcagcagcggcggcagccagctgctcttcaagcagaaggacatgcccctgatgggcagcgctgtggaccaccccctgagcgccagcctgcccaccggcatcaatgcccagcagaagctgagcggctgcttcagcagcttcctggagagcaagaagtctgtggacctgcagaccttccccagcagcagagatgacctgcaccccagcgtggtgtgcaacagcatcggccctggggtgtccaagatcaacgtgcagaggccccacaaccagagcgccatgttcaccctgaaggagagcaccctcatccagaagaacatctttgacctgagcaaccacctgagccaggtggcccagaacacccagatcagcagcggcatgagcagcaagattgaagataatgccaacaacatccagaggaactacctgagcagcatcggcaagctgtctgagtacagaaacagcctggagagcaagctggaccaggcctacacccccaacttcctgcactgcaaggacagccagcagcagatcgtgtgcatcgccgagcagagcaagcacagcgagacctgcagccctggcaacacagccagcgaggagagccagatgcccaacaactgctttgtgaccagcctgcggagccccatcaagcagatcgcctgggagcagaagcagaggggcttcatcctggacatgagcaacttcaagccagagcgggtgaagcccaggagcctgtctgaggccatcagccagaccaaggccctgagccagtgcaagaacagaaatgtgtccacccccagcgccttcggggagggccagagcggcctggccgtgctgaaggagctgctgcagaagaggcagcagaaggcccagaatgccaacaccacccaggaccccctgagcaacaagcaccagcccaacaagaacatcagcggcagcctggagcacaacaaggccaacaagaggaccaggtctgtgaccagccccaggaagcccaggacccccaggagcaccaagcagaaggagaagatccccaagctgctgaaggtggacagcctgaacctgcagaacagcagccagctggacaacagcgtgtctgatgacagccccatcttcttcagtgaccccggctttgagagctgctacagcctggaggacagcctgagccctgagcacaactacaactttgacatcaacaccatcggccagacaggcttctgcagcttctacagcggcagccagtttgtgcctgctgaccagaacctgccccagaagttcctgagtgatgctgtgcaggacctcttccctggccaggccatcgagaagaatgagttcctgagccatgacaaccagaagtgtgatgaggacaagcaccacaccacagacagcgcctcctggatccgcagcggcaccctgagccctgagatctttgagaagagcaccatcgacagcaatgaaaatagaagacacaaccagtggaagaacagcttccaccccctgaccaccaggagcaacagcatcatggacagcttctgtgtgcagcaggccgaggactgcctgtctgagaagagccggctgaacagaagctctgtgtccaaggaggtgttcctgagcctgccccagcccaacaacagcgactggatccagggccacaccaggaaggagatgggccagagcctggacagcgccaacaccagcttcaccgccatcctgagcagcccagatggagagctggtggatgtggcctgtgaggacctggagctgtatgtgtccagaaataatgacatgctgacccccaccccagacagcagccccaggagcaccagcagccccagccagagcaagaatggcagcttcacccccaggacagccaacatcctgaagcccctgatgagcccccccagccgggaggagatcatggccaccctgctggaccatgacctgtctgagaccatctaccaggagcccttctgcagcaaccccagtgatgtgcctgagaagccccgggagatcggcggccgcctgctgatggtggagacccggctggccaatgacctggccgagtttgaaggagacttcagcctggagggcctgcggctgtggaagacagccttcagcgccatgacccagaaccccaggcctggcagccccctgcggagcggccagggcgtggtgaacaagggcagcagcaacagccccaagatggtggaggacaagaagatcgtcatcatgccctgcaagtgtgcccccagccggcagctggtgcaggtgtggctgcaggccaaggaggagtatgaaagaagcaagaagctgcccaagaccaagcccaccggggtggtgaagtctgctgagaacttcagcagctctgtgaacccagatgacaagcctgtggtgccccccaagatggatgtgagcccctgcatcctgcccaccacagcccacaccaaggaggatgtggacaacagccagatcgccctgcaggcccccaccaccggctgcagccagacagccagcgagagccagatgctgccccctgtggccagcgccagtgaccctgagaaggatgaagatgatgatgacaactactacatctcctacagcagcccagacagccctgtgatccccccctggcagcagcccatcagcccagacagcaaggccctgaatggagatgaccggcccagcagccctgtggaggagctgcccagcctggcctttgagaacttcctgaagcccatcaaggatggcatccagaagagcccctgcagcgagccccaggagcccctggtgatcagccccatcaacacccgggccaggactggaaaatgtgagagcctgtgcttccacagcacccccatcatccagaggaagctgctggagcggctgcctgaggcccctggcctgagccccctgagcacagagcccaagacccagaagctgagcaacaagaagggcagcaacacagacaccctgcggcgggtgctgctgacccaggccaagaaccagtttgctgctgtgaacaccccccagaaggagaccagccagattgatggccccagcctgaacaacacctacggcttcaaggtgtccatccagaacctgcaggaggccaaggccctgcacgagatccagaacctgaccctcatctctgtggagctgcacgcccggacccggcgggacctggagccagaccctgagtttgaccccatctgtgccctcttctactgcatcagcagtgacacccccctgcctgacacagagaagacagagctgactggagtcatcgtcatcgacaaggacaagacagtgttcagccaggacatccgctaccagacccccctgctgatccgcagcggcatcaccggcctggaggtgacctatgctgctgatgagaaggccctcttccatgaaattgccaacatcatcaagagatatgaccctgacatcctgctgggctatgagatccagatgcacagctggggctacctgctgcagagagctgctgccctgagcattgacctgtgcaggatgatcagccgggtgcctgatgacaagattgagaacagatttgctgctgagagagatgaatatggcagctacaccatgtctgagatcaacatcgtgggccgcatcaccctgaacctgtggaggatcatgagaaatgaggtggccctgaccaactacacctttgaaaatgtgtccttccacgtgctgcaccagcgcttccccctcttcaccttccgggtgctgagtgactggtttgacaacaagacagacctgtaccgctggaagatggtggaccactacgtgtcccgggtgcggggcaacctgcagatgctggagcagctggacctgattggcaagaccagcgagatggcccggctgtttggcatccagttcctgcacgtgctgacccggggcagccagtacagagtggagagcatgatgctgcgcatcgccaagcccatgaactacatccctgtgacccccagcgtgcagcagaggagccagatgagggccccccagtgtgtgcccctcatcatggagcctgagagccgcttctacagcaacagcgtgctggtgctggacttccagagcctgtaccccagcatcgtcatcgcctacaactactgcttcagcacctgcctgggccacgtggagaacctgggcaagtatgatgagttcaagtttggctgcaccagcctgcgggtgcccccagacctgctgtaccaggtgagacatgacatcaccgtgagccccaacggggtggcctttgtgaagcccagcgtgaggaaaggagtgctgcccaggatgctggaggagatcctgaagacccgcttcatggtgaagcagagcatgaaggcctacaagcaggaccgggccctgagcaggatgctggatgcccggcagctgggcctgaagctgattgccaacgtgaccttcggctacaccagcgccaacttcagcggccgcatgccctgcatcgaggtgggggacagcatcgtgcacaaggcccgggagaccctggagcgggccatcaagctggtgaatgacaccaagaagtggggcgcccgggtggtgtatggagacacagacagcatgtttgtgctgctgaagggggccaccaaggagcagagcttcaagattggccaggagattgctgaggccgtgacagccaccaaccccaagcctgtgaagctgaagtttgagaaggtgtacctgccctgtgtgctgcagaccaagaagagatatgtgggctacatgtatgagaccctggaccagaaggaccctgtgtttgatgccaagggcattgaaacagtgagaagagacagctgcccagctgtgtccaagatcctggagaggagcctgaagctgctgtttgagacccgggacatcagcctcatcaagcagtatgtgcagaggcagtgcatgaagctgctggagggcaaggccagcatccaggacttcatctttgccaaggagtaccggggcagcttctcctacaagccaggggcctgtgtgcctgccctggagctgaccaggaagatgctgacctatgacagaagaagtgagccccaggtgggggagcgggtgccctacgtgatcatctacggcaccccaggagtgcccctcatccagctggtgagaagacctgtggaggtgctgcaggaccccaccctgcggctgaatgccacctactacatcaccaagcagatcctgccccccctggcccgcatcttcagcctgattggaattgatgtgttctcctggtaccacgagctgccccgcatccacaaggccaccagcagcagccgctctgagcctgagggcaggaagggcaccatcagccagtacttcaccaccctgcactgccctgtgtgtgatgacctgacccagcacggcatctgcagcaagtgccgcagccagccccagcacgtggccgtcatcctgaaccaggagatccgggagctggagcggcagcaggagcagctggtgaagatctgcaagaactgcaccggctgctttgacagacacatcccctgtgtgtccctgaactgccctgtgctcttcaagctgagccgggtgaaccgggagctgagcaaggccccctacctgcggcagctgctggaccagttctag

SEQ ID NO: 167789 - DNA, 9393 bp, Artificial Sequence; identical to SEQ ID NO: 167788
  Description of Artificial Sequence: Synthetic coding sequence

SEQ ID NO: 167790 - DNA, 9393 bp, Artificial Sequence; identical to SEQ ID NO: 167788
  Description of Artificial Sequence: Synthetic coding sequence

SEQ ID NO: 167791 - DNA, 9159 bp, Artificial Sequence
  Description of Artificial Sequence: Synthetic coding sequence
atggccttcagcattgaccgggccctgaatgtggccctgggcaaccccagcagcacagcccagcacgtgttcaaggtgtccctggtgtctggcatgcccttctacggctaccacgagaaggagcggcacttcatgaagatctacctgtacaaccccaccatggtgaagaggatctgtgagctgctgcagagcggggccatcatgaacaagttctaccagccccatgaggcccacatcccctacctgctgcagctgttcatcgactacaacctgtatggcatgaacctgatcaacctggccgctgtgaagttcaggaaggcccggaggaagagcaacaccctgcacgccaccggcagctgcaagaaccacctgagcggcaacagcctggccgacaccctcttccgctgggagcaggatgagatccccagcagcctcatcctggagggcgtggagccccagagcacctgtgagctggaggtggatgctgtggccgctgacatcctgaaccggctggacatcgaggcccagattggaggcaaccctggcctgcaggccatctgggaggatgagaagcagaggagaagaaacagaaatgagaccagccagatgagccagcctgagagccaggaccacagatttgtgcctgccacagaaagtgagaagaagttccagaagaggctgcaggagatcctgaagcagaatgacttctctgtgaccctgagcggctctgtggactacagtgatggcagccaggagttctctgctgagctgaccctgcacagcgaggtgctgagccctgagatgctgcagtgcaccccagccaacatggtggaggtgcacaaggacaaggagagcagcaagggccacaccaggcacaaggtggaggaggccctgatcaatgaggaggccatcctgaacctgatggagaacagccagaccttccagcccctgacccagaggctgtctgagagccctgtgttcatggacagcagcccagatgaggccctggtgcacctgctggccggcctggagagtgatggctacagaggagagaggaacaggatgcccagcccctgccgcagctttggaaacaacaagtacccccagaacagtgatgatgaagaaaatgagccccagatcgagaaggaggagatggagctgagcctggtgatgagccagcgctgggacagcaacatcgaggagcactgtgccaagaagaggagcctgtgcaggaacacccacaggagcagcacagaagatgatgacagcagcagtggagaggagatggagtggagcgacaacagcctgctgctggccagcctgagcatcccccagctggatggaacagcagatgagaacagcgacaaccccctgaacaatgaaaacagcaggacccacagcagcgtcatcgccaccagcaagctgtctgtgaagcccagcatcttccacaaggatgctgccaccctggagcccagcagcagcgccaagatcaccttccagtgcaagcacaccagcgccctgagcagccacgtgctgaacaaggaggacctgattgaggacctgagccagaccaacaagaacacagagaagggcctggacaacagcgtgaccagcttcaccaatgaaagcacctacagcatgaagtacccaggcagcctgagcagcacagtgcacagcgagaacagccacaaggagaacagcaagaaggagatcctgcctgtgagcagctgtgagagcagcatctttgattatgaggaggacatccccagcgtgacccggcaggtgcccagcaggaagtacaccaacatcaggaagattgagaaggacagccccttcatccacatgcaccgccaccccaatgaaaacaccctgggcaagaacagcttcaacttcagtgacctgaaccacagcaagaacaaggtgtcctctgagggcaatgagaagggcaacagcacagccctgagcagcctcttccccagcagcttcacagagaactgtgagctgctgagctgcagcggggagaacagaaccatggtgcacagcctgaacagcacagcagatgaaagtggcctgaacaagctgaagatccgctatgaggagttccaggagcacaagacagagaagcccagcctgagccagcaggccgcccactacatgttcttccccagcgtggtgctgagcaactgcctgacccggccccagaagctgagccctgtgacctacaagctgcagcccggcaacaagcccagccggctgaagctgaacaagaggaagctggccggccaccaggagaccagcaccaagagcagcgagaccggcagcaccaaggacaacttcatccagaacaacccctgcaacagcaaccctgagaaggacaatgccctggccagtgacctgaccaagaccaccaggggggcctttgagaacaagacccccacagatggcttcatcgactgccactttggagatggcaccctggagacagagcagagctttggcctgtatggcaacaagtacaccctgcgggccaagaggaaggtgaactatgaaacagaggacagcgagagcagctttgtgacccacaacagcaagatcagcctgccccaccccatggagattggagagagcctggatggcaccctgaagagcaggaagaggaggaagatgagcaagaagctgccccctgtgatcatcaagtacatcatcatcaaccgcttccggggcaggaagaacatgctggtgaagctgggcaagattgacagcaaggagaagcaggtgatcctgacagaggagaagatggagctgtacaagaagctggcccccctgaaggacttctggcccaaggtgcctgacagccctgccaccaagtaccccatctaccccctgacccccaagaagagccacaggaggaagagcaagcacaagagcgccaagaagaagacaggcaagcagcagaggaccaacaatgaaaacatcaagaggaccctgtccttcaggaagaagaggagccacgccatcctgagcccccccagccccagctacaatgctgagacagaggactgtgacctgaactacagtgatgtgatgagcaagctgggcttcctgtctgagaggagcaccagccccatcaacagcagccccccacgctgctggagccccacagaccccagggctgaggagatcatggctgctgctgagaaggaggccatgctgttcaagggccccaacgtgtacaagaagacagtgaacagccgcatcggcaagaccagccgggcccgggcccagatcaagaagagcaaggccaagctggccaaccccagcatcgtgaccaagaagaggaacaagaggaaccagaccaacaagctggtggatgatggcaagaagaagccccgggccaagcagaagaccaatgagaagggcaccagcaggaagcacaccaccctgaaggatgagaagatcaagagccagagcggggctgaggtgaagtttgtgctgaagcaccagaatgtgtctgaatttgccagcagcagcggcggcagccagctgctcttcaagcagaaggacatgcccctgatgggcagcgctgtggaccaccccctgagcgccagcctgcccaccggcatcaatgcccagcagaagctgagcggctgcttcagcagcttcctggagagcaagaagtctgtggacctgcagaccttccccagcagcagagatgacctgcaccccagcgtggtgtgcaacagcatcggccctggggtgtccaagatcaacgtgcagaggccccacaaccagagcgccatgttcaccctgaaggagagcaccctcatccagaagaacatctttgacctgagcaaccacctgagccaggtggcccagaacacccagatcagcagcggcatgagcagcaagattgaagataatgccaacaacatccagaggaactacctgagcagcatcggcaagctgtctgagtacagaaacagcctggagagcaagctggaccaggcctacacccccaacttcctgcactgcaaggacagccagcagcagatcgtgtgcatcgccgagcagagcaagcacagcgagacctgcagccctggcaacacagccagcgaggagagccagatgcccaacaactgctttgtgaccagcctgcggagccccatcaagcagatcgcctgggagcagaagcagaggggcttcatcctggacatgagcaacttcaagccagagcgggtgaagcccaggagcctgtctgaggccatcagccagaccaaggccctgagccagtgcaagaacagaaatgtgtccacccccagcgccttcggggagggccagagcggcctggccgtgctgaaggagctgctgcagaagaggcagcagaaggcccagaatgccaacaccacccaggaccccctgagcaacaagcaccagcccaacaagaacatcagcggcagcctggagcacaacaaggccaacaagaggaccaggtctgtgaccagccccaggaagcccaggacccccaggagcaccaagcagaaggagaagatccccaagctgctgaaggtggacagcctgaacctgcagaacagcagccagctggacaacagcgtgtctgatgacagccccatcttcttcagtgaccccggctttgagagctgctacagcctggaggacagcctgagccctgagcacaactacaactttgacatcaacaccatcggccagacaggcttctgcagcttctacagcggcagccagtttgtgcctgctgaccagaacctgccccagaagttcctgagtgatgctgtgcaggacctcttccctggccaggccatcgagaagaatgagttcctgagccatgacaaccagaagtgtgatgaggacaagcaccacaccacagacagcgcctcctggatccgcagcggcaccctgagccctgagatctttgagaagagcaccatcgacagcaatgaaaatagaagacacaaccagtggaagaacagcttccaccccctgaccaccaggagcaacagcatcatggacagcttctgtgtgcagcaggccgaggactgcctgtctgagaagagccggctgaacagaagctctgtgtccaaggaggtgttcctgagcctgccccagcccaacaacagcgactggatccagggccacaccaggaaggagatgggccagagcctggacagcgccaacaccagcttcaccgccatcctgagcagcccagatggagagctggtggatgtggcctgtgaggacctggagctgtatgtgtccagaaataatgacatgctgacccccaccccagacagcagccccaggagcaccagcagccccagccagagcaagaatggcagcttcacccccaggacagccaacatcctgaagcccctgatgagcccccccagccgggaggagatcatggccaccctgctggaccatgacctgtctgagaccatctaccaggagcccttctgcagcaaccccagtgatgtgcctgagaagccccgggagatcggcggccgcctgctgatggtggagacccggctggccaatgacctggccgagtttgaaggagacttcagcctggagggcctgcggctgtggaagacagccttcagcgccatgacccagaaccccaggcctggcagccccctgcggagcggccagggcgtggtgaacaagggcagcagcaacagccccaagatggtggaggacaagaagatcgtcatcatgccctgcaagtgtgcccccagccggcagctggtgcaggtgtggctgcaggccaaggaggagtatgaaagaagcaagaagctgcccaagaccaagcccaccggggtggtgaagtctgctgagaacttcagcagctctgtgaacccagatgacaagcctgtggtgccccccaagatggatgtgagcccctgcatcctgcccaccacagcccacaccaaggaggatgtggacaacagccagatcgccctgcaggcccccaccaccggctgcagccagacagccagcgagagccagatgctgccccctgtggccagcgccagtgaccctgagaaggatgaagatgatgatgacaactactacatctcctacagcagcccagacagccctgtgatccccccctggcagcagcccatcagcccagacagcaaggccctgaatggagatgaccggcccagcagccctgtggaggagctgcccagcctggcctttgagaacttcctgaagcccatcaaggatggcatccagaagagcccctgcagcgagccccaggagcccctggtgatcagccccatcaacacccgggccaggactggaaaatgtgagagcctgtgcttccacagcacccccatcatccagaggaagctgctggagcggctgcctgaggcccctggcctgagccccctgagcacagagcccaagacccagaagctgagcaacaagaagggcagcaacacagacaccctgcggcgggtgctgctgacccaggccaagaaccagtttgctgctgtgaacaccccccagaaggagaccagccagattgatggccccagcctgaacaacacctacggcttcaaggtgtccatccagaacctgcaggaggccaaggccctgcacgagatccagaacctgaccctcatctctgtggagctgcacgcccggacccggcgggacctggagccagaccctgagtttgaccccatctgtgccctcttctactgcatcagcagtgacacccccctgcctgacacagagaagacagagctgactggagtcatcgtcatcgacaaggacaagacagtgttcagccaggacatccgctaccagacccccctgctgatccgcagcggcatcaccggcctggaggtgacctatgctgctgatgagaaggccctcttccatgaaattgccaacatcatcaagagatatgaccctgacatcctgctgggctatgagatccagatgcacagctggggctacctgctgcagagagctgctgccctgagcattgacctgtgcaggatgatcagccgggtgcctgatgacaagattgagaacagatttgctgctgagagagatgaatatggcagctacaccatgtctgagatcaacatcgtgggccgcatcaccctgaacctgtggaggatcatgagaaatgaggtggccctgaccaactacacctttgaaaatgtgtccttccacgtgctgcaccagcgcttccccctcttcaccttccgggtgctgagtgactggtttgacaacaagacagacctgtaccgctggaagatggtggaccactacgtgtcccgggtgcggggcaacctgcagatgctggagcagctggacctgattggcaagaccagcgagatggcccggctgtttggcatccagttcctgcacgtgctgacccggggcagccagtacagagtggagagcatgatgctgcgcatcgccaagcccatgaactacatccctgtgacccccagcgtgcagcagaggagccagatgagggccccccagtgtgtgcccctcatcatggagcctgagagccgcttctacagcaacagcgtgctggtgctggacttccagagcctgtaccccagcatcgtcatcgcctacaactactgcttcagcacctgcctgggccacgtggagaacctgggcaagtatgatgagttcaagtttggctgcaccagcctgcgggtgcccccagacctgctgtaccaggtgagacatgacatcaccgtgagccccaacggggtggcctttgtgaagcccagcgtgaggaaaggagtgctgcccaggatgctggaggagatcctgaagacccgcttcatggtgaagcagagcatgaaggcctacaagcaggaccgggccctgagcaggatgctggatgcccggcagctgggcctgaagctgattgccaacgtgaccttcggctacaccagcgccaacttcagcggccgcatgccctgcatcgaggtgggggacagcatcgtgcacaaggcccgggagaccctggagcgggccatcaagctggtgaatgacaccaagaagtggggcgcccgggtggtgtatggagacacagacagcatgtttgtgctgctgaagggggccaccaaggagcagagcttcaagattggccaggagattgctgaggccgtgacagccaccaaccccaagcctgtgaagctgaagtttgagaaggtgtacctgccctgtgtgctgcagaccaagaagagatatgtgggctacatgtatgagaccctggaccagaaggaccctgtgtttgatgccaagggcattgaaacagtgagaagagacagctgcccagctgtgtccaagatcctggagaggagcctgaagctgctgtttgagacccgggacatcagcctcatcaagcagtatgtgcagaggcagtgcatgaagctgctggagggcaaggccagcatccaggacttcatctttgccaaggagtaccggggcagcttctcctacaagccaggggcctgtgtgcctgccctggagctgaccaggaagatgctgacctatgacagaagaagtgagccccaggtgggggagcgggtgccctacgtgatcatctacggcaccccaggagtgcccctcatccagctggtgagaagacctgtggaggtgctgcaggaccccaccctgcggctgaatgccacctactacatcaccaagcagatcctgccccccctggcccgcatcttcagcctgattggaattgatgtgttctcctggtaccacgagctgccccgcatccacaaggccaccagcagcagccgctctgagcctgagggcaggaagggcaccatcagccagtacttcaccaccctgcactgccctgtgtgtgatgacctgacccagcacggcatctgcagcaagtgccgcagccagccccagcacgtggccgtcatcctgaaccaggagatccgggagctggagcggcagcaggagcagctggtgaagatctgcaagaactgcaccggctgctttgacagacacatcccctgtgtgtccctgaactgccctgtgctcttcaagctgagccgggtgaaccgggagctgagcaaggccccctacctgcggcagctgctggaccagttctag

SEQ ID NO: 167792 - DNA, 2289 bp, Artificial Sequence
  Description of Artificial Sequence: Synthetic coding sequence
atggtggagacccggctggccaatgacctggccgagtttgaaggagacttcagcctggagggcctgcggctgtggaagacagccttcagcgccatgacccagaacccccggcccggcagccccctgcggagcggccagggcgtggtgaacaagggcagcagcaacagccccaagatggtggaggacaagaagatcgtcatcatgccctgcaagtgtgcccccagccggcagctggtgcaggtgtggctgcaggccaaggaggagtatgaaagaagcaagaagctgcccaagaccaagcccactggagtggtgaagtctgctgagaacttcagcagctctgtgaacccagatgacaagcctgtggtgccccccaagatggatgtgagcccctgcatcctgcccaccacagcccacaccaaggaggatgtggacaacagccagatcgccctgcaggcccccaccaccggctgcagccagacagccagcgagagccagatgctgccccctgtggccagcgccagtgaccctgagaaggatgaagatgatgatgacaactactacatctcctacagcagcccagacagccctgtgattcctccctggcagcagcccatcagcccagacagcaaggccctgaatggagatgaccggcccagcagccctgtggaggagctgcccagcctggcctttgagaacttcctgaagcccatcaaggatggcatccagaagagcccctgcagcgagccccaggagcccctggtgatcagccccatcaacacccgggccaggactggaaaatgtgagagcctgtgcttccacagcacccccatcatccagaggaagctgctggagcggctgcctgaggcccctggcctgagccccctgagcacagagcccaagacccagaagctgagcaacaagaagggcagcaacacagacaccctgcggcgggtgctgctgacccaggccaagaaccagtttgctgctgtgaacaccccccagaaggagaccagccagattgatggccccagcctgaacaacacctacggcttcaaggtgtccatccagaacctgcaggaggccaaggccctgcacgagatccagaacctgaccctcatctctgtggagctgcacgcccggacccggcgggacctggagccagaccctgagtttgaccccatctgtgccctcttctactgcatcagcagtgacacccccctgcctgacacagagaagacagagctgactggagtgattgtgattgacaaggacaagacagtgttcagccaggacatccgctaccagacccccctgctgatccgcagcggcatcaccggcctggaggtgacctacgccgcagatgagaaggccctcttccacgagatcgccaacatcatcaagagatatgaccctgacatcctgctgggctatgagatccagatgcacagctggggctacctgctgcagagagctgctgccctgagcattgacctgtgcaggatgatcagccgggtgcctgatgacaagattgaaaatagatttgctgctgagagagatgaatatggcagctacaccatgtctgagatcaacatcgtgggccgcatcaccctgaacctgtggaggatcatgagaaatgaggtggccctgaccaactacacctttgaaaatgtgtccttccacgtgctgcaccagcgcttccccctcttcaccttccgggtgctgagtgactggtttgacaacaagacagacctgtaccgctggaagatggtggaccactacgtgtcccgggtgcggggcaacctgcagatgctggagcagctggacctgattggcaagaccagcgagatggcccggctgtttggcatccagttcctgcacgtgctgacccggggcagccagtacagagtggagagcatgatgctgagaattgccaagcccatgaactacatccctgtgaccccatctgtgcagcagaggagccagatgagggccccccagtgtgtgcccctcatcatggagcctgagagccgcttctacagcaacagcgtgctggtgctggacttccagagcctgtaccccagcatcgtgattgcctacaactactgcttcagcacctgcctgggccacgtggagaacctgggcaagtatgatgagttcaagtttggctgcaccagcctgcgggtgcccccagacctgctgtaccaggtgagacatgacatcaccgtgagccccaatggagtggcctttgtgaagatcgccaacaagtgcaggcctgagggcatggcctag

SEQ ID NO: 167793 - DNA, 3666 bp, Artificial Sequence
  Description of Artificial Sequence: Synthetic coding sequence
atgctgcggagcacaggcttcttccgggccatcgactgcccctactggagcggggcccctgggggcccctgcagaagaccctactgccacttccgccacagaggagcccggggcagcggggcccctggagatggaggagaggcccctcctgctgctggcctgggctatgacccctacaaccctgagctgcccaagcccccagcccagagagaaaatggcaccctgggcctgggggaggagcccaggccagatgtgctggagctggagctggtgaaccaggccattgaagctgtgcgctctgaggtggagctggagcagaggcgctaccgggagctgctggagaccacccgggagcacaggtctgctgaggccccagccctggccccccggggccccaatgccagccccaccgtgggcccagatgaagatgccttccccctggcctttgactacagccctggcagccacggcctgctgagcccagatgctggctaccagcccacccccctggccgccccagctgagcccggcagcaagtacagcctggccagcctggaccggggccagggccggggcggcggcggcggcggggccctggagtatgtgcccaaggctgtgtcccagccccggcggcacagcaggcctgtgcccagcggcaagtatgtggtggacaacagccggcccccaacagacctggagtatgaccccctgagcaactacagcgcccggcacctgagccgggccagcagcagagatgaaagagctgccaagaggccccggggcagccggggcagcgagccctacaccccagcccccaagaagctgtgtgaccccttcggcagctgtgatgcccgcttcagtgacagtgaagatgaagctgccaccgtgcctggaaatgagcccaccacagccagcacccccaaggcccgggctgaccctgagatcaaggccaccggccagccccccagcaaggagggcctggaggccgagggcggcggcctgcgggagaccaaggagacagctgtgcagtgtgatgtgggggacctgcagcccccaccagccaagccagccagccctgcccaggtgcagagcagccaggacggcggctgccccaaggagggcaagcccaagaagaagaagacaggagcccccccagcccccagctgcaaggatggagcccagggcaaggacaagaccaaggacaagggccggggccggcctgtggagaagcccagggctgacaagaagggcccccaggccagcagccccaggaggaaggccgagaggcctgagggcaccaagaagaagcccagcagcgccacccctgtggccaccagcggcaagggccgcccagacaggcctgcccggcggcccagccccaccagcggggacagcaggcctgctgctggccggggccccccccggcccctgcagctgcctgacaggaagagcaccaaggcccccagcggcaagctggtggagaggaaggcccggagcctggatgaaggagccagccaggatgcccccaagctgaagaagagggccctgagccatgctgacctgtttggagatgaaagtgaagatgaggccgccggccctggggtgcccagcgtgtggcccagcgccctgcccagcctgagcagtgacagcgacagcgacagcgacagcagcctgggcttccctgaggcccagggcccccccaagaggctgaaggccagccccccacccagccctgcccccagcagcagcagcagcagcagcagcagcaccagcagcgctggagcagatgtggactacagcgccctggagaaggaggtggactttgacagcgaccccatggaggagtgcctgcgcatcttcaatgaaagcacctctgtgaagacagaagatcggggccgcctggcccggcagccccccaaggaggagaagtctgaggagaagggcctgagcggcctgaccaccctcttccctggccagaagaggcgcatcagccacctgagcaagcagggccaggaggtggagcccccaagaagaggccctgctgtgcccccagcccggcccccaacagcccaggaggtgtgctacctgcgggcccagcaggcccagagggccagcgccagcctgctgcaggccccagcccggctggccgagaagagccccagcgtgcacatcagcgcccctggagagaagagaagaattgcccacatccccaacccccggctggccgccgcccccaccggggccaagaggaccctggccgccagcggcagccagagcagcaatggacctgagcccggcggccagcagctgaagaccaggaccctgagcggcatggccagcaagaccaccaccaccatcatccccaagagaattgcccacagccccagcctgcagagcctgaagaagcccatcatccccaaggagtttggaggcaaggtgcccaccgtcatccggcagcgctacctgaacctcttcatcgaggagtgcctgaagttctgcaccagcaaccaggaggccatcgagaaggccctgaatgaggagaaggtggcctatgacaggagccccagcaagaacatctacctgaatgtggccgtgaacaccctgaagaagctgcggggcctggcccccagcgctgtgcccggcctgagcaagaccagcggccggcgggtggtgtcccatgaggtggtgctgggcggccgcctggccgccaagaccagcttcagcctgagccggcccagcagcccccgggtggaggacctgaagggagctgccctgtacagccggctgcgggagtacctgctgacccaggaccagctgaaggaaaatggctaccccttcccccaccctgagaggcctgggggcgccatcatcttcaccgctgaggagaagaggcccaaggacagcagctgcaggacctgctgccgctgtggcacagagtacctggtgagcagcagcggccgctgcatcagagatgaggagtgctactaccactggggccgcctgcggaggaacagagtggccggcggctgggagacccagtacatgtgctgcagcgctgctgctggctctgtgggctgccaggtggccaagcagcacgtgcaggacggcaggaaggagcggctggagggctttgtgaagacctttgagaaggagctgagcggggacacccaccctggcatctatgccctggactgtgagatgagctacaccacctacggcctggagctgaccagggtgacagtggtggacacagatgtgcacgtggtgtatgacacctttgtgaagccagacaatgagatcgtggactacaacacccgcttcagcggcgtgacagaagctgacctggccgacacctctgtgaccctgagagatgtgcaggccgtgctgctgtccatgttttctgctgacaccatcctgattggccacagcctggagagtgacctgctggccctgaaggtgatccacagcacagtggtggacacctctgtgctcttcccccaccggctgggcctgccctacaagaggagcctgaggaacctgatggctgactacctgcggcagatcatccaggacaacgtggatggccacagcagcagtgaagatgctggggcctgcatgcacctggtgatctggaaggtgagagaagatgccaagaccaagaggtag

SEQ ID NO: 167794 - DNA, 1014 bp, Artificial Sequence
  Description of Artificial Sequence: Synthetic coding sequence
atgctgcccagcagcacccggctgggctatgacccctacaaccctgagctgcccaagcccccagcccagagagaaaatggcaccctgggcctgggggaggagcccaggccagatgtgctggagctggagctggtgaaccaggccattgaagctgtgcgctctgaggtggagctggagcagaggcgctaccgggagctgctggagaccacccgggagcacaggtctgctgaggccccagccctggccccccggggccccaatgccagccccaccgtgggcccagatgaagatgccttccccctggcctttgactacagccctggcagccacggcctgctgagcccagatgctggctaccagcccacccccctggccgccccagctgagcccggcagcaagtacagcctggccagcctggaccggggccagggccggggcggcggcggcggcggggccctggagtatgtgcccaaggctgtgtcccagccccggcggcacagcaggcctgtgcccagcggcaagtatgtggtggacaacagccggcccccaacagacctggagtatgaccccctgagcaactacagcgcccggcacctgagccgggccagcagcagagatgaaagagctgccaagaggccccggggcagccggggcagcgagccctacaccccagcccccaagaagctgtgtgaccccttcggcagctgtgatgcccgcttcagtgacagtgaagatgaagctgccaccgtgcctggaaatgagcccaccacagccagcacccccaaggcccgggctgaccctgagatcaaggccaccggccagccccccagcaaggagggcctggaggccgagggcggcggcctgcgggagaccaaggagacagctgtgcagtgtgatgtgggggacctgcagcccccaccagccaagccagccagccctgcccaggtgcagagcagccaggacggcggctgccccaaggagggcaagcccaagaagaagaagacaggagcctag

SEQ ID NO: 167795 - DNA, 1482 bp, Artificial Sequence
  Description of Artificial Sequence: Synthetic coding sequence
atgggcagccacagcccctgtgcccacaccccctgtgcccccccagcccccaccggggccaagaggaccctggccgccagcggcagccagagcagcaatggacctgagcccggcggccagcagctgaagaccaggaccctgagcggcatggccagcaagaccaccaccaccatcatccccaagagaattgcccacagccccagcctgcagagcctgaagaagcccatcatccccaaggagtttggaggcaaggtgcccaccgtcatccggcagcgctacctgaacctcttcatcgaggagtgcctgaagttctgcaccagcaaccaggaggccatcgagaaggccctgaatgaggagaaggtggcctatgacaggagccccagcaagaacatctacctgaatgtggccgtgaacaccctgaagaagctgcggggcctggcccccagcgctgtgcccggcctgagcaagaccagcggccggcgggtggtgtcccatgaggtggtgctgggcggccgcctggccgccaagaccagcttcagcctgagccggcccagcagcccccgggtggaggacctgaagggagctgccctgtacagccggctgcgggagtacctgctgacccaggaccagctgaaggaaaatggctaccccttcccccaccctgagaggcctgggggcgccatcatcttcaccgctgaggagaagaggcccaaggacagcagctgcaggacctgctgccgctgtggcacagagtacctggtgagcagcagcggccgctgcatcagagatgaggagtgctactaccactggggccgcctgcggaggaacagagtggccggcggctgggagacccagtacatgtgctgcagcgctgctgctggctctgtgggctgccaggtggccaagcagcacgtgcaggacggcaggaaggagcggctggagggctttgtgaagacctttgagaaggagctgagcggggacacccaccctggcatctatgccctggactgtgagatgagctacaccacctacggcctggagctgaccagggtgacagtggtggacacagatgtgcacgtggtgtatgacacctttgtgaagccagacaatgagatcgtggactacaacacccgcttcagcggcgtgacagaagctgacctggccgacacctctgtgaccctgagagatgtgcaggccgtgctgctgtccatgttttctgctgacaccatcctgattggccacagcctggagagtgacctgctggccctgaaggtgatccacagcacagtggtggacacctctgtgctcttcccccaccggctgggcctgccctacaagaggagcctgaggaacctgatggctgactacctgcggcagatcatccaggacaacgtggatggccacagcagcagtgaagatgctggggcctgcatgcacctggtgatctggaaggtgagagaagatgccaagaccaagaggtag

SEQ ID NO: 167796 - DNA, 714 bp, Artificial Sequence
  Description of Artificial Sequence: Synthetic coding sequence
atgctgggcggcagcctgggcagccggctgctgcggggcgtgggcggcagccacggccgctttggagcccggggcgtgcgggagggcggggccgccatggctgctggggagagcatggcccagaggatggtgtgggtggacctggagatgacaggcctggacatcgagaaggaccagatcatcgagatggcctgcctgatcacagacagcgacctgaacatcctggccgagggccccaacctgatcatcaagcagccagatgagctgctggacagcatgtctgactggtgcaaggagcaccacggcaagagcggcctgaccaaggctgtgaaggagagcaccatcaccctgcagcaggccgagtatgagttcctgagctttgtgcggcagcagaccccacctggcctgtgccccctggccggcaacagcgtgcatgaggacaagaagttcctggacaagtacatgccccagttcatgaagcacctgcactaccgcatcattgatgtgtccacagtgaaggagctgtgccgccgctggtacccagaggagtatgaatttgcccccaagaaggccgccagccaccgggccctggatgacatcagcgagagcatcaaggagctgcagttctacagaaacaacatcttcaagaagaagattgatgagaagaagaggaagatcattgaaaatggagaaaatgagaagacagtgtcctag

SEQ ID NO: 167797 - DNA, 753 bp, Artificial Sequence
  Description of Artificial Sequence: Synthetic coding sequence
atgggcaaggccaaggtgcctgccagcaagagggcccccagcagccctgtggccaagccaggccctgtgaagaccctgaccaggaagaagaacaagaagaagaagcgcttctggaagagcaaggcccgggaggtgtccaagaagccagccagcggccctggagctgtggtgcggccccccaaggcccctgaggacttcagccagaactggaaggccctgcaggaggtgccccgctggacaggaggccggcagtacctggcccccaggcctgtggagcagagcaccatcaggaaggagcccaggaagggccagatggtgatcctcttccagaatgaaggcaccagcagcatccgcagcggcaagctgcggcggcagccccagccccaccccccccgggaggagctggaggtggtgcagaaggaggtggccgagatgctgaagggccgcatcctggtgggccacgccctgcacaatgacctgaaggtgctcttcctggaccaccccaagaagaagatccgggacacccagaagtacaagcccttcaagagccaggtgaagagcggccggcccagcctgcggctgctgtctgagaagatcctgggcctgcaggtgcagcaggccgagcactgcagcatccaggatgcccaggccgccatgaggctgtatgtgatggtgaagaaggagtgggagagcatggcccgggaccggcggcccctgctgacagccccagaccactgcagtgatgatgcctag

SEQ ID NO: 167798 - DNA, 1269 bp, Artificial Sequence
  Description of Artificial Sequence: Synthetic coding sequence
atgggcaaggccaaggtgcctgccagcaagagggcccccagcagccctgtggccaagccaggccctgtgaagaccctgaccaggaagaagaacaagaagaagaagcgcttctggaagagcaaggcccgggaggtgtccaagaagccagccagcggccctggagctgtggtgcggccccccaaggcccctgaggacttcagccagaactggaaggccctgcaggagtggctgctgaagcagaagagccaggcccctgagaagcccctggtgatcagccagatgggcagcaagaagaagcccaagatcatccagcagaacaagaaggagaccagcccccaggtgaagggggaggagatgcctgctgggaaggaccaggaggccagccggggctctgtgcccagcggcagcaagatggaccggcgggcccctgtgcccaggaccaaggccagcggcacagagcacaacaagaagggcaccaaggagaggaccaacggggacatcgtgcctgagcggggggacatcgagcacaagaagaggaaggccaaggaggccgccccagccccacccacagaggaggacatctggtttgatgatgtggaccctgctgacatcgaggccgccatcggccctgaggccgccaagatcgccaggaagcagctgggccagagcgagggctctgtgtccctgagcctggtgaaggagcaggcctttggaggcctgacccgggccctggccctggactgtgagatggtgggcgtgggccccaagggggaggagagcatggccgcccgggtgtccatcgtgaaccagtatggaaaatgtgtgtatgacaagtatgtgaagcccacagagcctgtgacagactacagaacagctgtgtctggcatccggcctgagaacctgaagcagggcgaggagctggaggtggtgcagaaggaggtggccgagatgctgaagggccgcatcctggtgggccacgccctgcacaatgacctgaaggtgctcttcctggaccaccccaagaagaagatccgggacacccagaagtacaagcccttcaagagccaggtgaagagcggccggcccagcctgcggctgctgtctgagaagatcctgggcctgcaggtgcagcaggccgagcactgcagcatccaggatgcccaggccgccatgaggctgtatgtgatggtgaagaaggagtgggagagcatggcccgggaccggcggcccctgctgacagccccagaccactgcagtgatgatgcctag

SEQ ID NO: 167799 - DNA, 570 bp, Artificial Sequence
  Description of Artificial Sequence: Synthetic coding sequence
atgggcagcaagaagaagcccaagatcatccagcagaacaagaaggagaccagcccccaggtgaagggggaggagatgcctgctgggaaggaccaggaggccagccggggctctgtgcccagcggcagcaagatggacagaagagcccctgtgcccaggaccaaggccagcggcacagagcacaacaagaagggcaccaaggagaggaccaatggagacatcgtgcctgagcggggggacatcgagcacaagaagaggaaggccaaggaggccgccccagccccacccacagaggaggacatctggtttgatgatgtggaccctgctgacattgaagctgccatcggccctgaggccgccaagatcgccaggaagcagctgggccagagcgagggctctgtgtccctgagcctggtgaaggagcaggccttcggcggcctgacccgggccctggccctggactgtgagatggtgggcgtgggccccaagggggaggagagcatggccgcccgggtgtccatcgtgaaccagtatggaaaatgtgtgtatgacaagtatgtgaagccctag

SEQ ID NO: 167800 - DNA, 1125 bp, Artificial Sequence
  Description of Artificial Sequence: Synthetic coding sequence
cctgtggccaagccaggccctgtgaagaccctgaccaggaagaagaacaagaagaagaagcgcttctggaagagcaaggcccgggaggtgtccaagaagccagccagcggccctggagctgtggtgcggccccccaaggcccctgaggacttcagccagaactggaaggccctgcaggagtggctgctgaagcagaagagccaggcccctgagaagcccctggtgatcagccagatgggcagcaagaagaagcccaagatcatccagcagaacaagaaggagaccagcccccaggtgaagggggaggagatgcctgctgggaaggaccaggaggccagccggggctctgtgcccagcggcagcaagatggacagaagagcccctgtgcccaggaccaaggccagcggcacagagcacaacaagaagggcaccaaggagaggaccaatggagacatcgtgcctgagcggggggacatcgagcacaagaagaggaaggccaaggaggccgccccagccccacccacagaggaggacatctggtttgatgatgtggaccctgctgacattgaagctgccatcggccctgaggccgccaagatcgccaggaagcagctgggccagagcgagggctctgtgtccctgagcctggtgaaggagcaggccttcggcggcctgacccgggccctggccctggactgtgagatggtgggcgtgggccccaagggggaggagagcatggccgcccgggtgtccatcgtgaaccagtatggaaaatgtgtgtatgacaagtatgtgaagcccacagagcctgtgacagactacagaacagctgtgtctggcatccggcctgagaacctgaagcagggcgaggagctggaggtggtgcagaaggaggtggccgagatgctgaagggccgcatcctggtgggccacgccctgcacaatgacctgaagagcggccggcccagcctgcggctgctgtctgagaagatcctgggcctgcaggtgcagcaggacagcggctgccccggcagcaatgaggccgtgagacatggagaggagggcgtgggggagcacggcccccggcaggcccctcctgctgactgcagccggcccctgcagtag

SEQ ID NO: 167801 - DNA, 702 bp, Artificial Sequence
  Description of Artificial Sequence: Synthetic coding sequence
atgggcaaggccaaggtgcctgccagcaagagggcccccagcagccctgtggccaagccaggccctgtgaagaccctgaccaggaagaagaacaagaagaagaagcgcttctggaagagcaaggcccgggaggtgtccaagaagccagccagcggccctggagctgtggtgcggccccccaaggcccctgaggacttcagccagaactggaaggccctgcaggaggtgccccgctggacaggaggccggcagtacctggcccccaggcctgtggagcagagcaccatcaggaaggagcccaggaagggccagatggtgatcctcttccagaatgaaggcaccagcagcatccgcagcggcaagctgcggcggcagccccagccccaccccccccgggaggagctggaggtggtgcagaaggaggtggccgagatgctgaagggccgcatcctggtgggccacgccctgcacaatgacctgaaggtgctcttcctggaccaccccaagaagaagatccgggacacccagaagtacaagcccttcaagagccaggtgaagagcggccggcccagcctgcggctgctgtctgagaagatcctgggcctgcaggtgcagcaggccgagcactgcagcatccaggatgcccaggccgccatgaggctgtatgtgatggtgaagaaggagtgggagagcatggcctag

SEQ ID NO: 167802 - DNA, 996 bp, Artificial Sequence
  Description of Artificial Sequence: Synthetic coding sequence
atgagccgggcccggggggccctgtgccgggcctgcctggccctggccgccgccctggccgccctgctgctgctgcccctgcccctgccccgggccccagccccagcccggaccccagccccagccccccgggccccacccagcaggcctgctgcccccagcctgcggccagatgatgtgttcatcgctgtgaagaccaccaggaagaaccacggcccccggctgcggctgctgctgcggacctggatcagccgggcccggcagcagaccttcatcttcacagatggagatgatcctgagctggagctgcagggcggggacagagtcatcaacaccaactgcagcgctgtgaggacccggcaggccctgtgctgcaagatgtctgtggagtatgacaagttcattgaaagtggcaggaagtggttctgccacgtggatgatgacaactacgtgaatgcccggagcctgctgcacctgctgagcagcttcagccccagccaggatgtgtacctgggccggcccagcctggaccaccccatcgaggccacagagcgggtgcagggcggccgcacagtgaccaccgtgaagttctggtttgccactggaggagctggcttctgcctgagccggggcctggccctgaagatgagcccctgggccagcctgggcagcttcatgagcacagctgagcaggtgcggctgcctgatgactgcaccgtgggctacatcgtggagggcctgctgggcgcccggctgctgcacagccccctcttccacagccacctggagaacctgcagaggctgcccccagacaccctgctgcagcaggtgaccctgagccatggaggccctgagaacccccacaacgtggtgaatgtggccggcggcttcagcctgcaccaggaccccacccgcttcaagagcatccactgcctgctgtacccagacacagactggtgcccccggcagaagcagggcgcccccaccagcaggtag

SEQ ID NO: 167803 - DNA, 873 bp, Artificial Sequence
  Description of Artificial Sequence: Synthetic coding sequence
atgagccgggccccacccagcaggcctgctgcccccagcctgcggccagatgatgtgttcatcgctgtgaagaccaccaggaagaaccacggcccccggctgcggctgctgctgcggacctggatcagccgggcccggcagcagaccttcatcttcacagatggagatgatcctgagctggagctgcagggcggggacagagtcatcaacaccaactgcagcgctgtgaggacccggcaggccctgtgctgcaagatgtctgtggagtatgacaagttcatcgagagcggcaggaagtggttctgccacgtggatgatgacaactacgtgaatgcccggagcctgctgcacctgctgagcagcttcagccccagccaggatgtgtacctgggccggcccagcctggaccaccccatcgaggccacagagcgggtgcagggcggccgcacagtgaccaccgtgaagttctggtttgccaccggcggggccggcttctgcctgagccggggcctggccctgaagatgagcccctgggccagcctgggcagcttcatgagcacagctgagcaggtgcggctgcctgatgactgcaccgtgggctacatcgtggagggcctgctgggcgcccggctgctgcacagccccctcttccacagccacctggagaacctgcagaggctgcccccagacaccctgctgcagcaggtgaccctgagccacggcggccctgagaacccccacaacgtggtgaatgtggccggcggcttcagcctgcaccaggaccccacccgcttcaagagcatccactgcctgctgtacccagacacagactggtgcccccggcagaagcagggcgcccccaccagcaggtag

SEQ ID NO: 167804 - DNA, 1626 bp, Artificial Sequence
  Description of Artificial Sequence: Synthetic coding sequence
atgggcagccaggaggtgctgggccacgccgcccggctggccagcagcggcctgctgctgcaggtgctcttccgcctcatcacctttgtgctgaatgccttcatcctgcgcttcctgagcaaggagatcgtgggcgtggtgaatgtgcggctgaccctgctgtacagcaccaccctcttcctggcccgggaggccttcagaagagcctgcctgagcggcggcacccagagggactggagccagaccctgaacctgctgtggctgactgtgcccctgggcgtcttctggagcctcttcctgggctggatctggctgcagctgctggaggtgcctgaccccaacgtggtgccccactacgccactggagtggtgctgtttggcctgtctgctgtggtggagctgctgggggagcccttctgggtgctggcccaggcccacatgtttgtgaagctgaaggtgattgctgagagcctgagcgtcatcctgaagtctgtgctgacagccttcctggtgctgtggctgccccactggggcctgtacatcttcagcctggcccagctgttctacaccaccgtgctggtgctgtgctacgtgatctacttcaccaagctgctgggcagccctgagagcaccaagctgcagaccctgcctgtgagccgcatcacagacctgctgcccaacatcaccagaaatggagccttcatcaactggaaggaggccaagctgacctggagcttcttcaagcagagcttcctgaagcagatcctgacagaaggagagcgctacgtgatgaccttcctgaatgtgctgaactttggagaccagggcgtgtatgacatcgtgaacaacctgggcagcctggtggcccggctcatcttccagcccatcgaggagagcttctacatcttctttgccaaggtgctggagcggggcaaggatgccaccctgcagaagcaggaggatgtggccgtggccgctgctgtgctggagagcctgctgaagctggccctgctggccggcctgaccatcaccgtgtttggatttgcctacagccagctggccctggacatctacggcggcaccatgctgagcagcggcagcggccctgtgctgctgcggagctactgcctgtatgtgctgctgctggccatcaatggagtgacagagtgcttcacctttgctgccatgagcaaggaggaggtggaccgctacaactttgtgatgctggccctgagcagcagcttcctggtgctgagctacctgctgacccgctggtgtggctctgtgggcttcatcctggccaactgcttcaacatgggcatccgcatcacccagagcctgtgcttcatccaccgctactacagaagaagcccccaccggcccctggccggcctgcacctgagccctgtgctgctgggcacctttgccctgagcggcggcgtgacagctgtgtctgaggtgttcctgtgctgtgagcagggctggccagcccggctggcccacatcgctgtgggcgccttctgcctgggcgccaccctgggcacagccttcctgacagagaccaagctgatccacttcctgcggacccagctgggcgtgcccaggagaacagacaagatgacctag

SEQ ID NO: 167805 - DNA, 1509 bp, Artificial Sequence
  Description of Artificial Sequence: Synthetic coding sequence
atgggcagccaggaggtgctgggccacgccgcccggctggccagcagcggcctgctgctgcaggtgctcttccgcctcatcacctttgtgctgaatgccttcatcctgcgcttcctgagcaaggagatcgtgggcgtggtgaatgtgcgggtgcccctgggcgtcttctggagcctcttcctgggctggatctggctgcagctgctggaggtgcctgaccccaacgtggtgccccactacgccaccggggtggtgctgtttggcctgtctgctgtggtggagctgctgggggagcccttctgggtgctggcccaggcccacatgtttgtgaagctgaaggtgattgctgagagcctgagcgtcatcctgaagtctgtgctgacagccttcctggtgctgtggctgccccactggggcctgtacatcttcagcctggcccagctgttctacaccaccgtgctggtgctgtgctacgtgatctacttcaccaagctgctgggcagccctgagagcaccaagctgcagaccctgcctgtgagccgcatcacagacctgctgcccaacatcaccagaaatggagccttcatcaactggaaggaggccaagctgacctggagcttcttcaagcagagcttcctgaagcagatcctgacagaaggagagagatatgtgatgaccttcctgaatgtgctgaactttggagaccagggcgtgtatgacatcgtgaacaacctgggcagcctggtggcccggctcatcttccagcccatcgaggagagcttctacatcttctttgccaaggtgctggagcggggcaaggatgccaccctgcagaagcaggaggatgtggccgtggccgctgctgtgctggagagcctgctgaagctggccctgctggccggcctgaccatcaccgtgtttggatttgcctacagccagctggccctggacatctatggaggcaccatgctgagcagcggcagcggccctgtgctgctgcggagctactgcctgtatgtgctgctgctggccatcaacggggtgacagagtgcttcacctttgctgccatgagcaaggaggaggtggaccgctacaactttgtgatgctggccctgagcagcagcttcctggtgctgagctacctgctgacccgctggtgtggctctgtgggcttcatcctggccaactgcttcaacatgggcatccgcatcacccagagcctgtgcttcatccaccgctactaccgccgcagcccccaccggcccctggccggcctgcacctgagccctgtgctgctgggcacctttgccctgtctggaggagtgacagctgtgtctgaggtgttcctgtgctgtgagcagggctggccagcccggctggcccacatcgctgtgggcgccttctgcctgggcgccaccctgggcacagccttcctgacagagaccaagctgatccacttcctgcggacccagctgggcgtgcccaggagaacagacaagatgacctag

SEQ ID NO: 167806 - DNA, 4308 bp, Artificial Sequence
  Description of Artificial Sequence: Synthetic coding sequence
atggcccagaccccagatggcatcagctgtgagctgcggggggagatcacccgcttcctgtggcccaaggaggtggagctgctgctgaagacctggctgcccggggagggcgctgtgcagaaccacgtgctggccctgctgcgctggagggcctacctgctgcacaccacctgcctgcccctgcgggtggactgcaccttctcctacctggaggtgcaggccatggccctgcaggagaccccaccccaggtgacctttgagctggagagcctgcgggagctggtgctggagttccctggggtggccgccctggagcagctggcccagcacgtggccgccgccatcaagaaggtgttccccaggagcaccctgggcaagctgttcagaagacccaccccagcctccatgctggcccggctggagaggagcagccccagcgagagcacagacccctgcagcccctgtggcggcttcctggagacctatgaggccctgtgtgactacaacggcttccccttccgggaggagatccagtgggatgtggacaccatctaccaccggcagggctgccgccacttcagcctgggggacttcagccacctgggcagccgggacctggccctgtctgtggccgccctgagctacaacctgtggttccgctgcctgagctgtgtggacatgaagctgagcctggaggtgtctgagcagatcctgcacatgatgagccagagcagccacctggaggagctggtgctggagacctgcagcctgcggggggactttgtgcggcggctggcccaggccctggccggccacagcagcagcggcctgcgggagctgagcctggccggcaacctgctggatgaccggggcatgacagccctgagccgccacctggagcgctgccctggggccctgcggcggctgagcctggcccagacaggcctgaccccccggggcatgagggccctgggccgggccctggccaccaatgctgcctttgacagcaccctgacccacctggacctgagcggcaaccctggggccctgggcgccagcgaggacagcggcggcctgtacagcttcctgagccggcccaacgtgctgtccttcctgaacctggccggcacagacacagccctggacacagtgcggggctgcagcgtgggcggctggatgacaggccgggctgactggagggctggccggggcggcctgggccccccagctggggtggccaacagcctgcccccccagctgtttgctgctgtgtcccggggctgctgcaccagcctgacccacctggatgccagcagaaatgtgttcagcaggaccaagagcagagctgccccagctgccctgcagctgttcctgagccgggcccggaccctgcggcacctgggcctggccggctgcaagctgcccccagatgccctgcgggccctgctggatggcctggccctgaacacccacctgcgggacctgcacctggacctgagcgcctgtgagctgcggtctgctggggcccaggtgatccaggacctggtgtgtgatgctggagctgtgagcagcctggacctggccgacaatggcttcggcagtgacatggtgaccctggtgctggccatcggccgcagccgcagcctgcggcacgtggccctgggcaggaacttcaacgtgcgctgcaaggagaccctggatgatgtgctgcacagaattgtgcagctgatgcaggatgatgactgccccctgcagagcctgtctgtggccgagagccggctgaagctgggcgcctctgtgctgctgcgggccctggccaccaaccccaacctgacagccctggacatctctggaaatgccatgggagatgctggggccaagctgctggccaaggccctgcgggtgaacagccggctgcggtctgtggtgtgggacaggaaccacaccagcgccctgggcctgctggatgtggcccaggccctggagcagaaccacagcctgaaggccatgcccctgcccctgaatgatgtggcccaggcccagaggagcaggcctgagctgacagcccgggctgtgcaccagatccaggcctgcctgctgaggaacaacagagctgaccctgccagcagtgaccacaccacccggctgcagcccctgggcctggtgtctgaccccagcgagcaggaggtgaatgagctgtgccagagcgtgcaggagcacgtggagctgctgggctgtggggccggcccccagggcgaggccgctgtgcggcaggccgaggatgccatccagaatgccaacttcagcctgagcatcctgcccatcctgtatgaagctggcagcagccccagccaccactggcagctgggccagaagctggagggcctgctgcggcaggtgggggaggtgtgccggcaggacatccaggacttcacccaggccaccctggacacagcccggagcctgtgcccccagatgctgcagggcagctcctggagggagcagctggagggcgtgctggccggcagccggggcctgcctgagctgctgcctgagcagctgctgcaggatgccttcacccggctgcgggacatgaggctgagcatcaccggcaccctggccgagagcatcgtggcccaggccctggccggcctgtctgctgcccgggaccagctggtggagagcctggcccagcaggccaccgtgaccatgcccccagccctgcctgccccagatggaggagagcccagcctgctggagcctggagagctggagggcctcttcttccctgaggagaaggaggaggagaaggagaaggatgacagccccccccagaagtggccagagctgagccacggcctgcacctggtgcccttcatccacagcgctgctgaggaggccgagcctgagcctgagctggccgcccctggagaagatgctgagccccaggccggccccagcgcccggggcagccccagccctgctgcccctggccccccagctggccccctgcccaggatggacctgcccctggccggccagcccctgcggcaccccacccgggcccggccccggccccggcggcagcaccaccaccggcccccacctgggggcccccaggtgcccccagccctgccccaggagggcaatggcctgagcgcccgggtggatgaaggagtggaggagttcttcagcaagaggctcatccagcaggaccggctgtgggccccagaagaagatcctgccacagaaggaggagccacccctgtgcccaggaccctgaggaagaagctgggcaccctgtttgccttcaagaagcccaggagcacccggggccccaggacagacctggagaccagccctggagctgcccccaggaccaggaagaccaccttcggggacctgctgcggccccccacccggcccagcagaggagaggagctgggcggcgctgagggggacaccagcagcccagaccctgctggccgcagccggccccgctacacccgggacagcaaggcctacagcatgatcctgctgcctgctgaggaggaggccaccctgggcgcccggccagacaagagaagacccctggagcggggggagacagagctggcccccagctttgagcagagggtgcaggtgatgctgcagagaattggagtgtcccggggcagcggcggcgctgagggcaagaggaagcagagcaaggatggagagatcaagaaggccggcagtgatggagacatcatggacagcagcacagaggccccacccatcagcatcaagagcaggacccacagcgtgtctgctgaccccagctgcaggcctggccctggcagccagggccctgagagcgccacctggaagaccctgggccagcagctgaatgctgagctgcggagccggggctggggccagcaggacggccctggcccccccagccctggccagagccccagcccctgcaggaccagccccagcccagacagcctgggcctgcctgaggacccctgcctgggccccagaaatgaagatggccagctgcggccccggcccctgtctgctggccggcgggctgtgtctgtgcatgaggaccagctgcaggccccagctgagcggcccctgcggctgcagaggagccctgtgctgaagaggcggcccaagctggaggccccacccagccccagcctgggcagcggcctgggcacagagcccctgcccccccagcccacagagcccagcagccctgagaggagcccccccagccctgccacagaccagaggggcggcggccccaacccctag

SEQ ID NO: 167807 - DNA, 1335 bp, Artificial Sequence
  Description of Artificial Sequence: Synthetic coding sequence
atgcccccagccctgcctgccccagatggaggagagcccagcctgctggagcccggggagctggagggcctcttcttccctgaggagaaggaggaggagaaggagaaggatgacagccccccccagaagtggccagagctgagccacggcctgcacctggtgcccttcatccacagcgctgctgaggaggccgagcctgagcctgagctggccgcccctggagaagatgctgagccccaggccggccccagcgcccggggcagccccagccctgctgcccctggccccccagctggccccctgcccaggatggacctgcccctggccggccagcccctgcggcaccccacccgggcccggccccggccccggcggcagcaccaccacaggcctcctcctgggggcccccaggtgcccccagccctgccccaggagggcaatggcctgagcgcccgggtggatgagggcgtggaggagttcttcagcaagaggctcatccagcaggaccggctgtgggcccctgaggaggaccctgccacagagggcggggccacccctgtgcccaggaccctgaggaagaagctgggcaccctgtttgccttcaagaagcccaggagcacccggggccccaggacagacctggagaccagccctggggccgcccccaggaccaggaagaccacctttggagacctgctgcggccccccacccggcccagcagaggagaggagctgggcggcgctgagggggacaccagcagcccagaccctgctggccgcagccggccccgctacacccgggacagcaaggcctacagcatgatcctgctgcctgctgaggaggaggccaccctgggcgcccggccagacaagaggcggcccctggagcggggggagacagagctggcccccagctttgagcagagggtgcaggtgatgctgcagagaattggagtgtcccggggcagcggcggcgctgagggcaagaggaagcagagcaaggatggagagatcaagaaggccggcagtgatggagacatcatggacagcagcacagaggccccacccatcagcatcaagagcaggacccacagcgtgtctgctgaccccagctgccggcccggccctggcagccagggccctgagagcgccacctggaagaccctgggccagcagctgaatgctgagctgcggagccggggctggggccagcaggacggccctggcccccccagccctggccagagccccagcccctgcaggaccccaccccagacagcctgggccagccagaggaccctggcctgggcccctgagatgaagaatggcccctag

SEQ ID NO: 167808 - DNA, 4119 bp, Artificial Sequence
  Description of Artificial Sequence: Synthetic coding sequence
atggcccagaccccagatggcatcagctgtgagctgcggggggagatcacccgcttcctgtggcccaaggaggtggagctgctgctgaagacctggctgcccggggagggcgctgtgcagaaccacgtgctggccctgctgcgctggagggcctacctgctgcacaccacctgcctgcccctgcgggtggactgcaccttctcctacctggaggtgcaggccatggccctgcaggagaccccaccccaggtgacctttgagctggagagcctgcgggagctggtgctggagttccctggggtggccgccctggagcagctggcccagcacgtggccgccgccatcaagaaggtgttccccaggagcaccctgggcaagctgttcagaagacccaccccagcctccatgctggcccggctggagaggagcagccccagcgagagcacagacccctgcagcccctgtggcggcttcctggagacctatgaggccctgtgtgactacaacggcttccccttccgggaggagatccagtgggatgtggacaccatctaccaccggcagggctgccgccacttcagcctgggggacttcagccacctgggcagccgggacctggccctgtctgtggccgccctgagctacaacctgtggttccgctgcctgagctgtgtggacatgaagctgagcctggaggtgtctgagcagatcctgcacatgatgagccagagcagccacctggaggagctggtgctggagacctgcagcctgcggggggactttgtgcggcggctggcccaggccctggccggccacagcagcagcggcctgcgggagctgagcctggccggcaacctgctggatgaccggggcatgacagccctgagccgccacctggagcgctgccctggggccctgcggcggctgagcctggcccagacaggcctgaccccccggggcatgagggccctgggccgggccctggccaccaatgctgcctttgacagcaccctgacccacctggacctgagcggcaaccctggggccctgggcgccagcgaggacagcggcggcctgtacagcttcctgagccggcccaacgtgctgtccttcctgaacctggccggcacagacacagccctggacaccctgtttgctgctgtgtcccggggctgctgcaccagcctgacccacctggatgccagcagaaatgtgttcagcaggaccaagagcagagctgccccagctgccctgcagctgttcctgagccgggcccggaccctgcggcacctgggcctggccggctgcaagctgcccccagatgccctgcgggccctgctggatggcctggccctgaacacccacctgcgggacctgcacctggacctgagcgcctgtgagctgcggtctgctggggcccaggtgatccaggacctggtgtgtgatgctggagctgtgagcagcctggacctggccgacaatggcttcggcagtgacatggtgaccctggtgctggccatcggccgcagccgcagcctgcggcacgtggccctgggcaggaacttcaacgtgcgctgcaaggagaccctggatgatgtgctgcacagaattgtgcagctgatgcaggatgatgactgccccctgcagagcctgtctgtggccgagagccggctgaagctgggcgcctctgtgctgctgcgggccctggccaccaaccccaacctgacagccctggacatctctggaaatgccatgggagatgctggggccaagctgctggccaaggccctgcgggtgaacagccggctgcggtctgtggtgtgggacaggaaccacaccagcgccctgggcctgctggatgtggcccaggccctggagcagaaccacagcctgaaggccatgcccctgcccctgaatgatgtggcccaggcccagaggagcaggcctgagctgacagcccgggctgtgcaccagatccaggcctgcctgctgaggaacaacagagctgaccctgccagcagtgaccacaccacccggctgcagcccctgggcctggtgtctgaccccagcgagcaggaggtgaatgagctgtgccagagcgtgcaggagcacgtggagctgctgggctgtggggccggcccccagggcgaggccgctgtgcggcaggccgaggatgccatccagaatgccaacttcagcctgagcatcctgcccatcctgtatgaagctggcagcagccccagccaccactggcagctgggccagaagctggagggcctgctgcggcaggtgggggaggtgtgccggcaggacatccaggacttcacccaggccaccctggacacagcccggagcctgtgcccccagatgctgcagggcagctcctggagggagcagctggagggcgtgctggccggcagccggggcctgcctgagctgctgcctgagcagctgctgcaggatgccttcacccggctgcgggacatgaggctgagcatcaccggcaccctggccgagagcatcgtggcccaggccctggccggcctgtctgctgcccgggaccagctggtggagagcctggcccagcaggccaccgtgaccatgcccccagccctgcctgccccagatggaggagagcccagcctgctggagcctggagagctggagggcctcttcttccctgaggagaaggaggaggagaaggagaaggatgacagccccccccagaagtggccagagctgagccacggcctgcacctggtgcccttcatccacagcgctgctgaggaggccgagcctgagcctgagctggccgcccctggagaagatgctgagccccaggccggccccagcgcccggggcagccccagccctgctgcccctggccccccagctggccccctgcccaggatggacctgcccctggccggccagcccctgcggcaccccacccgggcccggccccggccccggcggcagcaccaccaccggcccccacctgggggcccccaggtgcccccagccctgccccaggagggcaatggcctgagcgcccgggtggatgaaggagtggaggagttcttcagcaagaggctcatccagcaggaccggctgtgggccccagaagaagatcctgccacagaaggaggagccacccctgtgcccaggaccctgaggaagaagctgggcaccctgtttgccttcaagaagcccaggagcacccggggccccaggacagacctggagaccagccctggagctgcccccaggaccaggaagaccaccttcggggacctgctgcggccccccacccggcccagcagaggagaggagctgggcggcgctgagggggacaccagcagcccagaccctgctggccgcagccggccccgctacacccgggacagcaaggcctacagcatgatcctgctgcctgctgaggaggaggccaccctgggcgcccggccagacaagagaagacccctggagcggggggagacagagctggcccccagctttgagcagagggtgcaggtgatgctgcagagaattggagtgtcccggggcagcggcggcgctgagggcaagaggaagcagagcaaggatggagagatcaagaaggccggcagtgatggagacatcatggacagcagcacagaggccccacccatcagcatcaagagcaggacccacagcgtgtctgctgaccccagctgcaggcctggccctggcagccagggccctgagagcgccacctggaagaccctgggccagcagctgaatgctgagctgcggagccggggctggggccagcaggacggccctggcccccccagccctggccagagccccagcccctgcaggaccagccccagcccagacagcctgggcctgcctgaggacccctgcctgggccccagaaatgaggagcggcccctgcggctgcagaggagccctgtgctgaagagaagacccaagctggaggccccacccagccccagcctgggcagcggcctgggcacagagcccctgcccccccagcccacagagcccagcagccctgagaggagcccccccagccctgccacagaccagagaggaggcggccccaacccctag

SEQ ID NO: 167809 - DNA, 1305 bp, Artificial Sequence
  Description of Artificial Sequence: Synthetic coding sequence
atgggcatgggcagaggagctggccgcagcgccctgggcttctggcccaccctggccttcctgctgtgcagcttccctgctgccaccagcccctgcaagatcctgaagtgcaacagcgagttctggagcgccaccagcggcagccacgccccagccagtgatgacaccccagagttctgtgccgccctgcggagctatgccctgtgcaccaggagaacagcccggacctgccgcggggacctggcctaccacagcgctgtgcacggcatcgaggacctgatgagccagcacaactgcagcaaggatggccccaccagccagccccggctgcggaccctgcccccagctggggacagccaggagaggagtgacagccctgagatctgccactatgagaagagcttccacaagcacagcgccacccccaactacacccactgcggcctgtttggagacccccacctgcggaccttcacagaccgcttccagacctgcaaggtgcagggcgcctggcccctgattgacaacaactacctgaatgtgcaggtgaccaacacccctgtgctgcccggcagcgctgccacagccaccagcaagctgaccatcatcttcaagaacttccaggagtgtgtggaccagaaggtgtaccaggccgagatggatgagctgcctgctgcctttgtggatggcagcaagaatggaggagacaagcacggggccaacagcctgaagatcacagagaaggtgtctggccagcacgtggagatccaggccaagtacatcggcaccaccatcgtggtgcggcaggtgggccgctacctgacctttgctgtgaggatgcctgaggaggtggtgaatgctgtggaggactgggacagccagggcctgtacctgtgcctgcggggctgccccctgaaccagcagattgacttccaggccttccacaccaatgctgagggcactggagcccggcggctggccgccgccagccctgcccccacagcccctgagaccttcccctatgaaacagctgtggccaagtgcaaggagaagctgcctgtggaggacctgtactaccaggcctgtgtgtttgacctgctgaccactggagatgtgaacttcaccctggccgcctactatgccctggaggatgtgaagatgctgcacagcaacaaggacaagctgcacctgtatgacaggacccgggacctgcccggccgggctgctgctggcctgcccctggccccccggcccctgctgggcgccctggtgcccctgctggccctgctgcctgtgttctgctag

SEQ ID NO: 167810 - DNA, 1353 bp, Artificial Sequence
  Description of Artificial Sequence: Synthetic coding sequence
atgcagcccccccgggagcggctggtggtgacaggccgggccggctggatgggcatgggcagaggagctggccgcagcgccctgggcttctggcccaccctggccttcctgctgtgcagcttccctgctgccaccagcccctgcaagatcctgaagtgcaacagcgagttctggagcgccaccagcggcagccacgccccagccagtgatgacaccccagagttctgtgccgccctgcggagctatgccctgtgcaccaggagaacagcccggacctgccgcggggacctggcctaccacagcgctgtgcacggcatcgaggacctgatgagccagcacaactgcagcaaggatggccccaccagccagccccggctgcggaccctgcccccagctggggacagccaggagaggagtgacagccctgagatctgccactatgagaagagcttccacaagcacagcgccacccccaactacacccactgcggcctgtttggagacccccacctgcggaccttcacagaccgcttccagacctgcaaggtgcagggcgcctggcccctgattgacaacaactacctgaatgtgcaggtgaccaacacccctgtgctgcccggcagcgctgccacagccaccagcaagctgaccatcatcttcaagaacttccaggagtgtgtggaccagaaggtgtaccaggccgagatggatgagctgcctgctgcctttgtggatggcagcaagaatggaggagacaagcacggggccaacagcctgaagatcacagagaaggtgtctggccagcacgtggagatccaggccaagtacatcggcaccaccatcgtggtgcggcaggtgggccgctacctgacctttgctgtgaggatgcctgaggaggtggtgaatgctgtggaggactgggacagccagggcctgtacctgtgcctgcggggctgccccctgaaccagcagattgacttccaggccttccacaccaatgctgagggcactggagcccggcggctggccgccgccagccctgcccccacagcccctgagaccttcccctatgaaacagctgtggccaagtgcaaggagaagctgcctgtggaggacctgtactaccaggcctgtgtgtttgacctgctgaccactggagatgtgaacttcaccctggccgcctactatgccctggaggatgtgaagatgctgcacagcaacaaggacaagctgcacctgtatgacaggacccgggacctgcccggccgggctgctgctggcctgcccctggccccccggcccctgctgggcgccctggtgcccctgctggccctgctgcctgtgttctgctag

SEQ ID NO: 167811 - DNA, 1305 bp, Artificial Sequence; identical to SEQ ID NO: 167809
  Description of Artificial Sequence: Synthetic coding sequence

SEQ ID NO: 167812 - DNA, 1026 bp, Artificial Sequence
  Description of Artificial Sequence: Synthetic coding sequence
atgagccagcacaactgcagcaaggatggccccaccagccagccccggctgcggaccctgcccccagctggggacagccaggagaggagtgacagccctgagatctgccactatgagaagagcttccacaagcacagcgccacccccaactacacccactgcggcctgtttggagacccccacctgcggaccttcacagaccgcttccagacctgcaaggtgcagggcgcctggcccctgattgacaacaactacctgaatgtgcaggtgaccaacacccctgtgctgcccggcagcgctgccacagccaccagcaagctgaccatcatcttcaagaacttccaggagtgtgtggaccagaaggtgtaccaggccgagatggatgagctgcctgctgcctttgtggatggcagcaagaatggaggagacaagcatggagccaacagcctgaagatcacagagaaggtgtctggccagcacgtggagatccaggccaagtacatcggcaccaccatcgtggtgcggcaggtgggccgctacctgacctttgctgtgaggatgcctgaggaggtggtgaatgctgtggaggactgggacagccagggcctgtacctgtgcctgcggggctgccccctgaaccagcagattgacttccaggccttccacaccaatgctgagggcaccggggcccggcggctggccgccgccagccctgcccccacagcccctgagaccttcccctatgaaacagctgtggccaagtgcaaggagaagctgcctgtggaggacctgtactaccaggcctgtgtgtttgacctgctgaccactggagatgtgaacttcaccctggccgcctactatgccctggaggatgtgaagatgctgcacagcaacaaggacaagctgcacctgtatgacaggacccgggacctgcccggccgggctgctgctggcctgcccctggccccccggcccctgctgggcgccctggtgcccctgctggccctgctgcccgtcttctgctag

SEQ ID NO: 167813 - DNA, 1305 bp, Artificial Sequence; identical to SEQ ID NO: 167809
  Description of Artificial Sequence: Synthetic coding sequence

SEQ ID NO: 167814 - DNA, 1377 bp, Artificial Sequence
  Description of Artificial Sequence: Synthetic coding sequence
atgggcggcctgggccccaggagagctggcaccagccgggagcggctggtggtgacaggccgggccggctggatgggcatgggcagaggagctggccgcagcgccctgggcttctggcccaccctggccttcctgctgtgcagcttccctgctgccaccagcccctgcaagatcctgaagtgcaacagcgagttctggagcgccaccagcggcagccacgccccagccagtgatgacaccccagagttctgtgccgccctgcggagctatgccctgtgcaccaggagaacagcccggacctgccgcggggacctggcctaccacagcgctgtgcacggcatcgaggacctgatgagccagcacaactgcagcaaggatggccccaccagccagccccggctgcggaccctgcccccagctggggacagccaggagaggagtgacagccctgagatctgccactatgagaagagcttccacaagcacagcgccacccccaactacacccactgcggcctgtttggagacccccacctgcggaccttcacagaccgcttccagacctgcaaggtgcagggcgcctggcccctgattgacaacaactacctgaatgtgcaggtgaccaacacccctgtgctgcccggcagcgctgccacagccaccagcaagctgaccatcatcttcaagaacttccaggagtgtgtggaccagaaggtgtaccaggccgagatggatgagctgcctgctgcctttgtggatggcagcaagaatggaggagacaagcacggggccaacagcctgaagatcacagagaaggtgtctggccagcacgtggagatccaggccaagtacatcggcaccaccatcgtggtgcggcaggtgggccgctacctgacctttgctgtgaggatgcctgaggaggtggtgaatgctgtggaggactgggacagccagggcctgtacctgtgcctgcggggctgccccctgaaccagcagattgacttccaggccttccacaccaatgctgagggcactggagcccggcggctggccgccgccagccctgcccccacagcccctgagaccttcccctatgaaacagctgtggccaagtgcaaggagaagctgcctgtggaggacctgtactaccaggcctgtgtgtttgacctgctgaccactggagatgtgaacttcaccctggccgcctactatgccctggaggatgtgaagatgctgcacagcaacaaggacaagctgcacctgtatgacaggacccgggacctgcccggccgggctgctgctggcctgcccctggccccccggcccctgctgggcgccctggtgcccctgctggccctgctgcctgtgttctgctag

SEQ ID NO: 167815 - DNA, 1437 bp, Artificial Sequence
  Description of Artificial Sequence: Synthetic coding sequence
atgatcaggaagaagaggaagaggtctgcccctcctggcccctgccgcagccacggccccaggcctgccacagccccagcccccccacccagccctgagcccaccaggcctgcctggacaggcatgggcctgcgggccgcccccagcagcgctgctgctgctgctgctgaggtggagcagaggaggagccctggcctgtgccccccacccctggagctgctgctgctgctgctcttcagcctgggcctgctgcacgccggggactgccagcagcctgcccagtgccgcatccagaagtgcaccacagactttgtgtccctgaccagccacctgaacagcgctgtggatggctttgacagcgagttctgcaaggccctgcgggcctatgccggctgcacccagaggaccagcaaggcctgccggggcaacctggtgtaccacagcgctgtgctgggcatcagtgacctgatgagccagaggaactgcagcaaggatggccccaccagcagcaccaaccctgaggtgacccatgacccctgcaactaccacagccacgccggggcccgggagcaccggcggggggaccagaacccccccagctacctgttctgtggcctgtttggagacccccacctgcggaccttcaaggacaacttccagacctgcaaggtggagggcgcctggcccctgattgacaacaactacctgtctgtgcaggtgaccaacgtgcctgtggtgcccggcagcagcgccacagccaccaacaagatcaccatcatcttcaaggcccaccacgagtgcacagaccagaaggtgtaccaggccgtgacagatgacctgcctgctgcctttgtggatggcaccaccagcggcggggacagtgatgccaagagcctgagaattgtggagcgggagagcggccactacgtggagatgcacgcccgctacatcggcaccaccgtgtttgtgcggcaggtgggccgctacctgaccctggccatccgcatgcctgaggacctggccatgtcctatgaggagagccaggacctgcagctgtgtgtgaatggctgccccctgtctgaaagaattgatgatggccagggccaggtgtctgccatcctgggccacagcctgcccaggaccagcctggtgcaggcctggccaggctacaccctggagacagccaacacccagtgccacgagaagatgcctgtgaaggacatctacttccagagctgtgtgtttgacctgctgaccactggagatgccaacttcaccgctgctgcccacagcgccctggaggatgtggaggccctgcaccccaggaaggagcgctggcacatcttccccagcagtggaaatggcaccccccggggcggcagtgacctgtctgtgtccctgggcctgacctgcctgatcctgattgtgttcctgtag

SEQ ID NO: 167816 - DNA, 1314 bp, Artificial Sequence
  Description of Artificial Sequence: Synthetic coding sequence
atgggcctgcgggccgcccccagcagcgctgctgctgctgctgctgaggtggagcagaggaggagccctggcctgtgccccccacccctggagctgctgctgctgctgctcttcagcctgggcctgctgcatgctggggactgccagcagcctgcccagtgccgcatccagaagtgcaccacagactttgtgtccctgaccagccacctgaacagcgctgtggatggctttgattctgagttctgcaaggccctgcgggcctatgccggctgcacccagaggaccagcaaggcctgccggggcaacctggtgtaccacagcgctgtgctgggcatcagtgacctgatgagccagaggaactgcagcaaggatggccccaccagcagcaccaaccctgaggtgacccatgacccctgcaactaccacagccatgctggggcccgggagcacagaagaggagaccagaaccccccatcctacctgttctgtggcctgtttggagacccccacctgcggaccttcaaggacaacttccagacctgcaaggtggagggcgcctggcccctgattgacaacaactacctgtctgtgcaggtgaccaacgtgcctgtggtgcccggcagcagcgccacagccaccaacaagatcaccatcatcttcaaggcccaccatgaatgtacagaccagaaggtgtaccaggccgtgacagatgacctgcctgctgcctttgtggatggcaccaccagcggcggggacagtgatgccaagagcctgcgcatcgtggagcgggagagcggccactacgtggagatgcacgcccgctacatcggcaccaccgtgtttgtgcggcaggtgggccgctacctgaccctggccatccgcatgcctgaggacctggccatgtcctatgaggagagccaggacctgcagctgtgtgtgaatggctgccccctgtctgaaagaattgatgatggccagggccaggtgtctgccatcctgggccacagcctgcccaggaccagcctggtgcaggcctggccaggctacaccctggagacagccaacacccagtgccacgagaagatgcctgtgaaggacatctacttccagagctgtgtgtttgacctgctgaccactggagatgccaacttcaccgctgctgcccacagcgccctggaggatgtggaggccctgcaccccaggaaggagcgctggcacatcttccccagcagtggaaatggcaccccccggggcggcagtgacctgtctgtgtccctgggcctgacctgcctgatcctgattgtgttcctgtag

SEQ ID NO: 167817 - DNA, 1176 bp, Artificial Sequence
  Description of Artificial Sequence: Synthetic coding sequence
atgattgaggtggtggccgagctgagccggggccctgtgttcctggccggggaggccctggagtgtgtggtgacagtgaccaaccccctgcccccaacagccaccagcgccagcagcgaggccctggcctgggccagcgcccagatccactgccagttccacgccagcgagagccgggtggccctgcccccaccagacagcagccagccagatgtgcagcctgacagccagaccgtcttcctgccccacagaggagagcggggccagtgcatcctgagcaccccacccaagatcctcttctgtgacctgcggctggaccctggagagagcaagagctacagctacagcgaggtgctgcccatcgagggcccccccagcttccggggccagagcgtgaagtatgtgtacaagctgaccatcggctgccagagggtgaacagccccatcaccctgctgcgggtgcccctgcgggtgctggtgctgaccggcctgcaggatgtgcgcttcccccaggatgaggccgtggcccccagcagccccttcctggaggaggatgaaggaggcaagaaggacagctggctggccgagctggccggggagcggctgatggccgccaccagctgccgcagcctgcacctgtacaacatcagtgatggccggggcaaggtgggcaccttcggcatcttcaagtctgtgtaccgcctgggagaagatgtggtgggcaccctgaacctgggggagggcaccgtggcctgcctgcagttctctgtgtccctgcagacagaggagcgggtgcagcctgagtaccagaggagaagaggagctggaggagtgcccagcgtgagccacgtgacccacgcccggcaccaggagagctgcctgcacaccaccaggaccagcttcagcctgcccatccccctgagcagcaccccaggcttctgcacagccatcgtgtccctgaagtggaggctgcactttgaatttgtgaccagccgggagcccggcctggtgctgctgccccctgtggagcagcctgagcccaccacctggacaggccctgagcaggtgcctgtggacaccttctcctgggacctgcccatcaaggtgctgcccaccagccccaccctggccagctatgctgcccctggccccagcaccagcaccatcaccatctag

SEQ ID NO: 167818 - DNA, 1296 bp, Artificial Sequence
  Description of Artificial Sequence: Synthetic coding sequence
atgacccgggccctgagcggcctggcctgccgggccctgcctgctggccgggacagcgctgagggcctgggcgtgcccatccccagcgtggactatgcccggagtgacagcggggccgccatgattgaggtggtggccgagctgagccggggccctgtgttcctggccggggaggccctggagtgtgtggtgacagtgaccaaccccctgcccccaacagccaccagcgccagcagcgaggccctggcctgggccagcgcccagatccactgccagttccacgccagcgagagccgggtggccctgcccccaccagacagcagccagccagatgtgcagcctgacagccagaccgtcttcctgccccacagaggagagcggggccagtgcatcctgagcaccccacccaagatcctcttctgtgacctgcggctggaccctggagagagcaagagctacagctacagcgaggtgctgcccatcgagggcccccccagcttccggggccagagcgtgaagtatgtgtacaagctgaccatcggctgccagagggtgaacagccccatcaccctgctgcgggtgcccctgcgggtgctggtgctgaccggcctgcaggatgtgcgcttcccccaggatgaggccgtggcccccagcagccccttcctggaggaggatgaaggaggcaagaaggacagctggctggccgagctggccggggagcggctgatggccgccaccagctgccgcagcctgcacctgtacaacatcagtgatggccggggcaaggtgggcaccttcggcatcttcaagtctgtgtaccgcctgggagaagatgtggtgggcaccctgaacctgggggagggcaccgtggcctgcctgcagttctctgtgtccctgcagacagaggagcgggtgcagcctgagtaccagaggagaagaggagctggaggagtgcccagcgtgagccacgtgacccacgcccggcaccaggagagctgcctgcacaccaccaggaccagcttcagcctgcccatccccctgagcagcaccccaggcttctgcacagccatcgtgtccctgaagtggaggctgcactttgaatttgtgaccagccgggagcccggcctggtgctgctgccccctgtggagcagcctgagcccaccacctggacaggccctgagcaggtgcctgtggacaccttctcctgggacctgcccatcaaggtgctgcccaccagccccaccctggccagctatgctgcccctggccccagcaccagcaccatcaccatctag

SEQ ID NO: 167819 - DNA, 1119 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacacagactaccacatgaacctgcggcacttctacgtgtttgctgcctacttcggcctgactgtggcctggtgcctgcccaagcccctgcccaagggcacagaggacaatgaccagagggccaccatccccagcctgagcgccatgctgggcgccctcttcctgtggatgttctggcccagcgtgaacagcgccctgctgcggagccccatccagaggaagaatgccatgttcaacacctactatgccctggccgtgtctgtggtgacagccatcagcggcagcagcctggcccacccccagaggaagatctccatgacctacgtgcacagcgctgtgctggccggcggcgtggccgtgggcaccagctgccacctgatccccagcccctggctggccatggtgctgggcctggtggccggcctcatcagcatcggcggggccaagtgcctgcctgtgtgctgcaacagagtgctgggcatccaccacatctctgtgatgcacagcatcttcagcctgctgggcctgctgggggagatcacctacatcgtgctgctggtgctgcacacagtgtggaatggaaatggcatgtttgcccccaagagccagaacatggagagcaccagctgtggctag

SEQ ID NO: 167820 - DNA, 1254 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacacagactaccacatgaacctgcggcacttctacgtgtttgctgcctacttcggcctgactgtggcctggtgcctgcccaagcccctgcccaagggcacagaggacaatgaccagagggccaccatccccagcctgagcgccatgctgggcgccctcttcctgtggatgttctggcccagcgtgaacagcgccctgctgcggagccccatccagaggaagaatgccatgttcaacacctactatgccctggccgtgtctgtggtgacagccatcagcggcagcagcctggcccacccccagaggaagatctccatgacctacgtgcacagcgctgtgctggccggcggcgtggccgtgggcaccagctgccacctgatccccagcccctggctggccatggtgctgggcctggtggccggcctcatcagcatcggcggggccaagtgcctgcctgtgtgctgcaacagagtgctgggcatccaccacatctctgtgatgcacagcatcttcagcctgctgggcctgctgggggagatcacctacatcgtgctgctggtgctgcacacagtgtggaatggaaatggcatgattggcttccaggtgctgctgagcattggagagctgagcctggccatcgtcatcgccctgaccagcggcctgctgaccggcctgctgctgaacctgaagatctggaaggcccctcatgtggccaagtactttgatgaccaggtgttctggaagttcccccacctggccgtgggcttctag

SEQ ID NO: 167821 - DNA, 804 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacacctacgtgcacagcgctgtgctggccggcggcgtggccgtgggcaccagctgccacctgatccccagcccctggctggccatggtgctgggcctggtggccggcctcatcagcattggaggagccaagtgcctgcctgtgtgctgcaacagagtgctgggcatccaccacatctctgtgatgcacagcatcttcagcctgctgggcctgctgggggagatcacctacatcgtgctgctggtgctgcacacagtgtggaatggaaatggcatgtttgcccccaagagccagaacatggagagcaccagctgtggctag

SEQ ID NO: 167822 - DNA, 801 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacgtgtgctgcaacagagtgctgggcatccaccacatctctgtgatgcacagcatcttcagcctgctgggcctgctgggggagatcacctacatcgtgctgctggtgctgcacacagtgtggaatggaaatggcatgattggcttccaggtgctgctgagcatcggggagctgagcctggccatcgtgattgccctgaccagcggcctgctgaccggcctgctgctgaacctgaagatctggaaggccccccacgtggccaagtactttgatgaccaggtgttctggaagttcccccacctggccgtgggcttctag

SEQ ID NO: 167823 - DNA, 1206 bp, Artificial Sequence
  Description of Artificial Sequence: Synthetic coding sequence
atgtacttcatcaaccagaggctcttcctgcggctgtggagggtgcctgtgatgagggccagccactgctaccagagccagggctggaggcctgtggccgtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacacagactaccacatgaacctgcggcacttctacgtgtttgctgcctacttcggcctgactgtggcctggtgcctgcccaagcccctgcccaagggcacagaggacaatgaccagagggccaccatccccagcctgagcgccatgctgggcgccctcttcctgtggatgttctggcccagcgtgaacagcgccctgctgcggagccccatccagaggaagaatgccatgttcaacacctactatgccctggccgtgtctgtggtgacagccatcagcggcagcagcctggcccacccccagaggaagatctccatgacctacgtgcacagcgctgtgctggccggcggcgtggccgtgggcaccagctgccacctgatccccagcccctggctggccatggtgctgggcctggtggccggcctcatcagcatcggcggggccaagtgcctgcctgtgtgctgcaacagagtgctgggcatccaccacatctctgtgatgcacagcatcttcagcctgctgggcctgctgggggagatcacctacatcgtgctgctggtgctgcacacagtgtggaatggaaatggcatgattggcttccaggtgctgctgagcattggagagctgagcctggccatcgtcatcgccctgaccagcggcctgctgaccggcctgctgctgaacctgaagatctggaaggcccctcatgtggccaagtactttgatgaccaggtgttctggaagttcccccacctggccgtgggcttctag

SEQ ID NO: 167824 - DNA, 1065 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacacagactaccacatgaacctgcggcacttctacgtgtttgctgcctacttcggcctgactgtggcctggtgcctgcccaagcccctgcccaagggcacagaggacaatgaccagagggccaccatccccagcctgagcgccatgctgggcgccctcttcctgtggatgttctggcccagcgtgaacagcgccctgctgcggagccccatccagaggaagaatgccatgttcaacacctactatgccctggccgtgtctgtggtgacagccatcagcggcagcagcctggcccacccccagaggaagatctccatgacctacgtgcacagcgctgtgctggccggcggcgtggccgtgggcaccagctgccacctgatccccagcccctggctggccatggtgctgggcctggtggccggcctcatcagcatcggcggggccaagtgcctgcctgactggctgcccggccccccccagcactggggcacccagctgggccaccgggacagcagccacgtgtggagcccagacagatttgcccccaagagccagaacatggagagcaccagctgtggctag

SEQ ID NO: 167825 - DNA, 1206 bp, Artificial Sequence; identical to SEQ ID NO: 167823
  Description of Artificial Sequence: Synthetic coding sequence

SEQ ID NO: 167826 - DNA, 1191 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacacagactaccacatgaacctgcggcacttctacgtgtttgctgcctacttcggcctgactgtggcctggtgcctgcccaagcccctgcccaagggcacagaggacaatgaccagagggccaccatccccagcctgagcgccatgctgggcgccctcttcctgtggatgttctggcccagcgtgaacagcgccctgctgcggagccccatccagaggaagaatgccatgttcaacacctactatgccctggccgtgtctgtggtgacagccatcagcggcagcagcctggcccacccccagaggaagatctccatgacctacgtgcacagcgctgtgctggccggcggcgtggccgtgggcaccagctgccacctgatccccagcccctggctggccatggtgctgggcctggtggccggcctcatcagcatcggcggggccaagtgcctgcctgtgtgctgcaacagagtgctgggcatccaccacatctctgtgatgcacagcatcttcagcctgctgggcctgctgggggagatcacctacatcgtgctgctggtgctgcacacagtgtggaatggaaatggcatcttcctgatctggctgctggacttcaagcagaagcaccccaggaagaccaggcctgtgcagaagcaggacaacttcctgagcctgctgcctgcctttgtgcgggagaagaggagctag

SEQ ID NO: 167827 - DNA, 927 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacacagactaccacatgaacctgcggcacttctacgtgtttgctgcctacttcggcctgactgtggcctggtgcctgcccaagcccctgcccaagggcacagaggacaatgaccagagggccaccatccccagcctgagcgccatgctgggcgccctcttcctgtggatgttctggcccagcgtgaacagcgccctgctgcggagccccatccagaggaagaatgccatgttcaacacctactatgccctggccgtgtctgtggtgacagccatcagcggcagcagcctggcccacccccagaggaagatctccatggactggctgcccggccccccccagcactggggcacccagctgggccaccgggacagcagccacgtgtggagcccagacagatttgcccccaagagccagaacatggagagcaccagctgtggctag

SEQ ID NO: 167828 - DNA, 1197 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacacagactaccacatgaacctgcggcacttctacgtgtttgctgcctacttcggcctgactgtggcctggtgcctgcccaagcccctgcccaagggcacagaggacaatgaccagagggccaccatccccagcctgagcgccatgctgggcgccctcttcctgtggatgttctggcccagcgtgaacagcgccctgctgcggagccccatccagaggaagaatgccatgttcaacacctactatgccctggccgtgtctgtggtgacagccatcagcggcagcagcctggcccacccccagaggaagatctccatgacctacgtgcacagcgctgtgctggccggcggcgtggccgtgggcaccagctgccacctgatccccagcccctggctggccatggtgctgggcctggtggccggcctcatcagcatcggcggggccaagtgcctgcctgtgtgctgcaacagagtgctgggcatcccccacctgcggcatgccctgcacctgcagctggccggcagcgcctggagggaccacctgcactgtgccgccggggccagctactgcctggagcggcagtggcatgactggctgcccggccccccccagcactggggcacccagctgggccaccgggacagcagccacgtgtggagcccagacagatttgcccccaagagccagaacatggagagcaccagctgtggctag

SEQ ID NO: 167829 - DNA, 939 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaacacctacgtgcacagcgctgtgctggccggcggcgtggccgtgggcaccagctgccacctgatccccagcccctggctggccatggtgctgggcctggtggccggcctcatcagcattggaggagccaagtgcctgcctgtgtgctgcaacagagtgctgggcatccaccacatctctgtgatgcacagcatcttcagcctgctgggcctgctgggggagatcacctacatcgtgctgctggtgctgcacacagtgtggaatggaaatggcatgattggcttccaggtgctgctgagcatcggggagctgagcctggccatcgtgattgccctgaccagcggcctgctgaccggcctgctgctgaacctgaagatctggaaggccccccacgtggccaagtactttgatgaccaggtgttctggaagttcccccacctggccgtgggcttctag

SEQ ID NO: 167830 - DNA, 1041 bp, Artificial Sequence
  Description of Artificial Sequence: Synthetic coding sequence
atgagcagcaagtaccccaggtctgtgcggcgctgcctgcccctgtgtgccctgaccctggaggccgccctgatcctgctcttctacttcttcacccactatgatgccagcctggaggaccagaagggcctggtggccagctaccaggtgggccaggacctgactgtgatggccgccctgggcctgggcttcctgaccagcaacttccgccgccacagctggagctctgtggccttcaacctcttcatgctggccctgggcgtgcagtgggccatcctgctggatggcttcctgagccagttccccccaggcaaggtggtgatcaccctcttcagcatccggctggccaccatgtctgccatgtctgtgctgatctctgctggagctgtgctgggcaaggtgaacctggcccagctggtggtgatggtgctggtggaggtgacagccctgggcaccctgaggatggtgatcagcaacatcttcaaccccagcgtgaacagcgccctgctgcggagccccatccagaggaagaatgccatgttcaacacctactatgccctggccgtgtctgtggtgacagccatcagcggcagcagcctggcccacccccagaggaagatctccatgacctacgtgcacagcgctgtgctggccggcggcgtggccgtgggcaccagctgccacctgatccccagcccctggctggccatggtgctgggcctggtggtgtgctgcaacagagtgctgggcatccaccacatctctgtgatgcacagcatcttcagcctgctgggcctgctgggggagatcacctacatcgtgctgctggtgctgcacacagtgtggaatggaaatggcatgattggcttccaggtgctgctgagcatcggggagctgagcctggccatcgtgattgccctgaccagcggcctgctgaccggcctgctgctgaacctgaagatctggaaggccccccacgtggccaagtactttgatgaccaggtgttctggaagttcccccacctggccgtgggcttctag

SEQ ID NO: 167831 - DNA, 1254 bp, Artificial Sequence
  Description of Artificial Sequence: Synthetic coding sequence
atgagcagcaagtaccccaggtctgtgcggcgctgcctgcccctgtgggccctgaccctggaggccgccctgatcctgctcttctacttcttcacccactatgatgccagcctggaggaccagaagggcctggtggccagctaccaggtgggccaggacctgactgtgatggccgccatcggcctgggcttcctgaccagcagcttccgccgccacagctggagctctgtggccttcaacctcttcatgctggccctgggcgtgcagtgggccatcctgctggatggcttcctgagccagttccccagcggcaaggtggtgatcaccctcttcagcatccggctggccaccatgtctgccctgtctgtgctgatctctgtggatgctgtgctgggcaaggtgaacctggcccagctggtggtgatggtgctggtggaggtgacagccctgggcaacctgaggatggtgatcagcaacatcttcaacacagactaccacatgaacatgatgcacatctacgtgtttgctgcctacttcggcctgtctgtggcctggtgcctgcccaagcccctgcctgagggcacagaggacaaggaccagacagccaccatccccagcctgagcgccatgctgggcgccctcttcctgtggatgttctggcccagcttcaacagcgccctgctgcggagccccatcgagaggaagaatgctgtgttcaacacctactatgctgtggccgtgtctgtggtgacagccatcagcggcagcagcctggcccacccccagggcaagatcagcaagacctacgtgcacagcgctgtgctggccggcggcgtggccgtgggcaccagctgccacctgatccccagcccctggctggccatggtgctgggcctggtggccggcctcatctctgtgggcggggccaagtacctgcccggctgctgcaacagagtgctgggcatcccccacagcagcatcatgggctacaacttcagcctgctgggcctgctgggggagatcatctacatcgtgctgctggtgctggacacagtgggcgctggaaatggcatgattggcttccaggtgctgctgagcattggagagctgagcctggccatcgtcatcgccctgatgagcggcctgctgaccggcctgctgctgaacctgaagatctggaaggcccctcatgaggccaagtactttgatgaccaggtgttctggaagttcccccacctggccgtgggcttctag

SEQ ID NO: 167832 - DNA, 1482 bp, Artificial Sequence
  Description of Artificial Sequence: Synthetic coding sequence
atgagcagcaagtaccccaggtctgtgcggcgctgcctgcccctgtgggccctgaccctggaggccgccctgatcctgctcttctacttcttcacccactatgatgccagcctggaggaccagaagggcctggtggccagctaccaggtgggccaggacctgactgtgatggccgccatcggcctgggcttcctgaccagcagcttccgccgccacagctggagctctgtggccttcaacctcttcatgctggccctgggcgtgcagtgggccatcctgctggatggcttcctgagccagttccccagcggcaaggtggtgatcaccctcttcagcatccggctggccaccatgtctgccctgtctgtgctgatctctgtggatgctgtgctgggcaaggtgaacctggcccagctggtggtgatggtgctggtggaggtgacagccctgggcaacctgaggatggtgatcagcaacatcttcaacacagactaccacatgaacatgatgcacatctacgtgtttgctgcctacttcggcctgtctgtggcctggtgcctgcccaagcccctgcctgagggcacagaggacaaggaccagacagccaccatccccagcctgagcgccatgctgggcgccctcttcctgtggatgttctggcccagcttcaacagcgccctgctgcggagccccatcgagaggaagaatgctgtgttcaacacctactatgctgtggccgtgtctgtggtgacagccatcagcggcagcagcctggcccacccccagggcaagatcagcaagacctacgtgcacagcgctgtgctggccggcggcgtggccgtgggcaccagctgccacctgatccccagcccctggctggccatggtgctgggcctggtggccggcctcatctctgtgggcggggccaagtacctgcccggctgctgcaacagagtgctgggcatcccccacagcagcatcatgggctacaacttcagcctgctgggcctgctgggggagatcatctacatcgtgctgctggtgctggacacagtgggcgctggaaatggcatgagcctgggctggaacctggccgtgaagatggccgaggccggagatgaggagctgatgaggctggatgtgtcccagaggaaccacggcggcgctgctgtgcccaccggctcctggatgcccagcacagagaccaccatcgcccccaactacagagaccacatctctgtggtgtcctcctttggctgctggatcctgagcaagagcatccaggagaagcagggcctcttcaagaacaagaccaccagcagccactgctgcctgcacctgtatgtgagaaatgcccatgacagcaaggtgtccaatgtgcgggccggcaccggggtgcgggagaatggagtggagagcttcctgtgccacagcctgcggcgcatcagccccttcatcatgcactgccgcatccagcagtag

SEQ ID NO: 167833 - DNA, 1191 bp, Artificial Sequence
  Description of Artificial Sequence: Synthetic coding sequence
atgagcagcaagtaccccaggtctgtgcggcgctgcctgcccctgtgggccctgaccctggaggccgccctgatcctgctcttctacttcttcacccactatgatgccagcctggaggaccagaagggcctggtggccagctaccaggtgggccaggacctgactgtgatggccgccatcggcctgggcttcctgaccagcagcttccgccgccacagctggagctctgtggccttcaacctcttcatgctggccctgggcgtgcagtgggccatcctgctggatggcttcctgagccagttccccagcggcaaggtggtgatcaccctcttcagcatccggctggccaccatgtctgccctgtctgtgctgatctctgtggatgctgtgctgggcaaggtgaacctggcccagctggtggtgatggtgctggtggaggtgacagccctgggcaacctgaggatggtgatcagcaacatcttcaacacagactaccacatgaacatgatgcacatctacgtgtttgctgcctacttcggcctgtctgtggcctggtgcctgcccaagcccctgcctgagggcacagaggacaaggaccagacagccaccatccccagcctgagcgccatgctgggcgccctcttcctgtggatgttctggcccagcttcaacagcgccctgctgcggagccccatcgagaggaagaatgctgtgttcaacacctactatgctgtggccgtgtctgtggtgacagccatcagcggcagcagcctggcccacccccagggcaagatcagcaagacctacgtgcacagcgctgtgctggccggcggcgtggccgtgggcaccagctgccacctgatccccagcccctggctggccatggtgctgggcctggtggccggcctcatctctgtgggcggggccaagtacctgcccggctgctgcaacagagtgctgggcatcccccacagcagcatcatgggctacaacttcagcctgctgggcctgctgggggagatcatctacatcgtgctgctggtgctggacacagtgggcgctggaaatggcatcttcctgatctggctgctggacttcaagcagaagcaccccaggaagaccaggcctgtgcagaagcaggacaacttcctgagcctgctgcctgcctttgtgcgggagaagaggagctag

SEQ ID NO: 167834 - DNA, 1137 bp, Artificial Sequence
  Description of Artificial Sequence: Synthetic coding sequence
atgagcagcaagtaccccaggtctgtgcggcgctgcctgcccctgtgggccctgaccctggaggccgccctgatcctgctcttctacttcttcacccactatgatgccagcctggaggaccagaagggcctggtggccagctaccaggtgggccaggacctgactgtgatggccgccatcggcctgggcttcctgaccagcagcttccgccgccacagctggagctctgtggccttcaacctcttcatgctggccctgggcgtgcagtgggccatcctgctggatggcttcctgagccagttccccagcggcaaggtggtgatcaccctcttcagcatccggctggccaccatgtctgccctgtctgtgctgatctctgtggatgctgtgctgggcaaggtgaacctggcccagctggtggtgatggtgctggtggaggtgacagccctgggcaacctgaggatggtgatcagcaacatcttcaacacagactaccacatgaacatgatgcacatctacgtgtttgctgcctacttcggcctgtctgtggcctggtgcctgcccaagcccctgcctgagggcacagaggacaaggaccagacagccaccatccccagcctgagcgccatgctgggcgccctcttcctgtggatgttctggcccagcttcaacagcgccctgctgcggagccccatcgagaggaagaatgctgtgttcaacacctactatgctgtggccgtgtctgtggtgacagccatcagcggcagcagcctggcccacccccagggcaagatcagcaagacctacgtgcacagcgctgtgctggccggcggcgtggccgtgggcaccagctgccacctgatccccagcccctggctggccatggtgctgggcctggtggccggcctcatctctgtgggcggggccaagtacctgcctgactggctgcccggccccccccagcactggggcacccagctgggccaccgggacagcagccacgtgtggagcccagacagcttcctgatctggctgctggacttcaagcagaagcaccccaggaagaccaggcctgtgcagaagcaggacaacttcctgagcctgctgcctgcctttgtgcgggagaagaggagctag

SEQ ID NO: 167835 - DNA, 1464 bp, Artificial Sequence
  Description of Artificial Sequence: Synthetic coding sequence
atgagcagcaagtaccccaggtctgtgcggcgctgcctgcccctgtgggccctgaccctggaggccgccctgatcctgctcttctacttcttcacccactatgatgccagcctggaggaccagaagggcctggtggccagctaccaggtgggccaggacctgactgtgatggccgccatcggcctgggcttcctgaccagcagcttccgccgccacagctggagctctgtggccttcaacctcttcatgctggccctgggcgtgcagtgggccatcctgctggatggcttcctgagccagttccccagcggcaaggtggtgatcaccctcttcagcatccggctggccaccatgtctgccctgtctgtgctgatctctgtggatgctgtgctgggcaaggtgaacctggcccagctggtggtgatggtgctggtggaggtgacagccctgggcaacctgaggatggtgatcagcaacatcttcaacacagactaccacatgaacatgatgcacatctacgtgtttgctgcctacttcggcctgtctgtggcctggtgcctgcccaagcccctgcctgagggcacagaggacaaggaccagacagccaccatccccagcctgagcgccatgctgggcgccctcttcctgtggatgttctggcccagcttcaacagcgccctgctgcggagccccatcgagaggaagaatgctgtgttcaacacctactatgctgtggccgtgtctgtggtgacagccatcagcggcagcagcctggcccacccccagggcaagatcagcaagacctacgtgcacagcgctgtgctggccggcggcgtggccgtgggcaccagctgccacctgatccccagcccctggctggccatggtgctgggcctggtggccggcctcatctctgtgggcggggccaagtacctgcccggctgctgcaacagagtgctgggcatcccccacagcagcatcatgggctacaacttcagcctgctgggcctgctgggggagatcatctacatcgtgctgctggtgctggacacagtgggcgctggaaatggcatgattggcttccaggtgctgctgagcattggagagctgagcctggccatcgtcatcgccctgatgagcggcctgctgaccggcctgctgctgaacctgaagatctggaaggcccctcatgaggccaagtactttgatgaccaggtgttctggaagttcccccacctggccgtgggcttcagcaagagcatccaggagaagcagggcctcttcaagaacaagaccaccagcagccactgctgcctgcacctgtatgtgagaaatgcccatgacagcaaggtgtccaatgtgcgggccggcaccggggtgcgggagaatggagtggagagcttcctgtgccacagcctgcggcgcatcagccccttcatcatgcactgccgcatccagcagtag

SEQ ID NO: 167836 - DNA, 1296 bp, Artificial Sequence
  Description of Artificial Sequence: Synthetic coding sequence
atgagcagcaagtaccccaggtctgtgcggcgctgcctgcccctgtgggccctgaccctggaggccgccctgatcctgctcttctacttcttcacccactatgatgccagcctggaggaccagaagggcctggtggccagctaccaggtgggccaggacctgactgtgatggccgccatcggcctgggcttcctgaccagcagcttccgccgccacagctggagctctgtggccttcaacctcttcatgctggccctgggcgtgcagtgggccatcctgctggatggcttcctgagccagttccccagcggcaaggtggtgatcaccctcttcagcatccggctggccaccatgtctgccctgtctgtgctgatctctgtggatgctgtgctgggcaaggtgaacctggcccagctggtggtgatggtgctggtggaggtgacagccctgggcaacctgaggatggtgatcagcaacatcttcaacacagactaccacatgaacatgatgcacatctacgtgtttgctgcctacttcggcctgtctgtggcctggtgcctgcccaagcccctgcctgagggcacagaggacaaggaccagacagccaccatccccagcctgagcgccatgctgggcgccctcttcctgtggatgttctggcccagcttcaacagcgccctgctgcggagccccatcgagaggaagaatgctgtgttcaacacctactatgctgtggccgtgtctgtggtgacagccatcagcggcagcagcctggcccacccccagggcaagatcagcaagacctacgtgcacagcgctgtgctggccggcggcgtggccgtgggcaccagctgccacctgatccccagcccctggctggccatggtgctgggcctggtggccggcctcatctctgtgggcggggccaagtacctgcccggctgctgcaacagagtgctgggcatcccccacagcagcatcatgggctacaacttcagcctgctgggcctgctgggggagatcatctacatcgtgctgctggtgctggacacagtgggcgctggaaatggcatgagcctgggctggaacctggccgtgaagatggccgaggccggagatgaggagctgatgaggctggatgtgtcccagaggaaccacggcggcgctgctgtgcccaccggctcctggatgcccagcacagagaccaccatcgcccccaactacagagaccacatctctgtgggcctggccagccgcagcagcagcgccctgggcaacagcgcctggcccagctag

SEQ ID NO: 167837 - DNA, 966 bp, Artificial Sequence
  Description of Artificial Sequence: Synthetic coding sequence
atgagcagcaagtaccccaggtctgtgcggcgctgcctgcccctgtgggccctgaccctggaggccgccctgatcctgctcttctacttcttcacccactatgatgccagcctggaggaccagaagggcctggtggccagctaccaggtgggccaggacctgactgtgatggccgccatcggcctgggcttcctgaccagcagcttccgccgccacagctggagctctgtggccttcaacctcttcatgctggccctgggcgtgcagtgggccatcctgctggatggcttcctgagccagttccccagcggcaaggtggtgatcaccctcttcagcatccggctggccaccatgtctgccctgtctgtgctgatctctgtggatgctgtgctgggcaaggtgaacctggcccagctggtggtgatggtgctggtggaggtgacagccctgggcaacctgaggatggtgatcagcaacatcttcaacacagactaccacatgaacatgatgcacatctacgtgtttgctgcctacttcggcctgtctgtggcctggtgcctgcccaagcccctgcctgagggcacagaggacaaggaccagacagccaccatccccagcctgagcgccatgctgggcgccctcttcctgtggatgttctggcccagcttcaacagcgccctgctgcggagccccatcgagaggaagaatgctgtgttcaacacctactatgctgtggccgtgtctgtggtgacagccatcagcggcagcagcctggcccacccccagggcaagatcagcaagacctacgtgcacagcgctgtgctggccggcggcgtggccgtgggcaccagctgccacctgatccccagcccctggctggccatggtgctgggcctggtggccggcctcatctctgtgggcggggccaagtacctgcccttcccccacctggccgtgggcttctag

SEQ ID NO: 167838 - DNA, 294 bp, Artificial Sequence
  Description of Artificial Sequence: Synthetic coding sequence
atggccggcagccccagcagagctgctggaagaaggctgcagctgcccctgctgtgcctcttcctgcagggcgccacagctgtgctgtttgctgtgtttgtgcgctacaaccacaagacagatgctgccctgtggcacaggagcaaccacagcaatgctgacaatgagttctacttccgctacccaaatggagtgtccctgctgctgccccggctggagtgcaatggcaccatcagcgcccaccacaacctgtgcctgcccggcagcagtgacagccctgcctctgtgtcctag

SEQ ID NO: 167839 - DNA, 462 bp, Artificial Sequence
  Description of Artificial Sequence: Synthetic coding sequence
atggccggcagccccagcagagctgctggaagaaggctgcagctgcccctgctgtgcctcttcctgcagggcgccacagctgtgctgtttgctgtgtttgtgcgctacaaccacaagacagatgctgccctgtggcacaggagcaaccacagcaatgctgacaatgagttctacttccgctaccccaaggagagccacagcgtggcccaggccggcgtgcagaggaggaacctgggcagcctgcagcccagccccccccggctgcccggccgggcctgccacggcctgcggggcctgtggctgccccacggcctgcctgctgccctgcggctgcagcagaggggcctgcacctgcccccaggccgcctgtgcccagctgtggtgcacacaggccctggcctgagccccctgctgccccgctggccccacccctgctggagaggagaacatgaccagtgctag

SEQ ID NO: 167840 - DNA, 1119 bp, Artificial Sequence
  Description of Artificial Sequence: Synthetic coding sequence
atggtgtttgtgggcttcggcttcctgatggtgttcctgcagagatatggcttcagctctgtgggcttcaccttcctgctggccgcctttgccctgcagtggagcaccctggtgcagggcttcctgcacagcttccacggcggccacatccacgtgggcgtggagagcatgatcaatgctgacttctgtgccggggctgtgctgatcagctttggagctgtgctgggcaagacaggccccacccagctgctgctgatggccctgctggaggtggtgctgtttggcatcaatgaatttgtgctgctgcacctgctgggcgtgagagatgctgggggctccatgaccatccacacctttggagcctacttcggcctggtgctgagccgggtgctgtaccggccccagctggagaagagcaagcaccggcagggctctgtgtaccacagcgacctgtttgccatgattggcaccatcttcctgtggatcttctggcccagcttcaatgctgccctgacagccctgggcgccggccagcacaggacagccctgaacacctactacagcctggccgccagcaccctgggcacctttgccctgagcgccctggtgggagaagatggccgcctggacatggtgcacatccagaatgctgccctggccggcggcgtggtggtgggcaccagcagcgagatgatgctgaccccatttggagccctggccgccggcttcctggccggcaccgtgtccaccctgggctacaagttcttcacccccatcctggagagcaagttcaaggtgcaggacacctgtggggtgcacaacctgcacggcatgcctggggtgctgggcgccctgctgggcgtgctggtggccggcctggccacccatgaggcctatggagatggcctggagagcgtcttccccctgattgctgagggccagaggtctgccaccagccaggccatgcaccagctgtttggcctgtttgtgaccctgatgtttgcctctgtgggcggcggcctgggcggcctgctgctgaagctgcccttcctggacagccccccccggctgcctgccctgcggggccccagcagcctggccggggcctggagggcctag

SEQ ID NO: 167841 - DNA, 1374 bp, Artificial Sequence
  Description of Artificial Sequence: Synthetic coding sequence
atggccggcagccccagcagagctgctggaagaaggctgcagctgcccctgctgtgcctcttcctgcagggcgccacagctgtgctgtttgctgtgtttgtgcgctacaaccacaagacagatgctgccctgtggcacaggagcaaccacagcaatgctgacaatgagttctacttccgctaccccagcttccaggatgtgcacgccatggtgtttgtgggcttcggcttcctgatggtgttcctgcagagatatggcttcagctctgtgggcttcaccttcctgctggccgcctttgccctgcagtggagcaccctggtgcagggcttcctgcacagcttccatggaggccacatccacgtgggcgtggagagcatgatcaatgctgacttctgtgccggggctgtgctgatcagctttggagctgtgctgggcaagacaggccccacccagctgctgctgatggccctgctggaggtggtgctgtttggcatcaatgaatttgtgctgctgcacctgctgggcgtgagagatgctgggggctccatgaccatccacaccttcggggcctacttcggcctggtgctgagccgggtgctgtaccggccccagctggagaagagcaagcaccggcagggctctgtgtaccacagcgacctgtttgccatgattggcaccatcttcctgtggatcttctggcccagcttcaatgctgccctgacagccctgggcgccggccagcacaggacagccctgaacacctactacagcctggccgccagcaccctgggcacctttgccctgagcgccctggtgggggaggatggccgcctggacatggtgcacatccagaatgctgccctggccggcggcgtggtggtgggcaccagcagcgagatgatgctgaccccatttggagccctggccgccggcttcctggccggcaccgtgtccaccctgggctacaagttcttcacccccatcctggagagcaagttcaaggtgcaggacacctgtggggtgcacaacctgcacggcatgcctggggtgctgggcgccctgctgggcgtgctggtggccggcctggccacccatgaggcctatggagatggcctggagagcgtcttccccctgattgctgagggccagaggtctgccaccagccaggccatgcaccagctgtttggcctgtttgtgaccctgatgtttgcctctgtgggcggcggcctgggcggcctgctgctgaagctgcccttcctggaccccccagacagccagcactatgaggaccaggtgcactggcaggtgcctggagaacatgaggacaaggcccagaggcccctgcgggtggaggaggccgacacccaggcctag

SEQ ID NO: 167842 - DNA, 1326 bp, Artificial Sequence
  Description of Artificial Sequence: Synthetic coding sequence
atggccggcagccccagcagagctgctggaagaaggctgcagctgcccctgctgtgcctcttcctgcagggcgccacagctgtgctgtttgctgtgtttgtgcgctacaaccacaagacagatgctgccctgtggcacaggagcaaccacagcaatgctgacaatgagttctacttccgctaccccagcttccaggatgtgcacgccatggtgtttgtgggcttcggcttcctgatggtgttcctgcagagatatggcttcagctctgtgggcttcaccttcctgctggccgcctttgccctgcagtggagcaccctggtgcagggcttcctgcacagcttccatggaggccacatccacgtgggcgtggagagcatgatcaatgctgacttctgtgccggggctgtgctgatcagctttggagctgtgctgggcaagacaggccccacccagctgctgctgatggccctgctggaggtggtgctgtttggcatcaatgaatttgtgctgctgcacctgctgggcgtgagagatgctgggggctccatgaccatccacaccttcggggcctacttcggcctggtgctgagccgggtgctgtaccggccccagctggagaagagcaagcaccggcagggctctgtgtaccacagcgacctgtttgccatgattggcaccatcttcctgtggatcttctggcccagcttcaatgctgccctgacagccctgggcgccggccagcacaggacagccctgaacacctactacagcctggccgccagcaccctgggcacctttgccctgagcgccctggtgggggaggatggccgcctggacatggtgcacatccagaatgctgccctggccggcggcgtggtggtgggcaccagcagcgagatgatgctgaccccatttggagccctggccgccggcttcctggccggcaccgtgtccaccctgggctacaagttcttcacccccatcctggagagcaagttcaaggtgcaggacacctgtggggtgcacaacctgcacggcatgcctggggtgctgggcgccctgctgggcgtgctggtggccggcctggccacccatgaggcctatggagatggcctggagagcgtcttccccctgattgctgagggccagaggtctgccaccagccaggccatgcaccagctgtttggcctgtttgtgaccctgatgtttgcctctgtgggcggcggcctgggcggcctgctgctgaagctgcccttcctggacagccccccccggctgcctgccctgcggggccccagcagcctggccggggcctggagggcctag

SEQ ID NO: 167843 - DNA, 1230 bp, Artificial Sequence
  Description of Artificial Sequence: Synthetic coding sequence
atggtgtttgtgggcttcggcttcctgatggtgttcctgcagagatatggcttcagctctgtgggcttcaccttcctgctggccgcctttgccctgcagtggagcaccctggtgcagggcttcctgcacagcttccacggcggccacatccacgtgggcgtggagagcatgatcaatgctgacttctgtgccggggctgtgctgatcagctttggagctgtgctgggcaagacaggccccacccagctgctgctgatggccctgctggaggtggtgctgtttggcatcaatgaatttgtgctgctgcacctgctgggcgtgcgggtgtggggcggcatggagagcggcgtgggcggcggccagggccagcccctgagccaggagcggggcggcggcggcggcgtgctgcccctgaccccaccaccccaggtgagagatgctgggggctccatgaccatccacaccttcggggcctacttcggcctggtgctgagccgggtgctgtaccggccccagctggagaagagcaagcaccggcagggctctgtgtaccacagcgacctgtttgccatgattggcaccatcttcctgtggatcttctggcccagcttcaatgctgccctgacagccctgggcgccggccagcacaggacagccctgaacacctactacagcctggccgccagcaccctgggcacctttgccctgagcgccctggtgggggaggatggccgcctggacatggtgcacatccagaatgctgccctggccggcggcgtggtggtgggcaccagcagcgagatgatgctgaccccatttggagccctggccgccggcttcctggccggcaccgtgtccaccctgggctacaagttcttcacccccatcctggagagcaagttcaaggtgcaggacacctgtggggtgcacaacctgcacggcatgcctggggtgctgggcgccctgctgggcgtgctggtggccggcctggccacccatgaggcctatggagatggcctggagagcgtcttccccctgattgctgagggccagaggtctgccaccagccaggccatgcaccagctgtttggcctgtttgtgaccctgatgtttgcctctgtgggcggcggcctgggcggcctgctgctgaagctgcccttcctggacagccccccccggctgcctgccctgcggggccccagcagcctggccggggcctggagggcctag

SEQ ID NO: 167844 - DNA, 1125 bp, Artificial Sequence
  Description of Artificial Sequence: Synthetic coding sequence
atggtgtttgtgggcttcggcttcctgatggtgttcctgcagagatatggcttcagctctgtgggcttcaccttcctgctggccgcctttgccctgcagtggagcaccctggtgcagggcttcctgcacagcttccacggcggccacatccacgtgggcgtggagagcatgatcaatgctgacttctgtgccggggctgtgctgatcagctttggagctgtgctgggcaagacaggccccacccagctgctgctgatggccctgctggaggtggtgctgtttggcatcaatgaatttgtgctgctgcacctgctgggcgtgcgggtgtggggcggcatggagagcggcgtgggcggcggccagggccagcccctgagccaggagcggggcggcggcggcggcgtgctgcccctgaccccaccaccccaggtgagagatgctgggggctccatgaccatccacaccttcggggcctacttcggcctggtgctgagccgggtgctgtaccggccccagctggagaagagcaagcaccggcagggctctgtgtaccacagcgacctgtttgccatgattggcaccatcttcctgtggatcttctggcccagcttcaatgctgccctgacagccctgggcgccggccagcacaggacagccctgaacacctactacagcctggccgccagcaccctgggcacctttgccctgagcgccctggtgggggaggatggccgcctggacatgcccatcctggagagcaagttcaaggtgcaggacacctgtggggtgcacaacctgcacggcatgcctggggtgctgggcgccctgctgggcgtgctggtggccggcctggccacccatgaggcctatggagatggcctggagagcgtcttccccctgattgctgagggccagaggtctgccaccagccaggccatgcaccagctgtttggcctgtttgtgaccctgatgtttgcctctgtgggcggcggcctgggcggcatcatcctggtgctgtgcctgctggacccctgtgccctgtggcactgggtggcccccagctccatggtgggcggccgggaggccagccagatcctgccctaccaccaccagggcagctgctag

SEQ ID NO: 167845 - DNA, 687 bp, Artificial Sequence
  Description of Artificial Sequence: Synthetic coding sequence
atggccggcagccccagcagagctgctggaagaaggctgcagctgcccctgctgtgcctcttcctgcagggcgccacagctgtgctgtttgctgtgtttgtgcgctacaaccacaagacagatgctgccctgtggcacaggagcaaccacagcaatgctgacaatgagttctacttccgctaccccaggaccatcttcctgtggatcttctggcccagcttcaatgctgccctgacagccctgggcgccggccagcacaggacagccctgaacacctactacagcctggccgccagcaccctgggcacctttgccctgagcgccctggtgggggaggatggccgcctggacatggtgcacatccagaatgctgccctggccggcggcgtggtggtgggcaccagcagcgagatgatgctgaccccatttggagccctggccgccggcttcctggccggcaccgtgtccaccctgggccccagcctgaaccagaacagcaagagcaagacccacgtggagagcaccacctccatgggctgccggggctcctggggccccagctggggcagcctgtggctggacctgccccccatgaagctgacagagatgggagagttcccccccaacccctactgcagccgccaccccagcggcatgaccagcgtcatcctcttccactgtgtgtag

SEQ ID NO: 167846 - DNA, 1440 bp, Artificial Sequence
  Description of Artificial Sequence: Synthetic coding sequence
atggcctggaacaccaacctgcgctggaggctgcccctgacctgcctgctgctgcaggtgatcatggtgatcctgtttggagtgtttgtgcgctatgactttgaagcagatgcccactggtggagcgagaggacccacaagaacctgagtgacatggagaatgagttctactaccgctaccccagcttccaggatgtgcacgtgatggtgtttgtgggcttcggcttcctgatgaccttcctgcagagatatggcttctctgctgtgggcttcaacttcctgctggccgccttcggcatccagtgggccctgctgatgcagggctggttccacttcctgcaggaccgctacatcgtggtgggcgtggagaacctgatcaatgctgacttctgtgtggcctctgtgtgtgtggcctttggagctgtgctgggcaaggtgagccccatccagctgctgatcatgaccttcttccaggtgaccctgtttgctgtgaatgagttcatcctgctgaacctgctgaaggtgaaggatgctgggggctccatgaccatccacacctttggagcctacttcggcctgactgtgacccgcatcctgtacagaagaaacctggagcagagcaaggagcggcagaacagcgtgtaccagagcgacctgtttgccatgattggcaccctcttcctgtggatgtactggcccagcttcaacagcgccatctcctaccacggggacagccagcacagagctgccatcaacacctactgcagcctggccgcctgtgtgctgacctctgtggccatcagcagcgccctgcacaagaagggcaagctggacatggtgcacatccagaatgccaccctggccggcggcgtggccgtgggcacagctgctgagatgatgctgatgccctacggggccctgatcattggatttgtgtgtggcatcatcagcaccctgggctttgtgtacctgacccccttcctggagagccggctgcacatccaggacacctgtggcatcaacaacctgcacggcatccctggcatcatcggcggcatcgtgggcgctgtgacagctgccagcgccagcctggaggtgtatggcaaggagggcctggtgcacagctttgacttccagggcttcaacggggactggacagcccggacccagggcaagttccagatctacggcctgctggtgaccctggccatggccctgatgggcggcatcatcgtgggcctcatcctgcggctgcccttctggggccagcccagtgatgagaactgctttgaagatgctgtgtactgggagatgcctgagggcaacagcacagtgtacatccctgaggaccccaccttcaagcccagcggccccagcgtgcccagcgtgcccatggtgagccccctgcccatggccagctctgtgcccctggtgccctag

SEQ ID NO: 167847 - DNA, 1413 bp, Artificial Sequence
  Description of Artificial Sequence: Synthetic coding sequence
atggcctggaacacctgcctgctgctgcaggtgatcatggtgatcctgtttggagtgtttgtgcgctatgactttgaagcagatgcccactggtggagcgagaggacccacaagaacctgagtgacatggagaatgagttctactaccgctaccccagcttccaggatgtgcacgtgatggtgtttgtgggcttcggcttcctgatgaccttcctgcagagatatggcttctctgctgtgggcttcaacttcctgctggccgccttcggcatccagtgggccctgctgatgcagggctggttccacttcctgcaggaccgctacatcgtggtgggcgtggagaacctgatcaatgctgacttctgtgtggcctctgtgtgtgtggccttcggggctgtgctgggcaaggtgagccccatccagctgctgatcatgaccttcttccaggtgaccctgtttgctgtgaatgagttcatcctgctgaacctgctgaaggtgaaggatgctgggggctccatgaccatccacaccttcggggcctacttcggcctgactgtgacccgcatcctgtacagaagaaacctggagcagagcaaggagcggcagaacagcgtgtaccagagcgacctgtttgccatgattggcaccctcttcctgtggatgtactggcccagcttcaacagcgccatctcctaccatggagacagccagcaccgggccgccatcaacacctactgcagcctggccgcctgtgtgctgacctctgtggccatcagcagcgccctgcacaagaagggcaagctggacatggtgcacatccagaatgccaccctggccggcggcgtggccgtgggcacagctgctgagatgatgctgatgccctatggagccctgatcatcggctttgtgtgtggcatcatcagcaccctgggctttgtgtacctgacccccttcctggagagccggctgcacatccaggacacctgtggcatcaacaacctgcacggcatccctggcatcattggaggcatcgtgggcgctgtgacagctgccagcgccagcctggaggtgtatggcaaggagggcctggtgcacagctttgacttccagggcttcaatggagactggacagcccggacccagggcaagttccagatctacggcctgctggtgaccctggccatggccctgatgggcggcatcatcgtgggcctcatcctgcggctgcccttctggggccagcccagtgatgagaactgctttgaagatgctgtgtactgggagatgcctgagggcaacagcacagtgtacatccctgaggaccccaccttcaagcccagcggccccagcgtgcccagcgtgcccatggtgagccccctgcccatggccagctctgtgcccctggtgccctag

SEQ ID NO: 167848 - DNA, 1338 bp, Artificial Sequence
  Description of Artificial Sequence: Synthetic coding sequence
atggcctggaacaccaacctgcgctggaggctgcccctgacctgcctgctgctgcaggtgatcatggtgatcctgtttggagtgtttgtgcgctatgactttgaagcagatgcccactggtggagcgagaggacccacaagaacctgagtgacatggagaatgagttctactaccgctaccccagcttccaggatgtgcacgtgatggtgtttgtgggcttcggcttcctgatgaccttcctgcagagatatggcttctctgctgtgggcttcaacttcctgctggccgccttcggcatccagtgggccctgctgatgcagggctggttccacttcctgcaggaccgctacatcgtggtgggcgtggagaacctgatcaatgctgacttctgtgtggcctctgtgtgtgtggcctttggagctgtgctgggcaaggtgagccccatccagctgctgatcatgaccttcttccaggtgaccctgtttgctgtgaatgagttcatcctgctgaacctgctgaaggtgaaggatgctgggggctccatgaccatccacacctttggagcctacttcggcctgactgtgacccgcatcctgtacagaagaaacctggagcagagcaaggagcggcagaacagcgtgtaccagagcgacctgtttgccatgattggcaccctcttcctgtggatgtactggcccagcttcaacagcgccatctcctaccacggggacagccagcacagagctgccatcaacacctactgcagcctggccgcctgtgtgctgacctctgtggccatcagcagcgccctgcacaagaagggcaagctggacatggtgcacatccagaatgccaccctggccggcggcgtggccgtgggcacagctgctgagatgatgctgatgccctacggggccctgatcattggatttgtgtgtggcatcatcagcaccctgggctttgtgtacctgacccccttcctggagagccggctgcacatccaggacacctgtggcatcaacaacctgcacggcatccctggcatcatcggcggcatcgtgggcgctgtgacagctgccagcgccagcctggaggtgtatggcaaggagggcctggtgcacagctttgacttccagggcttcaacggggactggacagcccggacccagggcaagttccagatctacggcctgctggtgaccctggccatggccctgatgggcggcatcatcgtgggcctcatcctgcggctgcccttctggggccagcccagtgatgagaactgctttgaagatgctgtgtactgggaggacctggagctggcccccaaccagtag

SEQ ID NO: 167849 - DNA, 714 bp, Artificial Sequence
  Description of Artificial Sequence: Synthetic coding sequence
tgagacagccagcacagagctgccatcaacacctactgcagcctggccgcctgtgtgctgacctctgtggccatcagcagcgccctgcacaagaagggcaagctggacatggtgcacatccagaatgccaccctggccggcggcgtggccgtgggcacagctgctgagatgatgctgatgccctacggggccctgatcattggatttgtgtgtggcatcatcagcaccctgggctttgtgtacctgacccccttcctggagagccggctgcacatccaggacacctgtggcatcaacaacctgcacggcatccctggcatcatcggcggcatcgtgggcgctgtgacagctgccagcgccagcctggaggtgtatggcaaggagggcctggtgcacagctttgacttccagggcttcaacggggactggacagcccggacccagggcaagttccagatctacggcctgctggtgaccctggccatggccctgatgggcggcatcatcgtgggcctcatcctgcggctgcccttctggggccagcccagtgatgagaactgctttgaagatgctgtgtactgggagatgcctgagggcaacagcacagtgtacatccctgaggaccccaccttcaagcccagcggccccagcgtgcccagcgtgcccatggtgagccccctgcccatggccagctctgtgcccctggtgccctag

SEQ ID NO: 167850 - DNA, 429 bp, Artificial Sequence
  Description of Artificial Sequence: Synthetic coding sequence
atggctgctgctgtggccgccgccggggccggggagccccagagcccagatgagctgctgcccaagggagatgctgagaagccagaggaggagctggaggaggatgatgatgaggagctggatgagaccctgtctgagcggctgtggggcctgacagagatgtttcctgagcgggtgcgctctgctgctggggccacctttgacctgagcctgtttgtggcccagaagatgtaccgcttcagcagagctgccctgtggattggcaccaccagcttcatgatcctggtgctgcctgtggtgtttgaaacagagaagctgcagatggagcagcagcagcagctgcagcagaggcagatcctgctgggccccaacacaggcctgagcggcggcatgcctggggccctgcccagcctgcccgggaagatctag

SEQ ID NO: 167851 - DNA, 1083 bp, Artificial Sequence
  Description of Artificial Sequence: Synthetic coding sequence
atgagccaggagcggcccaccttctaccggcaggagctgaacaagaccatctgggaggtgcctgagcgctaccagaacctgagccctgtgggcagcggggcctacggctctgtgtgtgccgcctttgacaccaagacaggcctgcgggtggccgtgaagaagctgagccggcccttccagagcatcatccacgccaagaggacctaccgggagctgcggctgctgaagcacatgaagcatgaaaatgtcatcggcctgctggatgtgttcaccccagcccggagcctggaggagttcaatgatgtgtacctggtgacccacctgatgggcgctgacctgaacaacatcgtgaagtgccagaagctgacagatgaccacgtgcagttcctgatctaccagatcctgcggggcctgaagtacatccacagcgctgacatcatccaccgggacctgaagcccagcaacctggccgtgaatgaagactgtgagctgaagatcctggactttggcctggcccggcacacagatgatgagatgacaggctacgtggccacccgctggtaccgggcccctgagatcatgctgaactggatgcactacaaccagacagtggacatctggagcgtgggctgcatcatggccgagctgctgaccggccgcaccctcttccctggaacagaccacatcaaccagctgcagcagatcatgaggctgaccggcaccccaccagcctacctgatcaacaggatgcccagccatgaggccaggaactacatccagagcctgacccagatgcccaagatgaactttgccaacgtgttcatcggggccaaccccctggccgtggacctgctggagaagatgctggtgctggacagcgacaagaggatcacagctgcccaggccctggcccacgcctactttgcccagtaccatgaccctgatgatgagcctgtggccgacccctatgaccagagctttgagagccgggacctgctgattgatgagtggaagagcctgacctatgatgaagtcatcagctttgtgcccccacccctggaccaggaggagatggagagctag

SEQ ID NO: 167852 - DNA, 1230 bp, Artificial Sequence
  Description of Artificial Sequence: Synthetic coding sequence
atgaggttcaccttccccctgatggccatcgtgctggagatcgccatgattgtgctgtttggcctgtttgtggagtatgaaacagaccagacagtgctggagcagctgaacatcaccaagcccacagacatgggcatcttctttgagctgtaccccctcttccaggatgtgcacgtgatgatctttgtgggcttcggcttcctgatgaccttcctgaagaagtatggcttcagctctgtgggcatcaacctgctggtggccgccctgggcctgcagtggggcaccatcgtgcagggcatcctgcagagccagggccagaagttcaacatcggcatcaagaacatgatcaatgctgacttctctgctgccaccgtgctgatcagctttggagctgtgctgggcaagaccagccccacccagatgctgatcatgaccatcctggagatcgtgttctttgcccacaatgagtacctggtgtctgagatcttcaaggccagtgacatcggggcctccatgaccatccacgcctttggagcctacttcggcctggccgtggccggcatcctgtaccgcagcggcctgaggaagggccatgaaaatgaggagagcgcctactacagcgacctgtttgccatgattggcaccctcttcctgtggatgttctggcccagcttcaacagcgccatcgccgagcccggggacaagcagtgccgggccatcgtgaacacctacttcagcctggccgcctgtgtgctgacagcctttgccttcagcagcctggtggagcaccggggcaagctgaacatggtgcacatccagaatgccaccctggccggcggcgtggccgtgggcacctgtgccgacatggccatccaccccttcggctccatgatcatcggcagcattgctggcatggtgtctgtgctgggctacaagttcctgacccccctcttcaccaccaagctgcgcatccatgacacctgtggggtgcacaacctgcacggcctgcccggggtggtgggcggcctggccggcatcgtggccgtggccatgggcgccagcaacacctccatggccatgcaggccgccgccctgggcagcagcattggaacagctgtggtgggcggcctgatgacaggcctcatcctgaagctgcccctgtggggccagcccagcgaccagaactgctatgatgacagcgtgtactggaaggtgcccaagaccaggtag

SEQ ID NO: 167853 - DNA, 1233 bp, Artificial Sequence
  Description of Artificial Sequence: Synthetic coding sequence
atgaggttcaccttccccctgatggccatcgtgctggagatcgccatgattgtgctgtttggcctgtttgtggagtatgaaacagaccagacagtgctggagcagctgaacatcaccaagcccacagacatgggcatcttctttgagctgtaccccctcttccaggatgtgcacgtgatgatctttgtgggcttcggcttcctgatgaccttcctgaagaagtatggcttcagctctgtgggcatcaacctgctggtggccgccctgggcctgcagtggggcaccatcgtgcagggcatcctgcagagccagggccagaagttcaacatcggcatcaagaacatgatcaatgctgacttctctgctgccaccgtgctgatcagctttggagctgtgctgggcaagaccagccccacccagatgctgatcatgaccatcctggagatcgtgttctttgcccacaatgagtacctggtgtctgagatcttcaaggccagtgacatcggggcctccatgaccatccacgcctttggagcctacttcggcctggccgtggccggcatcctgtaccgcagcggcctgaggaagggccatgaaaatgaggagagcgcctactacagcgacctgtttgccatgattggcaccctcttcctgtggatgttctggcccagcttcaacagcgccatcgccgagcccggggacaagcagtgccgggccatcgtgaacacctacttcagcctggccgcctgtgtgctgacagcctttgccttcagcagcctggtggagcaccggggcaagctgaacatggtgcacatccagaatgccaccctggccggcggcgtggccgtgggcacctgtgccgacatggccatccaccccttcggctccatgatcatcggcagcattgctggcatggtgtctgtgctgggctacaagttcctgacccccctcttcaccaccaagctgcgcatccatgacacctgtggggtgcacaacctgcacggcctgcccggggtggtgggcggcctggccggcatcgtggccgtggccatgggcgccagcaacacctccatggccatgcaggccgccgccctgggcagcagcattggaacagctgtggtgggcggcctgatgacaggcctcatcctgaagctgcccctgtggggccagcccagcgaccagaactgctatgatgacagcgtgtactggaaggtgcccaagaccagggtgtag

SEQ ID NO: 167854 - DNA, 1146 bp, Artificial Sequence
  Description of Artificial Sequence: Synthetic coding sequence
atgaggttcaccttccccctgatggccatcgtgctggagatcgccatgattgtgctgtttggcctgtttgtggagtatgaaacagaccagacagtgctggagcagctgaacatcaccaagcccacagacatgggcatcttctttgagctgtaccccctcttccaggatgtgcacgtgatgatctttgtgggcttcggcttcctgatgaccttcctgaagaagtatggcttcagctctgtgggcatcaacctgctggtggccgccctgggcctgcagtggggcaccatcgtgcagggcatcctgcagagccagggccagaagttcaacatcggcatcaagaacatgatcaatgctgacttctctgctgccaccgtgctgatcagctttggagctgtgctgggcaagaccagccccacccagatgctgatcatgaccatcctggagatcgtgttctttgcccacaatgagtacctggtgtctgagatcttcaaggccagtgacatcggggcctccatgaccatccacgcctttggagcctacttcggcctggccgtggccggcatcctgtaccgcagcggcctgaggaagggccatgaaaatgaggagagcgcctactacagcgacctgtttgccatgattggcaccctcttcctgtggatgttctggcccagcttcaacagcgccatcgccgagcccggggacaagcagtgccgggccatcgtgaacacctacttcagcctggccgcctgtgtgctgacagcctttgccttcagcagcctggtggagcaccggggcaagctgaacatggtgcacatccagaatgccaccctggccggcggcgtggccgtgggcacctgtgccgacatggccatccaccccttcggctccatgatcatcggcagcattgctggcatggtgtctgtgctgggctacaagttcctgacccccctcttcaccaccaagctgcgcatccatgacacctgtggggtgcacaacctgcacggcctgcccggggtggtgggcggcctggccggcatcgtggccgtggccatgggcgccagcaacacctccatggccatgcaggccgccgccctgggcagcagcattggaacagctgtggtgggcggcctgatgacaggcacctag

SEQ ID NO: 167855 - DNA, 387 bp, Artificial Sequence
  Description of Artificial Sequence: Synthetic coding sequence
atgaagagcctcatcctgctggccatcctggccgccctggccgtggtgaccctgtgctacggggagtggcagaaggaggagaactttggatttgatattgtgtctgtgctgagcctgaactggcaccgggcccaggagagccatgagagcatggagagctatgagctgaaccccttcatcaacagaagaaatgccaacaccttcatcagcccccagcagcgctggagggccaaggtgcaggagcgcatccgggagaggagcaagcctgtgcatgagctgaaccgggaggcctgtgatgactaccgcctgtgtgaaagatatgccatggtgtatggctacaatgctgcctacaaccgctacttcaggaagaggcggggcaccaagtag

SEQ ID NO: 167856 - DNA, 339 bp, Artificial Sequence
  Description of Artificial Sequence: Synthetic coding sequence
atgacagagaaggcccctgagccccacgtggaggaggatgatgatgatgagctggacagcaagctgaactacaagcccccaccccagaagagcctgaaggagctgcaggagatggacaaggatgatgagagcctcatcaagtacaagaagaccctgctgggagatggccctgtggtgacagaccccaaggcccccaacgtggtggtgacccggctgaccctggtgtgtgagagcgcccctggccccatcaccatggacctgaccggggacctggaggccctgaagaaggagaccatcgtgctgaaggagggcagcgagtacagagtgaagatccactag

SEQ ID NO: 167857 - DNA, 606 bp, Artificial Sequence
  Description of Artificial Sequence: Synthetic coding sequence
atgacagagaaggcccctgagccccacgtggaggaggatgatgatgatgagctggacagcaagctgaactacaagcccccaccccagaagagcctgaaggagctgcaggagatggacaaggatgatgagagcctcatcaagtacaagaagaccctgctgggagatggccctgtggtgacagaccccaaggcccccaacgtggtggtgacccggctgaccctggtgtgtgagagcgcccctggccccatcaccatggacctgaccggggacctggaggccctgaagaaggagaccatcgtgctgaaggagggcagcgagtacagagtgaagatccacttcaaggtgaacagagacatcgtgtctggcctgaagtatgtgcagcacacctacagaactggagtgaaggtggacaaggccaccttcatggtgggcagctatggccccaggcctgaggagtatgagttcctgacccctgtggaggaggcccccaagggcatgctggcccggggcacctaccacaacaagagcttcttcacagatgatgacaagcaggaccacctgtcctgggagtggaacctgagcatcaagaaggagtggacagaatag

SEQ ID NO: 167858 - DNA, 606 bp, Artificial Sequence; identical to SEQ ID NO: 167857
  Description of Artificial Sequence: Synthetic coding sequence

SEQ ID NO: 167859 - DNA, 267 bp, Artificial Sequence
  Description of Artificial Sequence: Synthetic coding sequence
atgacagagaaggcccctgagccccacgtggaggaggatgatgatgatgagctggacagcaagctgaactacaagcccccaccccagaagagcctgaaggagctgcaggagatggacaaggatgatgagagcctcatcaagtacaagaagaccctgctgggagatggccctgtggtgacagaccccaaggcccccaacgtggtggtgacccggctgaccctggtgtgtgagagcgcccctggccccatcaccatggacctgacctag

SEQ ID NO: 167860 - DNA, 480 bp, Artificial Sequence
  Description of Artificial Sequence: Synthetic coding sequence
atgacagagaaggcccctgagccccacgtggaggaggatgatgatgatgagctggacagcaagctgaactacaagcccccaccccagaagagcctgaaggagctgcaggagatggacaaggatgatgagagcctcatcaagtacaagaagaccctgctgggagatggccctgtggtgacagaccccaaggcccccaacgtggtggtgacccggctgaccctggtgtgtgagagcgcccctggccccatcaccatggacctgaccggggacctggaggccctgaagaaggagaccatcgtgctgaaggagggcagcgagtacagagtgaagatccacttcaaggtgaacagagacatcgtgtctggcctgaagtatgtgcagcacacctacagaactggagtgaaggtggacaaggccaccttcatggtgggcagctatggccccaggcctgaggagtatgagttcctgacccctgtgtag

SEQ ID NO: 167861 - DNA, 1320 bp, Artificial Sequence
  Description of Artificial Sequence: Synthetic coding sequence
atggaccccctgtctgagctgcaggatgacctgaccctggatgacaccagcgaggccctgaaccagctgaagctggccagcattgatgagaagaactggcccagtgatgagatgccagacttccccaagagtgatgacagcaagagcagcagccctgagctggtgacccacctgaagtgggatgacccctactatgacatcgcccggcaccagatcgtggaggtggccggagatgacaagtatggcaggaagatcatcgtgttttctgcctgcaggatgccacccagccaccagctggaccacagcaagctgctgggctacctgaagcacaccctggaccagtatgtggagagtgactacaccctgctgtacctgcaccacggcctgaccagtgacaacaagcccagcctgtcctggctgagagatgcctaccgggagtttgacaggaagtacaagaagaacatcaaggccctgtacatcgtgcaccccaccatgttcatcaagaccctgctgatcctcttcaagcccctcatctccttcaagtttggccagaagatcttctacgtgaactacctgtctgagctgtctgagcacgtgaagctggagcagctgggcatcccccggcaggtgctgaagtatgatgacttcctgaagagcacccagaagagccctgccacagcccccaagcccatgccacccaggcctcccctgcccaaccagcagtttggagtgtccctgcagcacctgcaggagaagaaccctgagcaggagcccatccccatcgtgctgcgggagaccgtggcctacctgcaggcccacgccctgaccacagagggcatcttccgccgcagcgccaacacccaggtggtgcgggaggtgcagcagaagtacaacatgggcctgcctgtggactttgaccagtacaatgagctgcacctgcctgctgtgatcctgaagaccttcctgcgggagctgcctgagcccctgctgacctttgacctgtacccccacgtggtgggcttcctgaacattgatgagagccagagggtgcctgccaccctgcaggtgctgcagaccctgcctgaggagaactaccaggtgctgcgcttcctgacagccttcctggtgcagatcagcgcccacagcgaccagaacaagatgaccaacaccaacctggccgtggtgtttggccccaacctgctgtgggccaaggatgctgccatcaccctgaaggccatcaaccccatcaacaccttcaccaagttcctgctggaccaccagggcgagctgttccccagcccagaccccagcggcctgtag

SEQ ID NO: 167862 - DNA, 1377 bp, Artificial Sequence
  Description of Artificial Sequence: Synthetic coding sequence
atggaccccctgtctgagctgcaggatgacctgaccctggatgacaccagcgaggccctgaaccagctgaagctggccagcattgatgagaagaactggcccagtgatgagatgccagacttccccaagagtgatgacagcaagagcagcagccctgagctggtgacccacctgaagtgggatgacccctactatgacatcgcccggcaccagatcgtggaggtggccggagatgacaagtatggcaggaagatcatcgtgttttctgcctgcaggatgccacccagccaccagctggaccacagcaagctgctgggctacctgaagcacaccctggaccagtatgtggagagtgactacaccctgctgtacctgcaccacggcctgaccagtgacaacaagcccagcctgtcctggctgagagatgcctaccgggagtttgacaggaagtacaagaagaacatcaaggccctgtacatcgtgcaccccaccatgttcatcaagaccctgctgatcctcttcaagcccctcatctccttcaagtttggccagaagatcttctacgtgaactacctgtctgagctgtctgagcacgtgaagctggagcagctgggcatcccccggcaggtgctgaagtatgatgacttcctgaagagcacccagaagagccctgccacagcccccaagcccatgccacccaggcctcccctgcccaaccagcagtttggagtgtccctgcagcacctgcaggagaagaaccctgagcaggagcccatccccatcgtgctgcgggagaccgtggcctacctgcaggcccacgccctgaccacagagggcatcttccgccgcagcgccaacacccaggtggtgcgggaggtgcagcagaagtacaacatgggcctgcctgtggactttgaccagtacaatgagctgcacctgcctgctgtgatcctgaagaccttcctgcgggagctgcctgagcccctgctgacctttgacctgtacccccacgtggtgggcttcctgaacattgatgagagccagagggtgcctgccaccctgcaggtgctgcagaccctgcctgaggagaactaccaggtgctgcgcttcctgacagccttcctggtgcagatcagcgcccacagcgaccagaacaagatgaccaacaccaacctggccgtggtgtttggccccaacctgctgtgggccaaggatgctgccatcaccctgaaggccatcaaccccatggccaccttcttcttcttcttcctgcgctggagcctggccctgagccctggctggagcgctgtggcccggagccgccacaccagcgccttctgggtgcaggccatcctgctgccccagcccccagagtag

SEQ ID NO: 167863 - DNA, 579 bp, Artificial Sequence
  Description of Artificial Sequence: Synthetic coding sequence
atggaccccctgtctgagctgcaggatgacctgaccctggatgacaccagcgaggccctgaaccagctgaagctggccagcattgatgagaagaactggcccagtgatgagatgccagacttccccaagagtgatgacagcaagagcagcagccctgagctggtgacccacctgaagtgggatgacccctactatgacatcgcccggcaccagatcgtggaggtggccggagatgacaagtatggcaggaagatcatcgtgttttctgcctgcaggatgccacccagccaccagctggaccacagcaagctgctgggctacctgaagcacaccctggaccagtatgtggagagtgactacaccctgctgtacctgcaccacggcctgaccagtgacaacaagcccagcctgtcctggctgagagatgcctaccgggagtttgacaggaagtacaagaagaacatcaaggccctgtacatcgtgcaccccaccatgttcatcaagaccctgctgatcctcttcaagcccctcatctccttcaagtttggccagaagatcttctacgtgaactacctgtag

SEQ ID NO: 167864 - DNA, 2361 bp, Artificial Sequence
  Description of Artificial Sequence: Synthetic coding sequence
atgggcctgcagcccctggagttcagtgactgctacctggacagcccctggttccgggagcgcatccgggcccatgaagctgagctggagaggaccaacaagttcatcaaggagctgatcaaggatggcaagaacctgattgctgccaccaagagcctgtctgtggcccagaggaagtttgcccacagcctgcgggacttcaagtttgagttcatcggagatgctgtgacagatgatgagcgctgcattgatgccagcctgcgggagttcagcaacttcctgaagaacctggaggagcagcgggagatcatggccctgtctgtgacagagaccctcatcaagcccctggagaagttcaggaaggagcagctgggcgctgtgaaggaggagaagaagaagtttgacaaggagacagagaagaactacagcctgattgacaagcacctgaacctgagcgccaagaagaaggacagccacctgcaggaggccgacatccaggtggagcagaaccggcagcacttctatgagctgagcctggagtatgtgtgcaagctgcaggagatccaggagaggaagaagtttgaatttgtggagcccatgctgtccttcttccagggcatgttcaccttctaccaccagggccacgagctggccaaggacttcaaccactacaagatggagctgcagatcaacatccagaacaccaggaacagatttgagggcaccaggtctgaggtggaggagctgatgaacaagatccggcagaaccccaaggaccacaagagggccagccagttcaccgctgagggctacctgtatgtgcaggagaagaggcctgcccccttcggcagctcctgggtgaagcactactgcatgtacaggaaggccgccaagaagttcaacatgatcccctttgagcacaggtctgggggcaagctgggagatggagaggtgttcttcctgaaggaatgtaccaagaggcacacagacagcattgaccggcgcttctgctttgacatcgaggccgctgacaggcctggggtgtccctgaccatgcaggccttcagcgaggaggagaggaagcagtggctggaggccctgggcggcaaggaggccctgagccacagcttcaacacagccatcatccccaggcctgagggcaatgcccagctggacaagatgggcttcaccatcatcaggaagtgcatctctgctgtggagacccggggcatcaatgaccagggcctgtacagagtggtgggcgtgagcagcaaggtgcagaggctgctgtccatgctgatggatgtgaagacctgcaatgaggtggacctggagaacagcgctgactgggaggtgaagaccatcaccagcgccctgaagcagtacctgcggagcctgcctgagcccctgatgacctatgagctgcacggggacttcatcgtgcctgccaagagcggcagccctgagagccgggtgaatgccatccacttcctggtgcacaagctgcctgagaagaacaaggagatgctggacatcctggtgaagcacctgaccaacgtgagcaaccacagcaagcagaacctgatgacagtggccaacctgggcgtggtgtttggccccaccctgatgaggccccaggaggagaccgtggccgccctgatggacctgaagttccagaacatcgtggtggagatcctgattgagaaccacgagaagatcttccgcaccccaccagacaccaccttccctgagcccacctgcctgagcgccagccccccaaatgccccaccccggcagagcaagaggcagggccagaggaccaagaggcctgtggccgtgtacaacctgtgcctggagctggaggatggagacaacccctaccccagcaaagaagacacccccaccagcagcctggacagcctgagcagccccagccctgtgaccacagctgtgcccggccccccaggccctgacaagaaccacctgctggctgatggcggcagctttggagactgggccagcaccatccctggccagaccaggagctccatggtgcagtggctgaacccccagagccccaccaccaccagcagcaacagcgctgtgacccccctgagccctggcagcagccccttccccttcagccccccagccaccgtggccgacaagcccccagagagcatccgcagcaggaaggcccgggctgtgtacccctgtgaggccgagcacagcagcgagctgagctttgaaattggagccatctttgaagatgtgcagaccagccgggagcccggctggctggagggcaccctgaatggcaagaggggcctcatcccccagaactacgtgaagctgctgtag

SEQ ID NO: 167865 - DNA, 1155 bp, Artificial Sequence
  Description of Artificial Sequence: Synthetic coding sequence
atgcaggccttcagcgaggaggagaggaagcagtggctggaggccctgggcggcaaggaggccctgagccacagcttcaacacagccatcatccccaggcctgagggcaatgcccagctggacaagatgggcttcaccatcatcaggaagtgcatctctgctgtggagacccggggcatcaatgaccagggcctgtacagagtggtgggcgtgagcagcaaggtgcagaggctgctgtccatgctgatggatgtgaagacctgcaatgaggtggacctggagaacagcgctgactgggaggtgaagaccatcaccagcgccctgaagcagtacctgcggagcctgcctgagcccctgatgacctatgagctgcatggagacttcatcgtgcctgccaagagcggcagccctgagagccgggtgaatgccatccacttcctggtgcacaagctgcctgagaagaacaaggagatgctggacatcctggtgaagcacctgaccaacgtgagcaaccacagcaagcagaacctgatgacagtggccaacctgggcgtggtgtttggccccaccctgatgaggccccaggaggagaccgtggccgccctgatggacctgaagttccagaacatcgtggtggagatcctgattgaaaatcatgagaagatcttccgcaccccaccagacaccaccttccctgagcccacctgcctgagcgccagccccccaaatgccccaccccggcagagcaagaggcagggccagaggaccaagaggcctgtggccgtgtacaacctgtgcctggagctggaggatggagacaacccctaccccagcaaggaggacacccccaccagcagcctggacagcctgagcagccccagccctgtgaccacagctgtgcccggccccccaggccctgacaagaaccacctgctggctgatggcggcagctttggagactgggccagcaccatcatccgcagcaggaaggcccgggctgtgtacccctgtgaggccgagcacagcagcgagctgagctttgaaattggagccatctttgaagatgtgcagaccagccgggagcccggctggctggagggcaccctgaatggcaagaggggcctcatcccccagaactacgtgaagctgctgtag

SEQ ID NO: 167866 - DNA, 3072 bp, Artificial Sequence
  Description of Artificial Sequence: Synthetic coding sequence
atgtgggaccagaggctggtgcggctggccctgctgcagcacctgcgggccttctacggcatcaaggtgaagggcgtgcggggccagtgtgacagaagaagacatgaaacagctgccacagagatcggcggcaagatctttggagtgcccttcaatgccctgccccacagcgctgtgcctgaatatggccacatccccagcttcctggtggatgcctgcaccagcctggaggaccacatccacacagagggcctcttcaggaagagcggcagcgtcatccggctgaaggccctgaagaacaaggtggaccacggggagggctgcctgagcagcgccccaccctgtgacattgctggcctgctgaagcagttcttccgggagctgcctgagcccatcctgcctgctgacctgcacgaggccctgctgaaggcccagcagctgggcacagaggagaagaacaaggccaccctgctgctgagctgcctgctggccgaccacacagtgcacgtgctgcgctacttcttcaacttcctgagaaatgtgtccctgcggagcagcgagaacaagatggacagcagcaacctggccgtcatctttgcccccaacctgctgcagaccagcgagggccacgagaagatgagcagcaacacagagaagaagctgcggctgcaggccgctgtggtgcagaccctgattgattatgccagtgacatcggccgggtgcctgacttcatcctggagaagatcccagccatgctgggcattgatggcctgtgtgccacccccagcctggagggctttgaggagggggagtatgagaccccaggagagtacaagaggaagaggcggcagagcgtgggggactttgtgtctggggccctgaacaagttcaagcccaacagaacacccagcatcaccccccaggaggagcgcatcgcccagctgtctgagagccctgtgatcctgaccccaaatgccaagaggaccctgcctgtggacagcagccacggcttcagcagcaagaagaggaagagcatcaagcacaacttcaactttgagctgctgcccagcaacctcttcaacagcagcagcacccctgtgtctgtgcacatcgacaccagcagcgagggcagcagccagagcagcctgagccctgtgctgattggaggcaaccacctgatcacagctggggtgccccggcgcagcaagagaattgctgggaagaaggtgtgccgggtggagagcggcaaggccggctgcttcagccccaagatcagccacaaggagaaggtgcggcgcagcctgcggctgaagttcaacctgggcaagaatggccgggaggtgaatggctgcagcggcgtgaacagatatgaatctgtgggctggaggctggccaaccagcagagcctgaagaaccgcatcgagagcgtgaagacaggcctgctcttctccccagatgtggatgagaagctgcccaagaagggcagcgagaagatcagcaagtctgaggagaccctgctgaccccagagcggctggtgggcaccaactacaggatgtcctggacaggccccaacaacagcagcttccaggaggtggatgccaatgaggccagctccatggtggagaacctggaggtggagaacagcctggagccagacatcatggtggagaagagccctgccaccagctgtgagctgacccccagcaacctgaacaacaagcacaacagcaacatcaccagcagccccctgtctggagatgagaacaacatgaccaaggagaccctggtgaaggtgcagaaggccttcagcgagagcggcagcaacctgcacgccctgatgaaccagaggcagagctctgtgaccaacgtgggcaaggtgaagctgacagagcccagctacctggaggacagccctgaggagaacctgtttgagaccaatgacctgaccatcgtggagagcaaggagaagtatgagcaccacacaggcaagggggagaagtgcttcagcgagcgggacttcagccccctgcagacccagaccttcaaccgggagaccaccatcaagtgctacagcacccagatgaagatggagcacgagaaggacatccacagcaacatgcccaaggactacctgagcaagcaggagttcagcagtgatgaggagatcaagaagcagcagagccccaaggacaagctgaacaacaagctgaaggaaaatgaaaacatgatggagggcaacctgcccaagtgtgccgcccacagcaaggatgaggcccggagcagcttcagccagcagagcacctgtgtggtgaccaacctgagcaagccccggcccatgagaattgccaagcagcagagcctggagacctgtgagaagacagtgtctgagagcagccagatgacagagcacaggaaggtgtctgaccacatccagtggttcaacaagctgagcctgaatgagcccaaccgcatcaaggtgaagagccccctgaagttccagaggacccctgtgcggcagagcgtgcggcgcatcaacagcctgctggagtacagccggcagcccaccggccacaagctggccagcctgggggacacagccagccccctggtgaagtctgtgtcctgtgatggagccctgagcagctgcatcgagagcgccagcaaggacagctctgtgtcctgcatcaagagcggccccaaggagcagaagtccatgagctgtgaggagagcaacattggagccatcagcaagagctccatggagctgcccagcaagagcttcctgaagatgaggaagcacccagattctgtgaatgccagcctgcggagcaccaccgtgtacaagcagaagatcctgagtgatggccaggtgaaggtgcccctggatgacctgaccaaccacgacatcgtgaagcctgtggtgaacaacaacatgggcatcagcagcggcatcaacaacagagtgctgcggcggcccagcgagcggggccgggcctggtacaagggcagccccaagcaccccatcggcaagacccagctgctgcccaccagcaagcctgtggacctgtag

SEQ ID NO: 167867 - DNA, 2505 bp, Artificial Sequence
  Description of Artificial Sequence: Synthetic coding sequence
atggacagcagcaacctggccgtcatctttgcccccaacctgctgcagaccagcgagggccacgagaagatgagcagcaacacagagaagaagctgcggctgcaggccgctgtggtgcagaccctgattgattatgccagtgacatcggccgggtgcctgacttcatcctggagaagatcccagccatgctgggcattgatggcctgtgtgccacccccagcctggagggctttgaggagggggagtatgagaccccaggagagtacaagaggaagaggcggcagagcgtgggggactttgtgtctggggccctgaacaagttcaagcccaacagaacacccagcatcaccccccaggaggagagaattgcccagctgtctgagagccctgtgatcctgaccccaaatgccaagaggaccctgcctgtggacagcagccacggcttcagcagcaagaagaggaagagcatcaagcacaacttcaactttgagctgctgcccagcaacctcttcaacagcagcagcacccctgtgtctgtgcacatcgacaccagcagcgagggcagcagccagagcagcctgagccctgtgctgattggaggcaaccacctgatcacagctggggtgcccaggaggagcaagagaattgctgggaagaaggtgtgccgggtggagagcggcaaggccggctgcttcagccccaagatcagccacaaggagaaggtgagaagaagcctgcggctgaagttcaacctgggcaagaatggccgggaggtgaatggctgcagcggcgtgaacagatatgagagcgtgggctggaggctggccaaccagcagagcctgaagaacagaattgaatctgtgaagacaggcctgctcttctccccagatgtggatgagaagctgcccaagaagggcagcgagaagatcagcaagtctgaggagaccctgctgaccccagagcggctggtgggcaccaactacaggatgtcctggacaggccccaacaacagcagcttccaggaggtggatgccaatgaggccagctccatggtggagaacctggaggtggagaacagcctggagccagacatcatggtggagaagagccctgccaccagctgtgagctgacccccagcaacctgaacaacaagcacaacagcaacatcaccagcagccccctgtctggagatgagaacaacatgaccaaggagaccctggtgaaggtgcagaaggccttcagcgagagcggcagcaacctgcacgccctgatgaaccagaggcagagctctgtgaccaacgtgggcaaggtgaagctgacagagcccagctacctggaggacagccctgaggagaacctgtttgagaccaatgacctgaccatcgtggagagcaaggagaagtatgagcaccacactggaaaaggagagaagtgcttcagcgagcgggacttcagccccctgcagacccagaccttcaaccgggagaccaccatcaagtgctacagcacccagatgaagatggagcacgagaaggacatccacagcaacatgcccaaggactacctgagcaagcaggagttcagcagtgatgaggagatcaagaagcagcagagccccaaggacaagctgaacaacaagctgaaggaaaatgaaaacatgatggagggcaacctgcccaagtgtgccgcccacagcaaggatgaggcccggagcagcttcagccagcagagcacctgtgtggtgaccaacctgagcaagccccggcccatgagaattgccaagcagcagagcctggagacctgtgagaagacagtgtctgagagcagccagatgacagagcacaggaaggtgtctgaccacatccagtggttcaacaagctgagcctgaatgagcccaaccgcatcaaggtgaagagccccctgaagttccagaggacccctgtgcggcagagcgtgcggcgcatcaacagcctgctggagtacagccggcagcccaccggccacaagctggccagcctgggggacacagccagccccctggtgaagtctgtgtcctgtgatggagccctgagcagctgcattgaaagtgccagcaaggacagctctgtgtcctgcatcaagagcggccccaaggagcagaagtccatgagctgtgaggagagcaacatcggggccatcagcaagagctccatggagctgcccagcaagagcttcctgaagatgaggaagcacccagacagcgtgaatgccagcctgcggagcaccaccgtgtacaagcagaagatcctgagtgatggccaggtgaaggtgcccctggatgacctgaccaaccacgacatcgtgaagcctgtggtgaacaacaacatgggcatcagcagcggcatcaacaacagagtgctgcggcggcccagcgagcggggccgggcctggtacaagggcagccccaagcaccccatcggcaagacccagctgctgcccaccagcaagcctgtggacctgtag

SEQ ID NO: 167868 - DNA, 1506 bp, Artificial Sequence
  Description of Artificial Sequence: Synthetic coding sequence
atgtgggaccagaggctggtgcggctggccctgctgcagcacctgcgggccttctacggcatcaaggtgaagggcgtgcggggccagtgtgacagaagaagacatgaaacagctgccacagagatcggcggcaagatctttggagtgcccttcaatgccctgccccacagcgctgtgcctgaatatggccacatccccagcttcctggtggatgcctgcaccagcctggaggaccacatccacacagagggcctcttcaggaagagcggcagcgtcatccggctgaaggccctgaagaacaaggtggaccacggggagggctgcctgagcagcgccccaccctgtgacattgctggcctgctgaagcagttcttccgggagctgcctgagcccatcctgcctgctgacctgcacgaggccctgctgaaggcccagcagctgggcacagaggagaagaacaaggccaccctgctgctgagctgcctgctggccgaccacacagtgcacgtgctgcgctacttcttcaacttcctgagaaatgtgtccctgcggagcagcgagaacaagatggacagcagcaacctggccgtcatctttgcccccaacctgctgcagaccagcgagggccacgagaagatgagcagcaacacagagaagaagctgcggctgcaggccgctgtggtgcagaccctgattgattatgccagtgacatcggccgggtgcctgacttcatcctggagaagatcccagccatgctgggcattgatggcctgtgtgccacccccagcctggagggctttgaggagggggagtatgagaccccaggagagtacaagaggaagaggcggcagagcgtgggggactttgtgtctggggccctgaacaagttcaagcccaacagaacacccagcatcaccccccaggaggagcgcatcgcccagctgtctgagagccctgtgatcctgaccccaaatgccaagaggaccctgcctgtggacagcagccacggcttcagcagcaagaagaggaagagcatcaagcacaacttcaactttgagctgctgcccagcaacctcttcaacagcagcagcacccctgtgtctgtgcacatcgacaccagcagcgagggcagcagccagagcagcctgagccctgtgctgattggaggcaaccacctgatcacagctggggtgccccggcgcagcaagagaattgctgggaagaaggtgtgccgggtggagagcggcaaggccggctgcttcagccccaagatcagccacaaggagaaggtgcggcgcagcctgcggctgaagttcaacctgggcaagaatggccgggaggtgaatggctgcagcggcgtgaacagatatgaatctgtgggctggaggctggccaaccagcagagcctgaagaaccgcatcgagagcgtgaagacaggcctgctcttctccccagatgtggatgagaagctgcccaagaagggcaccttcacctactactgctag

SEQ ID NO: 167869 - DNA, 2385 bp, Artificial Sequence
  Description of Artificial Sequence: Synthetic coding sequence
atgaagatggctgacagaagtggcaagatcatccctggccaggtgtacatcgaggtggagtatgactatgaatatgaggccaaggacaggaagatcgtcatcaagcagggcgagcgctacatcctggtgaagaagaccaatgatgactggtggcaggtgaagccagatgagaacagcaaggccttctacgtgcctgcccagtatgtgaaggaggtgaccaggaaggccctgatgcctcctgtgaagcaggtggccggcctgcccaacaacagcaccaagatcatgcagagcctgcacctgcagaggagcacagaaaatgtgaacaagctgcctgagctgagcagctttgggaagcccagcagctctgtgcagggcaccggcctcatcagagatgccaaccagaactttggccccagctacaaccagggccagacagtgaacctgagcctggacctgacccacaacaacgggaagttcaacaatgacagccacagccccaaggtgagcagccagaacagaaccaggagctttggccacttccctggccctgagttcctggatgtggagaagaccagcttcagccaggagcagagctgtgacagcgctggggagggcagcgagcgcatccaccaggacagcgagagcggagatgagctgagcagcagcagcacagagcagatccgggccaccaccccacccaaccagggccgcccagacagccctgtgtatgccaacctgcaggagctgaagatcagccagagcgccctgccccccctgcccggcagccctgccatccagatcaacggggagtgggagacccacaaggacagcagcggccgctgctactactacaacagaggcacccaggagaggacctggaagcccccacgctggaccagagatgccagcatcagcaagggggacttccagaaccctggggaccaggagtggctgaagcacgtggatgaccagggccggcagtactactacagcgcagatggcagccgctctgagtgggagctgcccaagtacaatgccagcagccagcagcagcgggagatcatcaagagccgcagcctggaccggcggctgcaggagcccatcgtgctgaccaagtggaggcacagcaccatcgtgctggacaccaatgacaaggagagccccacagccagcaagccctgcttcccagaaaatgaaagcagccccagcagccccaagcaccaggacacagaccaggagaagtatggcctgctgaatgtgaccaagattgctgaaaatggcaagaaggtgaggaagaactggctgagctcctgggccgtgctgcagggcagcagcctgctcttcaccaagacccagggcagcagcacctcctggtttggcagcaaccagagcaagccagagttcaccgtggacctgaagggggccaccatcgagatggccagcaaggacaagagcagcaagaagaatgtgtttgagctgaagacccggcagggcacagagctgctgatccagagcgacaatgacaccgtcatcaatgactggttcaaggtgctgagcagcaccatcaacaaccaggccgtggagacagatgagggcatcgaggaggagatcccagacagccctggcatcgagaagcatgacaaggagaaggagcagaaggaccccaagaagctgcggagcttcaaggtgagcagcattgacagcagcgagcagaagaagaccaagaagaacctgaagaagttcctgacccggcggcccaccctgcaggccgtgcgggagaagggctacatcaaggaccaggtgtttggcagcaacctggccaacctgtgccagagagaaaatggcaccgtgcccaagtttgtgaagctgtgcattgaacatgtggaggagcacggcctggacattgatggcatctacagagtgtctggcaacctggccgtcatccagaagctgcgctttgctgtgaaccatgatgagaagctggacctgaatgacagcaagtgggaggacatccacgtgatcactggagccctgaagatgttcttccgggagctgcctgagcccctcttcaccttcaaccacttcaatgactttgtgaatgccatcaagcaggagccccggcagagggtggccgctgtgaaggacctgatccggcagctgcccaagcccaaccaggacaccatgcagatcctcttccgccacctgcggcgggtgattgaaaatggagagaagaacaggatgacctaccagagcatcgccatcgtgtttggccccaccctgctgaagccagagaaggagactggaaatattgctgtgcacacagtgtaccagaaccagatcgtggagctgatcctgctggagctgagcagcatcttcggccgctag

SEQ ID NO: 167870 - DNA, 2541 bp, Artificial Sequence
  Description of Artificial Sequence: Synthetic coding sequence
atgaagatggctgacagaagtggcaagatcatccctggccaggtgtacatcgaggtggagtatgactatgaatatgaggccaaggacaggaagatcgtcatcaagcagggcgagcgctacatcctggtgaagaagaccaatgatgactggtggcaggtgaagccagatgagaacagcaaggccttctacgtgcctgcccagtatgtgaaggaggtgaccaggaaggccctgatgcctcctgtgaagcaggtggccggcctgcccaacaacagcaccaagatcatgcagagcctgcacctgcagaggagcacagaaaatgtgaacaagctgcctgagctgagcagctttgggaagcccagcagctctgtgcagggcaccggcctcatcagagatgccaaccagaactttggccccagctacaaccagggccagacagtgaacctgagcctggacctgacccacaacaacgggaagttcaacaatgacagccacagccccaaggtgagcagccagaacagaaccaggagctttggccacttccctggccctgagttcctggatgtggagaagaccagcttcagccaggagcagagctgtgacagcgctggggagggcagcgagcgcatccaccaggacagcgagagcggagatgagctgagcagcagcagcacagagcagatccgggccaccaccccacccaaccagggccgcccagacagccctgtgtatgccaacctgcaggagctgaagatcagccagagcgccctgccccccctgcccggcagccctgccatccagatcaacggggagtgggagacccacaaggacagcagcggccgctgctactactacaacagaggcacccaggagaggacctggaagcccccacgctggaccagagatgccagcatcagcaagggggacttccagaaccctggggaccaggagctgctgagcagcgaggagaactactacagcaccagctacagccagagcgacagccagtgtggcagccccccccggggctggagcgaggagctggatgagcggggccacaccctgtacaccagtgactacaccaatgagaagtggctgaagcacgtggatgaccagggccggcagtactactacagcgcagatggcagccgctctgagtgggagctgcccaagtacaatgccagcagccagcagcagcgggagatcatcaagagccgcagcctggaccggcggctgcaggagcccatcgtgctgaccaagtggaggcacagcaccatcgtgctggacaccaatgacaaggagagccccacagccagcaagccctgcttcccagaaaatgaaagcagccccagcagccccaagcaccaggacacagccagcagccccaaggaccaggagaagtatggcctgctgaatgtgaccaagattgctgaaaatggcaagaaggtgaggaagaactggctgagctcctgggccgtgctgcagggcagcagcctgctcttcaccaagacccagggcagcagcacctcctggtttggcagcaaccagagcaagccagagttcaccgtggacctgaagggggccaccatcgagatggccagcaaggacaagagcagcaagaagaatgtgtttgagctgaagacccggcagggcacagagctgctgatccagagcgacaatgacaccgtcatcaatgactggttcaaggtgctgagcagcaccatcaacaaccaggccgtggagacagatgagggcatcgaggaggagatcccagacagccctggcatcgagaagcatgacaaggagaaggagcagaaggaccccaagaagctgcggagcttcaaggtgagcagcattgacagcagcgagcagaagaagaccaagaagaacctgaagaagttcctgacccggcggcccaccctgcaggccgtgcgggagaagggctacatcaaggaccaggtgtttggcagcaacctggccaacctgtgccagagagaaaatggcaccgtgcccaagtttgtgaagctgtgcattgaacatgtggaggagcacggcctggacattgatggcatctacagagtgtctggcaacctggccgtcatccagaagctgcgctttgctgtgaaccatgatgagaagctggacctgaatgacagcaagtgggaggacatccacgtgatcactggagccctgaagatgttcttccgggagctgcctgagcccctcttcaccttcaaccacttcaatgactttgtgaatgccatcaagcaggagccccggcagagggtggccgctgtgaaggacctgatccggcagctgcccaagcccaaccaggacaccatgcagatcctcttccgccacctgcggcgggtgattgaaaatggagagaagaacaggatgacctaccagagcatcgccatcgtgtttggccccaccctgctgaagccagagaaggagactggaaatattgctgtgcacacagtgtaccagaaccagatcgtggagctgatcctgctggagctgagcagcatcttcggccgctag

SEQ ID NO: 167871 - DNA, 2385 bp, Artificial Sequence; identical to SEQ ID NO: 167869
  Description of Artificial Sequence: Synthetic coding sequence

SEQ ID NO: 167872 - DNA, 2451 bp, Artificial Sequence
  Description of Artificial Sequence: Synthetic coding sequence
atgaagatggctgacagaagtggcaagatcatccctggccaggtgtacatcgaggtggagtatgactatgaatatgaggccaaggacaggaagatcgtcatcaagcagggcgagcgctacatcctggtgaagaagaccaatgatgactggtggcaggtgaagccagatgagaacagcaaggccttctacgtgcctgcccagtatgtgaaggaggtgaccaggaaggccctgatgcctcctgtgaagcaggtggccggcctgcccaacaacagcaccaagatcatgcagagcctgcacctgcagaggagcacagaaaatgtgaacaagctgcctgagctgagcagctttgggaagcccagcagctctgtgcagggcaccggcctcatcagagatgccaaccagaactttggccccagctacaaccagggccagacagtgaacctgagcctggacctgacccacaacaacgggaagttcaacaatgacagccacagccccaaggtgagcagccagaacagaaccaggagctttggccacttccctggccctgagttcctggatgtggagaagaccagcttcagccaggagcagagctgtgacagcgctggggagggcagcgagcgcatccaccaggacagcgagagcggagatgagctgagcagcagcagcacagagcagatccgggccaccaccccacccaaccagggccgcccagacagccctgtgtatgccaacctgcaggagctgaagatcagccagagcgccctgccccccctgcccggcagccctgccatccagatcaacggggagtgggagacccacaaggacagcagcggccgctgctactactacaacagaggcacccaggagaggacctggaagcccccacgctggaccagagatgccagcatcagcaagggggacttccagaaccctggggaccaggagctgctgagcagcgaggagaactactacagcaccagctacagccagagcgacagccagtgtggcagccccccccggggctggagcgaggagctggatgagcggggccacaccctgtacaccagtgactacaccaatgagaagtggctgaagcacgtggatgaccagggccggcagtactactacagcgcagatggcagccgctctgagtgggagctgcccaagtacaatgccagcagccagcagcagcgggagatcatcaagagccgcagcctggaccggcggctgcaggagcccatcgtgctgaccaagtggaggcacagcaccatcgtgctggacaccaatgacaaggaccaggagaagtatggcctgctgaatgtgaccaagattgctgaaaatggcaagaaggtgaggaagaactggctgagctcctgggccgtgctgcagggcagcagcctgctcttcaccaagacccagggcagcagcacctcctggtttggcagcaaccagagcaagccagagttcaccgtggacctgaagggggccaccatcgagatggccagcaaggacaagagcagcaagaagaatgtgtttgagctgaagacccggcagggcacagagctgctgatccagagcgacaatgacaccgtcatcaatgactggttcaaggtgctgagcagcaccatcaacaaccaggccgtggagacagatgagggcatcgaggaggagatcccagacagccctggcatcgagaagcatgacaaggagaaggagcagaaggaccccaagaagctgcggagcttcaaggtgagcagcattgacagcagcgagcagaagaagaccaagaagaacctgaagaagttcctgacccggcggcccaccctgcaggccgtgcgggagaagggctacatcaaggaccaggtgtttggcagcaacctggccaacctgtgccagagagaaaatggcaccgtgcccaagtttgtgaagctgtgcattgaacatgtggaggagcacggcctggacattgatggcatctacagagtgtctggcaacctggccgtcatccagaagctgcgctttgctgtgaaccatgatgagaagctggacctgaatgacagcaagtgggaggacatccacgtgatcactggagccctgaagatgttcttccgggagctgcctgagcccctcttcaccttcaaccacttcaatgactttgtgaatgccatcaagcaggagccccggcagagggtggccgctgtgaaggacctgatccggcagctgcccaagcccaaccaggacaccatgcagatcctcttccgccacctgcggcgggtgattgaaaatggagagaagaacaggatgacctaccagagcatcgccatcgtgtttggccccaccctgctgaagccagagaaggagactggaaatattgctgtgcacacagtgtaccagaaccagatcgtggagctgatcctgctggagctgagcagcatcttcggccgctag

SEQ ID NO: 167873 - DNA, 2526 bp, Artificial Sequence
  Description of Artificial Sequence: Synthetic coding sequence
atgaagatggctgacagaagtggcaagatcatccctggccaggtgtacatcgaggtggagtatgactatgaatatgaggccaaggacaggaagatcgtcatcaagcagggcgagcgctacatcctggtgaagaagaccaatgatgactggtggcaggtgaagccagatgagaacagcaaggccttctacgtgcctgcccagtatgtgaaggaggtgaccaggaaggccctgatgcctcctgtgaagcaggtggccggcctgcccaacaacagcaccaagatcatgcagagcctgcacctgcagaggagcacagaaaatgtgaacaagctgcctgagctgagcagctttgggaagcccagcagctctgtgcagggcaccggcctcatcagagatgccaaccagaactttggccccagctacaaccagggccagacagtgaacctgagcctggacctgacccacaacaacgggaagttcaacaatgacagccacagccccaaggtgagcagccagaacagaaccaggagctttggccacttccctggccctgagttcctggatgtggagaagaccagcttcagccaggagcagagctgtgacagcgctggggagggcagcgagcgcatccaccaggacagcgagagcggagatgagctgagcagcagcagcacagagcagatccgggccaccaccccacccaaccagggccgcccagacagccctgtgtatgccaacctgcaggagctgaagatcagccagagcgccctgccccccctgcccggcagccctgccatccagatcaacggggagtgggagacccacaaggacagcagcggccgctgctactactacaacagaggcacccaggagaggacctggaagcccccacgctggaccagagatgccagcatcagcaagggggacttccagaaccctggggaccaggagctgctgagcagcgaggagaactactacagcaccagctacagccagagcgacagccagtgtggcagccccccccggggctggagcgaggagctggatgagcggggccacaccctgtacaccagtgactacaccaatgagaagtggctgaagcacgtggatgaccagggccggcagtactactacagcgcagatggcagccgctctgagtgggagctgcccaagtacaatgccagcagccagcagcagcgggagatcatcaagagccgcagcctggaccggcggctgcaggagcccatcgtgctgaccaagtggaggcacagcaccatcgtgctggacaccaatgacaaggagagccccacagccagcaagccctgcttcccagaaaatgaaagcagccccagcagccccaagcaccaggacacagaccaggagaagtatggcctgctgaatgtgaccaagattgctgaaaatggcaagaaggtgaggaagaactggctgagctcctgggccgtgctgcagggcagcagcctgctcttcaccaagacccagggcagcagcacctcctggtttggcagcaaccagagcaagccagagttcaccgtggacctgaagggggccaccatcgagatggccagcaaggacaagagcagcaagaagaatgtgtttgagctgaagacccggcagggcacagagctgctgatccagagcgacaatgacaccgtcatcaatgactggttcaaggtgctgagcagcaccatcaacaaccaggccgtggagacagatgagggcatcgaggaggagatcccagacagccctggcatcgagaagcatgacaaggagaaggagcagaaggaccccaagaagctgcgctccttcaaggtgagcagcattgacagcagcgagcagaagaagaccaagaagaacctgaagaagttcctgacccggcggcccaccctgcaggccgtgcgggagaagggctacatcaaggaccaggtgtttggcagcaacctggccaacctgtgccagcgggagaatggaacagtgcccaagtttgtgaagctgtgcatcgagcacgtggaggagcacggcctggacattgatggcatctacagagtgtctggcaacctggccgtcatccagaagctgcgctttgctgtgaaccatgatgagaagctggacctgaatgacagcaagtgggaggacatccacgtgatcaccggggccctgaagatgttcttccgggagctgcctgagcccctcttcaccttcaaccacttcaatgactttgtgaatgccatcaagcaggagccccggcagagggtggccgctgtgaaggacctgatccggcagctgcccaagcccaaccaggacaccatgcagatcctcttccgccacctgcggcgggtgattgaaaatggagagaagaacaggatgacctaccagagcatcgccatcgtgtttggccccaccctgctgaagccagagaaggagaccggcaacattgctgtgcacacagtgtaccagaaccagatcgtggagctgatcctgctggagctgagcagcatctttggaagatag

SEQ ID NO: 167874 - DNA, 591 bp, Artificial Sequence
  Description of Artificial Sequence: Synthetic coding sequence
tgaagcaccagctacagccagagcgacagccagtgtggcagccccccccggggctggagcgaggagctggatgagcggggccacaccctgtacaccagtgactacaccaatgagaagtggctgaagcacgtggatgaccagggccggcagtactactacagcgcagatggcagccgctctgagtgggagctgcccaagtacaatgccagcagccagcagcagcgggagatcatcaagagccgcagcctggaccggcggctgcaggagcccatcgtgctgaccaagtggaggcacagcaccatcgtgctggacaccaatgacaaggagagccccacagccagcaagccctgcttcccagaaaatgaaagcagccccagcagccccaagcaccaggacacagaccaggagaagtatggcctgctgaatgtgaccaagattgctgaaaatggcaagaaggtgaggaagaactggctgagctcctgggccgtgctgcagggcagcagcctgctcttcaccaagacccagggcagcagcacctcctggtttggcagcaaccagagcaagccagagttcaccgtggacctgaagtag

SEQ ID NO: 167875 - DNA, 2646 bp, Artificial Sequence
  Description of Artificial Sequence: Synthetic coding sequence
atgaagaagcagttcaacaggatgaagcagctggccaaccagacagtgggccgggcagagaagacagaggtgctgtctgaggacctgctgcagatcgagcggcggctggacacagtgcgcagcatctgccaccacagccacaagaggctggtggcctgcttccagggccagcacggcacagatgctgagcggcggcacaagaagctgcccctgacagccctggcccagaacatgcaggaggccagcacccagctggaggacagcctgctgggcaagatgctggagacctgtggagatgctgagaaccagctggccctggagctgagccagcacgaggtgtttgtggagaaggagatcgtggaccccctgtatggaattgctgaggtggagatccccaacatccagaagcagaggaagcagctggcccggctggtgctggactgggacagcgtgcgggcccgctggaaccaggcccacaagagcagcggcaccaacttccagggcctgcccagcaagattgacaccctgaaggaggagatggatgaagctggcaacaaggtggagcagtgcaaggaccagctggccgctgacatgtacaacttcatggccaaggagggggagtatggcaagttctttgtgaccctgctggaggcccaggccgactaccacaggaaggccctggccgtgctggagaagaccctgcctgagatgagggcccaccaggacaagtgggccgagaagccagccttcggcacccccctggaggagcacctgaagaggagcggccgggagatcgccctgcccatcgaggcctgtgtgatgctgctgctggagaccggcatgaaggaggagggcctcttcagaattggagctggggccagcaagctgaagaagctgaaggccgccctggactgcagcaccagccacctggatgagttctacagcgacccccatgctgtggccggggccctgaagagctacctgcgggagctgcctgagcccctgatgaccttcaacctgtatgaggagtggacccaggtggcctctgtgcaggaccaggacaagaagctgcaggacctgtggaggacctgccagaagctgcccccccagaactttgtgaacttccgctacctgatcaagttcctggccaagctggcccagaccagtgatgtgaacaagatgacccccagcaacatcgccatcgtgctgggccccaacctgctgtgggccagaaatgaaggcaccctggccgagatggctgctgccacctctgtgcacgtggtggccgtgattgagcccatcatccagcacgccgactggttcttccctgaggaggtggagttcaacgtgtctgaggcctttgtgcccctgaccacccccagcagcaaccacagcttccacactggaaatgacagcgacagcggcaccctggagaggaagaggcctgcctccatggctgtgatggagggggacctggtgaagaaggagagctttggagtgaagctgatggacttccaggcccacagaagaggaggcaccctgaacaggaagcacatcagccctgccttccagccccccctgcccccaacagatggcagcacagtggtgcctgctggccctgagcccccaccccagagcagcagagctgagagcagcagcggcggcggcaccgtgcccagcagcgctggcatcctggagcagggccccagccctggagatggcagcccccccaagcccaaggaccctgtgtctgctgctgtgcctgcccctggcaggaacaacagccagatcgccagcggccagaaccagccccaggccgccgccggcagccaccagctgtccatgggccagccccacaatgctgctggccccagcccccacaccctgcggcgggctgtgaagaagccagccccagccccacccaagccaggcaaccccccacctggccaccctgggggccagagcagcagcggcaccagccagcacccccccagcctgagccccaagccacccaccaggagccccagcccccccacccagcacacaggccagcccccaggccagcccagcgcccccagccagctgagcgccccccggcgctacagcagcagcctgagccccatccaggcccccaaccaccccccaccccagccccccacccaggccacccccctgatgcacaccaagcccaacagccagggcccccccaaccccatggccctgcccagcgagcacggcctggagcagcccagccacaccccaccccagacccccaccccacccagcaccccacccctgggcaagcagaaccccagcctgcctgccccccagaccctggccggcggcaaccctgagacagcccagccccatgctggcaccctgccccggcccaggcctgtgcccaagcccaggaaccggcccagcgtgcccccaccaccccagcccccaggagtgcacagcgctggggacagcagcctgaccaacacagcccccacagccagcaagatcgtgacagacagcaacagccgggtgtctgagccccacaggagcatcttccctgagatgcacagcgacagcgccagcaaggatgtgcccggccgcatcctgctggacatcgacaatgacacagagagcacagccctgtag

SEQ ID NO: 167876 - DNA, 2412 bp, Artificial Sequence
  Description of Artificial Sequence: Synthetic coding sequence
atgaagaagcagttcaacaggatgaagcagctggccaaccagacagtgggccgggcagagaagacagaggtgctgtctgaggacctgctgcagatcgagcggcggctggacacagtgcgcagcatctgccaccacagccacaagaggctggtggcctgcttccagggccagcacggcacagatgctgagcggcggcacaagaagctgcccctgacagccctggcccagaacatgcaggaggccagcacccagctggaggacagcctgctgggcaagatgctggagacctgtggagatgctgagaaccagctggccctggagctgagccagcacgaggtgtttgtggagaaggagatcgtggaccccctgtatggaattgctgaggtggagatccccaacatccagaagcagaggaagcagctggcccggctggtgctggactgggacagcgtgcgggcccgctggaaccaggcccacaagagcagcggcaccaacttccagggcctgcccagcaagattgacaccctgaaggaggagatggatgaagctggcaacaaggtggagcagtgcaaggaccagctggccgctgacatgtacaacttcatggccaaggagggggagtatggcaagttctttgtgaccctgctggaggcccaggccgactaccacaggaaggccctggccgtgctggagaagaccctgcctgagatgagggcccaccaggacaagtgggccgagaagccagccttcggcacccccctggaggagcacctgaagaggagcggccgggagatcgccctgcccatcgaggcctgtgtgatgctgctgctggagaccggcatgaaggaggagggcctcttcagaattggagctggggccagcaagctgaagaagctgaaggccgccctggactgcagcaccagccacctggatgagttctacagcgacccccatgctgtggccggggccctgaagagctacctgcgggagctgcctgagcccctgatgaccttcaacctgtatgaggagtggacccaggtggcctctgtgcaggaccaggacaagaagctgcaggacctgtggaggacctgccagaagctgcccccccagaactttgtgaacttccgctacctgatcaagttcctggccaagctggcccagaccagtgatgtgaacaagatgacccccagcaacatcgccatcgtgctgggccccaacctgctgtgggccagaaatgaaggcaccctggccgagatggctgctgccacctctgtgcacgtggtggccgtgattgagcccatcatccagcacgccgactggttcttccctgaggaggtggagttcaacgtgtctgaggcctttgtgcccctgaccacccccagcagcaaccacagcttccacactggaaatgacagcgacagcggcaccctggagaggaagaggcctgcctccatggctgtgatggagggggacctggtgaagaaggagagcccccccaagcccaaggaccctgtgtctgctgctgtgcctgcccctggcaggaacaacagccagatcgccagcggccagaaccagccccaggccgccgccggcagccaccagctgtccatgggccagccccacaatgctgctggccccagcccccacaccctgcggcgggctgtgaagaagccagccccagccccacccaagccaggcaaccccccacctggccaccctgggggccagagcagcagcggcaccagccagcacccccccagcctgagccccaagccacccaccaggagccccagcccccccacccagcacacaggccagcccccaggccagcccagcgcccccagccagctgagcgccccccggcgctacagcagcagcctgagccccatccaggcccccaaccaccccccaccccagccccccacccaggccacccccctgatgcacaccaagcccaacagccagggcccccccaaccccatggccctgcccagcgagcacggcctggagcagcccagccacaccccaccccagacccccaccccacccagcaccccacccctgggcaagcagaaccccagcctgcctgccccccagaccctggccggcggcaaccctgagacagcccagccccatgctggcaccctgccccggcccaggcctgtgcccaagcccaggaaccggcccagcgtgcccccaccaccccagcccccaggagtgcacagcgctggggacagcagcctgaccaacacagcccccacagccagcaagatcgtgacagacagcaacagccgggtgtctgagccccacaggagcatcttccctgagatgcacagcgacagcgccagcaaggatgtgcccggccgcatcctgctggacatcgacaatgacacagagagcacagccctgtag

SEQ ID NO: 167877 - DNA, 681 bp, Artificial Sequence
  Description of Artificial Sequence: Synthetic coding sequence
atgaagaagcagttcaacaggatgaagcagctggccaaccagacagtgggccgggcagagaagacagaggtgctgtctgaggacctgctgcagatcgagcggcggctggacacagtgcgcagcatctgccaccacagccacaagaggctggtggcctgcttccagggccagcacggcacagatgctgagcggcggcacaagaagctgcccctgacagccctggcccagaacatgcaggaggccagcacccagctggaggacagcctgctgggcaagatgctggagacctgtggagatgctgagaaccagctggccctggagctgagccagcacgaggtgtttgtggagaaggagatcgtggaccccctgtatggaattgctgaggtggagatccccaacatccagaagcagaggaagcagctggcccggctggtgctggactgggacagcgtgcgggcccgctggaaccaggcccacaagagcagcggcaccaacttccagggcctgcccagcaagattgacaccctgaaggaggagatggatgaagctggcaacaaggtggagcagtgcaaggaccagctggccgctgacatgtacaacttcatggccaaggagggggagtatggcaagttctttgtgaccatcagcggcaggaagaaccagcccctgggcctgccctag

SEQ ID NO: 167878 - DNA, 2523 bp, Artificial Sequence
  Description of Artificial Sequence: Synthetic coding sequence
atgaagaagcagttcaacaggatgaagcagctggccaaccagacagtgggccgggcagagaagacagaggtgctgtctgaggacctgctgcagatcgagcggcggctggacacagtgcgcagcatctgccaccacagccacaagaggctggtggcctgcttccagggccagcacggcacagatgctgagcggcggcacaagaagctgcccctgacagccctggcccagaacatgcaggaggccagcacccagctggaggacagcctgctgggcaagatgctggagacctgtggagatgctgagaaccagctggccctggagctgagccagcacgaggtgtttgtggagaaggagatcgtggaccccctgtatggaattgctgaggtggagatccccaacatccagaagcagaggaagcagctggcccggctggtgctggactgggacagcgtgcgggcccgctggaaccaggcccacaagagcagcggcaccaacttccagggcctgcccagcaagattgacaccctgaaggaggagatggatgaagctggcaacaaggtggagcagtgcaaggaccagctggccgctgacatgtacaacttcatggccaaggagggggagtatggcaagttctttgtgaccctgctggaggcccaggccgactaccacaggaaggccctggccgtgctggagaagaccctgcctgagatgagggcccaccaggacaagtgggccgagaagccagccttcggcacccccctggaggagcacctgaagaggagcggccgggagatcgccctgcccatcgaggcctgtgtgatgctgctgctggagaccggcatgaaggaggagggcctcttcagaattggagctggggccagcaagctgaagaagctgaaggccgccctggactgcagcaccagccacctggatgagttctacagcgacccccatgctgtggccggggccctgaagagctacctgcgggagctgcctgagcccctgatgaccttcaacctgtatgaggagtggacccaggtggcctctgtgcaggaccaggacaagaagctgcaggacctgtggaggacctgccagaagctgcccccccagaactttgtgaacttccgctacctgatcaagttcctggccaagctggcccagaccagtgatgtgaacaagatgacccccagcaacatcgccatcgtgctgggccccaacctgctgtgggccagaaatgaaggcaccctggccgagatggctgctgccacctctgtgcacgtggtggccgtgattgagcccatcatccagcacgccgactggttcttccctgaggaggtggagttcaacgtgtctgaggcctttgtgcccctgaccacccccagcagcaaccacagcttccacactggaaatgacagcgacagcggcaccctggagaggaagaggcctgcctccatggctgtgatggagggggacctggtgaagaaggagagctttggagtgaagctgatggacttccaggcccacagaagaggaggcaccctgaacaggaagcacatcagccctgccttccagccccccctgcccccaacagatggcagcacagtggtgcctgctggccctgagcccccaccccagagcagcagagctgagagcagcagcggcggcggcaccgtgcccagcagcgctggcatcctggagcagggccccagccctggagatggcagcccccccaagcccaaggaccctgtgtctgctgctgtgcctgcccctggcaggaacaacagccagatcgccagcggccagaaccagccccaggccgccgccggcagccaccagctgtccatgggccagccccacaatgctgctggccccagcccccacaccctgcggcgggctgtgaagaagccagccccagccccacccaagccaggcaaccccccacctggccaccctgggggccagagcagcagcggcaccagccagcacccccccagcctgagccccaagccacccaccaggagccccagcccccccacccagcacacaggccagcccccaggccagcccagcgcccccagccagctgagcgccccccggcgctacagcagcagcctgagccccatccaggcccccaaccaccccccaccccagccccccacccaggccacccccctgatgcacaccaagcccaacagccagggcccccccaaccccatggccctgcccagcgagcacggcctggagcagcccagccacaccccaccccagacccccaccccacccagcaccccacccctgggcaagcagaaccccagcctgcctgccccccagaccctggccggcggcaaccctgagacagcccagccccatgctggcaccctgccccggcccaggcctgtgcccaagcccaggaaccggcccagcgtgcccccaccaccccagcccccaggagtgcacagcgctggggacagcagcctgaccaacacagcccccacagccagcaagatcgtgactggagtgtag

SEQ ID NO: 167879 - DNA, 1992 bp, Artificial Sequence
  Description of Artificial Sequence: Synthetic coding sequence
atgtcctggctgagcagcagccagggcgtggtgctgacagcctaccaccccagcggcaaggaccagacagtgggcaacagccacgccaaggccggggaggaggccaccagcagcagaagatatggccagtacaccatgaaccaggagagcaccaccatcaaggtgatggagaagcccccatttgacaggagcatcagccaggacagcctggatgagctgtccatggaggactactggattgagctggagaacatcaagaagagcagcgagaacagccaggaggaccaggaggtggtggtggtgaaggagccagatgaaggagagctggaggaggagtggctgaaggaggccggcctgagcaacctgtttggagagagcgctggggacccccaggagagcatcgtgttcctgagcaccctgaccaggacccaggccgctgctgtgcagaagagggtggagaccgtgtcccagaccctgaggaagaagaacaagcagtaccagatcccagatgtgcgggacatctttgcccagcagcgggagagcaaggagacagcccctgggggcacagagagccagagcctgcggaccaatgaaaacaagtaccagggcagagatgatgaggccagcaacctggtgggggaggagaagctgatccccccagaggagaccccagcccctgagacagacatcaacctggaggtgtcctttgctgagcaggccctgaaccagaaggagagcagcaaggagaagatccagaagagcaaaggagatgatgccaccctgcccagcttccggctgcccaaggacaagacaggcaccacccgcatcggggacctggccccccaggacatgaagaaggtgtgccacctggccctgattgagctgacagccctgtatgatgtgctgggcatcgagctgaagcagcagaaggctgtgaagatcaagaccaaggacagcggcctcttctgtgtgcccctgacagccctgctggagcaggaccagaggaaggtgcccggcatgaggatccccctcatcttccagaagctgatcagcagaattgaggagcggggcctggagacagagggcctgctgcgcatccctggagctgccatccgcatcaagaacctgtgccaggagctggaggccaagttctatgagggcaccttcaactgggagagcgtgaagcagcatgatgctgccagcctgctgaagctgttcatccgggagctgccccagcccctgctgtctgtggagtacctgaaggccttccaggccgtgcagaacctgcccaccaagaagcagcagctgcaggccctgaacctgctggtgatcctgctgcctgatgccaacagagacaccctgaaggccctgctggagttcctgcagagggtgattgacaacaaggagaagaacaagatgacagtgatgaatgtggccatggtgatggcccccaacctcttcatgtgccacgccctgggcctgaagagcagcgagcagcgggagtttgtgatggccgccggcacagccaacaccatgcacctgctgatcaagtaccagaagctgctgtggaccatccccaagttcatcgtgaaccaggtgaggaagcagaacacagagaaccacaagaaggacaagagggccatgaagaagctgctgaagaagatggcctatgaccgggagaagtatgagaagcaggacaagagcaccaatgatgctgatgtgccccagggcgtcatccgggtgcaggccccccacctgagcaaggtgtccatggccatccagctgacagaggagctgaaggccagtgatgtgctggcccgcttcctgagccaggagagcggcgtggcccagaccctgaagaagggggaggtgttcctgtatgaaattggaggcaacattggagagcgctgcctggatgatgacacctacatgaaggacctgtaccagctgaaccccaatgctgagtgggtgatcaagagcaagcccctgtag

SEQ ID NO: 167880 - DNA, 1857 bp, Artificial Sequence
  Description of Artificial Sequence: Synthetic coding sequence
atgaaccaggagagcaccaccatcaaggtgatggagaagcccccatttgacaggagcatcagccaggacagcctggatgagctgtccatggaggactactggattgagctggagaacatcaagaagagcagcgagaacagccaggaggaccaggaggtggtggtggtgaaggagccagatgaaggagagctggaggaggagtggctgaaggaggccggcctgagcaacctgtttggagagagcgctggggacccccaggagagcatcgtgttcctgagcaccctgaccaggacccaggccgctgctgtgcagaagagggtggagaccgtgtcccagaccctgaggaagaagaacaagcagtaccagatcccagatgtgcgggacatctttgcccagcagcgggagagcaaggagacagcccctgggggcacagagagccagagcctgcggaccaatgaaaacaagtaccagggcagagatgatgaggccagcaacctggtgggggaggagaagctgatccccccagaggagaccccagcccctgagacagacatcaacctggaggtgtcctttgctgagcaggccctgaaccagaaggagagcagcaaggagaagatccagaagagcaaaggagatgatgccaccctgcccagcttccggctgcccaaggacaagacaggcaccaccagaattggagacctggccccccaggacatgaagaaggtgtgccacctggccctgattgagctgacagccctgtatgatgtgctgggcatcgagctgaagcagcagaaggctgtgaagatcaagaccaaggacagcggcctcttctgtgtgcccctgacagccctgctggagcaggaccagaggaaggtgcccggcatgaggatccccctcatcttccagaagctgatcagccgcatcgaggagcggggcctggagacagagggcctgctgcgcatccctggggccgccatccgcatcaagaacctgtgccaggagctggaggccaagttctatgagggcaccttcaactgggagagcgtgaagcagcatgatgctgccagcctgctgaagctgttcatccgggagctgccccagcccctgctgtctgtggagtacctgaaggccttccaggccgtgcagaacctgcccaccaagaagcagcagctgcaggccctgaacctgctggtgatcctgctgcctgatgccaacagagacaccctgaaggccctgctggagttcctgcagagggtcatcgacaacaaggagaagaacaagatgacagtgatgaatgtggccatggtgatggcccccaacctcttcatgtgccacgccctgggcctgaagagcagcgagcagcgggagtttgtgatggctgctggaacagccaacaccatgcacctgctgatcaagtaccagaagctgctgtggaccatccccaagttcatcgtgaaccaggtgaggaagcagaacacagagaaccacaagaaggacaagagggccatgaagaagctgctgaagaagatggcctatgaccgggagaagtatgagaagcaggacaagagcaccaatgatgctgatgtgccccagggcgtcatccgggtgcaggccccccacctgagcaaggtgtccatggccatccagctgacagaggagctgaaggccagtgatgtgctggcccgcttcctgagccaggagagcggcgtggcccagaccctgaagaagggggaggtgttcctgtatgagatcggcggcaacatcggggagcgctgcctggatgatgacacctacatgaaggacctgtaccagctgaaccccaatgctgagtgggtgatcaagagcaagcccctgtag

SEQ ID NO: 167881 - DNA, 1485 bp, Artificial Sequence
  Description of Artificial Sequence: Synthetic coding sequence
atggccacagaggcccagagcgagggggaggtgcctgcccgggagagcggccgcagtgatgccatctgcagctttgtgatctgcaatgacagcagcctgcggggccagcccatcatcttcaacccagacttctttgtggagaagctgcggcatgagaagccagagatcttcacagagctggtggtgagcaacatcacccggctgattgacctgcccggcacagagctggcccagctgatgggagaggtggacctgaagctgcccggcggggccggccctgccagcggcttcttccgcagcctgatgagcctgaagaggaaggagaagggcgtcatcttcggcagccccctgacagaggagggcatcgcccagatctaccagctgattgagtacctgcacaagaacctgcgggtggagggcctcttccgggtgcccggcaacagcgtgcggcagcagatcctgagagatgccctgaacaacggcacagacatcgacctggagagcggggagttccacagcaatgatgtggccaccctgctgaagatgttcctgggggagctgcctgagcccctgctgacccacaagcacttcaatgcccacctgaagattgctgacctgatgcagtttgatgacaagggcaacaagaccaacatcccagacaaggaccggcagatcgaggccctgcagctgctcttcctgatcctgcccccacccaacagaaacctgctgaagctgctgctggacctgctgtaccagacagccaagaagcaggacaagaacaagatgtctgcctacaacctggccctgatgtttgccccccacgtgctgtggcccaagaatgtgacagccaatgacctgcaggagaacatcaccaagctgaacagcggcatggccttcatgatcaagcacagccagaagctgttcaaggccccagcctacatccgggagtgtgcccggctgcactacctgggcagcaggacccaggccagcaaggatgacctggacctgattgccagctgccacaccaagagcttccagctggccaagagccagaagaggaacagagtggacagctgcccccaccaggaggagacccagcaccacacagaggaggccctgcgggagctgttccagcacgtgcatgacatgcctgagagcgccaagaagaagcagctgatccggcagttcaacaagcagagcctgacccagaccccaggccgggagcccagcaccagccaggtgcagaagagggcccggagccgctccttcagcggcctcatcaagaggaaggtgctgggcaaccagatgatgtctgagaagaagaagaagaaccccaccccagagagcgtggccatcggggagctgaagggcaccagcaaagaaaatagaaacctgctcttcagcggcagccctgctgtgaccatgacccccacccggctgaagtggagcgagggcaagaaggagggcaagaaggtgttcctgtag

SEQ ID NO: 167882 - DNA, 1458 bp, Artificial Sequence
  Description of Artificial Sequence: Synthetic coding sequence
atgccccaccagaagctgagcgccctgattgatgccatctgcagctttgtgatctgcaatgacagcagcctgcggggccagcccatcatcttcaacccagacttctttgtggagaagctgcggcatgagaagccagagatcttcacagagctggtggtgagcaacatcacccggctgattgacctgcctggaacagagctggcccagctgatgggagaggtggacctgaagctgcctggaggagctggccctgccagcggcttcttccgcagcctgatgagcctgaagaggaaggagaagggcgtcatcttcggcagccccctgacagaggagggcatcgcccagatctaccagctgattgagtacctgcacaagaacctgcgggtggagggcctcttccgggtgcccggcaacagcgtgcggcagcagatcctgagagatgccctgaacaatggaacagacatcgacctggagagcggggagttccacagcaatgatgtggccaccctgctgaagatgttcctgggggagctgcctgagcccctgctgacccacaagcacttcaatgcccacctgaagattgctgacctgatgcagtttgatgacaagggcaacaagaccaacatcccagacaaggaccggcagatcgaggccctgcagctgctcttcctgatcctgcccccacccaacagaaacctgctgaagctgctgctggacctgctgtaccagacagccaagaagcaggacaagaacaagatgtctgcctacaacctggccctgatgtttgcccctcatgtgctgtggcccaagaatgtgacagccaatgacctgcaggagaacatcaccaagctgaacagcggcatggccttcatgatcaagcacagccagaagctgttcaaggccccagcctacatcagagaatgtgcccggctgcactacctgggcagcaggacccaggccagcaaggatgacctggacctgattgccagctgccacaccaagagcttccagctggccaagagccagaagaggaacagagtggacagctgcccccaccaggaggagacccagcaccacacagaggaggccctgcgggagctgttccagcacgtgcatgacatgcctgagagcgccaagaagaagcagctgatccggcagttcaacaagcagagcctgacccagaccccaggccgggagcccagcaccagccaggtgcagaagagggcccggagccgctccttcagcggcctcatcaagaggaaggtgctgggcaaccagatgatgtctgagaagaagaagaagaaccccaccccagagagcgtggccatcggggagctgaagggcaccagcaaggagaacagaaacctgctcttcagcggcagccctgctgtgaccatgacccccacccggctgaagtggagcgagggcaagaaggagggcaagaaggtgttcctgtag

SEQ ID NO: 167883 - DNA, 1398 bp, Artificial Sequence
  Description of Artificial Sequence: Synthetic coding sequence
atggccacagaggcccagagcgagggggaggtgcctgcccgggagagcggccgcagtgatgccatctgcagctttgtgatctgcaatgacagcagcctgcggggccagcccatcatcttcaacccagacttctttgtggagaagctgcggcatgagaagccagagatcttcacagagctggtggtgagcaacatcacccggctgattgacctgcccggcacagagctggcccagctgatgggagaggtggacctgaagctgcccggcggggccggccctgccagcggcttcttccgcagcctgatgagcctgaagaggaaggagaagggcgtcatcttcggcagccccctgacagaggagggcatcgcccagatctaccagctgattgagtacctgcacaagaacctgcgggtggagggcctcttccgggtgcccggcaacagcgtgcggcagcagatcctgagagatgccctgaacaacggcacagacatcgacctggagagcggggagttccacagcaatgatgtggccaccctgctgaagatgttcctgggggagctgcctgagcccctgctgacccacaagcacttcaatgcccacctgaagattgctgacctgatgcagtttgatgacaagggcaacaagaccaacatcccagacaaggaccggcagatcgaggccctgcagctgctcttcctgatcctgcccccacccaacagaaacctgctgaagctgctgctggacctgctgtaccagacagccaagaagcaggacaagaacaagatgtctgcctacaacctggccctgatgtttgccccccacgtgctgtggcccaagaatgccccagcctacatcagagaatgtgcccggctgcactacctgggcagcaggacccaggccagcaaggatgacctggacctgattgccagctgccacaccaagagcttccagctggccaagagccagaagaggaacagagtggacagctgcccccaccaggaggagacccagcaccacacagaggaggccctgcgggagctgttccagcacgtgcatgacatgcctgagagcgccaagaagaagcagctgatccggcagttcaacaagcagagcctgacccagaccccaggccgggagcccagcaccagccaggtgcagaagagggcccggagccgctccttcagcggcctcatcaagaggaaggtgctgggcaaccagatgatgtctgagaagaagaagaagaaccccaccccagagagcgtggccatcggggagctgaagggcaccagcaaggagaacagaaacctgctcttcagcggcagccctgctgtgaccatgacccccacccggctgaagtggagcgagggcaagaaggagggcaagaaggcctttgtgtag

SEQ ID NO: 167884 - DNA, 1485 bp, Artificial Sequence
  Description of Artificial Sequence: Synthetic coding sequence
atggccacagaggcccagagcgagggggaggtgcctgcccgggagagcggccgcagtgatgccatctgcagctttgtgatctgcaatgacagcagcctgcggggccagcccatcatcttcaacccagacttctttgtggagaagctgcggcatgagaagccagagatcttcacagagctggtggtgagcaacatcacccggctgattgacctgcccggcacagagctggcccagctgatgggagaggtggacctgaagctgcccggcggggccggccctgccagcggcttcttccgcagcctgatgagcctgaagaggaaggagaagggcgtcatcttcggcagccccctgacagaggagggcatcgcccagatctaccagctgattgagtacctgcacaagaacctgcgggtggagggcctcttccgggtgcccggcaacagcgtgcggcagcagatcctgagagatgccctgaacaacggcacagacatcgacctggagagcggggagttccacagcaatgatgtggccaccctgctgaagatgttcctgggggagctgcctgagcccctgctgacccacaagcacttcaatgcccacctgaagattgctgacctgatgcagtttgatgacaagggcaacaagaccaacatcccagacaaggaccggcagatcgaggccctgcagctgctcttcctgatcctgcccccacccaacagaaacctgctgaagctgctgctggacctgctgtaccagacagccaagaagcaggacaagaacaagatgtctgcctacaacctggccctgatgtttgccccccacgtgctgtggcccaagaatgtgacagccaatgacctgcaggagaacatcaccaagctgaacagcggcatggccttcatgatcaagcacagccagaagctgttcaaggccccagcctacatccgggagtgtgcccggctgcactacctgggcagcaggacccaggccagcaaggatgacctggacctgattgccagctgccacaccaagagcttccagctggccaagagccagaagaggaacagagtggacagctgcccccaccaggaggagacccagcaccacacagaggaggccctgcgggagctgttccagcacgtgcatgacatgcctgagagcgccaagaagaagcagctgatccggcagttcaacaagcagagcctgacccagaccccaggccgggagcccagcaccagccaggtgcagaagagggcccggagccgctccttcagcggcctcatcaagaggaaggtgctgggcaaccagatgatgtctgagaagaagaagaagaaccccaccccagagagcgtggccatcggggagctgaagggcaccagcaaagaaaatagaaacctgctcttcagcggcagccctgctgtgaccatgacccccacccggctgaagtggagcgagggcaagaaggagggcaagaagggcttcctgtag

SEQ ID NO: 167885 - DNA, 1458 bp, Artificial Sequence
  Description of Artificial Sequence: Synthetic coding sequence
atgccccaccagaagctgagcgccctgattgatgccatctgcagctttgtgatctgcaatgacagcagcctgcggggccagcccatcatcttcaacccagacttctttgtggagaagctgcggcatgagaagccagagatcttcacagagctggtggtgagcaacatcacccggctgattgacctgcctggaacagagctggcccagctgatgggagaggtggacctgaagctgcctggaggagctggccctgccagcggcttcttccgcagcctgatgagcctgaagaggaaggagaagggcgtcatcttcggcagccccctgacagaggagggcatcgcccagatctaccagctgattgagtacctgcacaagaacctgcgggtggagggcctcttccgggtgcccggcaacagcgtgcggcagcagatcctgagagatgccctgaacaatggaacagacatcgacctggagagcggggagttccacagcaatgatgtggccaccctgctgaagatgttcctgggggagctgcctgagcccctgctgacccacaagcacttcaatgcccacctgaagattgctgacctgatgcagtttgatgacaagggcaacaagaccaacatcccagacaaggaccggcagatcgaggccctgcagctgctcttcctgatcctgcccccacccaacagaaacctgctgaagctgctgctggacctgctgtaccagacagccaagaagcaggacaagaacaagatgtctgcctacaacctggccctgatgtttgcccctcatgtgctgtggcccaagaatgtgacagccaatgacctgcaggagaacatcaccaagctgaacagcggcatggccttcatgatcaagcacagccagaagctgttcaaggccccagcctacatcagagaatgtgcccggctgcactacctgggcagcaggacccaggccagcaaggatgacctggacctgattgccagctgccacaccaagagcttccagctggccaagagccagaagaggaacagagtggacagctgcccccaccaggaggagacccagcaccacacagaggaggccctgcgggagctgttccagcacgtgcatgacatgcctgagagcgccaagaagaagcagctgatccggcagttcaacaagcagagcctgacccagaccccaggccgggagcccagcaccagccaggtgcagaagagggcccggagccgctccttcagcggcctcatcaagaggaaggtgctgggcaaccagatgatgtctgagaagaagaagaagaaccccaccccagagagcgtggccatcggggagctgaagggcaccagcaaggagaacagaaacctgctcttcagcggcagccctgctgtgaccatgacccccacccggctgaagtggagcgagggcaagaaggagggcaagaagggcttcctgtag

SEQ ID NO: 167886 - DNA, 942 bp, Artificial Sequence
  Description of Artificial Sequence: Synthetic coding sequence
atgttcctgggggagctgcctgagcccctgctgacccacaagcacttcaatgcccacctgaagattgctgacctgatgcagtttgatgacaagggcaacaagaccaacatcccagacaaggaccggcagatcgaggccctgcagctgctcttcctgatcctgcccccacccaacagaaacctgctgaagctgctgctggacctgctgtaccagacagccaagaagcaggacaagaacaagatgtctgcctacaacctggccctgatgtttgcccctcatgtgctgtggcccaagaatgtgacagccaatgacctgcaggagaacatcaccaagctgaacagcggcatggccttcatgatcaagcacagccagaagctgttcaaggccccagcctacatcagagaatgtgcccggctgcactacctgggcagcaggacccaggccagcaaggatgacctggacctgattgccagctgccacaccaagagcttccagctggccaagagccagaagaggaacagagtggacagctgcccccaccaggaggagacccagcaccacacagaggaggccctgcgggagctgttccagcacgtgcatgacatgcctgagagcgccaagaagaagcagctgatccggcagttcaacaagcagagcctgacccagaccccaggccgggagcccagcaccagccaggtgcagaagagggcccggagccgctccttcagcggcctcatcaagaggaaggtgctgggcaaccagatgatgtctgagaagaagaagaagaaccccaccccagagagcgtggccatcggggagctgaagggcaccagcaaggagaacagaaacctgctcttcagcggcagccctgctgtgaccatgacccccacccggctgaagtggagcgagggcaagaaggagggcaagaagggcttcctgtag

SEQ ID NO: 167887 - DNA, 1554 bp, Artificial Sequence
  Description of Artificial Sequence: Synthetic coding sequence
atggccacagaggcccagagcgagggggaggtgcctgcccgggagagcggccgcagtgatgccatctgcagctttgtgatctgcaatgacagcagcctgcggggccagcccatcatcttcaacccagacttctttgtggagaagctgcggcatgagaagccagagatcttcacagagctggtggtgagcaacatcacccggctgattgacctgcccggcacagagctggcccagctgatgggagaggtggacctgaagctgcccggcggggccggccctgccagcggcttcttccgcagcctgatgagcctgaagaggaaggagaagggcgtcatcttcggcagccccctgacagaggagggcatcgcccagatctaccagctgattgagtacctgcacaagaacctgcgggtggagggcctcttccgggtgcccggcaacagcgtgcggcagcagatcctgagagatgccctgaacaacggcacagacatcgacctggagagcggggagttccacagcaatgatgtggccaccctgctgaagatgttcctgggggagctgcctgagcccctgctgacccacaagcacttcaatgcccacctgaagattgctgacctgatgcagtttgatgacaagggcaacaagaccaacatcccagacaaggaccggcagatcgaggccctgcagctgctcttcctgatcctgcccccacccaacagaaacctgctgaagctgctgctggacctgctgtaccagacagccaagaagcaggacaagaacaagatgtctgcctacaacctggccctgatgtttgccccccacgtgctgtggcccaagaatgtgacagccaatgacctgcaggagaacatcaccaagctgaacagcggcatggccttcatgatcaagcacagccagaagctgttcaaggccccagcctacatccgggagtgtgcccggctgcactacctgggcagcaggacccaggccagcaaggatgacctggacctgattgccagctgccacaccaagagcttccagctggccaagagccagaagaggaacagagtggacagctgcccccaccaggaggagacccagcaccacacagaggaggccctgcgggagctgttccagcacgtgcatgacatgcctgagagcgccaagaagaagcagctgatccggcagttcaacaagcagagcctgacccagaccccaggccgggagcccagcaccagccaggtgcagaagagggcccggagccgctccttcagcggcctcatcaagaggaaggtgctgggcaaccagatgatgtctgagaagaagaagaagaaccccaccccagagagcgtggccatcggggagctgaagggcaccagcaaagaaaatagaaacctgctcttcagcggcagccctgctgtgaccatgacccccacccggctgaagtggagcgagggcaagaaggagggcaagaagggcaacagcatggccaccaccagcctgggcagcatccgcatgaccctgcggggcagcagcagctgtggctgctgcagctag

SEQ ID NO: 167888 - DNA, 3654 bp, Artificial Sequence
  Description of Artificial Sequence: Synthetic coding sequence
atggcccagcctgtggagatcagccccccagacagcagcctgagcaagcagcagaccagcacccctgtgctgacccagcccggccgggcctacaggatggagatccaggtgccccccagccccacagatgtggccaagagcaacacagctgtgtgtgtgtgcaatgaatctgtgaggacagtcatcgtgcccagcgagaaggtggtggacctgctgagcaacagaaacaaccacacaggccccagccacaggacagaggaggtgcgctatggagtgtctgagcagaccagcctgaagacagtgtccaggaccaccagcccccccctgagcatccccaccacccacctgatccaccagcctgctggcagccgcagcctggagcccagcggcatcctgctgaagagcggcaactacagcggccacagtgatggcatcagcagcagccgcagccaggccgtggaggcccccagcgtgtctgtgaaccactacagccccaacagccaccagcacatcgactggaagaactacaagacctacaaggagtacatcgacaacagaaggctgcacatcggctgcaggaccatccaggagcggctggacagcctgcgggccgccagccagagcaccacagactacaaccaggtggtgcccaacagaaccaccctgcagggcagaagaagaagcaccagccatgacagagtgccccagagcgtgcagatccggcagaggtctgtgtcccaggagcggctggaggacagcgtgctgatgaagtactgccccaggtctgccagccagggcgccctgaccagccccagcgtgtccttcagcaaccacaggaccaggtcctgggactacatcgagggccaggatgagaccctggagaatgtgaacagcggcacccccatcccagacagcaatggagagaagaagcagacctacaagtggagcggcttcacagagcaggatgaccggcggggcatctgtgagcggccccggcagcaggagatccacaagagcttccggggcagcaacttcaccgtggcccccagcgtggtgaacagcgacaacagaaggatgagcggccggggcgtgggctctgtgtcccagttcaagaagatccccccagacctgaagaccctgcagagcaacagaaacttccagaccacctgtggcatgagcctgccccggggcatcagccaggacaggagccccctggtgaaggtgcgcagcaacagcctgaaggcccccagcacccacgtgaccaagcccagcttcagccagaagagctttgtgtccatcaaggaccagaggcctgtgaaccacctgcaccagaacagcctgctgaaccagcagacctgggtgaggacagacagcgccccagaccagcaggtggagaccgggaagagccccagcctgagcggggccagcgccaagccagccccccagagcagtgaaaatgccggcaccagtgacctggagctgcctgtgtcccagaggaaccaggacctgagcctgcaggaggccgagacagagcagagcgacaccctggacaacaaggaggccgtcatcctgcgggagaagccacccagcggccggcagaccccccagcccctgcggcaccagagctacatcctggccgtgaatgaccaggagaccggcagtgacaccacctgctggctgcccaatgatgcccggcgggaggtgcacatcaagaggatggaggagaggaaggccagcagcaccagccccccaggggacagcctggccagcatccccttcattgatgagcccaccagccccagcattgaccatgacatcgcccacatcccagccagcgctgtgatcagcgccagcaccagccaggtgcccagcatcgccaccgtgcccccctgcctgaccaccagcgcccccctcatccggcggcagctgagccatgaccatgaatctgtgggcccccccagcctggatgcccagcccaacagcaagacagagaggagcaagagctatgatgagggcctggatgactaccgggaggatgccaagctgtccttcaagcacgtgagcagcctgaagggcatcaagattgctgacagccagaagagcagtgaagattctggcagcaggaaggacagcagcagcgaggtgttcagtgatgctgccaaggagggctggctgcacttccggcccctggtgacagacaagggcaagagggtgggcggcagcatccggccctggaagcagatgtatgtggtgctgcggggccacagcctgtacctgtacaaggacaagcgggagcagaccacccccagcgaggaggagcagcccatctctgtgaatgcctgcctgattgacatctcctacagcgagaccaagaggaagaatgtgttccggctgaccaccagtgactgtgagtgcctcttccaggccgaggacagagatgacatgctggcctggatcaagaccatccaggagagcagcaacctgaatgaagaagatactggagtgaccaacagagacctgatcagccgccgcatcaaggagtacaacaacctgatgagcaaggccgagcagctgcccaagaccccccggcagagcctgagcatccggcagaccctgctgggcgccaagtctgagcccaagacccagagcccccacagccccaaggaggagagcgagaggaagctgctgagcaaggatgacaccagcccccccaaggacaagggcacctggaggaagggcatccccagcatcatgaggaagacctttgagaagaagcccacagccaccggcaccttcggcgtgcggctggatgactgccccccagcccacaccaaccgctacatccccctgattgtggacatctgctgcaagctggtggaggagcggggcctggagtacacaggcatctacagagtgcccggcaacaatgctgccatcagctccatgcaggaggagctgaacaagggcatggctgacatcgacatccaggatgacaagtggagggacctgaatgtcatcagcagcctgctgaagagcttcttcaggaagctgcctgagcccctcttcaccaatgacaagtatgctgacttcatcgaggccaacagaaaagaagaccccctggaccggctgaagaccctgaagaggctcatccatgacctgcctgagcaccactatgagaccctgaagttcctgagcgcccacctgaagacagtggctgaaaattctgagaagaacaagatggagcccaggaacctggccatcgtgtttggccccaccctggtgaggaccagcgaggacaacatgacccacatggtgacccacatgccagaccagtacaagatcgtggagaccctcatccagcaccacgactggttcttcacagaggagggcgctgaggagcccctgaccaccgtgcaggaggagagcacagtggacagccagcctgtgcccaacatcgaccacctgctgaccaacattggaagaactggagtgtccccaggagatgtgtctggagaggtgggcggcgtgtaccacacagtgatgagcctggtggacagcgtgatgagcctgatggacagctggaactgcaggaagaaggaggactgctgcccccactgcagctgcctggtgtgcaggaacccccgcttcctgtag

SEQ ID NO: 167889 - DNA, 3498 bp, Artificial Sequence
  Description of Artificial Sequence: Synthetic coding sequence
atgatggccaccaggagaacaggcctgtctgaaggagatggagacaagctgaaggcctgtgaggtgtccaagaacaaggatggcaaggagcagagcgagaccgtgtccctgtctgaagatgagaccttctcctggccaggccccaagacagtgaccctgaagaggaccagccagggcttcggcttcaccctgcggcacttcatcgtgtacccacctgagagcgccatccagttctcctacaaggatgaggagaatggaaacagaggaggcaagcagaggaaccggctggagcccatggacaccatctttgtgaagcaggtgaaggagggcggccctgcctttgaggccggcctgtgcaccggggaccgcatcatcaaggtgaatggagagagcgtgattggcaagacctacagccaggtgattgccctgatccagaacagcgacaccaccctggagctgtctgtgatgcccaaggatgaggacatcctgcaggtggcctacagccaggatgcctacctgaagggaaatgaggcctacagcggaaatgccaggaacatccctgagcccccacccatctgctacccctggctgcccagcgcccccagcgccatggcccagcctgtggagatcagccccccagacagcagcctgagcaagcagcagaccagcacccctgtgctgacccagcccggccgggcctacaggatggagatccaggtgccccccagccccacagatgtggccaagagcaacacagctgtgtgtgtgtgcaatgaatctgtgaggacagtgattgtgcccagcgagaaggtggtggacctgctgagcaacagaaacaaccacacaggccccagccacaggacagaggaggtgcgctatggagtgtctgagcagaccagcctgaagacagtgtccaggaccaccagcccccccctgagcatccccaccacccacctgatccaccagcctgctggcagccgcagcctggagcccagcggcatcctgctgaagagcggcaactacagcggccacagtgatggcatcagcagcagccgcagccaggccgtggaggcccccagcgtgtctgtgaaccactacagccccaacagccaccagcacatcgactggaagaactacaagacctacaaggagtacatcgacaacagaaggctgcacatcggctgcaggaccatccaggagcggctggacagcctgcgggccgccagccagagcaccacagactacaaccaggtggtgcccaacagaaccaccctgcagggcagaagaagaagcaccagccatgacagagtgccccagagcgtgcagatccggcagaggtctgtgtcccaggagcggctggaggacagcgtgctgatgaagtactgccccaggtctgccagccagggcgccctgaccagccccagcgtgtccttcagcaaccacaggaccaggtcctgggactacatcgagggccaggatgagaccctggagaatgtgaacagcggcacccccatcccagacagcaatggagagaagaagcagacctacaagtggagcggcttcacagagcaggatgacagaagaggcatctgtgagcggccccggcagcaggagatccacaagagcttccggggcagcaacttcaccgtggcccccagcgtggtgaacagcgacaacagaaggatgagcggccggggcgtgggctctgtgtcccagttcaagaagatccccccagacctgaagaccctgcagagcaacagaaacttccagaccacctgtggcatgagcctgccccggggcatcagccaggacaggagccccctggtgaaggtgcgcagcaacagcctgaaggcccccagcacccacgtgaccaagcccagcttcagccagaagagctttgtgtccatcaaggaccagaggcctgtgaaccacctgcaccagaacagcctgctgaaccagcagacctgggtgaggacagattctgccccagaccagcaggtggagaccgggaagagccccagcctgagcggggccagcgccaagccagccccccagagcagtgaaaatgccggcaccagtgacctggagctgcctgtgtcccagaggaaccaggacctgagcctgcaggaggccgagacagagcagagcgacaccctggacaacaaggaggccgtcatcctgcgggagaagcccccatctggccggcagaccccccagcccctgcggcaccagagctacatcctggccgtgaatgaccaggagactggaagtgacaccacctgctggctgcccaatgatgcccggcgggaggtgcacatcaagaggatggaggagaggaaggccagcagcaccagccccccaggggacagcctggccagcatccccttcattgatgagcccaccagccccagcattgaccatgacatcgcccacatcccagccagcgctgtgatcagcgccagcaccagccaggtgcccagcatcgccaccgtgcccccctgcctgaccaccagcgcccccctcatccggcggcagctgagccatgaccacgagagcgtgggcccccccagcctggatgcccagcccaacagcaagacagagaggagcaagagctatgatgagggcctggatgactacagagaagatgccaagctgtccttcaagcacgtgagcagcctgaagggcatcaagattgctgacagccagaagagcagcgaggacagcggcagcaggaaggacagcagcagcgaggtgttcagtgatgctgccaaggagggctggctgcacttccggcccctggtgacagacaagggcaagagggtgggcggcagcatccggccctggaagcagatgtatgtggtgctgcggggccacagcctgtacctgtacaaggacaagcgggagcagaccaccccatctgaggaggagcagcccatctctgtgaatgcctgcctgattgacatctcctacagcgagaccaagaggaagaatgtgttccggctgaccaccagtgactgtgaatgtctcttccaggctgaagatagagatgacatgctggcctggatcaagaccatccaggagagcagcaacctgaatgaggaggacaccggggtgaccaacagagacctgatcagccgccgcatcaaggagtacaacaacctgatgagcaaggccgagcagctgcccaagaccccccggcagagcctgagcatccggcagaccctgctgggcgccaagtctgagcccaagacccagagcccccacagccccaaggaggagagcgagaggaagctgctgagcaaggatgacaccagcccccccaaggacaagggcacctggaggaagggcatccccagcatcatgaggaagacctttgagaagaagcccacagccaccggcacctttggagtgcggctggatgactgccccccagcccacaccaacagagtgggggacaccagccccccagacttcctgaagagcctcatccagttctag

SEQ ID NO: 167890 - DNA, 5877 bp, Artificial Sequence
  Description of Artificial Sequence: Synthetic coding sequence
atgatggccaccaggagaacaggcctgtctgaaggagatggagacaagctgaaggcctgtgaggtgtccaagaacaaggatggcaaggagcagagcgagaccgtgtccctgtctgaagatgagaccttctcctggccaggccccaagacagtgaccctgaagaggaccagccagggcttcggcttcaccctgcggcacttcatcgtgtacccacctgagagcgccatccagttctcctacaaggatgaggagaatggaaacagaggaggcaagcagaggaaccggctggagcccatggacaccatctttgtgaagcaggtgaaggagggcggccctgcctttgaggccggcctgtgcaccggggaccgcatcatcaaggtgaatggagagagcgtgattggcaagacctacagccaggtgattgccctgatccagaacagcgacaccaccctggagctgtctgtgatgcccaaggatgaggacatcctgcaggtgctgcagttcaccaaggatgtgacagccctggcctacagccaggatgcctacctgaagggaaatgaggcctacagcggaaatgccaggaacatccctgagcccccacccatctgctacccctggctgcccagcgcccccagcgccatggcccagcctgtggagatcagccccccagacagcagcctgagcaagcagcagaccagcacccctgtgctgacccagcccggccgggcctacaggatggagatccaggtgccccccagccccacagatgtggccaagagcaacacagctgtgtgtgtgtgcaatgaatctgtgaggacagtgattgtgcccagcgagaaggtggtggacctgctgagcaacagaaacaaccacacaggccccagccacaggacagaggaggtgcgctatggagtgtctgagcagaccagcctgaagacagtgtccaggaccaccagcccccccctgagcatccccaccacccacctgatccaccagcctgctggcagccgcagcctggagcccagcggcatcctgctgaagagcggcaactacagcggccacagtgatggcatcagcagcagccgcagccaggccgtggaggcccccagcgtgtctgtgaaccactacagccccaacagccaccagcacatcgactggaagaactacaagacctacaaggagtacatcgacaacagaaggctgcacatcggctgcaggaccatccaggagcggctggacagcctgcgggccgccagccagagcaccacagactacaaccaggtggtgcccaacagaaccaccctgcagggcagaagaagaagcaccagccatgacagagtgccccagagcgtgcagatccggcagaggtctgtgtcccaggagcggctggaggacagcgtgctgatgaagtactgccccaggtctgccagccagggcgccctgaccagccccagcgtgtccttcagcaaccacaggaccaggtcctgggactacatcgagggccaggatgagaccctggagaatgtgaacagcggcacccccatcccagacagcaatggagagaagaagcagacctacaagtggagcggcttcacagagcaggatgacagaagaggcatctgtgagcggccccggcagcaggagatccacaagagcttccggggcagcaacttcaccgtggcccccagcgtggtgaacagcgacaacagaaggatgagcggccggggcgtgggctctgtgtcccagttcaagaagatccccccagacctgaagaccctgcagagcaacagaaacttccagaccacctgtggcatgagcctgccccggggcatcagccaggacaggagccccctggtgaaggtgcgcagcaacagcctgaaggcccccagcacccacgtgaccaagcccagcttcagccagaagagctttgtgtccatcaaggaccagaggcctgtgaaccacctgcaccagaacagcctgctgaaccagcagacctgggtgaggacagattctgccccagaccagcaggtggagaccgggaagagccccagcctgagcggggccagcgccaagccagccccccagagcagtgaaaatgccggcaccagtgacctggagctgcctgtgtcccagaggaaccaggacctgagcctgcaggaggccgagacagagcagagcgacaccctggacaacaaggaggccgtcatcctgcgggagaagcccccatctggccggcagaccccccagcccctgcggcaccagagctacatcctggccgtgaatgaccaggagactggaagtgacaccacctgctggctgcccaatgatgcccggcgggaggtgcacatcaagaggatggaggagaggaaggccagcagcaccagccccccaggggacagcctggccagcatccccttcattgatgagcccaccagccccagcattgaccatgacatcgcccacatcccagccagcgctgtgatcagcgccagcaccagccaggtgcccagcatcgccaccgtgcccccctgcctgaccaccagcgcccccctcatccggcggcagctgagccatgaccacgagagcgtgggcccccccagcctggatgcccagcccaacagcaagacagagaggagcaagagctatgatgagggcctggatgactacagagaagatgccaagctgtccttcaagcacgtgagcagcctgaagggcatcaagattgctgacagccagaagagcagcgaggacagcggcagcaggaaggacagcagcagcgaggtgttcagtgatgctgccaaggagggctggctgcacttccggcccctggtgacagacaagggcaagagggtgggcggcagcatccggccctggaagcagatgtatgtggtgctgcggggccacagcctgtacctgtacaaggacaagcgggagcagaccaccccatctgaggaggagcagcccatctctgtgaatgcctgcctgattgacatctcctacagcgagaccaagaggaagaatgtgttccggctgaccaccagtgactgtgaatgtctcttccaggctgaagatagagatgacatgctggcctggatcaagaccatccaggagagcagcaacctgaatgaggaggacaccggggtgaccaacagagacctgatcagccgccgcatcaaggagtacaacaacctgatgagcaaggccgagcagctgcccaagaccccccggcagagcctgagcatccggcagaccctgctgggcgccaagtctgagcccaagacccagagcccccacagccccaaggaggagagcgagaggaagctgctgagcaaggatgacaccagcccccccaaggacaagggcacctggaggaagggcatccccagcatcatgaggaagacctttgagaagaagcccacagccaccggcacctttggagtgcggctggatgactgccccccagcccacaccaaccgctacatccccctcatcgtggacatctgctgcaagctggtggaggagcggggcctggagtacacaggcatctacagagtgcccggcaacaatgctgccatcagctccatgcaggaggagctgaacaagggcatggctgacatcgacatccaggatgacaagtggagggacctgaatgtcatcagcagcctgctgaagagcttcttcaggaagctgcctgagcccctcttcaccaatgacaagtatgctgacttcatcgaggccaacaggaaggaggaccccctggaccggctgaagaccctgaagaggctcatccatgacctgcctgagcaccactatgagaccctgaagttcctgagcgcccacctgaagacagtggccgagaacagcgagaagaacaagatggagcccaggaacctggccatcgtgtttggccccaccctggtgaggaccagcgaggacaacatgacccacatggtgacccacatgccagaccagtacaagatcgtggagaccctcatccagcaccacgactggttcttcacagaggagggcgctgaggagcccctgaccaccgtgcaggaggagagcacagtggacagccagcctgtgcccaacatcgaccacctgctgaccaacatcggccgcactggagtgtccccaggagatgtgtctgattctgccaccagtgacagcaccaagagcaagggctcctggggcagcggcaaggaccagtacagccgggagctgctggtgagcagcatctttgctgctgccagcaggaagaggaagaagcccaaggagaaggcccagcccagcagcagtgaagatgagctggacaacgtgttcttcaagaaggaaaatgtggagcagtgccacaatgacaccaaggaggagagcaagaaggagagcgagaccctgggcaggaagcagaagatcatcatcgccaaggagaacagcaccaggaaggaccccagcaccaccaaggatgagaagatcagcctgggcaaggagagcacccccagcgaggagcccagccccccccacaacagcaagcacaacaagagccccaccctgagctgccgctttgccatcctgaaggagagccccaggagcctgctggcccagaagagcagccacctggaggagaccggcagtgacagcggcaccctgctgagcaccagcagccaggccagcctggcccgcttctccatgaagaagagcaccagccctgagaccaagcacagcgagttcctggccaacgtgtccaccatcaccagtgactacagcaccaccagcagcgccacctacctgaccagcctggacagcagccggctgagccctgaggtgcagagcgtggccgagagcaaaggagatgaagcagatgatgagaggtctgagctgatcagcgagggccggcctgtggagacagattctgagagcgagttccctgtgttccccacagccctgaccagcgagcggctcttccggggcaagctgcaggaggtgaccaagagcagcagaagaaattctgagggcagcgagctgagctgcacagagggcagcctgaccagcagcctggacagccggcggcagctgttcagcagccacaagctgattgaatgtgacaccctgagcaggaagaagagcgcccgcttcaagagtgacagcggcagcctgggagatgccaagaatgagaaggaggcccccagcctgaccaaggtgtttgatgtgatgaagaagggcaagagcacaggcagcctgctgacccccaccagaggagagagcgagaagcaggagcccacctggaagaccaagattgctgaccggctgaagctgcggccccgggccccagcagatgacatgtttggagtgggcaaccacaaggtgaatgctgagacagccaagaggaagagcatcagaagaagacacaccctgggcggccacagagatgccacagagatctctgtgctgaacttctggaaggtgcatgagcagagcggggagcgggagagcgagctgtctgctgtgaaccggctgaagcccaagtgcagcgcccaggacctgagcatcagtgactggctggcccgggagcggctgcggaccagcaccagtgacctgagcagaggagagatcggggacccccagacagagaaccccagcacccgggagatcgccaccacagacacccccctgagcctgcactgcaacacaggcagcagcagcagcaccctggccagcaccaaccggcccctgctgagcatccccccccagagcccagaccagatcaacggggagagcttccagaatgtgtccaagaatgccagcagcgctgccaatgcccagccccacaagctgtctgagaccccaggcagcaaggccgagttccacccctgcctgtag

SEQ ID NO: 167891 - DNA, 594 bp, Artificial Sequence
  Description of Artificial Sequence: Synthetic coding sequence
tgaaacaatgctgccatcagctccatgcaggaggagctgaacaagggcatggctgacatcgacatccaggatgacaagtggagggacctgaatgtcatcagcagcctgctgaagagcttcttcaggaagctgcctgagcccctcttcaccaatgacaagtatgctgacttcatcgaggccaacaggaaggaggaccccctggaccggctgaagaccctgaagaggctcatccatgacctgcctgagcaccactatgagaccctgaagttcctgagcgcccacctgaagacagtggccgagaacagcgagaagaacaagatggagcccaggaacctggccatcgtgtttggccccaccctggtgaggaccagcgaggacaacatgacccacatggtgacccacatgccagaccagtacaagatcgtggagaccctcatccagcaccacgactggttcttcacagaggagggcgctgaggagcccctcatccagctgctggtgacccagcagaacctgcgggtgctgggggacctggagcgcatcagcattgctggcaactgcctgtgcccccccagcctgcagctgctggtgtag

SEQ ID NO: 167892 - DNA, 342 bp, Artificial Sequence
  Description of Artificial Sequence: Synthetic coding sequence
tacatccccctgattgtggacatctgctgcaagctggtggaggagcggggcctggagtacacaggcatctacagagtgcccggcaacaatgctgccatcagctccatgcaggaggagctgaacaagggcatggctgacatcgacatccaggatgacaagtggagggacctgaatgtcatcagcagcctgctgaagagcttcttcaggaagctgcctgagcccctcttcaccaatgacaagtatgctgacttcatcgaggccaacagaaaagaagaccccctggaccggctgaagaccctgaagaggctcttcctgagcgcccacctgaagacagtggcctag

SEQ ID NO: 167893 - DNA, 2724 bp, Artificial Sequence
  Description of Artificial Sequence: Synthetic coding sequence
atgcccaaggatgaggacatcctgcaggtggcctacagccaggatgcctacctgaagggaaatgaggcctacagcggaaatgccaggaacatccctgagcccccacccatctgctacccctggctgcccagcgcccccagcgccatggcccagcctgtggagatcagccccccagacagcagcctgagcaagcagcagaccagcacccctgtgctgacccagcccggccgggcctacaggatggagatccaggtgccccccagccccacagatgtggccaagagcaacacagctgtgtgtgtgtgcaatgaatctgtgaggacagtcatcgtgcccagcgagaaggtggtggacctgctgagcaacagaaacaaccacacaggccccagccacaggacagaggaggtgcgctatggagtgtctgagcagaccagcctgaagacagtgtccaggaccaccagcccccccctgagcatccccaccacccacctgatccaccagcctgctggcagccgcagcctggagcccagcggcatcctgctgaagagcggcaactacagcggccacagtgatggcatcagcagcagccgcagccaggccgtggaggcccccagcgtgtctgtgaaccactacagccccaacagccaccagcacatcgactggaagaactacaagacctacaaggagtacatcgacaacagaaggctgcacatcggctgcaggaccatccaggagcggctggacagcctgcgggccgccagccagagcaccacagactacaaccaggtggtgcccaacagaaccaccctgcagggcagaagaagaagcaccagccatgacagagtgccccagagcgtgcagatccggcagaggtctgtgtcccaggagcggctggaggacagcgtgctgatgaagtactgccccaggtctgccagccagggcgccctgaccagccccagcgtgtccttcagcaaccacaggaccaggtcctgggactacatcgagggccaggatgagaccctggagaatgtgaacagcggcacccccatcccagacagcaatggagagaagaagcagacctacaagtggagcggcttcacagagcaggatgaccggcggggcatctgtgagcggccccggcagcaggagatccacaagagcttccggggcagcaacttcaccgtggcccccagcgtggtgaacagcgacaacagaaggatgagcggccggggcgtgggctctgtgtcccagttcaagaagatccccccagacctgaagaccctgcagagcaacagaaacttccagaccacctgtggcatgagcctgccccggggcatcagccaggacaggagccccctggtgaaggtgcgcagcaacagcctgaaggcccccagcacccacgtgaccaagcccagcttcagccagaagagctttgtgtccatcaaggaccagaggcctgtgaaccacctgcaccagaacagcctgctgaaccagcagacctgggtgaggacagacagcgccccagaccagcaggtggagaccgggaagagccccagcctgagcggggccagcgccaagccagccccccagagcagtgaaaatgccggcaccagtgacctggagctgcctgtgtcccagaggaaccaggacctgagcctgcaggaggccgagacagagcagagcgacaccctggacaacaaggaggccgtcatcctgcgggagaagccacccagcggccggcagaccccccagcccctgcggcaccagagctacatcctggccgtgaatgaccaggagaccggcagtgacaccacctgctggctgcccaatgatgcccggcgggaggtgcacatcaagaggatggaggagaggaaggccagcagcaccagccccccaggggacagcctggccagcatccccttcattgatgagcccaccagccccagcattgaccatgacatcgcccacatcccagccagcgctgtgatcagcgccagcaccagccaggtgcccagcatcgccaccgtgcccccctgcctgaccaccagcgcccccctcatccggcggcagctgagccatgaccatgaatctgtgggcccccccagcctggatgcccagcccaacagcaagacagagaggagcaagagctatgatgagggcctggatgactaccgggaggatgccaagctgtccttcaagcacgtgagcagcctgaagggcatcaagattgctgacagccagaagagcagtgaagattctggcagcaggaaggacagcagcagcgaggtgttcagtgatgctgccaaggagggctggctgcacttccggcccctggtgacagacaagggcaagagggtgggcggcagcatccggccctggaagcagatgtatgtggtgctgcggggccacagcctgtacctgtacaaggacaagcgggagcagaccacccccagcgaggaggagcagcccatctctgtgaatgcctgcctgattgacatctcctacagcgagaccaagaggaagaatgtgttccggctgaccaccagtgactgtgagtgcctcttccaggccgaggacagagatgacatgctggcctggatcaagaccatccaggagagcagcaacctgaatgaagaagatactggagtgaccaacagagacctgatcagccgccgcatcaaggagtacaacaacctgatgagcaaggccgagcagctgccctag

SEQ ID NO: 167894 - DNA, 3396 bp, Artificial Sequence
  Description of Artificial Sequence: Synthetic coding sequence
atgatggccaccaggagaacaggcctgtctgaaggagatggagacaagctgaaggcctgtgaggtgtccaagaacaaggatggcaaggagcagagcgagaccgtgtccctgtctgaagatgagaccttctcctggccaggccccaagacagtgaccctgaagaggaccagccagggcttcggcttcaccctgcggcacttcatcgtgtacccacctgagagcgccatccagttctcctacaaggatgaggagaatggaaacagaggaggcaagcagaggaaccggctggagcccatggacaccatctttgtgaagcaggtgaaggagggcggccctgcctttgaggccggcctgtgcaccggggaccgcatcatcaaggtgaatggagagagcgtgattggcaagacctacagccaggtgattgccctgatccagaacagcgacaccaccctggagctgtctgtgatgcccaaggatgaggacatcctgcaggtgctgcagttcaccaaggatgtgacagccctggcctacagccaggatgcctacctgaagggaaatgaggcctacagcggaaatgccaggaacatccctgagcccccacccatctgctacccctggctgcccagcgcccccagcgccatggcccagcctgtggagatcagccccccagacagcagcctgagcaagcagcagaccagcacccctgtgctgacccagcccggccgggcctacaggatggagatccaggtgccccccagccccacagatgtggccaagagcaacacagctgtgtgtgtgtgcaatgaatctgtgaggacagtgattgtgcccagcgagaaggtggtggacctgctgagcaacagaaacaaccacacaggccccagccacaggacagaggaggtgcgctatggagtgtctgagcagaccagcctgaagacagtgtccaggaccaccagcccccccctgagcatccccaccacccacctgatccaccagcctgctggcagccgcagcctggagcccagcggcatcctgctgaagagcggcaactacagcggccacagtgatggcatcagcagcagccgcagccaggccgtggaggcccccagcgtgtctgtgaaccactacagccccaacagccaccagcacatcgactggaagaactacaagacctacaaggagtacatcgacaacagaaggctgcacatcggctgcaggaccatccaggagcggctggacagcctgcgggccgccagccagagcaccacagactacaaccaggtggtgcccaacagaaccaccctgcagggcagaagaagaagcaccagccatgacagagtgccccagagcgtgcagatccggcagaggtctgtgtcccaggagcggctggaggacagcgtgctgatgaagtactgccccaggtctgccagccagggcgccctgaccagccccagcgtgtccttcagcaaccacaggaccaggtcctgggactacatcgagggccaggatgagaccctggagaatgtgaacagcggcacccccatcccagacagcaatggagagaagaagcagacctacaagtggagcggcttcacagagcaggatgacagaagaggcatctgtgagcggccccggcagcaggagatccacaagagcttccggggcagcaacttcaccgtggcccccagcgtggtgaacagcgacaacagaaggatgagcggccggggcgtgggctctgtgtcccagttcaagaagatccccccagacctgaagaccctgcagagcaacagaaacttccagaccacctgtggcatgagcctgccccggggcatcagccaggacaggagccccctggtgaaggtgcgcagcaacagcctgaaggcccccagcacccacgtgaccaagcccagcttcagccagaagagctttgtgtccatcaaggaccagaggcctgtgaaccacctgcaccagaacagcctgctgaaccagcagacctgggtgaggacagattctgccccagaccagcaggtggagaccgggaagagccccagcctgagcggggccagcgccaagccagccccccagagcagtgaaaatgccggcaccagtgacctggagctgcctgtgtcccagaggaaccaggacctgagcctgcaggaggccgagacagagcagagcgacaccctggacaacaaggaggccgtcatcctgcgggagaagcccccatctggccggcagaccccccagcccctgcggcaccagagctacatcctggccgtgaatgaccaggagactggaagtgacaccacctgctggctgcccaatgatgcccggcgggaggtgcacatcaagaggatggaggagaggaaggccagcagcaccagccccccaggggacagcctggccagcatccccttcattgatgagcccaccagccccagcattgaccatgacatcgcccacatcccagccagcgctgtgatcagcgccagcaccagccaggtgcccagcatcgccaccgtgcccccctgcctgaccaccagcgcccccctcatccggcggcagctgagccatgaccacgagagcgtgggcccccccagcctggatgcccagcccaacagcaagacagagaggagcaagagctatgatgagggcctggatgactacagagaagatgccaagctgtccttcaagcacgtgagcagcctgaagggcatcaagattgctgacagccagaagagcagcgaggacagcggcagcaggaaggacagcagcagcgaggtgttcagtgatgctgccaaggagggctggctgcacttccggcccctggtgacagacaagggcaagagggtgggcggcagcatccggccctggaagcagatgtatgtggtgctgcggggccacagcctgtacctgtacaaggacaagcgggagcagaccaccccatctgaggaggagcagcccatctctgtgaatgcctgcctgattgacatctcctacagcgagaccaagaggaagaatgtgttccggctgaccaccagtgactgtgaatgtctcttccaggctgaagatagagatgacatgctggcctggatcaagaccatccaggagagcagcaacctgaatgaggaggacaccggggtgaccaacagagacctgatcagccgccgcatcaaggagtacaacaacctgatgagcaaggccgagcagctgcccaagaccccccggcagagcctgagcatccggcagaccctgctgggcgccaagtctgagcccaagacccagagcccccacagccccaaggaggagagcgagaggaagctgctgagcaaggatgacaccagcccccccaaggacaagggcacctggaggaagggcatccccagcatcatgtag

SEQ ID NO: 167895 - DNA, 4224 bp, Artificial Sequence
  Description of Artificial Sequence: Synthetic coding sequence
atggccaccaggagaacaggcctgtctgaaggagatggagacaagctgaaggcctgtgaggtgtccaagaacaaggatggcaaggagcagagcgagaccgtgtccctgtctgaagatgagaccttctcctggccaggccccaagacagtgaccctgaagaggaccagccagggcttcggcttcaccctgcggcacttcatcgtgtacccacctgagagcgccatccagttctcctacaaggatgaagaaaatggaaacagaggaggcaagcagaggaaccggctggagcccatggacaccatctttgtgaagcaggtgaaggagggcggccctgcctttgaagctggcctgtgcacaggagaccgcatcatcaaggtgaatggagagagcgtcatcggcaagacctacagccaggtgattgccctgatccagaacagcgacaccaccctggagctgtctgtgatgcccaaggatgaggacatcctgcaggtggcctacagccaggatgcctacctgaagggaaatgaggcctacagcggaaatgccaggaacatccctgagcccccacccatctgctacccctggctgcccagcgcccccagcgccatggcccagcctgtggagatcagccccccagacagcagcctgagcaagcagcagaccagcacccctgtgctgacccagcccggccgggcctacaggatggagatccaggtgccccccagccccacagatgtggccaagagcaacacagctgtgtgtgtgtgcaatgaatctgtgaggacagtcatcgtgcccagcgagaaggtggtggacctgctgagcaacagaaacaaccacacaggccccagccacaggacagaggaggtgcgctatggagtgtctgagcagaccagcctgaagacagtgtccaggaccaccagcccccccctgagcatccccaccacccacctgatccaccagcctgctggcagccgcagcctggagcccagcggcatcctgctgaagagcggcaactacagcggccacagtgatggcatcagcagcagccgcagccaggccgtggaggcccccagcgtgtctgtgaaccactacagccccaacagccaccagcacatcgactggaagaactacaagacctacaaggagtacatcgacaacagaaggctgcacatcggctgcaggaccatccaggagcggctggacagcctgcgggccgccagccagagcaccacagactacaaccaggtggtgcccaacagaaccaccctgcagggcagaagaagaagcaccagccatgacagagtgccccagagcgtgcagatccggcagaggtctgtgtcccaggagcggctggaggacagcgtgctgatgaagtactgccccaggtctgccagccagggcgccctgaccagccccagcgtgtccttcagcaaccacaggaccaggtcctgggactacatcgagggccaggatgagaccctggagaatgtgaacagcggcacccccatcccagacagcaatggagagaagaagcagacctacaagtggagcggcttcacagagcaggatgaccggcggggcatctgtgagcggccccggcagcaggagatccacaagagcttccggggcagcaacttcaccgtggcccccagcgtggtgaacagcgacaacagaaggatgagcggccggggcgtgggctctgtgagccactggaggaagggcatccccagcatcatgaggaagacctttgagaagaagcccacagccaccggcaccttcggcgtgcggctggatgactgccccccagcccacaccaaccgctacatccccctgattgtggacatctgctgcaagctggtggaggagcggggcctggagtacacaggcatctacagagtgcccggcaacaatgctgccatcagctccatgcaggaggagctgaacaagggcatggctgacatcgacatccaggatgacaagtggagggacctgaatgtcatcagcagcctgctgaagagcttcttcaggaagctgcctgagcccctcttcaccaatgacaagtatgctgacttcatcgaggccaacagaaaagaagaccccctggaccggctgaagaccctgaagaggctcatccatgacctgcctgagcaccactatgagaccctgaagttcctgagcgcccacctgaagacagtggctgaaaattctgagaagaacaagatggagcccaggaacctggccatcgtgtttggccccaccctggtgaggaccagcgaggacaacatgacccacatggtgacccacatgccagaccagtacaagatcgtggagaccctcatccagcaccacgactggttcttcacagaggagggcgctgaggagcccctgaccaccgtgcaggaggagagcacagtggacagccagcctgtgcccaacatcgaccacctgctgaccaacattggaagaactggagtgtccccaggagatgtgtctgacagcgccaccagtgacagcaccaagagcaagggctcctggggcagcggcaaggaccagtacagccgggagctgctggtgagcagcatctttgctgctgccagcaggaagaggaagaagcccaaggagaaggcccagcccagcagcagtgaagatgagctggacaacgtgttcttcaagaaggaaaatgtggagcagtgccacaatgacaccaaggaggagagcaagaaggagagcgagaccctgggcaggaagcagaagatcatcatcgccaaggagaacagcaccaggaaggaccccagcaccaccaaggatgagaagatcagcctgggcaaggagagcaccccatctgaggagcccagccccccccacaacagcaagcacaacaagagccccaccctgagctgccgctttgccatcctgaaggagagccccaggagcctgctggcccagaagagcagccacctggaggagactggaagtgacagcggcaccctgctgagcaccagcagccaggccagcctggcccgcttctccatgaagaagagcaccagccctgagaccaagcacagcgagttcctggccaacgtgtccaccatcaccagtgactacagcaccaccagcagcgccacctacctgaccagcctggacagcagccggctgagccctgaggtgcagagcgtggccgagagcaaaggagatgaagcagatgatgagaggtctgagctgatcagcgagggccggcctgtggagacagacagcgagagcgagttccctgtgttccccacagccctgaccagcgagcggctcttccggggcaagctgcaggaggtgaccaagagcagcagaagaaacagcgagggcagcgagctgagctgcacagagggcagcctgaccagcagcctggacagccggcggcagctgttcagcagccacaagctgattgaatgtgacaccctgagcaggaagaagagcgcccgcttcaagagtgacagcggcagcctgggagatgccaagaatgagaaggaggcccccagcctgaccaaggtgtttgatgtgatgaagaagggcaagagcacaggcagcctgctgacccccaccagaggagagagcgagaagcaggagcccacctggaagaccaagattgctgaccggctgaagctgcggccccgggccccagcagatgacatgtttggagtgggcaaccacaaggtgaatgctgagacagccaagaggaagagcatcagaagaagacacaccctgggcggccacagagatgccacagagatctctgtgctgaacttctggaaggtgcatgagcagagcggggagcgggagagcgagctgtctgctgtgaaccggctgaagcccaagtgcagcgcccaggacctgagcatcagtgactggctggcccgggagcggctgcggaccagcaccagtgacctgagcagaggagaaattggagacccccagacagagaaccccagcacccgggagatcgccaccacagacacccccctgagcctgcactgcaacacaggcagcagcagcagcaccctggccagcaccaaccggcccctgctgagcatccccccccagagcccagaccagatcaatggagagagcttccagaatgtgtccaagaatgccagcagcgctgccaatgcccagccccacaagctgtctgagaccccaggcagcaaggccgagttccacccctgcctgtag

SEQ ID NO: 167896 - DNA, 279 bp, Artificial Sequence
  Description of Artificial Sequence: Synthetic coding sequence
atggacaccatctttgtgaagcaggtgaaggagggcggccctgcctttgaggccggcctgtgcaccggggaccgcatcatcaaggtgaatggagagagcgtgattggcaagacctacagccaggtgattgccctgatccagaacagcgacaccaccctggagctgtctgtgatgcccaaggatgaggacatcctgcaggtgaacctggagttcagcaccttctacaagaacaccatcgccaagttcctgcagctgagtgacatggagatgctgtgctag

SEQ ID NO: 167897 - DNA, 4476 bp, Artificial Sequence
  Description of Artificial Sequence: Synthetic coding sequence
atgaatggagtggccttctgcctggtgggcatcccccccaggcctgagcccaggcctccccagctgcccctgggccccagagatggctgcagcccccggcggcccttcccctggcagggccccaggaccctgctgctgtacaagagcccccaggacggcttcggcttcaccctgcggcacttcatcgtgtacccacctgagagcgctgtgcactgcagcctgaaggaggaggagaatggaggccggggcggcggccccagcccccgctaccgcctggagcccatggacaccatctttgtgaagaatgtgaaggaggatggccctgcccaccgggccggcctgaggactggagaccggctggtgaaggtgaatggagagagcgtgattggcaagacctacagccaggtgattgccctgatccagaacagtgatgacaccctggagctgagcatcatgcccaaggatgaggacatcctgcagctggcctacagccaggatgcctacctgaagggaaatgagccctacagcggggaggcccggagcatccctgagcccccacccatctgctaccccaggaagacctacgcccccccagcccgggccagcacccgggccaccatggtgcctgagcccaccagcgccctgcccagcgaccccaggagccctgctgcctggagcgaccccggcctgcgggtgcccccagctgcccgggcccacctggacaacagcagcctgggcatgagccagccccggcccagccctggggccttcccccacctgagcagcgagcccaggaccccccgggccttccctgagcccggcagccgggtgccccccagccggctggagtgccagcaggccctgagccactggctgagcaaccaggtgccccggcgggccggggagcggcgctgcccagccatggccccccgggcccggagcgccagccaggaccggctggaggaggtggccgccccccggccctggccctgcagcaccagccaggatgccctgagccagctgggccaggagggctggcaccgggcccggagtgatgactacctgagccgggccaccaggtctgctgaggccctgggccctggggccctggtgagccccaggtttgagcgctgtggctgggccagccagaggagcagcgcccggaccccagcctgccccacccgggacctgcccggcccccaggcccccccacccagcggcctgcagggcctggatgacctgggctacatcggctaccgcagctacagccccagcttccagaggagaacaggcctgctgcacgccctgtccttccgggacagcccctttggaggcctgcccaccttcaacctggcccagagccctgccagcttccccccagaggccagcgagcccccccgggtggtgcggcctgagcccagcacccgggccctggagcccccagcagaagatagaggagatgaggtggtgctgcggcagaagcccccaactggaaggaaggtgcagctgaccccagcccggcagatgaacctgggctttggagatgagagccctgagcctgaggccagcggccgcggggagcggctgggcaggaaggtggcccccctggccaccacagaggacagcctggccagcatccccttcattgatgagcccaccagccccagcattgacctgcaggccaagcacgtgcctgccagcgctgtggtgagcagcgccatgaacagcgcccctgtgctgggcaccagccccagcagccccaccttcaccttcaccctgggccgccactacagccaggactgcagcagcatcaaggccggccgccgcagcagctacctgctggccatcaccacagagaggagcaagagctgtgatgatggcctgaacaccttcagagatgagggccgggtgctgcggcggctgcccaaccgcatccccagcctgaggatgctgcgctccttcttcacagatggcagcctggacagctggggcaccagtgaagatgctgatgcccccagcaagaggcacagcaccagtgacctgagtgatgccaccttcagtgacatccggcgggagggctggctgtactacaagcagatcctgaccaagaagggcaagaaggccggcagcggcctgcggcagtggaagagggtgtatgctgccctgcgggcccggagcctgagcctgagcaaggagcggcgggagcccggccctgctgctgctggagctgctgctgctggggccggggaggatgaagctgcccctgtgtgcatcggcagctgcctggtggacatctcctacagcgagaccaagagaagacatgtgttccggctgaccacagctgacttctgtgagtacctgttccaggctgaagatagagatgacatgctgggctggatccgggccatccgggagaacagcagagctgagggggaggaccccggctgtgccaaccaggccctgatcagcaagaagctgaatgactacaggaaggtgagccacagcagcggccccaaggctgacagcagccccaagggcagccggggcctgggcggcctgaagtctgagttcctgaagcagagcgctgcccggggcctgcggacccaggacctgcctgctggcagcaaggatgattctgctgctgcccccaagaccccctggggcatcaacatcatcaagaagaacaagaaggccgccccccgggcctttggagtgcggctggaggagtgccagcctgccacagagaaccagagggtgcccctcatcgtggccgcctgctgcagaattgtggaggcccggggcctggagagcacaggcatctacagagtgcccggcaacaatgctgtggtgagcagcctgcaggagcagctgaacagaggccctggggacatcaacctgcaggatgagcgctggcaggacctgaatgtcatcagcagcctgctgaagagcttcttcaggaagctgcctgagcccctcttcacagatgacaagtacaatgacttcatcgaggccaacagaattgaagatgcccgggagaggatgaggaccctgaggaagctgatccgggacctgcccggccactactatgagaccctgaagttcctggtgggccacctgaagaccatcgctgaccacagcgagaagaacaagatggagcccaggaacctggccctggtgtttggccccaccctggtgaggaccagcgaggacaacatgacagacatggtgacccacatgccagaccgctacaagatcgtggagaccctcatccagcacagcgactggttcttcagtgatgaagaagataaaggagagaggacccctgtgggggacaaggagccccaggccgtgcccaacatcgagtacctgctgcccaacattggaagaacagtgcccccaggggaccccggcagtgacagcaccacctgcagcagcgccaagagcaagggctcctgggcccccaagaaggagccctatgcccgggagatgctggccatctccttcatctctgctgtgaacaggaagaggaagaagagaagagaggcccggggcctgggcagcagcacagatgatgattctgagcaggaggcccacaagccaggggccggggccacagcccctggcacccaggagcggccccagggccccctgcccggggctgtggcccctgaggcccctggccgcctgagccccccagctgcccctgaggagaggcctgctgctgacaccaggagcatcgtgtctggctacagcaccctgagcaccatggacagatctgtgtgcagcggggccagcggcagaagagctggagctggagatgaagcagatgatgagaggtctgagctgagccacgtggagacagacacagaaggagctgctggagctggccctgggggccgcctgacccggcggcccagcttcagcagccaccacctgatgccctgtgacaccctggcccggcggcggctggcccggggccgcccagatggagagggcgccggccggggcggcccccgggcccctgagcccccaggcagcgccagcagcagcagccaggagagcctgcggcccccagctgctgccctggccagccggcccagcaggatggaggccctgcggctgcggctgcggggcacagcagatgacatgctggccgtgcggctgcggcggcccctgagccctgagaccaggagaagaagaagctcctggaggaggcacacagtggtggtgcagagccccctgacagacctgaacttcaatgagtggaaggagctgggcggcggcggccccccagagcctgctggggcccgggcccacagcgacaacaaggacagcggcctgagcagcctggagagcaccaaggcccgggcccccagcagcgctgccagccagcccccagcccctggggacaccggcagcctgcagagccagcccccccggcgctctgctgccagccggctgcaccagtgcctgtag

SEQ ID NO: 167898 - DNA, 3435 bp, Artificial Sequence
  Description of Artificial Sequence: Synthetic coding sequence
atgaatggagtggccttctgcctggtgggcatcccccccaggcctgagcccaggcctccccagctgcccctgggccccagagatggctgcagcccccggcggcccttcccctggcagggccccaggaccctgctgctgtacaagagcccccaggacggcttcggcttcaccctgcggcacttcatcgtgtacccacctgagagcgctgtgcactgcagcctgaaggaggaggagaatggaggccggggcggcggccccagcccccgctaccgcctggagcccatggacaccatctttgtgaagaatgtgaaggaggatggccctgcccaccgggccggcctgaggactggagaccggctggtgaaggtgaatggagagagcgtgattggcaagacctacagccaggtgattgccctgatccagaacagtgatgacaccctggagctgagcatcatgcccaaggatgaggacatcctgcagctggcctacagccaggatgcctacctgaagggaaatgagccctacagcggggaggcccggagcatccctgagcccccacccatctgctaccccaggaagacctacgcccccccagcccgggccagcacccgggccaccatggtgcctgagcccaccagcgccctgcccagcgaccccaggagccctgctgcctggagcgaccccggcctgcgggtgcccccagctgcccgggcccacctggacaacagcagcctgggcatgagccagccccggcccagccctggggccttcccccacctgagcagcgagcccaggaccccccgggccttccctgagcccggcagccgggtgccccccagccggctggagtgccagcaggccctgagccactggctgagcaaccaggtgccccggcgggccggggagcggcgctgcccagccatggccccccgggcccggagcgccagccaggaccggctggaggaggtggccgccccccggccctggccctgcagcaccagccaggatgccctgagccagctgggccaggagggctggcaccgggcccggagtgatgactacctgagccgggccaccaggtctgctgaggccctgggccctggggccctggtgagccccaggtttgagcgctgtggctgggccagccagaggagcagcgcccggaccccagcctgccccacccgggacctgcccggcccccaggcccccccacccagcggcctgcagggcctggatgacctgggctacatcggctaccgcagctacagccccagcttccagaggagaacaggcctgctgcacgccctgtccttccgggacagcccctttggaggcctgcccaccttcaacctggcccagagccctgccagcttccccccagaggccagcgagcccccccgggtggtgcggcctgagcccagcacccgggccctggagcccccagcagaagatagaggagatgaggtggtgctgcggcagaagcccccaactggaaggaaggtgcagctgaccccagcccggcagatgaacctgggctttggagatgagagccctgagcctgaggccagcggccgcggggagcggctgggcaggaaggtggcccccctggccaccacagaggacagcctggccagcatccccttcattgatgagcccaccagccccagcattgacctgcaggccaagcacgtgcctgccagcgctgtggtgagcagcgccatgaacagcgcccctgtgctgggcaccagccccagcagccccaccttcaccttcaccctgggccgccactacagccaggactgcagcagcatcaaggccggccgccgcagcagctacctgctggccatcaccacagagaggagcaagagctgtgatgatggcctgaacaccttcagagatgagggccgggtgctgcggcggctgcccaaccgcatccccagcctgaggatgctgcgctccttcttcacagatggcagcctggacagctggggcaccagtgaagatgctgatgcccccagcaagaggcacagcaccagtgacctgagtgatgccaccttcagtgacatccggcgggagggctggctgtactacaagcagatcctgaccaagaagggcaagaaggccggcagcggcctgcggcagtggaagagggtgtatgctgccctgcgggcccggagcctgagcctgagcaaggagcggcgggagcccggccctgctgctgctggagctgctgctgctggggccggggaggatgaagctgcccctgtgtgcatcggcagctgcctggtggacatctcctacagcgagaccaagagaagacatgtgttccggctgaccacagctgacttctgtgagtacctgttccaggctgaagatagagatgacatgctgggctggatccgggccatccgggagaacagcagagctgagggggaggaccccggctgtgccaaccaggccctgatcagcaagaagctgaatgactacaggaaggtgagccacagcagcggccccaaggctgacagcagccccaagggcagccggggcctgggcggcctgaagtctgagttcctgaagcagagcgctgcccggggcctgcggacccaggacctgcctgctggcagcaaggatgattctgctgctgcccccaagaccccctggggcatcaacatcatcaagaagaacaagaaggccgccccccgggcctttggagtgcggctggaggagtgccagcctgccacagagaaccagagggtgcccctcatcgtggccgcctgctgcagaattgtggaggcccggggcctggagagcacaggcatctacagagtgcccggcaacaatgctgtggtgagcagcctgcaggagcagctgaacagaggccctggggacatcaacctgcaggatgagcgctggcaggacctgaatgtcatcagcagcctgctgaagagcttcttcaggaagctgcctgagcccctcttcacagatgacaagtacaatgacttcatcgaggccaacagaattgaagatgcccgggagaggatgaggaccctgaggaagctgatccgggacctgcccggccactactatgagaccctgaagttcctggtgggccacctgaagaccatcgctgaccacagcgagaagaacaagatggagcccaggaacctggccctggtgtttggccccaccctggtgaggaccagcgaggacaacatgacagacatggtgacccacatgccagaccgctacaagatcgtggagaccctcatccagcacagcgactggttcttcagtgatgaagaagataaaggagagaggacccctgtgggggacaaggagccccaggccgtgcccaacatcgagtacctgctgcccaacattggaagaacagtgcccccaggggaccccggcagcgctgacctgctggagatctag

SEQ ID NO: 167899 - DNA, 4194 bp, Artificial Sequence
  Description of Artificial Sequence: Synthetic coding sequence
atggacaccatctttgtgaagaatgtgaaggaggatggccctgcccaccgggccggcctgaggactggagaccggctggtgaaggtgaatggagagagcgtgattggcaagacctacagccaggtgattgccctgatccagaacagtgatgacaccctggagctgagcatcatgcccaaggatgaggacatcctgcagctggcctacagccaggatgcctacctgaagggaaatgagccctacagcggggaggcccggagcatccctgagcccccacccatctgctaccccaggaagacctacgcccccccagcccgggccagcacccgggccaccatggtgcctgagcccaccagcgccctgcccagcgaccccaggagccctgctgcctggagcgaccccggcctgcgggtgcccccagctgcccgggcccacctggacaacagcagcctgggcatgagccagccccggcccagccctggggccttcccccacctgagcagcgagcccaggaccccccgggccttccctgagcccggcagccgggtgccccccagccggctggagtgccagcaggccctgagccactggctgagcaaccaggtgccccggcgggccggggagcggcgctgcccagccatggccccccgggcccggagcgccagccaggaccggctggaggaggtggccgccccccggccctggccctgcagcaccagccaggatgccctgagccagctgggccaggagggctggcaccgggcccggagtgatgactacctgagccgggccaccaggtctgctgaggccctgggccctggggccctggtgagccccaggtttgagcgctgtggctgggccagccagaggagcagcgcccggaccccagcctgccccacccgggacctgcccggcccccaggcccccccacccagcggcctgcagggcctggatgacctgggctacatcggctaccgcagctacagccccagcttccagaggagaacaggcctgctgcacgccctgtccttccgggacagcccctttggaggcctgcccaccttcaacctggcccagagccctgccagcttccccccagaggccagcgagcccccccgggtggtgcggcctgagcccagcacccgggccctggagcccccagcagaagatagaggagatgaggtggtgctgcggcagaagcccccaactggaaggaaggtgcagctgaccccagcccggcagatgaacctgggctttggagatgagagccctgagcctgaggccagcggccgcggggagcggctgggcaggaaggtggcccccctggccaccacagaggacagcctggccagcatccccttcattgatgagcccaccagccccagcattgacctgcaggccaagcacgtgcctgccagcgctgtggtgagcagcgccatgaacagcgcccctgtgctgggcaccagccccagcagccccaccttcaccttcaccctgggccgccactacagccaggactgcagcagcatcaaggccggccgccgcagcagctacctgctggccatcaccacagagaggagcaagagctgtgatgatggcctgaacaccttcagagatgagggccgggtgctgcggcggctgcccaaccgcatccccagcctgaggatgctgcgctccttcttcacagatggcagcctggacagctggggcaccagtgaagatgctgatgcccccagcaagaggcacagcaccagtgacctgagtgatgccaccttcagtgacatccggcgggagggctggctgtactacaagcagatcctgaccaagaagggcaagaaggccggcagcggcctgcggcagtggaagagggtgtatgctgccctgcgggcccggagcctgagcctgagcaaggagcggcgggagcccggccctgctgctgctggagctgctgctgctggggccggggaggatgaagctgcccctgtgtgcatcggcagctgcctggtggacatctcctacagcgagaccaagagaagacatgtgttccggctgaccacagctgacttctgtgagtacctgttccaggctgaagatagagatgacatgctgggctggatccgggccatccgggagaacagcagagctgagggggaggaccccggctgtgccaaccaggccctgatcagcaagaagctgaatgactacaggaaggtgagccacagcagcggccccaaggctgacagcagccccaagggcagccggggcctgggcggcctgaagtctgagttcctgaagcagagcgctgcccggggcctgcggacccaggacctgcctgctggcagcaaggatgattctgctgctgcccccaagaccccctggggcatcaacatcatcaagaagaacaagaaggccgccccccgggcctttggagtgcggctggaggagtgccagcctgccacagagaaccagagggtgcccctcatcgtggccgcctgctgcagaattgtggaggcccggggcctggagagcacaggcatctacagagtgcccggcaacaatgctgtggtgagcagcctgcaggagcagctgaacagaggccctggggacatcaacctgcaggatgagcgctggcaggacctgaatgtcatcagcagcctgctgaagagcttcttcaggaagctgcctgagcccctcttcacagatgacaagtacaatgacttcatcgaggccaacagaattgaagatgcccgggagaggatgaggaccctgaggaagctgatccgggacctgcccggccactactatgagaccctgaagttcctggtgggccacctgaagaccatcgctgaccacagcgagaagaacaagatggagcccaggaacctggccctggtgtttggccccaccctggtgaggaccagcgaggacaacatgacagacatggtgacccacatgccagaccgctacaagatcgtggagaccctcatccagcacagcgactggttcttcagtgatgaagaagataaaggagagaggacccctgtgggggacaaggagccccaggccgtgcccaacatcgagtacctgctgcccaacattggaagaacagtgcccccaggggaccccggcagtgacagcaccacctgcagcagcgccaagagcaagggctcctgggcccccaagaaggagccctatgcccgggagatgctggccatctccttcatctctgctgtgaacaggaagaggaagaagagaagagaggcccggggcctgggcagcagcacagatgatgattctgagcaggaggcccacaagccaggggccggggccacagcccctggcacccaggagcggccccagggccccctgcccggggctgtggcccctgaggcccctggccgcctgagccccccagctgcccctgaggagaggcctgctgctgacaccaggagcatcgtgtctggctacagcaccctgagcaccatggacagatctgtgtgcagcggggccagcggcagaagagctggagctggagatgaagcagatgatgagaggtctgagctgagccacgtggagacagacacagaaggagctgctggagctggccctgggggccgcctgacccggcggcccagcttcagcagccaccacctgatgccctgtgacaccctggcccggcggcggctggcccggggccgcccagatggagagggcgccggccggggcggcccccgggcccctgagcccccaggcagcgccagcagcagcagccaggagagcctgcggcccccagctgctgccctggccagccggcccagcaggatggaggccctgcggctgcggctgcggggcacagcagatgacatgctggccgtgcggctgcggcggcccctgagccctgagaccaggagaagaagaagctcctggaggaggcacacagtggtggtgcagagccccctgacagacctgaacttcaatgagtggaaggagctgggcggcggcggccccccagagcctgctggggcccgggcccacagcgacaacaaggacagcggcctgagcagcctggagagcaccaaggcccgggcccccagcagcgctgccagccagcccccagcccctggggacaccggcagcctgcagagccagcccccccggcgctctgctgccagccggctgcaccagtgcctgtag

SEQ ID NO: 167900 - DNA, 1968 bp, Artificial Sequence
  Description of Artificial Sequence: Synthetic coding sequence
atgccagaagatagaaattctgggggctgcccagctggggccctggccagcacccccttcatccccaagaccacctaccgccgcatcaagcgctgcttctccttcaggaagggcatcttcggccagaagctggaggacacagtgcgctatgagaagagatatggcaaccggctggcccccatgctggtggagcagtgtgtggacttcatccggcagaggggcctgaaggaggagggcctcttccggctgcccggccaggccaacctggtgaaggagctgcaggatgcctttgactgtggggagaagcccagctttgacagcaacacagatgtgcacacagtggccagcctgctgaagctgtacctgcgggagctgcctgagcccgtcatcccctatgccaagtatgaggacttcctgagctgtgccaagctgctgagcaaggaggaggaggccggcgtgaaggagctggccaagcaggtgaagagcctgcctgtggtgaactacaacctgctgaagtacatctgccgcttcctggatgaggtgcagagctacagcggcgtgaacaagatgtctgtgcagaacctggccaccgtgtttggccccaacatcctgcggcccaaggtggaggaccccctgaccatcatggagggcaccgtggtggtgcagcagctgatgtctgtgatgatcagcaagcatgactgcctcttccccaaggatgctgagctgcagagcaagccccaggatggagtgagcaacaacaatgagatccagaagaaggccaccatgggccagctgcagaacaaggagaacaacaacaccaaggacagccccagccggcagtgctcctgggacaagtctgagagcccccagaggagctccatgaacaacggcagccccacagccctgagcggcagcaagaccaacagccccaagaacagcgtgcacaagctggatgtgagccgcagcccccccctgatggtgaagaagaacccagccttcaacaagggcagcggcatcgtgaccaacggcagcttcagcagcagcaatgctgagggcctggagaagacccagaccaccccaaatggcagcctgcaggcccggcgcagcagcagcctgaaggtgtctggcaccaagatgggcacccacagcgtgcagaatggcaccgtgaggatgggcatcctgaacagcgacaccctgggcaaccccaccaacgtgaggaacatgtcctggctgcccaacggctacgtgaccctgcgggacaacaagcagaaggagcaggccggggagctgggccagcacaaccggctgagcacctatgacaacgtgcaccagcagttctccatgatgaacctggatgacaagcagagcattgattctgccacctggagcaccagcagctgtgagatcagcctgcctgagaacagcaacagctgccgcagcagcaccaccacctgcccagagcaggacttctttggaggcaactttgaggaccctgtgctggatggccccccccaggatgacctgagccacccccgggactatgagagcaagagtgaccacaggtctgtgggcggccgcagcagccgggccaccagcagcagtgacaacagcgagacctttgtgggcaacagcagcagcaaccacagcgccctgcacagcctggtgagcagcctgaagcaggagatgaccaagcagaagattgaatatgagagccgcatcaagagcctggagcagaggaacctgaccctggagacagagatgatgagcctgcatgatgagctggaccaggagaggaagaagttcaccatgattgagatcaagatgagaaatgctgagcgggccaaggaggatgctgagaagagaaatgacatgctgcagaaggagatggagcagttcttcagcaccttcggggagctgactgtggagcccaggagaacagagcggggcaacaccatctggatccagtag

SEQ ID NO: 167901 - DNA, 1962 bp, Artificial Sequence
  Description of Artificial Sequence: Synthetic coding sequence
atgacagccaaccacgagagctacctgctgatggccagcacccagaatgacatggaggactgggtgaagagcatccggcgggtcatctggggcccctttggaggcggcatcttcggccagaagctggaggacacagtgcgctatgagaagagatatggcaaccggctggcccccatgctggtggagcagtgtgtggacttcatccggcagaggggcctgaaggaggagggcctcttccggctgcccggccaggccaacctggtgaaggagctgcaggatgcctttgactgtggggagaagcccagctttgacagcaacacagatgtgcacacagtggccagcctgctgaagctgtacctgcgggagctgcctgagcccgtcatcccctatgccaagtatgaggacttcctgagctgtgccaagctgctgagcaaggaggaggaggccggcgtgaaggagctggccaagcaggtgaagagcctgcctgtggtgaactacaacctgctgaagtacatctgccgcttcctggatgaggtgcagagctacagcggcgtgaacaagatgtctgtgcagaacctggccaccgtgtttggccccaacatcctgcggcccaaggtggaggaccccctgaccatcatggagggcaccgtggtggtgcagcagctgatgtctgtgatgatcagcaagcatgactgcctcttccccaaggatgctgagctgcagagcaagccccaggatggagtgagcaacaacaatgagatccagaagaaggccaccatgggccagctgcagaacaaggagaacaacaacaccaaggacagccccagccggcagtgctcctgggacaagtctgagagcccccagaggagctccatgaacaacggcagccccacagccctgagcggcagcaagaccaacagccccaagaacagcgtgcacaagctggatgtgagccgcagcccccccctgatggtgaagaagaacccagccttcaacaagggcagcggcatcgtgaccaacggcagcttcagcagcagcaatgctgagggcctggagaagacccagaccaccccaaatggcagcctgcaggcccggcgcagcagcagcctgaaggtgtctggcaccaagatgggcacccacagcgtgcagaatggcaccgtgaggatgggcatcctgaacagcgacaccctgggcaaccccaccaacgtgaggaacatgtcctggctgcccaacggctacgtgaccctgcgggacaacaagcagaaggagcaggccggggagctgggccagcacaaccggctgagcacctatgacaacgtgcaccagcagttctccatgatgaacctggatgacaagcagagcattgattctgccacctggagcaccagcagctgtgagatcagcctgcctgagaacagcaacagctgccgcagcagcaccaccacctgcccagagcaggacttctttggaggcaactttgaggaccctgtgctggatggccccccccaggatgacctgagccacccccgggactatgagagcaagagtgaccacaggtctgtgggcggccgcagcagccgggccaccagcagcagtgacaacagcgagacctttgtgggcaacagcagcagcaaccacagcgccctgcacagcctggtgagcagcctgaagcaggagatgaccaagcagaagattgaatatgagagccgcatcaagagcctggagcagaggaacctgaccctggagacagagatgatgagcctgcatgatgagctggaccaggagaggaagaagttcaccatgattgagatcaagatgagaaatgctgagcgggccaaggaggatgctgagaagagaaatgacatgctgcagaaggagatggagcagttcttcagcaccttcggggagctgactgtggagcccaggagaacagagcggggcaacaccatctggatccagtag

SEQ ID NO: 167902 - DNA, 2247 bp, Artificial Sequence
  Description of Artificial Sequence: Synthetic coding sequence
atggaggagaacaatgacagcacagagaacccccagcagggccagggccggcagaatgccatcaagtgtggctggctgaggaagcagggcggctttgtgaagacctggcacacccgctggtttgtgctgaagggggaccagctgtactacttcaaggatgaagatgagaccaagcccctgggcaccatcttcctgcccggcaacaaggtgtctgagcacccctgcaatgaggagaaccctgggaagttcctgtttgaggtggtgcctggaggagaccgggacaggatgacagccaaccacgagagctacctgctgatggccagcacccagaatgacatggaggactgggtgaagagcatcagaagagtcatctggggcccctttggaggcggcatcttcggccagaagctggaggacacagtgcgctatgagaagagatatggcaaccggctggcccccatgctggtggagcagtgtgtggacttcatccggcagaggggcctgaaggaggagggcctcttccggctgcccggccaggccaacctggtgaaggagctgcaggatgcctttgactgtggggagaagcccagctttgacagcaacacagatgtgcacacagtggccagcctgctgaagctgtacctgcgggagctgcctgagcctgtgatcccctatgccaagtatgaggacttcctgagctgtgccaagctgctgagcaaggaggaggaggccggcgtgaaggagctggccaagcaggtgaagagcctgcctgtggtgaactacaacctgctgaagtacatctgccgcttcctggatgaggtgcagagctacagcggcgtgaacaagatgtctgtgcagaacctggccaccgtgtttggccccaacatcctgcggcccaaggtggaggaccccctgaccatcatggagggcaccgtggtggtgcagcagctgatgtctgtgatgatcagcaagcatgactgcctcttccccaaggatgctgagctgcagagcaagccccaggatggagtgagcaacaacaatgagatccagaagaaggccaccatgggccagctgcagaacaaggagaacaacaacaccaaggacagccccagccggcagtgctcctgggacaagtctgagagcccccagaggagctccatgaacaacggcagccccacagccctgagcggcagcaagaccaacagccccaagaacagcgtgcacaagctggatgtgagccgcagcccccccctgatggtgaagaagaacccagccttcaacaagggcagcggcatcgtgaccaacggcagcttcagcagcagcaatgctgagggcctggagaagacccagaccacccccaacggcagcctgcaggcccggcgcagcagcagcctgaaggtgtctggcaccaagatgggcacccacagcgtgcagaatggaacagtgaggatgggcatcctgaacagcgacaccctgggcaaccccaccaacgtgaggaacatgtcctggctgcccaacggctacgtgaccctgcgggacaacaagcagaaggagcaggccggggagctgggccagcacaaccggctgagcacctatgacaacgtgcaccagcagttctccatgatgaacctggatgacaagcagagcattgacagcgccacctggagcaccagcagctgtgagatcagcctgcctgagaacagcaacagctgccgcagcagcaccaccacctgcccagagcaggacttcttcggcggcaactttgaagatcctgtgctggatggccccccccaggatgacctgagccacccccgggactatgagagcaagagtgaccacaggtctgtgggcggccgcagcagccgggccaccagcagcagtgacaacagcgagacctttgtgggcaacagcagcagcaaccacagcgccctgcacagcctggtgagcagcctgaagcaggagatgaccaagcagaagattgaatatgagagccgcatcaagagcctggagcagaggaacctgaccctggagacagagatgatgagcctgcatgatgagctggaccaggagaggaagaagttcaccatgattgagatcaagatgagaaatgctgagcgggccaaggaggatgctgagaagagaaatgacatgctgcagaaggagatggagcagttcttcagcacctttggagagctgactgtggagcccaggagaacagagcggggcaacaccatctggatccagtag

SEQ ID NO: 167903 - DNA, 741 bp, Artificial Sequence
  Description of Artificial Sequence: Synthetic coding sequence
atggaggagaacaatgacagcacagagaacccccagcagggccagggccggcagaatgccatcaagtgtggctggctgaggaagcagggcggctttgtgaagacctggcacacccgctggtttgtgctgaagggggaccagctgtactacttcaaggatgaagatgagaccaagcccctgggcaccatcttcctgcccggcaacaaggtgtctgagcacccctgcaatgaggagaaccctgggaagttcctgtttgaggtggtgcctggaggagaccgggacaggatgacagccaaccacgagagctacctgctgatggccagcacccagaatgacatggaggactgggtgaagagcatcagaagagtcatctggggcccctttggaggcggcatcttcggccagaagctggaggacacagtgcgctatgagaagagatatggcaaccggctggcccccatgctggtggagcagtgtgtggacttcatccggcagaggggcctgaaggaggagggcctcttccggctgcccggccaggccaacctggtgaaggagctgcaggatgcctttgactgtggggagaagcccagctttgacagcaacacagatgtgcacacagtggccagcctgctgaagctgtacctgcgggagctgcctgagcctgtgatcccctatgccaagtatgaggacttcctgagctgtgccaagctgctgagcaaggaggaggaggccgtgtcctag

SEQ ID NO: 167904 - DNA, 249 bp, Artificial Sequence
  Description of Artificial Sequence: Synthetic coding sequence
atgacagccaaccacgagagctacctgctgatggccagcacccagaatgacatggaggactgggtgaagagcatccggcgggtcatctggggcccctttggaggcggcatcttcggccagaagctggaggacacagtgcgctatgagaagagatatggcaaccggctggcccccatgctggtggagcagtgtgtggacttcatccggcagaggggcctgaaggaggagggcctcttccggctgccctag

SEQ ID NO: 167905 - DNA, 1938 bp, Artificial Sequence
  Description of Artificial Sequence: Synthetic coding sequence
atgagcctgaagctgcccaggaactgggacttcaacctgaaggtggaggccgccaagatcgcccggagccgctctgtgatgaccggggagcagatggccgccttccaccccagcagcacccccaaccccctggagcggcccatcaagatgggctggctgaagaagcagaggagcatcgtgaagaactggcagcagcgctactttgtgctgcgggcccagcagctgtactactacaaggatgaggaggacaccaagccccagggctgcatgtacctgcccggctgcaccatcaaggagatcgccaccaaccctgaggaggccggcaagtttgtgtttgagatcatcccagcctcctgggaccagaacaggatgggccaggacagctatgtgctgatggccagcagccaggccgagatggaggagtgggtgaagttcctgcggcgggtggccggcaccccctgtggggtgtttggccagaggctggatgagaccgtggcctatgagcagaagtttggcccccacctggtgcccatcctggtggagaagtgtgccgagttcatcctggagcacggcagaaatgaggagggcatcttccggctgcccggccaggacaacctggtgaagcagctgagagatgcctttgatgctggggagcggcccagctttgaccgggacacagatgtgcacacagtggccagcctgctgaagctgtacctgcgggacctgcctgagcctgtggtgccctggagccagtatgagggcttcctgctgtgtggccagctgaccaatgctgatgaggccaaggcccagcaggagctgatgaagcagctgagcatcctgccccgggacaactacagcctgctgagctacatctgccgcttcctgcacgagatccagctgaactgtgctgtgaacaagatgtctgtggacaacctggccaccgtcatcggcgtgaacctgatccgcagcaaggtggaggaccctgctgtgatcatgaggggcaccccccagatccagagggtgatgaccatgatgatccgggaccacgaggtgctcttccccaagagcaaggacatccccctgagccccccagcccagaagaatgaccccaagaaggcccctgtggcccggagctctgtgggctgggatgccacagaggacctgcgcatcagcaggacagacagcttcagctccatgaccagtgacagcgacaccaccagccccaccggccagcagcccagtgatgccttccctgaggacagcagcaaggtgccccgggagaagccaggggactggaagatgcagagcaggaagaggacccagaccctgcccaacaggaagtgcttcctgaccagcgccttccagggcgccaacagcagcaagatggagatcttcaagaatgagttctggagccccagcagcgaggccaaggccggggagggccacaggaggaccatgagccaggacctgcggcagctgagtgacagccagaggaccagcacctatgacaacgtgcccagcctgcccggcagccctggagaggaggccagcgccctgagcagccaggcctgtgacagcaaaggagacaccctggccagccccaacagcgagaccggccctgggaagaagaacagcggggaggaggagattgacagcctgcagaggatggtgcaggagctgaggaaggagattgagacccagaagcagatgtatgaggagcagatcaagaacctggagaaggaaaattatgatgtgtgggccaaggtggtgcggctgaatgaggagctggagaaggagaagaagaagtctgctgccctggagatcagcctgaggaacatggagaggagccgggaggatgtggagaagaggaacaaggccctggaggaggaggtgaaggagtttgtgaagtccatgaaggagcccaagacagaggcctag

SEQ ID NO: 167906 - DNA, 1917 bp, Artificial Sequence
  Description of Artificial Sequence: Synthetic coding sequence
atgagcctgggccagagcgcctgcctcttcctgagcatcgcccggagccgctctgtgatgactggagagcagatggccgccttccaccccagcagcacccccaaccccctggagcggcccatcaagatgggctggctgaagaagcagaggagcatcgtgaagaactggcagcagcgctactttgtgctgcgggcccagcagctgtactactacaaggatgaggaggacaccaagccccagggctgcatgtacctgcccggctgcaccatcaaggagatcgccaccaaccctgaggaggccggcaagtttgtgtttgagatcatcccagcctcctgggaccagaacaggatgggccaggacagctatgtgctgatggccagcagccaggccgagatggaggagtgggtgaagttcctgcggcgggtggccggcaccccctgtggggtgtttggccagaggctggatgaaacagtggcctatgagcagaagtttggcccccacctggtgcccatcctggtggagaagtgtgccgagttcatcctggagcacggcagaaatgaggagggcatcttccggctgcccggccaggacaacctggtgaagcagctgagagatgcctttgatgctggggagcggcccagctttgaccgggacacagatgtgcacacagtggccagcctgctgaagctgtacctgcgggacctgcctgagcctgtggtgccctggagccagtatgagggcttcctgctgtgtggccagctgaccaatgctgatgaggccaaggcccagcaggagctgatgaagcagctgagcatcctgccccgggacaactacagcctgctgagctacatctgccgcttcctgcacgagatccagctgaactgtgctgtgaacaagatgtctgtggacaacctggccaccgtgattggagtgaacctgatccgcagcaaggtggaggaccctgctgtgatcatgaggggcaccccccagatccagagggtgatgaccatgatgatccgggaccacgaggtgctcttccccaagagcaaggacatccccctgagccccccagcccagaagaatgaccccaagaaggcccctgtggcccggagctctgtgggctgggatgccacagaggacctgcgcatcagcaggacagacagcttcagctccatgaccagtgacagcgacaccaccagccccaccggccagcagcccagtgatgccttccctgaggacagcagcaaggtgccccgggagaagccaggggactggaagatgcagagcaggaagaggacccagaccctgcccaacaggaagtgcttcctgaccagcgccttccagggcgccaacagcagcaagatggagatcttcaagaatgagttctggagccccagcagcgaggccaaggccggggagggccacaggaggaccatgagccaggacctgcggcagctgagtgacagccagaggaccagcacctatgacaacgtgcccagcctgcccggcagccctggagaggaggccagcgccctgagcagccaggcctgtgacagcaagggggacaccctggccagccccaacagcgagactggacctgggaagaagaacagcggggaggaggagattgacagcctgcagaggatggtgcaggagctgaggaaggagattgagacccagaagcagatgtatgaggagcagatcaagaacctggagaaggagaactatgatgtgtgggccaaggtggtgcggctgaatgaggagctggagaaggagaagaagaagtctgctgccctggagatcagcctgaggaacatggagaggagcagagaagatgtggagaagaggaacaaggccctggaggaggaggtgaaggagtttgtgaagtccatgaaggagcccaagacagaggcctag

SEQ ID NO: 167907 - DNA, 1941 bp, Artificial Sequence
  Description of Artificial Sequence: Synthetic coding sequence
atgagcctgaagctgcccaggaactgggacttcaacctgaaggtggaggccgccaagatcgcccggagccgctctgtgatgaccggggagcagatggccgccttccaccccagcagcacccccaaccccctggagcggcccatcaagatgggctggctgaagaagcagaggagcatcgtgaagaactggcagcagcgctactttgtgctgcgggcccagcagctgtactactacaaggatgaggaggacaccaagccccagggctgcatgtacctgcccggctgcaccatcaaggagatcgccaccaaccctgaggaggccggcaagtttgtgtttgagatcatcccagcctcctgggaccagaacaggatgggccaggacagctatgtgctgatggccagcagccaggccgagatggaggagtgggtgaagttcctgcggcgggtggccggcaccccctgtggggctgtgtttggccagaggctggatgaaacagtggcctatgagcagaagtttggcccccacctggtgcccatcctggtggagaagtgtgccgagttcatcctggagcacggcagaaatgaggagggcatcttccggctgcccggccaggacaacctggtgaagcagctgagagatgcctttgatgctggggagcggcccagctttgaccgggacacagatgtgcacacagtggccagcctgctgaagctgtacctgcgggacctgcctgagcctgtggtgccctggagccagtatgagggcttcctgctgtgtggccagctgaccaatgctgatgaggccaaggcccagcaggagctgatgaagcagctgagcatcctgccccgggacaactacagcctgctgagctacatctgccgcttcctgcacgagatccagctgaactgtgctgtgaacaagatgtctgtggacaacctggccaccgtgattggagtgaacctgatccgcagcaaggtggaggaccctgctgtgatcatgaggggcaccccccagatccagagggtgatgaccatgatgatccgggaccacgaggtgctcttccccaagagcaaggacatccccctgagccccccagcccagaagaatgaccccaagaaggcccctgtggcccggagctctgtgggctgggatgccacagaggacctgcgcatcagcaggacagacagcttcagctccatgaccagtgacagcgacaccaccagccccaccggccagcagcccagtgatgccttccctgaggacagcagcaaggtgccccgggagaagccaggggactggaagatgcagagcaggaagaggacccagaccctgcccaacaggaagtgcttcctgaccagcgccttccagggcgccaacagcagcaagatggagatcttcaagaatgagttctggagccccagcagcgaggccaaggccggggagggccacaggaggaccatgagccaggacctgcggcagctgagtgacagccagaggaccagcacctatgacaacgtgcccagcctgcccggcagccctggagaggaggccagcgccctgagcagccaggcctgtgacagcaagggggacaccctggccagccccaacagcgagactggacctgggaagaagaacagcggggaggaggagattgacagcctgcagaggatggtgcaggagctgaggaaggagattgagacccagaagcagatgtatgaggagcagatcaagaacctggagaaggagaactatgatgtgtgggccaaggtggtgcggctgaatgaggagctggagaaggagaagaagaagtctgctgccctggagatcagcctgaggaacatggagaggagcagagaagatgtggagaagaggaacaaggccctggaggaggaggtgaaggagtttgtgaagtccatgaaggagcccaagacagaggcctag

SEQ ID NO: 167908 - DNA, 1920 bp, Artificial Sequence
  Description of Artificial Sequence: Synthetic coding sequence
atgagcctgggccagagcgcctgcctcttcctgagcatcgcccggagccgctctgtgatgactggagagcagatggccgccttccaccccagcagcacccccaaccccctggagcggcccatcaagatgggctggctgaagaagcagaggagcatcgtgaagaactggcagcagcgctactttgtgctgcgggcccagcagctgtactactacaaggatgaggaggacaccaagccccagggctgcatgtacctgcccggctgcaccatcaaggagatcgccaccaaccctgaggaggccggcaagtttgtgtttgagatcatcccagcctcctgggaccagaacaggatgggccaggacagctatgtgctgatggccagcagccaggccgagatggaggagtgggtgaagttcctgcggcgggtggccggcaccccctgtggggctgtgtttggccagaggctggatgagaccgtggcctatgagcagaagtttggcccccacctggtgcccatcctggtggagaagtgtgccgagttcatcctggagcacggcagaaatgaggagggcatcttccggctgcccggccaggacaacctggtgaagcagctgagagatgcctttgatgctggggagcggcccagctttgaccgggacacagatgtgcacacagtggccagcctgctgaagctgtacctgcgggacctgcctgagcctgtggtgccctggagccagtatgagggcttcctgctgtgtggccagctgaccaatgctgatgaggccaaggcccagcaggagctgatgaagcagctgagcatcctgccccgggacaactacagcctgctgagctacatctgccgcttcctgcacgagatccagctgaactgtgctgtgaacaagatgtctgtggacaacctggccaccgtcatcggcgtgaacctgatccgcagcaaggtggaggaccctgctgtgatcatgaggggcaccccccagatccagagggtgatgaccatgatgatccgggaccacgaggtgctcttccccaagagcaaggacatccccctgagccccccagcccagaagaatgaccccaagaaggcccctgtggcccggagctctgtgggctgggatgccacagaggacctgcgcatcagcaggacagacagcttcagctccatgaccagtgacagcgacaccaccagccccaccggccagcagcccagtgatgccttccctgaggacagcagcaaggtgccccgggagaagccaggggactggaagatgcagagcaggaagaggacccagaccctgcccaacaggaagtgcttcctgaccagcgccttccagggcgccaacagcagcaagatggagatcttcaagaatgagttctggagccccagcagcgaggccaaggccggggagggccacaggaggaccatgagccaggacctgcggcagctgagtgacagccagaggaccagcacctatgacaacgtgcccagcctgcccggcagccctggagaggaggccagcgccctgagcagccaggcctgtgacagcaaaggagacaccctggccagccccaacagcgagaccggccctgggaagaagaacagcggggaggaggagattgacagcctgcagaggatggtgcaggagctgaggaaggagattgagacccagaagcagatgtatgaggagcagatcaagaacctggagaaggaaaattatgatgtgtgggccaaggtggtgcggctgaatgaggagctggagaaggagaagaagaagtctgctgccctggagatcagcctgaggaacatggagaggagccgggaggatgtggagaagaggaacaaggccctggaggaggaggtgaaggagtttgtgaagtccatgaaggagcccaagacagaggcctag

SEQ ID NO: 167909 - DNA, 852 bp, Artificial Sequence
  Description of Artificial Sequence: Synthetic coding sequence
atgaccggggagcagatggccgccttccaccccagcagcacccccaaccccctggagcggcccatcaagatgggctggctgaagaagcagaggagcatcgtgaagaactggcagcagcgctactttgtgctgcgggcccagcagctgtactactacaaggatgaggaggacaccaagccccagggctgcatgtacctgcccggctgcaccatcaaggagatcgccaccaaccctgaggaggccggcaagtttgtgtttgagatcatcccagcctcctgggaccagaacaggatgggccaggacagctatgtgctgatggccagcagccaggccgagatggaggagtgggtgaagttcctgcggcgggtggccggcaccccctgtggggctgtgtttggccagaggctggatgaaacagtggcctatgagcagaagtttggcccccacctggtgcccatcctggtggagaagtgtgccgagttcatcctggagcacggcagaaatgaggagggcatcttccggctgcccggccaggacaacctggtgaagcagctgagagatgcctttgatgctggggagcggcccagctttgaccgggacacagatgtgcacacagtggccagcctgctgaagctgtacctgcgggacctgcctgagcctgtggtgccctggagccagtatgagggcttcctgctgtgtggccagctgaccaatgctgatgaggccaagaactacagaaacagaaatgactgccagagcgtggtgtctgcccagatccaccagttctgcccccgggtgtccctgctggcccacggccaggcccacctgctggtgaatgacctgctggtgtag

SEQ ID NO: 167910 - DNA, 1776 bp, Artificial Sequence
  Description of Artificial Sequence: Synthetic coding sequence
atgagcctgggccagagcgcctgcctcttcctgagcatcgcccggagccgctctgtgatgactggagagcagatggccgccttccaccccagcagcacccccaaccccctggagcggcccatcaagatgggctggctgaagaagcagaggagcatcgtgaagaactggcagcagcgctactttgtgctgcgggcccagcagctgtactactacaaggatgaggaggacaccaagccccagggctgcatgtacctgcccggctgcaccatcaaggagatcgccaccaaccctgaggaggccggcaagtttgtgtttgagatcatcccagcctcctgggaccagaacaggatgggccaggacagctatgtgctgatggccagcagccaggccgagatggaggagtgggtgaagttcctgcggcgggtggccggcaccccctgtggggctgtgtttggccagaggctggatgagaccgtggcctatgagcagaagtttggcccccacctggtgcccatcctggtggagaagtgtgccgagttcatcctggagcacggcagaaatgaggagggcatcttccggctgcccggccaggacaacctggtgaagcagctgagagatgcctttgatgctggggagcggcccagctttgaccgggacacagatgtgcacacagtggccagcctgctgaagctgtacctgcgggacctgcctgagcctgtggtgccctggagccagtatgagggcttcctgctgtgtggccagctgaccaatgctgatgaggccaaggcccagcaggagctgatgaagcagctgagcatcctgccccgggacaactacagcctgctgagctacatctgccgcttcctgcacgagatccagctgaactgtgctgtgaacaagatgtctgtggacaacctggccaccgtcatcggcgtgaacctgatccgcagcaaggtggaggaccctgctgtgatcatgaggggcaccccccagatccagagggtgatgaccatgatgatccgggaccacgaggtgctcttccccaagagcaaggacatccccctgagccccccagcccagaagaatgaccccaagaaggcccctgtggcccggagctctgtgggctgggatgccacagaggacctgcgcatcagcaggacagacagcttcagctccatgaccagtgacagcgacaccaccagccccaccggccagcagcccagtgatgccttccctgaggacagcagcaaggtgccccgggagaagccaggggactggaagatgcagagcaggaagaggacccagaccctgcccaacaggaagtgcttcctgaccagcgccttccagggcgccaacagcagcaagatggagatcttcaagaatgagttctggagccccagcagcgaggccaaggccggggagggccacaggaggaccatgagccaggacctgcggcagctgagtgacagccagaggaccagcacctatgacaacgtgcccagcctgcccggcagccctggagaggaggccagcgccctgagcagccaggcctgtgacagcaaaggagacaccctggccagccccaacagcgagaccggccctgggaagaagaacagcggggaggaggagattgacagcctgcagaggatggtgcaggagctgaggaaggagattgagacccagaagcagatgtatgaggagcagatcaagaacctggagaaggaaaattatgatgtgtgggccaaggtggtgcggcccttcctgagcgccatctag

SEQ ID NO: 167911 - DNA, 1377 bp, Artificial Sequence
  Description of Artificial Sequence: Synthetic coding sequence
atgagcctgggccagagcgcctgcctcttcctgagcatcgcccggagccgctctgtgatgactggagagcagatggccgccttccaccccagcagcacccccaaccccctggagcggcccatcaagatgggctggctgaagaagcagaggagcatcgtgaagaactggcagcagcgctactttgtgctgcgggcccagcagctgtactactacaaggatgaggaggacaccaagccccagggctgcatgtacctgcccggctgcaccatcaaggagatcgccaccaaccctgaggaggccggcaagtttgtgtttgagatcatcccagcctcctgggaccagaacaggatgggccaggacagctatgtgctgatggccagcagccaggccgagatggaggagtgggtgaagttcctgcggcgggtggccggcaccccctgtggggctgtgtttggccagaggctggatgagaccgtggcctatgagcagaagtttggcccccacctggtgcccatcctggtggagaagtgtgccgagttcatcctggagcacggcagaaatgaggagggcatcttccggctgcccggccaggacaacctggtgaagcagctgagagatgcctttgatgctggggagcggcccagctttgaccgggacacagatgtgcacacagtggccagcctgctgaagctgtacctgcgggacctgcctgagcctgtggtgccctggagccagtatgagggcttcctgctgtgtggccagctgaccaatgctgatgaggccaaggcccagcaggagctgatgaagcagctgagcatcctgccccgggacaactacagcctgctgagctacatctgccgcttcctgcacgagatccagctgaactgtgctgtgaacaagatgtctgtggacaacctggccaccgtcatcggcgtgaacctgatccgcagcaaggtggaggaccctgctgtgatcatgaggggcaccccccagatccagagggtgatgaccatgatgatccgggaccacgaggtgctcttccccaagagcaaggacatccccctgagccccccagcccagaagaatgaccccaagaaggcccctgtggcccggagctctgtgggctgggatgccacagaggacctgcgcatcagcaggacagacagcttcagctccatggtgcgctgccgggagcccagctgcttccactgggtgctgcccctggtgcaggccatcccctgcaaggcctgcagccgggtggccatctggggcgtgctgggagatgctgtggccgtgggcgctgctgccacagacagcagcgagcacaccctgaaggcctggcccctgagcaagagcagcttctactggcacctgtag

SEQ ID NO: 167912 - DNA, 1893 bp, Artificial Sequence
  Description of Artificial Sequence: Synthetic coding sequence
atgagcctgggccagagcgcctgcctcttcctgagcatcgcccggagccgctctgtgatgactggagagcagatggccgccttccaccccagcagcacccccaaccccctggagcggcccatcaagatgggctggctgaagaagcagaggagcatcgtgaagaactggcagcagagctactactacaaggatgaggaggacaccaagccccagggctgcatgtacctgcccggctgcaccatcaaggagatcgccaccaaccctgaggaggccggcaagtttgtgtttgagatcatcccagcctcctgggaccagaacaggatgggccaggacagctatgtgctgatggccagcagccaggccgagatggaggagtgggtgaagttcctgcggcgggtggccggcaccccctgtggggctgtgtttggccagaggctggatgaaacagtggcctatgagcagaagtttggcccccacctggtgcccatcctggtggagaagtgtgccgagttcatcctggagcacggcagaaatgaggagggcatcttccggctgcccggccaggacaacctggtgaagcagctgagagatgcctttgatgctggggagcggcccagctttgaccgggacacagatgtgcacacagtggccagcctgctgaagctgtacctgcgggacctgcctgagcctgtggtgccctggagccagtatgagggcttcctgctgtgtggccagctgaccaatgctgatgaggccaaggcccagcaggagctgatgaagcagctgagcatcctgccccgggacaactacagcctgctgagctacatctgccgcttcctgcacgagatccagctgaactgtgctgtgaacaagatgtctgtggacaacctggccaccgtgattggagtgaacctgatccgcagcaaggtggaggaccctgctgtgatcatgaggggcaccccccagatccagagggtgatgaccatgatgatccgggaccacgaggtgctcttccccaagagcaaggacatccccctgagccccccagcccagaagaatgaccccaagaaggcccctgtggcccggagctctgtgggctgggatgccacagaggacctgcgcatcagcaggacagacagcttcagctccatgaccagtgacagcgacaccaccagccccaccggccagcagcccagtgatgccttccctgaggacagcagcaaggtgccccgggagaagccaggggactggaagatgcagagcaggaagaggacccagaccctgcccaacaggaagtgcttcctgaccagcgccttccagggcgccaacagcagcaagatggagatcttcaagaatgagttctggagccccagcagcgaggccaaggccggggagggccacaggaggaccatgagccaggacctgcggcagctgagtgacagccagaggaccagcacctatgacaacgtgcccagcctgcccggcagccctggagaggaggccagcgccctgagcagccaggcctgtgacagcaagggggacaccctggccagccccaacagcgagactggacctgggaagaagaacagcggggaggaggagattgacagcctgcagaggatggtgcaggagctgaggaaggagattgagacccagaagcagatgtatgaggagcagatcaagaacctggagaaggagaactatgatgtgtgggccaaggtggtgcggctgaatgaggagctggagaaggagaagaagaagtctgctgccctggagatcagcctgaggaacatggagaggagcagagaagatgtggagaagaggaacaaggccctggaggaggaggtgaaggagtttgtgaagtccatgaaggagcccaagacagaggcctag

SEQ ID NO: 167913 - DNA, 852 bp, Artificial Sequence; identical to SEQ ID NO: 167909
  Description of Artificial Sequence: Synthetic coding sequence

SEQ ID NO: 167914 - DNA, 1821 bp, Artificial Sequence
  Description of Artificial Sequence: Synthetic coding sequence
atgagcctgaagctgcccaggaactgggacttcaacctgaaggtggaggccgccaagatcgcccggagccgctctgtgatgaccggggagcagatggccgccttccaccccagcagcacccccaaccccctggagcggcccatcaagatgggctggctgaagaagcagaggagcatcgtgaagaactggcagcagcgctactttgtgctgcgggcccagcagctgtactactacaaggatgaggaggacaccaagccccagggctgcatgtacctgcccggctgcaccatcaaggagatcgccaccaaccctgaggaggccggcaagtttgtgtttgagatcatccctgtgtttggccagaggctggatgaaacagtggcctatgagcagaagtttggcccccacctggtgcccatcctggtggagaagtgtgccgagttcatcctggagcacggcagaaatgaggagggcatcttccggctgcccggccaggacaacctggtgaagcagctgagagatgcctttgatgctggggagcggcccagctttgaccgggacacagatgtgcacacagtggccagcctgctgaagctgtacctgcgggacctgcctgagcctgtggtgccctggagccagtatgagggcttcctgctgtgtggccagctgaccaatgctgatgaggccaaggcccagcaggagctgatgaagcagctgagcatcctgccccgggacaactacagcctgctgagctacatctgccgcttcctgcacgagatccagctgaactgtgctgtgaacaagatgtctgtggacaacctggccaccgtgattggagtgaacctgatccgcagcaaggtggaggaccctgctgtgatcatgaggggcaccccccagatccagagggtgatgaccatgatgatccgggaccacgaggtgctcttccccaagagcaaggacatccccctgagccccccagcccagaagaatgaccccaagaaggcccctgtggcccggagctctgtgggctgggatgccacagaggacctgcgcatcagcaggacagacagcttcagctccatgaccagtgacagcgacaccaccagccccaccggccagcagcccagtgatgccttccctgaggacagcagcaaggtgccccgggagaagccaggggactggaagatgcagagcaggaagaggacccagaccctgcccaacaggaagtgcttcctgaccagcgccttccagggcgccaacagcagcaagatggagatcttcaagaatgagttctggagccccagcagcgaggccaaggccggggagggccacaggaggaccatgagccaggacctgcggcagctgagtgacagccagaggaccagcacctatgacaacgtgcccagcctgcccggcagccctggagaggaggccagcgccctgagcagccaggcctgtgacagcaagggggacaccctggccagccccaacagcgagactggacctgggaagaagaacagcggggaggaggagattgacagcctgcagaggatggtgcaggagctgaggaaggagattgagacccagaagcagatgtatgaggagcagatcaagaacctggagaaggagaactatgatgtgtgggccaaggtggtgcggctgaatgaggagctggagaaggagaagaagaagtctgctgccctggagatcagcctgaggaacatggagaggagcagagaagatgtggagaagaggaacaaggccctggaggaggaggtgaaggagtttgtgaagtccatgaaggagcccaagacagaggcctag

SEQ ID NO: 167915 - DNA, 2445 bp, Artificial Sequence
  Description of Artificial Sequence: Synthetic coding sequence
atgggcctgcctgccctggagttcagtgactgctgcctggacagcccccacttccgggagaccctgaagagccatgaagctgagctggacaagaccaacaagttcatcaaggagctgatcaaggatggcaagagcctcatcagcgccctgaagaacctgagcagcgccaagaggaagtttgctgacagcctgaatgagttcaagttccagtgcattggagatgctgagacagatgatgagatgtgcatcgcccggagcctgcaggagtttgccaccgtgctgaggaacctggaggatgagcgcatccgcatgattgaaaatgccagcgaggtgctgatcacccccctggagaagttcaggaaggagcagatcggggccgccaaggaggccaagaagaagtatgacaaggagacagagaagtactgcggcatcctggagaagcacctgaacctgagcagcaagaagaaggagagccagctgcaggaggccgacagccaggtggacctggtgcggcagcacttctatgaggtgtccctggagtatgtgttcaaggtgcaggaggtgcaggagaggaagatgtttgaatttgtggagcccctgctggccttcctgcagggcctcttcaccttctaccaccacggctatgagctggccaaggactttggagacttcaagacccagctgaccatcagcatccagaacaccaggaacagatttgagggcaccaggtctgaggtggagagcctgatgaagaagatgaaggagaaccccctggagcacaagaccatcagcccctacaccatggagggctacctgtatgtgcaggagaagaggcacttcggcacctcctgggtgaagcactactgcacctaccagagggacagcaagcagatcaccatggtgccctttgaccagaagagcggcggcaaaggaggagaagatgagagcgtcatcctgaagagctgcaccaggaggaagacagacagcattgagaagcgcttctgctttgatgtggaggccgtggacaggcctggggtcatcaccatgcaggccctgtctgaagaagatagaaggctgtggatggaggccatggatggccgggagcctgtgtacaacagcaacaaggacagccagagcgagggcacagcccagctggacagcatcggcttcagcatcatcaggaagtgcatccatgctgtggagacccggggcatcaatgagcagggcctgtacagaattgtgggcgtgaacagccgggtgcagaagctgctgtctgtgctgatggaccccaagacagccagcgagacagaaacagacatctgtgccgagtgggagatcaagaccatcaccagcgccctgaagacctacctgaggatgctgcccggccccctgatgatgtaccagttccagaggagcttcatcaaggccgccaagctggagaaccaggagagccgggtgtctgagatccacagcctggtgcaccggctgcctgagaagaaccggcagatgctgcagctgctgatgaaccacctggccaacgtggccaacaaccacaagcagaacctgatgacagtggccaacctgggcgtggtgtttggccccaccctgctgcggccccaggaggagaccgtggccgccatcatggacatcaagttccagaacatcgtgattgagatcctgattgagaaccacgagaagatcttcaacacagtgcctgacatgcccctgaccaatgcccagctgcacctgagcaggaagaagagcagtgacagcaagccacccagctgcagcgagcggcccctgaccctcttccacacagtgcagagcacagagaagcaggagcagaggaacagcatcatcaacagcagcctggagagcgtgagcagcaaccccaacagcatcctgaacagcagcagcagcctgcagcccaacatgaacagcagtgaccctgacctggccgtggtgaagcccacccggcccaacagcctgccccccaaccccagccccaccagccccctgagccccagctggcccatgttttctgcccccagcagccccatgcccaccagcagcaccagcagtgacagcagccctgtgcgctctgtggccggctttgtgtggttctctgtggccgctgtggtgctgagcctggcccggagcagcctgcatgctgtgttcagcctgctggtgaactttgtgccctgccaccccaacctgcacctgctgtttgacaggcctgaggaggccgtgcatgaggacagcagcacccccttcaggaaggccaaggccctgtatgcctgcaaggccgagcatgattctgagctgtccttcaccgctggcaccgtgtttgacaacgtgcaccccagccaggagcccggctggctggagggcaccctgaatggcaagacaggcctcatccctgagaactacgtggagttcctgtag

SEQ ID NO: 167916 - DNA, 2280 bp, Artificial Sequence
  Description of Artificial Sequence: Synthetic coding sequence
atgggcctgcctgccctggagttcagtgactgctgcctggacagcccccacttccgggagaccctgaagagccatgaagctgagctggacaagaccaacaagttcatcaaggagctgatcaaggatggcaagagcctcatcagcgccctgaagaacctgagcagcgccaagaggaagtttgctgacagcctgaatgagttcaagttccagtgcattggagatgctgagacagatgatgagatgtgcatcgcccggagcctgcaggagtttgccaccgtgctgaggaacctggaggatgagcgcatccgcatgattgaaaatgccagcgaggtgctgatcacccccctggagaagttcaggaaggagcagatcggggccgccaaggaggccaagaagaagtatgacaaggagacagagaagtactgcggcatcctggagaagcacctgaacctgagcagcaagaagaaggagagccagctgcaggaggccgacagccaggtggacctggtgcggcagcacttctatgaggtgtccctggagtatgtgttcaaggtgcaggaggtgcaggagaggaagatgtttgaatttgtggagcccctgctggccttcctgcagggcctcttcaccttctaccaccacggctatgagctggccaaggactttggagacttcaagacccagctgaccatcagcatccagaacaccaggaacagatttgagggcaccaggtctgaggtggagagcctgatgaagaagatgaaggagaaccccctggagcacaagaccatcagcccctacaccatggagggctacctgtatgtgcaggagaagaggcacttcggcacctcctgggtgaagcactactgcacctaccagagggacagcaagcagatcaccatggtgccctttgaccagaagagcggcggcaaaggaggagaagatgagagcgtcatcctgaagagctgcaccaggaggaagacagacagcattgagaagcgcttctgctttgatgtggaggccgtggacaggcctggggtcatcaccatgcaggccctgtctgaagaagatagaaggctgtggatggaggccatggatggccgggagcctgtgtacaacagcaacaaggacagccagagcgagggcacagcccagctggacagcatcggcttcagcatcatcaggaagtgcatccatgctgtggagacccggggcatcaatgagcagggcctgtacagaattgtgggcgtgaacagccgggtgcagaagctgctgtctgtgctgatggaccccaagacagccagcgagacagaaacagacatctgtgccgagtgggagatcaagaccatcaccagcgccctgaagacctacctgaggatgctgcccggccccctgatgatgtaccagttccagaggagcttcatcaaggccgccaagctggagaaccaggagagccgggtgtctgagatccacagcctggtgcaccggctgcctgagaagaaccggcagatgctgcagctgctgatgaaccacctggccaacgtggccaacaaccacaagcagaacctgatgacagtggccaacctgggcgtggtgtttggccccaccctgctgcggccccaggaggagaccgtggccgccatcatggacatcaagttccagaacatcgtgattgagatcctgattgagaaccacgagaagatcttcaacacagtgcctgacatgcccctgaccaatgcccagctgcacctgagcaggaagaagagcagtgacagcaagccacccagctgcagcgagcggcccctgaccctcttccacacagtgcagagcacagagaagcaggagcagaggaacagcatcatcaacagcagcctggagagcgtgagcagcaaccccaacagcatcctgaacagcagcagcagcctgcagcccaacatgaacagcagtgaccctgacctggccgtggtgaagcccacccggcccaacagcctgccccccaaccccagccccaccagccccctgagccccagctggcccatgttttctgcccccagcagccccatgcccaccagcagcaccagcagtgacagcagccctgtgtccacccccttcaggaaggccaaggccctgtatgcctgcaaggccgagcatgacagcgagctgtccttcaccgctggcaccgtgtttgacaacgtgcaccccagccaggagcccggctggctggagggcaccctgaatggcaagacaggcctcatcccagaaaattatgtggagttcctgtag

SEQ ID NO: 167917 - DNA, 885 bp, Artificial Sequence
  Description of Artificial Sequence: Synthetic coding sequence
tgacccaagacagccagcgagacagaaacagacatctgtgccgagtgggagatcaagaccatcaccagcgccctgaagacctacctgaggatgctgcccggccccctgatgatgtaccagttccagaggagcttcatcaaggccgccaagctggagaaccaggagagccgggtgtctgagatccacagcctggtgcaccggctgcctgagaagaaccggcagatgctgcagctgctgatgaaccacctggccaacgtggccaacaaccacaagcagaacctgatgacagtggccaacctgggcgtggtgtttggccccaccctgctgcggccccaggaggagaccgtggccgccatcatggacatcaagttccagaacatcgtgattgagatcctgattgagaaccacgagaagatcttcaacacagtgcctgacatgcccctgaccaatgcccagctgcacctgagcaggaagaagagcagtgacagcaagccacccagctgcagcgagcggcccctgaccctcttccacacagtgcagagcacagagaagcaggagcagaggaacagcatcatcaacagcagcctggagagcgtgagcagcaaccccaacagcatcctgaacagcagcagcagcctgcagcccaacatgaacagcagtgaccctgacctggccgtggtgaagcccacccggcccaacagcctgacccccttcaggaaggccaaggccctgtatgcctgcaaggccgagcatgattctgagctgtccttcaccgctggcaccgtgtttgacaacgtgcaccccagccaggagcccggctggctggagggcaccctgaatggcaagacaggcctcatccctgagaactacgtggagttcctgtag

SEQ ID NO: 167918 - DNA, 861 bp, Artificial Sequence
  Description of Artificial Sequence: Synthetic coding sequence
atggaccccaagacagccagcgagacagaaacagacatctgtgccgagtgggagatcaagaccatcaccagcgccctgaagacctacctgaggatgctgcccggccccctgatgatgtaccagttccagaggagcttcatcaaggccgccaagctggagaaccaggagagccgggtgtctgagatccacagcctggtgcaccggctgcctgagaagaaccggcagatgctgcagctgctgatgaaccacctggccaacgtggccaacaaccacaagcagaacctgatgacagtggccaacctgggcgtggtgtttggccccaccctgctgcggccccaggaggagaccgtggccgccatcatggacatcaagttccagaacatcgtcatcgagatcctgattgaaaatcatgagaagatcttcaacacagtgcctgacatgcccctgaccaatgcccagctgcacctgagcaggaagaagagcagtgacagcaagccacccagctgcagcgagcggcccctgaccctcttccacacagtgcagagcacagagaagcaggagcagagaaattccatcatcaacagcagcctggagagcgtgagcagcaaccccaacagcatcctgaacagcagcagcagcctgcagcccaacatgaacagcagtgaccctgacctggccgtggtgaagcccacccggcccaacagcctgccccccaaccccagccccaccagccccctgagccccagctggcccatgttcagcgcccccagcagccccatgcccaccagcagcaccagcagtgacagcagcccccgcatcacctggagcagcagcaacagaggcccccagcagaactgctag

SEQ ID NO: 167919 - DNA, 1167 bp, Artificial Sequence
  Description of Artificial Sequence: Synthetic coding sequence
tgagcccagctggacagcatcggcttcagcatcatcaggaagtgcatccatgctgtggagacccggggcatcaatgagcagggcctgtaccgcatcgtgggcgtgaacagccgggtgcagaagctgctgtctgtgctgatggaccccaagacagccagcgagacagaaacagacatctgtgccgagtgggagatcaagaccatcaccagcgccctgaagacctacctgaggatgctgcccggccccctgatgatgtaccagttccagaggagcttcatcaaggccgccaagctggagaaccaggagagccgggtgtctgagatccacagcctggtgcaccggctgcctgagaagaaccggcagatgctgcagctgctgatgaaccacctggccaacgtggccaacaaccacaagcagaacctgatgacagtggccaacctgggcgtggtgtttggccccaccctgctgcggccccaggaggagaccgtggccgccatcatggacatcaagttccagaacatcgtcatcgagatcctgattgaaaatcatgagaagatcttcaacacagtgcctgacatgcccctgaccaatgcccagctgcacctgagcaggaagaagagcagtgacagcaagccacccagctgcagcgagcggcccctgaccctcttccacacagtgcagagcacagagaagcaggagcagagaaattccatcatcaacagcagcctggagagcgtgagcagcaaccccaacagcatcctgaacagcagcagcagcctgcagcccaacatgaacagcagtgaccctgacctggccgtggtgaagcccacccggcccaacagcctgccccccaaccccagccccaccagccccctgagccccagctggcccatgttcagcgcccccagcagccccatgcccaccagcagcaccagcagtgacagcagccctgtgcggcctgaggaggccgtgcatgaggacagcagcacccccttcaggaaggccaaggccctgtatgcctgcaaggccgagcatgattctgagctgtccttcaccgctggcaccgtgtttgacaacgtgcaccccagccaggagcccggctggctggagggcaccctgaatggcaagacaggcctcatccctgagaactacgtggagttcctgtag

SEQ ID NO: 167920 - DNA, 792 bp, Artificial Sequence
  Description of Artificial Sequence: Synthetic coding sequence
atggctgctgatgtggtgggagatgtgtatgtgctggtggagcacccctttgagtacaccgggaaggatggaagaagagtggccatccggcccaatgaaagataccgcctgctgcggcgcagcacagagcactggtggcacgtgagaagagagcccggcggccggcccttctacctgcctgcccagtatgtgcgggagctgcctgccctgggcaacccagctgctgctgcccctcctggcccccaccccagccctgctgcccctgagcccctggcctatgactacagatttgtgtctgctgctgccacagctggcccagatggagcccctgaggagagcggcggccgggccagcagcctgtgtggccctgcccagagaggagctgccacccagaggagcagcctggcccctggcctgcctgcctgcctgtacctgcggcctgctgcccctgtgcggcctgcccagagcctgaatgacctggcctgtgccgctgtgtccccacctgctggcctgctgggcagcagcggcagcttcaaggcctgcagcgtggccggctcctgggtgtgcccccggcccctggcccggagtgacagtgaaaatgtgtatgaggtgatccaggacctgcacgtgcccccacctgaggagagcgctgagcaggtgcccccccgggccctgggccggggcggcggctggagggcccgggaccgggccaggacagagcccggcaggaaggagaccaggtctgcccagaggcgggcccggcggccccccctgtctgaggactttggatag

SEQ ID NO: 167921 - DNA, 1647 bp, Artificial Sequence
  Description of Artificial Sequence: Synthetic coding sequence
atgcagcccggcctgagccctggcagccctggggaccccaggcctcccaccccagagacagactacccagagagcctgaccagctacccagaggaggactacagccctgtgggcagctttggagagcccggccccaccagccccctgaccaccccacctggctggagctgccacgtgtcccaggacaagcagatgctgtacaccaaccacttcacccaggagcagtgggtgcggctggaggacccccacggcaagccctacttctacaaccctgaggacagctctgtgcgctgggagctgccccaggtgcctgtgcctgcccccaggagcatccacaagagcagccaggatggagacaccccagcccaggccagccccccagaggagaaggtgcctgctgagctggatgaggtgggctcctgggaggaggtgtccccagccacagctgctgtgaggaccaagaccctggacaaggccggcgtgctgcacaggaccaagacagctgacaagggcaagaggctgaggaagaagcactggagcgcctcctggacagtgctggagggcggcgtgctgaccttcttcaaggacagcaagaccagcgctgctgggggcctgcggcagcccagcaagttcagcaccccagagtacacagtggagctgcggggggccaccctgtcctgggcccccaaggacaagagcagcaggaagaatgtgctggagctgcggagcagagatggcagcgagtacctgatccagcatgattctgaggccatcatcagcacctggcacaaggccatcgcccagggcatccaggagctgtctgctgagctgcccccagaggagagcgagagcagccgggtggactttggcagcagcgagcggctgggctcctggcaggagaaggaggaggatgcccggcccaatgctgctgccccagccctgggccctgtgggcctggagagtgacctgagcaaggtgcgccacaagctgaggaagttcctgcagaggcggcccaccctgcagagcctgcgggagaagggctacatcaaggaccaggtgtttggctgtgccctggccgccctgtgtgagcgggagaggagccgggtgcccaggtttgtgcagcagtgcatccgggctgtggaggcccggggcctggacattgatggcctgtaccgcatcagcggcaacctggccaccatccagaagctgcgctacaaggtggaccatgatgagcggctggacctggatgatggccgctgggaggatgtgcacgtgatcactggagccctgaagctgttcttccgggagctgcctgagcccctcttccccttcagccacttccggcagttcatcgccgccatcaagctgcaggaccaggcccggcgcagccgctgtgtgcgggacctggtgcgcagcctgcctgcccccaaccacgacaccctgaggatgctgttccagcacctgtgcagggtcatcgagcacggggagcagaacaggatgtctgtgcagagcgtggccatcgtgtttggccccaccctgctgcggcctgaggtggaggagacctccatgcccatgaccatggtgttccagaaccaggtggtggagctgatcctgcagcagtgtgccgacatcttccccccccactag

SEQ ID NO: 167922 - DNA, 2670 bp, Artificial Sequence
  Description of Artificial Sequence: Synthetic coding sequence
atggctgctgatgtggtgggagatgtgtatgtgctggtggagcacccctttgagtacaccgggaaggatggaagaagagtggccatccggcccaatgaaagataccgcctgctgcggcgcagcacagagcactggtggcacgtgagaagagagcccggcggccggcccttctacctgcctgcccagtatgtgcgggagctgcctgccctgggcaacccagctgctgctgcccctcctggcccccaccccagccctgctgcccctgagcccctggcctatgactacagatttgtgtctgctgctgccacagctggcccagatggagcccctgaggagagcggcggccgggccagcagcctgtgtggccctgcccagagaggagctgccacccagaggagcagcctggcccctggcctgcctgcctgcctgtacctgcggcctgctgcccctgtgcggcctgcccagagcctgaatgacctggcctgtgccgctgtgtccccacctgctggcctgctgggcagcagcggcagcttcaaggcctgcagcgtggccggctcctgggtgtgcccccggcccctggcccggagtgacagtgaaaatgtgtatgaggtgatccaggacctgcacgtgcccccacctgaggagagcgctgagcaggtggatgatcctcctgagcctgtgtatgccaacatcgagcggcagccccgggccaccagccctggagctgctgctgcccccctgcccagccctgtgtgggagacccacacagatgctggcaccggccggccctactactacaacccagacaccggggtgaccacctgggagagcccctttgaagctgctgagggcgccgccagccctgccaccagccctgcctctgtggacagccacgtgtccctggagacagagtggggccagtactgggatgaggagagccggcgggtcttcttctacaaccccctgactggagaaacagcctgggaggatgaagcagaaaatgaacctgaggaggagctggagatgcagcccggcctgagccctggcagccctggggacccccggccccccaccccagagacagactacccagagagcctgaccagctacccagaggaggactacagccctgtgggcagctttggagagcccggccccaccagccccctgaccaccccacctggctggagctgccacgtgtcccaggacaagcagatgctgtacaccaaccacttcacccaggagcagtgggtgcggctggaggacccccacggcaagccctacttctacaaccctgaggacagctctgtgcgctgggagctgccccaggtgcctgtgcctgcccccaggagcatccacaagagcagccaggatggagacaccccagcccaggccagccccccagaggagaaggtgcctgctgagctggatgaggtgggctcctgggaggaggtgtccccagccacagctgctgtgaggaccaagaccctggacaaggccggcgtgctgcacaggaccaagacagctgacaagggcaagaggctgaggaagaagcactggagcgcctcctggacagtgctggagggcggcgtgctgaccttcttcaaggacagcaagaccagcgctgctgggggcctgcggcagcccagcaagttcagcaccccagagtacacagtggagctgcggggggccaccctgtcctgggcccccaaggacaagagcagcaggaagaatgtgctggagctgcggagcagagatggcagcgagtacctgatccagcacgacagcgaggccatcatcagcacctggcacaaggccatcgcccagggcatccaggagctgtctgctgagctgcccccagaggagagcgagagcagccgggtggactttggcagcagcgagcggctgggctcctggcaggagaaggaggaggatgcccggcccaatgctgctgccccagccctgggccctgtgggcctggagagtgacctgagcaaggtgcgccacaagctgaggaagttcctgcagaggcggcccaccctgcagagcctgcgggagaagggctacatcaaggaccaggtgtttggctgtgccctggccgccctgtgtgagcgggagaggagccgggtgcccaggtttgtgcagcagtgcatccgggctgtggaggcccggggcctggacattgatggcctgtaccgcatcagcggcaacctggccaccatccagaagctgcgctacaaggtggaccatgatgagcggctggacctggatgatggccgctgggaggatgtgcacgtgatcaccggggccctgaagctgttcttccgggagctgcctgagcccctcttccccttcagccacttccggcagttcatcgccgccatcaagctgcaggaccaggcccggcgcagccgctgtgtgcgggacctggtgcgcagcctgcctgcccccaaccacgacaccctgaggatgctgttccagcacctgtgccgggtgattgaacatggagagcagaacaggatgtctgtgcagagcgtggccatcgtgtttggccccaccctgctgcggcctgaggtggaggagacctccatgcccatgaccatggtgttccagaaccaggtggtggagctgatcctgcagcagtgtgccgacatcttccccccccactag

SEQ ID NO: 167923 - DNA, 2589 bp, Artificial Sequence
  Description of Artificial Sequence: Synthetic coding sequence
atggctgctgatgtggtgggagatgtgtatgtgctggtggagcacccctttgagtacaccgggaaggatggaagaagagtggccatccggcccaatgaaagataccgcctgctgcggcgcagcacagagcactggtggcacgtgagaagagagcccggcggccggcccttctacctgcctgcccagtatgtgcgggagctgcctgccctgggcaacccagctgctgctgcccctcctggcccccaccccagccctgctgcccctgagcccctggcctatgactacagatttgtgtctgctgctgccacagctggcccagatggagcccctgaggagagcggcggccgggccagcagcctgtgtggccctgcccagagaggagctgccacccagaggagcagcctggcccctggcctgcctgcctgcctgtacctgcggcctgctgcccctgtgcggcctgcccagagcctgaatgacctggcctgtgccgctgtgtccccacctgctggcctgctgggcagcagcggcagcttcaaggcctgcagcgtggccggctcctgggtgtgcccccggcccctggcccggagtgacagtgaaaatgtgtatgaggtgatccaggacctgcacgtgcccccacctgaggagagcgctgagcaggtggatgatcctcctgagcctgtgtatgccaacatcgagcggcagccccgggccaccagccctggagctgctgctgcccccctgcccagccctgtgtgggagacccacacagatgctggcaccggccggccctactactacaacccagacaccggggtgaccacctgggagagcccctttgaagctgctgagggcgccgccagccctgccaccagccctgcctctgtggacagccacgtgtccctggagacagagtggggccagtactgggatgaggagagccggcgggtcttcttctacaaccccctgactggagaaacagcctgggaggatgaagcagaaaatgaacctgaggaggagctggagatgcagcccggcctgagccctggcagccctggggacccccggccccccaccccagagacagactacccagagagcctgaccagctacccagaggaggactacagccctgtgggcagctttggagagcccggccccaccagccccctgaccaccccacctggctggagctgccacgtgtcccaggacaagcagatgctgtacaccaaccacttcacccaggagcaggtgcctgtgcctgcccccaggagcatccacaagagcagccaggatggagacaccccagcccaggccagccccccagaggagaaggtgcctgctgagctggatgaggtgggctcctgggaggaggtgtccccagccacagctgctgtgaggaccaagaccctggacaaggccggcgtgctgcacaggaccaagacagctgacaagggcaagaggctgaggaagaagcactggagcgcctcctggacagtgctggagggcggcgtgctgaccttcttcaaggacagcaagaccagcgctgctgggggcctgcggcagcccagcaagttcagcaccccagagtacacagtggagctgcggggggccaccctgtcctgggcccccaaggacaagagcagcaggaagaatgtgctggagctgcggagcagagatggcagcgagtacctgatccagcatgattctgaggccatcatcagcacctggcacaaggccatcgcccagggcatccaggagctgtctgctgagctgcccccagaggagagcgagagcagccgggtggactttggcagcagcgagcggctgggctcctggcaggagaaggaggaggatgcccggcccaatgctgctgccccagccctgggccctgtgggcctggagagtgacctgagcaaggtgcgccacaagctgaggaagttcctgcagaggcggcccaccctgcagagcctgcgggagaagggctacatcaaggaccaggtgtttggctgtgccctggccgccctgtgtgagcgggagaggagccgggtgcccaggtttgtgcagcagtgcatccgggctgtggaggcccggggcctggacattgatggcctgtaccgcatcagcggcaacctggccaccatccagaagctgcgctacaaggtggaccatgatgagcggctggacctggatgatggccgctgggaggatgtgcacgtgatcactggagccctgaagctgttcttccgggagctgcctgagcccctcttccccttcagccacttccggcagttcatcgccgccatcaagctgcaggaccaggcccggcgcagccgctgtgtgcgggacctggtgcgcagcctgcctgcccccaaccacgacaccctgaggatgctgttccagcacctgtgcagggtcatcgagcacggggagcagaacaggatgtctgtgcagagcgtggccatcgtgtttggccccaccctgctgcggcctgaggtggaggagacctccatgcccatgaccatggtgttccagaaccaggtggtggagctgatcctgcagcagtgtgccgacatcttccccccccactag

SEQ ID NO: 167924 - DNA, 1647 bp, Artificial Sequence; identical to SEQ ID NO: 167921
  Description of Artificial Sequence: Synthetic coding sequence

SEQ ID NO: 167925 - DNA, 792 bp, Artificial Sequence; identical to SEQ ID NO: 167920
  Description of Artificial Sequence: Synthetic coding sequence

SEQ ID NO: 167926 - DNA, 1566 bp, Artificial Sequence
  Description of Artificial Sequence: Synthetic coding sequence
atgcagcccggcctgagccctggcagccctggggaccccaggcctcccaccccagagacagactacccagagagcctgaccagctacccagaggaggactacagccctgtgggcagctttggagagcccggccccaccagccccctgaccaccccacctggctggagctgccacgtgtcccaggacaagcagatgctgtacaccaaccacttcacccaggagcaggtgcctgtgcctgcccccaggagcatccacaagagcagccaggatggagacaccccagcccaggccagccccccagaggagaaggtgcctgctgagctggatgaggtgggctcctgggaggaggtgtccccagccacagctgctgtgaggaccaagaccctggacaaggccggcgtgctgcacaggaccaagacagctgacaagggcaagaggctgaggaagaagcactggagcgcctcctggacagtgctggagggcggcgtgctgaccttcttcaaggacagcaagaccagcgctgctgggggcctgcggcagcccagcaagttcagcaccccagagtacacagtggagctgcggggggccaccctgtcctgggcccccaaggacaagagcagcaggaagaatgtgctggagctgcggagcagagatggcagcgagtacctgatccagcacgacagcgaggccatcatcagcacctggcacaaggccatcgcccagggcatccaggagctgtctgctgagctgcccccagaggagagcgagagcagccgggtggactttggcagcagcgagcggctgggctcctggcaggagaaggaggaggatgcccggcccaatgctgctgccccagccctgggccctgtgggcctggagagtgacctgagcaaggtgcgccacaagctgaggaagttcctgcagaggcggcccaccctgcagagcctgcgggagaagggctacatcaaggaccaggtgtttggctgtgccctggccgccctgtgtgagcgggagaggagccgggtgcccaggtttgtgcagcagtgcatccgggctgtggaggcccggggcctggacattgatggcctgtaccgcatcagcggcaacctggccaccatccagaagctgcgctacaaggtggaccatgatgagcggctggacctggatgatggccgctgggaggatgtgcacgtgatcaccggggccctgaagctgttcttccgggagctgcctgagcccctcttccccttcagccacttccggcagttcatcgccgccatcaagctgcaggaccaggcccggcgcagccgctgtgtgcgggacctggtgcgcagcctgcctgcccccaaccacgacaccctgaggatgctgttccagcacctgtgccgggtgattgaacatggagagcagaacaggatgtctgtgcagagcgtggccatcgtgtttggccccaccctgctgcggcctgaggtggaggagacctccatgcccatgaccatggtgttccagaaccaggtggtggagctgatcctgcagcagtgtgccgacatcttccccccccactag

SEQ ID NO: 167927 - DNA, 2013 bp, Artificial Sequence
  Description of Artificial Sequence: Synthetic coding sequence
atgctgagcaatgaaagcctgcaccccccagccttcagccgcagcaacagcgaggcctctgtggacagcgcctccatggaggacttctggagagaaattgagagcatcaaggacagctccatgggcggccaggaggagcccccacctgctgaggtgacccctgtggatgaaggagagctggaggccgagtggctgcaggatgtgggcctgagcaccctcatctctggagatgaggaggaggatggcaaggccctgctgagcaccctgaccaggacccaggccgctgctgtgcagaagcgctaccacacctacacccagaccatgaggaagaaggacaagcagagcatcagagatgtgcgggacatctttggagtgtctgagagccccccccgggacacctgtggcaaccacaccaaccagctggatggcaccaaggaggagcgggagctgcccagggtcatcaagaccagcggctccatgccagatgatgccagcctgaacagcaccaccctgagtgatgccagccaggacaaggagggcagctttgctgtgcccaggagtgacagcgtggccatcctggagaccatccctgtgctgcctgtgcacagcaatggcagccctgagcccggccagcctgtgcagaatgccatcagtgatgatgacttcctggagaagaacatccccccagaggccgaggagctgagctttgaggtgtcctacagcgagatggtgacagaggccctgaagaggaacaagctgaagaagtctgagatcaagaaggaggactatgtgctgaccaagttcaacgtgcagaagaccaggtttggcctgacagaggccggggacctgtctgctgaggacatgaagaagatccgccacctgagcctgattgagctgacagccttctttgatgccttcggcatccagctgaagaggaacaagacagagaaggtgaagggccgggacaatggcatcttcggcgtgcccctgactgtgctgctggatggagacaggaagaaggaccccggggtgaaggtgcccctggtgctgcagaagttctttgagaaggtggaggagagcggcctggagagcgagggcatcttccggctgagcggctgcacagccaaggtgaagcagtaccgggaggagctggatgccaagttcaatgctgacaagttcaagtgggacaagatgtgccaccgggaggccgctgtgatgctgaaggccttcttccgggagctgcccaccagcctcttccctgtggagtacatcccagccttcatcagcctgatggagcggggcccccacgtgaaggtgcagttccaggccctgcacctgatggtgatggccctgcctgatgccaacagagatgctgcccaggccctgatgaccttcttcaacaaggtgattgccaatgaaagcaagaacaggatgagcctgtggaacatcagcacagtgatggcccccaacctcttcttcagccgcagcaagcacagcgactatgaggagctgctgctggccaacacagctgcccacatcatccggctgatgctgaagtaccagaagatcctgtggaaggtgcccagcttcctgatcacccaggtgcggaggatgaatgaggccaccatgctgctgaagaagcagctgcccagcgtgaggaagctgctgcggaggaagaccctggagcgggagacagccagccccaagaccagcaaggtgctgcagaagagccccagcgcccggaggatgtctgatgtgcctgagggcgtcatccgggtgcacgcccccctgctgagcaaggtgtccatggccatccagctgaacaaccagaccaaggccaaggacatcctggccaagttccagtatgaaaatcgcatcctgcactggcagagagctgccctgtccttcctgaatggcaagtgggtgaagaaggagcgggaggagagcacagagaccaacagaagccccaagcacgtgttcctgttcaccatcggcctggacatcagcacctag

SEQ ID NO: 167928 - DNA, 1713 bp, Artificial Sequence
  Description of Artificial Sequence: Synthetic coding sequence
atgaggaagaaggacaagcagagcatcagagatgtgcgggacatcttcggcgtgtctgagagccccccccgggacacctgtggcaaccacaccaaccagctggatggcaccaaggaggagcgggagctgcccagggtcatcaagaccagcggctccatgccagatgatgccagcctgaacagcaccaccctgagtgatgccagccaggacaaggagggcagctttgctgtgcccaggagtgacagcgtggccatcctggagaccatccctgtgctgcctgtgcacagcaatggcagccctgagcccggccagcctgtgcagaatgccatcagtgatgatgacttcctggagaagaacatccccccagaggccgaggagctgagctttgaggtgtcctacagcgagatggtgacagaggccctgaagaggaacaagctgaagaagtctgagatcaagaaggaggactatgtgctgaccaagttcaacgtgcagaagacccgcttcggcctgacagaagctggggacctgtctgctgaggacatgaagaagatccgccacctgagcctcatcgagctgacagccttctttgatgccttcggcatccagctgaagaggaacaagacagagaaggtgaagggccgggacaatggcatctttggagtgcccctgactgtgctgctggatggagacaggaagaaggaccccggggtgaaggtgcccctggtgctgcagaagttctttgagaaggtggaggagagcggcctggagagcgagggcatcttccggctgagcggctgcacagccaaggtgaagcagtaccgggaggagctggatgccaagttcaatgctgacaagttcaagtgggacaagatgtgccaccgggaggccgctgtgatgctgaaggccttcttccgggagctgcccaccagcctcttccctgtggagtacatcccagccttcatcagcctgatggagcggggcccccacgtgaaggtgcagttccaggccctgcacctgatggtgatggccctgcctgatgccaacagagatgctgcccaggccctgatgaccttcttcaacaaggtgattgccaatgaaagcaagaacaggatgagcctgtggaacatcagcacagtgatggcccccaacctcttcttcagccgcagcaagcacagcgactatgaggagctgctgctggccaacacagctgcccacatcatccggctgatgctgaagtaccagaagatcctgtggaaggtgcccagcttcctgatcacccaggtgcggaggatgaatgaggccaccatgctgctgaagaagcagctgcccagcgtgaggaagctgctgcggaggaagaccctggagcgggagacagccagccccaagaccagcaaggtgctgcagaagagccccagcgcccggaggatgtctgatgtgcctgagggcgtcatccgggtgcacgcccccctgctgagcaaggtgtccatggccatccagctgaacaaccagaccaaggccaaggacatcctggccaagttccagtatgagaacagccacggcagcagcgagtgcatcaagatccagaaccagaggctgtatgaaattggaggcaacattggagagcactgcctggaccctgatgcctacatcctggatgtgtaccgcatcaacccccaggccgagtgggtgatcaagccccagcagagcagctag

SEQ ID NO: 167929 - DNA, 1638 bp, Artificial Sequence
  Description of Artificial Sequence: Synthetic coding sequence
atgaatgagctgccccgggacacctgtggcaaccacaccaaccagctggatggcaccaaggaggagcgggagctgcccagggtcatcaagaccagcggctccatgccagatgatgccagcctgaacagcaccaccctgagtgatgccagccaggacaaggagggcagctttgctgtgcccaggagtgacagcgtggccatcctggagaccatccctgtgctgcctgtgcacagcaatggcagccctgagcccggccagcctgtgcagaatgccatcagtgatgatgacttcctggagaagaacatccccccagaggccgaggagctgagctttgaggtgtcctacagcgagatggtgacagaggccctgaagaggaacaagctgaagaagtctgagatcaagaaggaggactatgtgctgaccaagttcaacgtgcagaagacccgcttcggcctgacagaagctggggacctgtctgctgaggacatgaagaagatccgccacctgagcctcatcgagctgacagccttctttgatgccttcggcatccagctgaagaggaacaagacagagaaggtgaagggccgggacaatggcatctttggagtgcccctgactgtgctgctggatggagacaggaagaaggaccccggggtgaaggtgcccctggtgctgcagaagttctttgagaaggtggaggagagcggcctggagagcgagggcatcttccggctgagcggctgcacagccaaggtgaagcagtaccgggaggagctggatgccaagttcaatgctgacaagttcaagtgggacaagatgtgccaccgggaggccgctgtgatgctgaaggccttcttccgggagctgcccaccagcctcttccctgtggagtacatcccagccttcatcagcctgatggagcggggcccccacgtgaaggtgcagttccaggccctgcacctgatggtgatggccctgcctgatgccaacagagatgctgcccaggccctgatgaccttcttcaacaaggtgattgccaatgaaagcaagaacaggatgagcctgtggaacatcagcacagtgatggcccccaacctcttcttcagccgcagcaagcacagcgactatgaggagctgctgctggccaacacagctgcccacatcatccggctgatgctgaagtaccagaagatcctgtggaaggtgcccagcttcctgatcacccaggtgcggaggatgaatgaggccaccatgctgctgaagaagcagctgcccagcgtgaggaagctgctgcggaggaagaccctggagcgggagacagccagccccaagaccagcaaggtgctgcagaagagccccagcgcccggaggatgtctgatgtgcctgagggcgtcatccgggtgcacgcccccctgctgagcaaggtgtccatggccatccagctgaacaaccagaccaaggccaaggacatcctggccaagttccagtatgagaaccgcatcctgcactggcagagagctgccctgtccttcctgaatggcaagtgggtgaagaaggagcgggaggagagcacagagaccaacagaagccccaagcacgtgttcctgttcaccatcggcctggacatcagcacctag

SEQ ID NO: 167930 - DNA, 2169 bp, Artificial Sequence
  Description of Artificial Sequence: Synthetic coding sequence
atggaggtggaggacagcggcggcgtggtgctgacagcctaccacagctatgcccgggcccagcccccaaatgctgagagccgctgtgcccccagggctgctgccagccaccccctgagcaggaagagcatcccccgctgccgccgcatcaacaggatgctgagcaatgaaagcctgcaccccccagccttcagccgcagcaacagcgaggcctctgtggacagcgcctccatggaggacttctggagagaaattgagagcatcaaggacagctccatgggcggccaggaggagcccccacctgctgaggtgacccctgtggatgaaggagagctggaggccgagtggctgcaggatgtgggcctgagcaccctcatctctggagatgaggaggaggatggcaaggccctgctgagcaccctgaccaggacccaggccgctgctgtgcagaagcgctaccacacctacacccagaccatgaggaagaaggacaagcagagcatcagagatgtgcgggacatctttggagtgtctgagagccccccccgggacacctgtggcaaccacaccaaccagctggatggcaccaaggaggagcgggagctgcccagggtcatcaagaccagcggctccatgccagatgatgccagcctgaacagcaccaccctgagtgatgccagccaggacaaggagggcagctttgctgtgcccaggagtgacagcgtggccatcctggagaccatccctgtgctgcctgtgcacagcaatggcagccctgagcccggccagcctgtgcagaatgccatcagtgatgatgacttcctggagaagaacatccccccagaggccgaggagctgagctttgaggtgtcctacagcgagatggtgacagaggccctgaagaggaacaagctgaagaagtctgagatcaagaaggaggactatgtgctgaccaagttcaacgtgcagaagaccaggtttggcctgacagaggccggggacctgtctgctgaggacatgaagaagatccgccacctgagcctgattgagctgacagccttctttgatgccttcggcatccagctgaagaggaacaagacagagaaggtgaagggccgggacaatggcatcttcggcgtgcccctgactgtgctgctggatggagacaggaagaaggaccccggggtgaaggtgcccctggtgctgcagaagttctttgagaaggtggaggagagcggcctggagagcgagggcatcttccggctgagcggctgcacagccaaggtgaagcagtaccgggaggagctggatgccaagttcaatgctgacaagttcaagtgggacaagatgtgccaccgggaggccgctgtgatgctgaaggccttcttccgggagctgcccaccagcctcttccctgtggagtacatcccagccttcatcagcctgatggagcggggcccccacgtgaaggtgcagttccaggccctgcacctgatggtgatggccctgcctgatgccaacagagatgctgcccaggccctgatgaccttcttcaacaaggtgattgccaatgaaagcaagaacaggatgagcctgtggaacatcagcacagtgatggcccccaacctcttcttcagccgcagcaagcacagcgactatgaggagctgctgctggccaacacagctgcccacatcatccggctgatgctgaagtaccagaagatcctgtggaaggtgcccagcttcctgatcacccaggtgcggaggatgaatgaggccaccatgctgctgaagaagcagctgcccagcgtgaggaagctgctgcggaggaagaccctggagcgggagacagccagccccaagaccagcaaggtgctgcagaagagccccagcgcccggaggatgtctgatgtgcctgagggcgtcatccgggtgcacgcccccctgctgagcaaggtgtccatggccatccagctgaacaaccagaccaaggccaaggacatcctggccaagttccagtatgaaaatcgcatcctgcactggcagagagctgccctgtccttcctgaatggcaagtgggtgaagaaggagcgggaggagagcacagagaccaacagaagccccaagcacgtgttcctgttcaccatcggcctggacatcagcacctag

SEQ ID NO: 167931 - DNA, 1692 bp, Artificial Sequence
  Description of Artificial Sequence: Synthetic coding sequence
atgaggaagaaggacaagcagagcatcagagatgtgcgggacatcttcggcgtgtctgagagccccccccgggacacctgtggcaaccacaccaaccagctggatggcaccaaggaggagcgggagctgcccagggtcatcaagaccagcggctccatgccagatgatgccagcctgaacagcaccaccctgagtgatgccagccaggacaaggagggcagctttgctgtgcccaggagtgacagcgtggccatcctggagaccatccctgtgctgcctgtgcacagcaatggcagccctgagcccggccagcctgtgcagaatgccatcagtgatgatgacttcctggagaagaacatccccccagaggccgaggagctgagctttgaggtgtcctacagcgagatggtgacagaggccctgaagaggaacaagctgaagaagtctgagatcaagaaggaggactatgtgctgaccaagttcaacgtgcagaagacccgcttcggcctgacagaagctggggacctgtctgctgaggacatgaagaagatccgccacctgagcctcatcgagctgacagccttctttgatgccttcggcatccagctgaagaggaacaagacagagaaggtgaagggccgggacaatggcatctttggagtgcccctgactgtgctgctggatggagacaggaagaaggaccccggggtgaaggtgcccctggtgctgcagaagttctttgagaaggtggaggagagcggcctggagagcgagggcatcttccggctgagcggctgcacagccaaggtgaagcagtaccgggaggagctggatgccaagttcaatgctgacaagttcaagtgggacaagatgtgccaccgggaggccgctgtgatgctgaaggccttcttccgggagctgcccaccagcctcttccctgtggagtacatcccagccttcatcagcctgatggagcggggcccccacgtgaaggtgcagttccaggccctgcacctgatggtgatggccctgcctgatgccaacagagatgctgcccaggccctgatgaccttcttcaacaaggtgattgccaatgaaagcaagaacaggatgagcctgtggaacatcagcacagtgatggcccccaacctcttcttcagccgcagcaagcacagcgactatgaggagctgctgctggccaacacagctgcccacatcatccggctgatgctgaagtaccagaagatcctgtggaaggtgcccagcttcctgatcacccaggtgcggaggatgaatgaggccaccatgctgctgaagaagcagctgcccagcgtgaggaagctgctgcggaggaagaccctggagcgggagacagccagccccaagaccagcaaggtgctgcagaagagccccagcgcccggaggatgtctgatgtgcctgagggcgtcatccgggtgcacgcccccctgctgagcaaggtgtccatggccatccagctgaacaaccagaccaaggccaaggacatcctggccaagttccagtatgagaaccgcatcctgcactggcagagagctgccctgtccttcctgaatggcaagtgggtgaagaaggagcgggaggagagcacagagaccaacagaagccccaagcacgtgttcctgttcaccatcggcctggacatcagcacctag

SEQ ID NO: 167932 - DNA, 1713 bp, Artificial Sequence; identical to SEQ ID NO: 167928
  Description of Artificial Sequence: Synthetic coding sequence

SEQ ID NO: 167933 - DNA, 354 bp, Artificial Sequence
  Description of Artificial Sequence: Synthetic coding sequence
atgctgagcaatgaaagcctgcaccccccagccttcagccgcagcaacagcgaggcctctgtggacagcgcctccatggaggacttctggagagaaattgagagcatcaaggacagctccatgggcggccaggaggagcccccacctgctgaggtgacccctgtggatgaaggagagctggaggccgagtggctgcaggatgtgggcctgagcaccctcatctctggagatgaggaggaggatggcaaggccctgctgagcaccctgaccaggacccaggccgctgctgtgcagaagcgctaccacacctacacccagaccatgaggaagaaggacaagcagagcatcagatag

SEQ ID NO: 167934 - DNA, 1665 bp, Artificial Sequence
  Description of Artificial Sequence: Synthetic coding sequence
atggccttcatgaggatcaacgtcatcatgaatgagctgccccgggacacctgtggcaaccacaccaaccagctggatggcaccaaggaggagcgggagctgcccagggtcatcaagaccagcggctccatgccagatgatgccagcctgaacagcaccaccctgagtgatgccagccaggacaaggagggcagctttgctgtgcccaggagtgacagcgtggccatcctggagaccatccctgtgctgcctgtgcacagcaatggcagccctgagcccggccagcctgtgcagaatgccatcagtgatgatgacttcctggagaagaacatccccccagaggccgaggagctgagctttgaggtgtcctacagcgagatggtgacagaggccctgaagaggaacaagctgaagaagtctgagatcaagaaggaggactatgtgctgaccaagttcaacgtgcagaagaccaggtttggcctgacagaggccggggacctgtctgctgaggacatgaagaagatccgccacctgagcctgattgagctgacagccttctttgatgccttcggcatccagctgaagaggaacaagacagagaaggtgaagggccgggacaatggcatcttcggcgtgcccctgactgtgctgctggatggagacaggaagaaggaccccggggtgaaggtgcccctggtgctgcagaagttctttgagaaggtggaggagagcggcctggagagcgagggcatcttccggctgagcggctgcacagccaaggtgaagcagtaccgggaggagctggatgccaagttcaatgctgacaagttcaagtgggacaagatgtgccaccgggaggccgctgtgatgctgaaggccttcttccgggagctgcccaccagcctcttccctgtggagtacatcccagccttcatcagcctgatggagcggggcccccacgtgaaggtgcagttccaggccctgcacctgatggtgatggccctgcctgatgccaacagagatgctgcccaggccctgatgaccttcttcaacaaggtgattgccaatgaaagcaagaacaggatgagcctgtggaacatcagcacagtgatggcccccaacctcttcttcagccgcagcaagcacagcgactatgaggagctgctgctggccaacacagctgcccacatcatccggctgatgctgaagtaccagaagatcctgtggaaggtgcccagcttcctgatcacccaggtgcggaggatgaatgaggccaccatgctgctgaagaagcagctgcccagcgtgaggaagctgctgcggaggaagaccctggagcgggagacagccagccccaagaccagcaaggtgctgcagaagagccccagcgcccggaggatgtctgatgtgcctgagggcgtcatccgggtgcacgcccccctgctgagcaaggtgtccatggccatccagctgaacaaccagaccaaggccaaggacatcctggccaagttccagtatgaaaatcgcatcctgcactggcagagagctgccctgtccttcctgaatggcaagtgggtgaagaaggagcgggaggagagcacagagaccaacagaagccccaagcacgtgttcctgttcaccatcggcctggacatcagcacctag

SEQ ID NO: 167935 - DNA, 3786 bp, Artificial Sequence
  Description of Artificial Sequence: Synthetic coding sequence
atgattgcccacaagcagaagaagaccaagaagaagagggcctgggccagcggccagctgagcacagacatcaccaccagcgagatgggcctgaagagcctgagcagcaacagcatctttgatcctgactacatcaaggagctggtgaatgacatcaggaagttcagccacatgctgctgtacctgaaggaggccatcttcagtgactgcttcaaggaggtgatccacatccggctggaggagctgctgcgggtgctgaagagcatcatgaacaagcaccagaacctgaacagcgtggacctgcagaatgctgctgagatgctgacagccaaggtgaaggctgtgaacttcacagaggtgaatgaggagaacaagaatgacctcttccaggaggtgttcagcagcattgagaccctggccttcacctttggaaacatcctgaccaacttcctgatgggagatgtgggcaatgacagcctgctgcggctgcctgtgtcccgggagaccaagagctttgaaaatgtgtctgtggagagcgtggacagcagcagcgagaagggcaacttcagccccctggagctggacaacgtgctgctgaagaacacagacagcattgagctggccctgtcctatgccaagacctggagcaagtacaccaagaacatcgtgtcctgggtggagaagaagctgaacctggagctggagagcaccaggaacatggtgaagctggccgaggccaccaggaccaacatcggcatccaggagttcatgcccctgcagagcctcttcaccaatgccctgctgaatgacatcgagagcagccacctgctgcagcagaccatcgccgccctgcaggccaacaagtttgtgcagcccctgctgggcaggaagaatgagatggagaagcagaggaaggagatcaaggagctgtggaagcaggagcagaacaagatgctggaggccgagaatgccctgaagaaggccaagctgctgtgcatgcagaggcaggatgaatatgagaaggccaagagctccatgttccgggcagaggaggagcacctgagcagcagcggcggcctggccaagaacctgaacaagcagctggagaagaagaggcggctggaggaggaggccctgcagaaggtggaggaggccaatgagctgtacaaggtgtgtgtgaccaacgtggaggagaggagaaatgacctggagaacaccaagcgggagatcctggcccagctgcggaccctggtgttccagtgtgacctgaccctgaaggctgtgacagtgaacctcttccacatgcagcacctgcaggccgccagcctggccgacagcctgcagagcctgtgtgacagcgccaagctgtatgaccccggccaggagtacagcgagtttgtgaaggccaccaacagcacagaggaggagaaggtggatggaaatgtgaacaagcacctgaacagcagccagcccagcggcttcggccctgccaacagcctggaggatgtggtgcggctgcctgacagcagcaacaagattgaagaagatcgctgcagcaacagcgctgacatcaccggccccagcttcatccgctcctggaccttcggcatgttcagtgacagcgagagcactggaggcagcagcgagagccgcagcctggacagcgagagcatcagccctggggacttccacaggaagctgcccaggacccccagcagcggcaccatgagcagcgcagatgacctggatgagcgggagccccccagccccagcgagaccggccccaacagcctgggcaccttcaagaagaccctgatgagcaaggccgccctgacccacaagttcaggaagctgcggagccccaccaagtgccgggactgtgagggcatcgtggtgttccagggcgtggagtgtgaggagtgcctgctggtgtgccacaggaagtgcctggagaacctggtgatcatctgtggccaccagaagctgcccgggaagatccacctgtttggagctgagttcacccaggtggccaagaaggagccagatggcatccccttcatcctgaagatctgtgccagcgagattgagaacagagccctgtgcctgcagggcatctacagagtgtgtggcaacaagatcaagacagagaagctgtgccaggccctggagaatggcatgcacctggtggacatcagcgagttcagcagccatgacatctgtgatgtgctgaagctgtacctgcggcagctgcctgagcccttcatcctcttccggctgtacaaggagttcatcgacctggccaaggagatccagcacgtgaatgaggagcaggagaccaagaagaacagcctggaggacaagaagtggcccaacatgtgcatcgagatcaaccgcatcctgctgaagagcaaggacctgctgcggcagctgcctgccagcaacttcaacagcctgcacttcctgattgtgcacctgaagagggtggtggaccacgccgaggagaacaagatgaacagcaagaacctgggcgtcatcttcggccccagcctcatccggccccggcccaccacagcccccatcaccatcagcagcctggccgagtacagcaaccaggcccggctggtggagttcctgatcacctacagccagaagatctttgatggcagcctgcagccccaggatgtgatgtgcagcattggagtggtggaccagggctgcttccccaagcccctgctgagccctgaggagcgggacatcgagaggtccatgaagagcctcttcttcagcagcaaggaggacatccacaccagcgagagcgagagcaagatctttgagcgggccaccagctttgaggagagcgagaggaagcagaatgccctgggcaaatgtgatgcctgcctgagtgacaaggcccagctgctgctggaccaggaggccgagagcgccagccagaagattgaagatggcaagacccccaagcccctgagcctgaagagtgacaggagcaccaacaacgtggagcggcacacccccaggaccaagatccggcctgtgtccctgcctgtggaccggctgctgctggccagccccccaaatgaaagaaatggaagaaacatgggaaatgtgaacctggacaagttctgcaagaacccagcctttgaaggagtgaacaggaaggatgctgccaccaccgtgtgcagcaagttcaacggctttgaccagcagaccctgcagaagatccaggacaagcagtatgagcagaacagcctgacagccaagaccaccatgatcatgcccagcgccctgcaggagaagggcgtgaccaccagcctgcagatcagcggggaccacagcatcaatgccacccagcccagcaagccctatgcagagcctgtgcgctctgtgcgggaggccagcgagaggaggagcagtgacagctaccccctggcccctgtgcgggcccccaggaccctgcagccccagcactggaccaccttctacaagccccacgcccccatcatcagcatcagaggaaatgaggagaagccagccagccccagcgctgctgtgcccccaggcacagaccatgacccccacggcctggtggtgaagtccatgccagaccctgacaaggccagcgcctgccccggccaggccaccggccagcccaaggaggacagcgaggagctgggcctgcctgatgtgaaccccatgtgccagaggccccggctgaagaggatgcagcagtttgaggacctggagggggagatcccccagtttgtgtag

SEQ ID NO: 167936 - DNA, 1182 bp, Artificial Sequence
  Description of Artificial Sequence: Synthetic coding sequence
atgattgcccacaagcagaagaagaccaagaagaagagggcctgggccagcggccagctgagcacagacatcaccaccagcgagatgggcctgaagagcctgagcagcaacagcatctttgatcctgactacatcaaggagctggtgaatgacatcaggaagttcagccacatgctgctgtacctgaaggaggccatcttcagtgactgcttcaaggaggtgatccacatccggctggaggagctgctgcgggtgctgaagagcatcatgaacaagcaccagaacctgaacagcgtggacctgcagaatgctgctgagatgctgacagccaaggtgaaggctgtgaacttcacagaggtgaatgaggagaacaagaatgacctcttccaggaggtgttcagcagcattgagaccctggccttcacctttggaaacatcctgaccaacttcctgatgggagatgtgggcaatgacagcctgctgcggctgcctgtgtcccgggagaccaagagctttgaaaatgtgtctgtggagagcgtggacagcagcagcgagaagggcaacttcagccccctggagctggacaacgtgctgctgaagaacacagacagcattgagctggccctgtcctatgccaagacctggagcaagtacaccaagaacatcgtgtcctgggtggagaagaagctgaacctggagctggagagcaccaggaacatggtgaagctggccgaggccaccaggaccaacatcggcatccaggagttcatgcccctgcagagcctcttcaccaatgccctgctgaatgacatcgagagcagccacctgctgcagcagaccatcgccgccctgcaggccaacaagtttgtgcagcccctgctgggcaggaagaatgagatggagaagcagaggaaggagatcaaggagctgtggaagcaggagcagaacaagatgctggaggccgagaatgccctgaagaaggccaagctgctgtgcatgcagaggcaggatgaatatgagaaggccaagagctccatgttccgggcagaggaggagcacctgagcagcagcggcggcctggccaagaacctgaacaagcagctggagaagaagaggcggctggaggaggaggccctgcagaaggtgaccatcttcttcttcttcatctgcaagctgaactag

SEQ ID NO: 167937 - DNA, 3306 bp, Artificial Sequence
  Description of Artificial Sequence: Synthetic coding sequence
atgaagagccggcagaagggcaagaagaagggcagcgccaaggagcgggtgtttggctgtgacctgcaggagcacctgcagcacagcggccaggaggtgccccaggtgctgaagagctgtgccgagtttgtggaggagtatggagtggtggatggcatctaccgcctgtctggagtgagcagcaacatccagaagctgcggcaggagtttgagagcgagaggaagccagacctgcggagagatgtgtacctgcaggacatccactgtgtgagcagcctgtgcaaggcctacttccgggagctgcctgaccccctgctgacctaccgcctgtatgacaagtttgctgaggccgtgggcgtgcagctggagcctgagcggctggtgaagatcctggaggtgctgcgggagctgcctgtgcccaactaccgcaccctggagttcctgatgaggcacctggtgcacatggccagcttcagcgcccagaccaacatgcacgccaggaacctggccatcgtgtgggcccccaacctgctgcggagcaaggacatcgaggccagcggcttcaatggaacagctgccttcatggaggtgcgggtgcagagcatcgtggtggagttcatcctgacccacgtggaccagctgtttggaggagctgccctgtctggaggagaggtggagagcggctggaggagcctgcccggcacccgggccagcggcagccctgaggacctgatgccccggcccctgccctaccacctgcccagcatcctgcaggccggagatggccccccccagatgaggccctaccacaccatcattgaaattgctgagcacaagaggaagggcagcctgaaggtgaggaagtggaggagcatcttcaacctgggccgcagcggccacgagaccaagaggaagctgcccagaggagcagaagatcgggaggacaagagcaacaagggcaccctgcggcctgccaagtccatggacagcctgtctgctgctgctggggccagtgatgagcctgagggcctggtgggccccagcagcccccggcccagccccctgctgcctgagagcctggagaatgacagcattgaagctgctgagggggagcaggagcctgaggccgaggccctgggcggcaccaacagcgagcccggcacccccagggctggccgcagcgccatccgggccggcggcagcagcagagctgagcgctgtgccggcgtgcacatcagtgacccctacaacgtgaacctgcccctgcacatcaccagcatcctgtctgtgccccccaacatcatcagcaatgtgtccctggcccggctgacccggggcctggagtgcccagccctgcagcaccggcccagccctgccagcggccctggccctggccctggcctgggccctggccccccagatgagaagctggaggccagccctgccagcagccccctggccgacagcggcccagatgacctggccccagccctggaggacagcctgagccaggaggtgcaggacagcttctccttcctggaggacagcagcagcagcgagcctgagtgggtgggcgcagaagatggagaggtggcccaggccgaggccgccggggccgccttcagccctggagaagatgaccccggcatgggctacctggaggagctgctgggcgtgggcccccaggtggaggagttctctgtggagccccccctggatgacctgagcctggatgaggcccagtttgtgctggcccccagctgctgcagcctggacagcgctggccccaggcctgaggtggaggaggagaatggagaggaggtgttcctgagcgcctatgatgacctgagccccctgctgggccccaagccacccatctggaagggcagcggcagcctggagggggaggccgccggctgcggccggcaggccctgggccagggcggggaggagcaggcctgctgggaggtgggggaggacaagcaggccgagcccggcggccgcctggacatccgggaggaggccgagggcagccctgagaccaaggtggaggccggcaaggccagcgaggacagaggagaggccggcggcagccaggagaccaaggtgcggctgcgggagggcagccgggaggagacagaggccaaggaggagaagagcaagggccagaagaaggctgacagcatggaggccaagggcgtggaggagcctggaggagatgagtacacagatgagaaggagaaggagattgaaagagaggaggatgagcagcgggaggaggcccaggtggaggccggccgggacctggagcagggcgcccaggaggaccaggtggccgaggagaagtgggaggtggtgcagaagcaggaggccgagggcgtgcgggaggatgaggacaagggccagcgggagaagggctaccacgaggccaggaaggaccagggagatggagaggacagccgcagccctgaggccgccacagaaggaggagctggggaggtgtccaaggagcgggagagcggagatggagaggccgagggggaccagagagctgggggctactacctggaggaggacaccctgtctgagggcagcggcgtggccagcctggaggtggactgtgccaaggagggcaacccccacagcagcgagatggaggaggtggccccccagcccccccagcctgaggagatggagcctgagggccagcccagcccagatggctgcctgtgcccctgcagcctgggcctgggcggcgtgggcatgaggctggccagcaccctggtgcaggtgcagcaggtgcgctctgtgcctgtggtgccccccaagccccagtttgccaagatgcccagcgccatgtgcagcaagatccacgtggccccagccaacccctgcccccggcccggccgcctggatggcaccccaggagagcgggcctggggcagccgggccagccgcagctcctggagaaatggaggcagcctgagctttgatgctgctgtggccctggcccgggaccggcagaggacagaggcccagggcgtgcggaggacccagacctgcacagagggcggggactactgcctgatccccaggaccagcccctgcagcatgatcagcgcccacagcccccggcccctgagctgcctggagctgcccagcgagggcgctgagggcagcggcagccgcagccggctgagcctgcccccccgggagccccaggtgcctgaccccctgctgagcagccagaggaggagctatgcctttgagacccaggccaaccctggaaaaggagagggcctgtag

SEQ ID NO: 167938 - DNA, 2673 bp, Artificial Sequence
  Description of Artificial Sequence: Synthetic coding sequence
atgaagagccggcagaagggcaagaagaagggcagcgccaaggagcgggtgtttggctgtgacctgcaggagcacctgcagcacagcggccaggaggtgccccaggtgctgaagagctgtgccgagtttgtggaggagtatggagtggtggatggcatctaccgcctgtctggagtgagcagcaacatccagaagctgcggcaggagtttgagagcgagaggaagccagacctgcggagagatgtgtacctgcaggacatccactgtgtgagcagcctgtgcaaggcctacttccgggagctgcctgaccccctgctgacctaccgcctgtatgacaagtttgctgaggccgtgggcgtgcagctggagcctgagcggctggtgaagatcctggaggtgctgcgggagctgcctgtgcccaactaccgcaccctggagttcctgatgaggcacctggtgcacatggccagcttcagcgcccagaccaacatgcacgccaggaacctggccatcgtgtgggcccccaacctgctgcggagcaaggacatcgaggccagcggcttcaatggaacagctgccttcatggaggtgcgggtgcagagcatcgtggtggagttcatcctgacccacgtggaccagctgtttggaggagctgccctgtctggaggagaggtggagagcggctggaggagcctgcccggcacccgggccagcggcagccctgaggacctgatgccccggcccctgccctaccacctgcccagcatcctgcaggccggagatggccccccccagatgaggccctaccacaccatcattgaaattgctgagcacaagaggaagggcagcctgaaggtgaggaagtggaggagcatcttcaacctgggccgcagcggccacgagaccaagaggaagctgcccagaggagcagaagatcgggaggacaagagcaacaagggcaccctgcggcctgccaagtccatggacagcctgtctgctgctgctggggccagtgatgagcctgagggcctggtgggccccagcagcccccggcccagccccctgctgcctgagagcctggagaatgacagcattgaagctgctgagggggagcaggagcctgaggccgaggccctgggcggcaccaacagcgagcccggcacccccagggctggccgcagcgccatccgggccggcggcagcagcagagctgagcgctgtgccggcgtgcacatcagtgacccctacaacgtgaacctgcccctgcacatcaccagcatcctgtctgtgccccccaacatcatcagcaatgtgtccctggcccggctgacccggggcctggagtgcccagccctgcagcaccggcccagccctgccagcggccctggccctggccctggcctgggccctggccccccagatgagaagctggaggccagccctgccagcagccccctggccgacagcggcccagatgacctggccccagccctggaggacagcctgagccaggaggtgcaggacagcttctccttcctggaggacagcagcagcagcgagcctgagtgggtgggcgcagaagatggagaggtggcccaggccgaggccgccggggccgccttcagccctggagaagatgaccccggcatgggctacctggaggagctgctgggcgtgggcccccaggtggaggagttctctgtggagccccccctggatgacctgagcctggatgaggcccagtttgtgctggcccccagctgctgcagcctggacagcgctggccccaggcctgaggtggaggaggagaatggagaggaggtgttcctgagcgcctatgatgacctgagccccctgctgggccccaagccacccatctggaagggcagcggcagcctggagggggaggccgccggctgcggccggcaggccctgggccagggcggggaggagcaggcctgctgggaggtgggggaggacaagcaggccgagcccggcggccgcctggacatccgggaggaggccgagggcaccccccagcccccccagcctgaggagatggagcctgagggccagcccagcccagatggctgcctgtgcccctgcagcctgggcctgggcggcgtgggcatgaggctggccagcaccctggtgcaggtgcagcaggtgcgctctgtgcctgtggtgccccccaagccccagtttgccaagatgcccagcgccatgtgcagcaagatccacgtggccccagccaacccctgccccaggcctggccgcctggatggcaccccaggagagcgggcctggggcagccgggccagccgcagctcctggagaaatggaggcagcctgagctttgatgctgctgtggccctggcccgggaccggcagaggacagaggcccagggcgtgcggaggacccagacctgcacagaaggaggagactactgcctgatccccaggaccagcccctgcagcatgatcagcgcccacagcccccggcccctgagctgcctggagctgcccagcgagggcgctgagggcagcggcagccgcagccggctgagcctgcccccccgggagccccaggtgcctgaccccctgctgagcagccagaggaggagctatgcctttgagacccaggccaaccctgggaagggggagggcctgtag

SEQ ID NO: 167939 - DNA, 1500 bp, Artificial Sequence
  Description of Artificial Sequence: Synthetic coding sequence
atgaggcacctggtgcacatggccagcttcagcgcccagaccaacatgcacgccaggaacctggccatcgtgtgggcccccaacctgctgcggagcaaggacatcgaggccagcggcttcaatggaacagctgccttcatggaggtgcgggtgcagagcatcgtggtggagttcatcctgacccacgtggaccagctgtttggaggagctgccctgtctggaggagaggtggagagcggctggaggagcctgcccggcacccgggccagcggcagccctgaggacctgatgccccggcccctgccctaccacctgcccagcatcctgcaggccggagatggccccccccagatgaggccctaccacaccatcattgaaattgctgagcacaagaggaagggcagcctgaaggtgaggaagtggaggagcatcttcaacctgggccgcagcggccacgagaccaagaggaagctgcccagaggagcagaagatcgggaggacaagagcaacaagggcaccctgcggcctgccaagtccatggacagcctgtctgctgctgctggggccagtgatgagcctgagggcctggtgggccccagcagcccccggcccagccccctgctgcctgagagcctggagaatgacagcattgaagctgctgagggggagcaggagcctgaggccgaggccctgggcggcaccaacagcgagcccggcacccccagggctggccgcagcgccatccgggccggcggcagcagcagagctgagcgctgtgccggcgtgcacatcagtgacccctacaacgtgaacctgcccctgcacatcaccagcatcctgtctgtgccccccaacatcatcagcaatgtgtccctggcccggctgacccggggcctggagtgcccagccctgcagcaccggcccagccctgccagcggccctggccctggccctggcctgggccctggccccccagatgagaagctggaggccagccctgccagcagccccctggccgacagcggcccagatgacctggccccagccctggaggacagcctgagccaggaggtgcaggacagcttctccttcctggaggacagcagcagcagcgagcctgagtgggtgggcgcagaagatggagaggtggcccaggccgaggccgccggggccgccttcagccctggagaagatgaccccggcatgggctacctggaggagctgctgggcgtgggcccccaggtggaggagttctctgtggagccccccctggatgacctgagcctggatgaggcccagtttgtgctggcccccagctgctgcagcctggacagcgctggccccaggcctgaggtggaggaggagaatggagaggaggtgttcctgagcgcctatgatgacctgagccctgccctgggcctgctgctgcagcccggctggggccacaggagccacagcagcgagggccagtgcctgcgcatcaaggctgtgttcctgtag

SEQ ID NO: 167940 - DNA, 4335 bp, Artificial Sequence
  Description of Artificial Sequence: Synthetic coding sequence
atgaagaacaagggggccaagcagaagctgaagaggaaaggagctgccagcgccttcggctgtgacctgacagagtacctggagagcagcggccaggatgtgccctacgtgctgaagagctgtgccgagttcatcgagacccacggcatcgtggatggcatctaccgcctgagcggcgtgaccagcaacatccagaggctgcggcaggagtttggaagtgaccagtgcccagacctgacccgggaggtgtacctgcaggacatccactgtgtgggcagcctgtgcaagctgtacttccgggagctgcccaaccccctgctgacctatgagctgtatgagaagttcacagaggccgtgagccactgcccagaggagggccagctggcccgcatccagaatgtcatccaggagctgccccccagccactaccgcaccctggagtacctgatccgccacctggcccacatcgccagcttcagcagcaagaccaacatgcacgccaggaacctggccctggtgtgggcccccaacctgctgcggagcaaggagattgaggccaccggctgcaatggagatgctgccttcctggccgtgcgggtgcagcaggtggtgattgagttcatcctgaaccacgtggaccagatcttcaacaacggggcccctggcagcctggagaatgatgagaaccggcccatcatgaagagcctgaccctgcctgccctgagcctgcccatgaagctggtgtccctggaggaggcccaggcccggagcctggccaccaaccacccagccaggaaggagcggcgggagaacagcctgcctgagatcgtgccccccatgggcaccctcttccacacagtgctggagctgcctgacaacaagaggaagctgagcagcaagagcaagaagtggaagagcatcttcaacctgggccgcagcggcagtgacagcaagagcaagctgagcagaaatggatctgtgtttgtgcggggccagaggctgtctgtggagaaggccaccatccggcctgccaagtccatggacagcctgtgcagcgtgcctgtggagggcaaggagaccaagggcaacttcaacagaacagtgaccaccggcggcttcttcatcccagccaccaagatgcacagcactggaacaggcagcagctgtgacctgaccaagcaggagggggagtggggccaggagggcatgcctcctggagctgagggcggctttgatgtgtccagtgacaggagccacctgcagggcgcccaggcccggcccccacctgagcagctgaaggtgttccggcctgtggaggaccctgagagcgagcagacagcccccaagatgctgggcatgttctacaccagcaatgacagccccagcaagagcgtcttcaccagcagcctcttccagatggagcccagccccaggaaccagaggaaggccctgaacatcagcgagccctttgctgtgtctgtgcccctgcgggtgtctgctgtgatcagcaccaacagcaccccctgcaggaccccacccaaggagctgcagagcctgagcagcctggaggagttctccttccacggcagcgagagcggcggctggccagaggaggagaagcccctgggcgctgagaccagcgctgcctctgtgcccaagaaggccggcctggaggatgccaaggctgtgcctgaggcccctggcaccgtggagtgcagcaagggcctgagccaggagcccggggcccacctggaggagaagaagaccccagagagcagcctgagcagccagcacctgaatgagctggagaagaggcccaaccctgagaaggtggtggaggagggccgggaggccggggagatggagagcagcaccctgcaggagagcccccgggcccgggcagaggccgtgctgctgcacgagatggatgaagatgacctggccaatgccctgatctggccagagatccagcaggagctgaagatcattgaaagtgaggaggagctgagcagcctgcccccaccagccctgaagaccagccccatccagcccatcctggagagcagcctgggccccttcatccccagcgagcccccaggcagcctgccctgtggcagcttccctgcccctgtgtccacccccctggaggtgtggacccgggaccctgccaaccagagcacccagggcgccagcacagctgccagccgggagaagccagagcctgagcagggcctgcacccagacctggccagcctggcccccctggagatcgtgccctttgagaaggccagcccccaggccaccgtggaggtgggcggccctggcaacctgagcccccccctgcccccagcccctcctccacccacccccctggaggagagcacccctgtgctgctgagcaaaggaggccctgagcgggaggacagcagcaggaagctgaggacagacctgtacatcgaccagctgaagagccaggacagccctgagatcagcagcctgtgccagggcgaggaggccacccccaggcacagcgacaagcagaacagcaagaatgctgccagcgagggcaagggctgcggcttccccagccccacccgggaggtggagatcgtgtcccaggaggaggaggatgtgacccacagcgtgcaggagcccagcgactgtgatgaagatgacacagtgacagacatcgcccagcacggcctggagatggtggagccctgggaggagccccagtgggtgaccagccccctgcacagccccaccctgaaggatgcccacaaggcccaggtgcagggcctgcagggccaccagctggagaagaggctgagccaccggcccagcctgcggcagagccacagcctggacagcaagcccaccgtgaagagccagtggaccctggaggtgcccagcagcagcagctgtgccaacctggagacagagaggaacagcgaccccctgcagccccaggccccccggcgggagatcaccggctgggatgagaaggccctgcggagcttccgggagttcagcggcctgaagggagctgaggccccacccaaccagaagggccccagcggcgtgcagcccaacccagctgagaccagccccatcagcctggccgagggcaaggagctgggcacccacctgggccacagcagcccccagatccggcagggcggcgtgcccggccctgagagcagcaaggagagcagccccagcgtgcaggacagcaccagccctggagagcacccagccaagctgcagctgaagagcacagaatgtggcccccccaagggcaagaaccggcccagcagcctgaacctggaccctgccatccccatcgctgacctcttctggtttgaaaatgtggccagcttcagcagccctggcatgcaggtgtctgagcccggggaccccaaggtgacctggatgaccagcagctactgcaaggctgacccctggagggtgtacagccaggacccccaggacctggacatcgtggcccacgccctgactggaagaagaaacagcgcccctgtgtctgtgtctgctgtgaggaccagcttcatggtgaagatgtgccaggcccgggctgtgcctgtgatcccccccaagatccagtacacccagatcccccagcccctgcccagccagagcagtggagaaaatggagtgcagcccctggagaggagccaggagggccccagcagcaccagcggcaccacccagaagccagccaaggatgacagccccagcagcctggagagcagcaaggaggagaagcccaagcaggaccccggggccatcaagagcagccctgtggatgccacagccccctgcatgtgtgagggccccaccctgagccctgagcccggcagcagcaacctgctgagcacccaggatgctgtggtgcagtgcaggaagaggatgtctgaaacagagcccagcggggacaacctgctgagcagcaagctggagcggcccagcggcggcagcaagcccttccacaggagcaggcctggccggccccagagcctcatcctcttcagcccccccttccccatcatggaccacctgccccccagcagcacagtgacagacagcaaggtgctgctgagccccatccgcagccccacccagacagtgtccccaggcctgctgtgtggggagctggccgagaacacctgggtgaccccagagggcgtgaccctgaggaacaagatgaccatccccaagaatggccagaggctggagaccagcaccagctgcttctaccagccccagaggaggagcgtcatcctggatggccgcagcggccggcagattgaatag

SEQ ID NO: 167941 - DNA, 3300 bp, Artificial Sequence
  Description of Artificial Sequence: Synthetic coding sequence
atgaagaacaagggggccaagcagaagctgaagaggaaaggagctgccagcgccttcggctgtgacctgacagagtacctggagagcagcggccaggatgtgccctacgtgctgaagagctgtgccgagttcatcgagacccacggcatcgtggatggcatctaccgcctgagcggcgtgaccagcaacatccagaggctgcggcaggagtttggaagtgaccagtgcccagacctgacccgggaggtgtacctgcaggacatccactgtgtgggcagcctgtgcaagctgtacttccgggagctgcccaaccccctgctgacctatgagctgtatgagaagttcacagaggccgtgagccactgcccagaggagggccagctggcccgcatccagaatgtcatccaggagctgccccccagccactaccgcaccctggagtacctgatccgccacctggcccacatcgccagcttcagcagcaagaccaacatgcacgccaggaacctggccctggtgtgggcccccaacctgctgcggagcaaggagattgaggccaccggctgcaatggagatgctgccttcctggccgtgcgggtgcagcaggtggtgattgagttcatcctgaaccacgtggaccagatcttcaacaacggggcccctggcagcctggagaatgatgagaaccggcccatcatgaagagcctgaccctgcctgccctgagcctgcccatgaagctggtgtccctggaggaggcccaggcccggagcctggccaccaaccacccagccaggaaggagcggcgggagaacagcctgcctgagatcgtgccccccatgggcaccctcttccacacagtgctggagctgcctgacaacaagaggaagctgagcagcaagagcaagaagtggaagagcatcttcaacctgggccgcagcggcagtgacagcaagagcaagctgagcagaaatggatctgtgtttgtgcggggccagaggctgtctgtggagaaggccaccatccggcctgccaagtccatggacagcctgtgcagcgtgcctgtggagggcaaggagaccaagggcaacttcaacagaacagtgaccaccggcggcttcttcatcccagccaccaagatgcacagcactggaacaggcagcagctgtgacctgaccaagcaggagggggagtggggccaggagggcatgcctcctggagctgagggcggctttgatgtgtccagtgacaggagccacctgcagggcgcccaggcccggcccccacctgagcagctgaaggtgttccggcctgtggaggaccctgagagcgagcagacagcccccaagatgctgggcatgttctacaccagcaatgacagccccagcaagagcgtcttcaccagcagcctcttccagatggagcccagccccaggaaccagaggaaggccctgaacatcagcgagccctttgctgtgtctgtgcccctgcgggtgtctgctgtgatcagcaccaacagcaccccctgcaggaccccacccaaggagctgcagagcctgagcagcctggaggagttctccttccacggcagcgagagcggcggctggccagaggaggagaagcccctgggcgctgagaccagcgctgcctctgtgcccaagaaggccggcctggaggatgccaaggctgtgcctgaggcccctggcaccgtggagtgcagcaagggcctgagccaggagcccggggcccacctggaggagaagaagaccccagagagcagcctgagcagccagcacctgaatgagctggagaagaggcccaaccctgagaaggtggtggaggagggccgggaggccggggagatggagagcagcaccctgcaggagagcccccgggcccgggcagaggccgtgctgctgcacgagatggatgaagatgacctggccaatgccctgatctggccagagatccagcaggagctgaagatcattgaaagtgaggaggagctgagcagcctgcccccaccagccctgaagaccagccccatccagcccatcctggagagcagcctgggccccttcatccccagcgagcccccaggcagcctgccctgtggcagcttccctgcccctgtgtccacccccctggaggtgtggacccgggaccctgccaaccagagcacccagggcgccagcacagctgccagccgggagaagccagagcctgagcagggcctgcacccagacctggccagcctggcccccctggagatcgtgccctttgagaaggccagcccccaggccaccgtggaggtgggcggccctggcaacctgagcccccccctgcccccagcccctcctccacccacccccctggaggagagcacccctgtgctgctgagcaaaggaggccctgagcgggaggacagcagcaggaagctgaggacagacctgtacatcgaccagctgaagagccaggacagccctgagatcagcagcctgtgccagggcgaggaggccacccccaggcacagcgacaagcagaacagcaagaatgctgccagcgagggcaagggctgcggcttccccagccccacccgggaggtggagatcgtgtcccaggaggaggaggatgtgacccacagcgtgcaggagcccagcgactgtgatgaagatgacacagtgacagacatcgcccagcacggcctggagatggtggagccctgggaggagccccagtgggtgaccagccccctgcacagccccaccctgaaggatgcccacaaggcccaggtgcagggcctgcagggccaccagctggagaagaggctgagccaccggcccagcctgcggcagagccacagcctggacagcaagcccaccgtgaagagccagtggaccctggaggtgcccagcagcagcagctgtgccaacctggagacagagaggaacagcgaccccctgcagccccaggccccccggcgggagatcaccggctgggatgagaaggccctgcggagcttccgggagttcagcggcctgaagggagctgaggccccacccaaccagaagggccccagcggcgtgcagcccaacccagcccagcctgtgggccccctgaggaacctgcccaagatgatcctgcccccaccctggaaggcccagaggaagaagaaccagagcaagatccctgagcccctgagcccccaccagtggatgcccctgcacccagcctgtgcccgggacctgcccttcctgcagaaccaggcccggctgacctgcagcccccccaggatgcagtag

SEQ ID NO: 167942 - DNA, 4509 bp, Artificial Sequence
  Description of Artificial Sequence: Synthetic coding sequence
atgatggccaagaacaaggagccccggccccccagctacaccatcagcatcgtgggcctgtctggaacagagaaggacaagggcaactgtggggtgggcaagagctgcctgtgcaacagatttgtgcgcagcaaggcagatgagtactacccagagcacacctctgtgctgagcaccatcgactttggaggccgggtggtgaacaatgaccacttcctgtactggggagacatcatccagaacagtgaagatggagtggagtgcaagatccacgtgattgagcagacagagttcattgatgaccagaccttcctgccccacaggagcaccaacctgcagccctacatcaagagagctgctgccagcaagctgcagagcgctgagaagctgatgtacatctgcacagaccagctgggcctggagcaggactttgagcagaagcagatgcctgagggcaagctgaatgtggatggcttcctgctgtgcattgatgtgtcccagggctgcaacaggaagtttgatgaccagctgaagtttgtgaacaacctgtttgtgcagctgagcaagagcaagaagcctgtgatcatcgccgccaccaagtgtgatgaatgtgtggaccactacctgcgggaggtgcaggcctttgccagcaacaagaagaacctgctggtggtggagaccagcgcccgcttcaacgtgaacatcgagacctgcttcaccgccctggtgcagatgctggacaagaccaggagcaagcccaagatcatcccctacctggatgcctacaagacccagaggcagctggtggtgacagccacagacaagtttgagaagctggtgcagacagtgcgggactaccacgccacctggaagacagtgagcaacaagctgaagaaccacccagactatgaggagtacatcaacctggagggcaccaggaaggccaggaacaccttcagcaagcacatcgagcagctgaagcaggagcacatcaggaagaggcgggaggagtacatcaacaccctgccccgggccttcaacaccctgctgcccaacctggaggagattgagcacctgaactggagcgaggccctgaagctgatggagaagagagctgacttccagctgtgctttgtggtgctggagaagaccccctgggatgaaacagaccacatcgacaagatcaatgaccggcgcatcccctttgacctgctgagcaccctggaggccgagaaggtgtaccagaaccacgtgcagcacctgatcagcgagaagagaagagtggagatgaaggagaagttcaagaagaccctggagaagatccagttcatcagccctggccagccctgggaggaggtgatgtgctttgtgatggaggatgaggcctacaagtacatcacagaagctgacagcaaggaggtgtatggccgccaccagcgggagatcgtggagaaggccaaggaggagttccaggagatgctgtttgagcacagcgagctgttctatgacctggacctgaatgccacccccagcagtgacaagatgtctgagatccacacagtgctgtctgaggagccccgctacaaggccctgcagaagctggccccagaccgggagagcctgctgctgaagcacatcggctttgtgtaccaccccaccaaggagacctgcctgagcggccagaactgcacagacatcaaggtggagcagctgctggccagcagcctgctgcagctggaccacggccgcctgcggctgtaccatgacagcaccaacatcgacaaggtgaacctcttcatcctgggcaaggatggcctggcccaggagctggccaatgagatccgcacccagagcacagatgatgaatatgccctggatggcaagatctatgagctggacctgcggcctgtggatgccaagagcccctacttcctgagccagctgtggacagctgccttcaagccccacggctgcttctgtgtgttcaacagcattgagagcctgtccttcatcggggagttcatcggcaagatcagaacagaggccagccagatcaggaaggacaagtacatggccaacctgcccttcaccctcatcctggccaaccagagggacagcatcagcaagaacctgcccatcctgcggcaccagggccagcagctggccaacaagctgcagtgcccctttgtggatgtgcctgctggcacctaccccaggaagttcaatgagacccagatcaagcaggccctgcggggcgtgctggagagcgtgaagcacaacctggatgtggtgagccccatcccagccaacaaggacctgtctgaggccgacctgcgcatcgtgatgtgtgccatgtgtggggaccccttctctgtggacctgatcctgagccccttcctggacagccacagctgcagcgctgcccaggccggccagaacaacagcctgatgctggacaagatcatcggggagaagagaagacgcatccagatcaccatcctgagctaccacagcagcattggagtgaggaaggatgagctggtgcacggctacatcctggtgtacagcgccaagaggaaggcctccatgggcatgctgcgggccttcctgtctgaggtgcaggacaccatccctgtgcagctggtggccgtgacagacagccaggccgacttctttgaaaatgaggccatcaaggagctgatgacagaaggagagcacatcgccacagagatcacagccaagttcaccgccctgtacagcctgagccagtaccaccggcagacagaggtgttcaccctcttcttcagtgatgtgctggagaagaagaacatgattgagaacagctacctgagtgacaacacccgggagagcacccaccagagtgaagatgtgttcctgcccagcccccgggactgcttcccctacaacaactacccagacagtgatgatgacacagaggcccccccaccctacagccccatcggagatgatgtgcagctgctgcccacccccagcgacaggagccgctaccgcctggacctggagggcaatgagtaccccatccacagcacccccaactgccacgaccacgagaggaaccacaaggtgcccccacccatcaagcccaagcctgtggtgcccaagaccaacgtgaagaagctggaccccaacctgctgaagaccatcgaggccggcatcggcaagaaccccaggaagcagaccagccgggtgcccctggcccaccctgaggacatggaccccagcgacaactatgcagagcccatcgacaccatcttcaagcagaagggctacagtgatgagatctacgtggtgcctgatgacagccagaaccgcatcaagatccggaacagctttgtgaacaacacccagggagatgaggagaatggcttcagtgacaggaccagcaagagccatggagagcggcggcccagcaagtacaagtacaagagcaagaccctcttcagcaaggccaagagctactacagaaggacccacagtgatgccagtgatgatgaggccttcaccaccagcaagaccaagaggaagggccgccaccggggcagcgaggaggaccccctgctgagccctgtggagacctggaagggcggcatcgacaacccagccatcaccagtgaccaggagctggatgacaagaagatgaagaagaagacccacaaggtgaaggaggacaagaagcagaagaagaagaccaagaacttcaacccccccaccaggaggaactgggagagcaactacttcggcatgcccctgcaggacctggtgacagctgagaagcccatccccctgtttgtggagaagtgtgtggagttcatcgaggacaccggcctgtgcacagagggcctgtacagagtgtctggcaacaagacagaccaggacaacatccagaagcagtttgaccaggaccacaacatcaacctggtgtccatggaggtgacagtgaatgctgtggccggggccctgaaggccttctttgctgacctgcctgaccccctcatcccctacagcctgcaccctgagctgctggaggccgccaagatcccagacaagacagagcggctgcacgccctgaaggagatcgtgaagaagttccaccctgtgaactatgatgtgttccgctacgtgatcacccacctgaacagagtgtcccagcagcacaagatcaacctgatgacagctgacaacctgagcatctgcttctggcccaccctgatgaggccagactttgaaaatcgggagttcctgagcaccaccaagatccaccagagcgtggtggagaccttcatccagcagtgccagttcttcttctacaatggagagatcgtggagaccaccaacatcgtggcccctcctccacccagcaaccctggccagctggtggagcccatggtgcccctgcagctgcccccacccctgcagccccagctgatccagccccagctgcagacagaccccctgggcatcatctag

SEQ ID NO: 167943 - DNA, 714 bp, Artificial Sequence
  Description of Artificial Sequence: Synthetic coding sequence
atgagcctgcccccacctcctcctggccccctgcccctgcggaggagaagaagaagacccaccctgctgggcctgtgcacagagggcctgtacagagtgtctggcaacaagacagaccaggacaacatccagaagcagtttgaccaggaccacaacatcaacctggtgtccatggaggtgacagtgaatgctgtggccggggccctgaaggccttctttgctgacctgcctgaccccctcatcccctacagcctgcaccctgagctgctggaggccgccaagatcccagacaagacagagcggctgcacgccctgaaggagatcgtgaagaagttccaccctgtgaactatgatgtgttccgctacgtgatcacccacctgaacagagtgtcccagcagcacaagatcaacctgatgacagctgacaacctgagcatctgcttctggcccaccctgatgaggccagactttgagaaccgggagttcctgagcaccaccaagatccaccagagcgtggtggagaccttcatccagcagtgccagttcttcttctacaacggggagatcgtggagaccaccaacatcgtggcccctcctccacccagcaaccctggccagctggtggagcccatggtgcccctgcagctgcccccacccctgcagccccagctgatccagccccagctgcagacagaccccctgggcatcatctag

SEQ ID NO: 167944 - DNA, 4506 bp, Artificial Sequence
  Description of Artificial Sequence: Synthetic coding sequence
atgatggccaagaacaaggagccccggccccccagctacaccatcagcatcgtgggcctgtctggaacagagaaggacaagggcaactgtggggtgggcaagagctgcctgtgcaacagatttgtgcgcagcaaggcagatgagtactacccagagcacacctctgtgctgagcaccatcgactttggaggccgggtggtgaacaatgaccacttcctgtactggggagacatcatccagaacagtgaagatggagtggagtgcaagatccacgtgattgagcagacagagttcattgatgaccagaccttcctgccccacaggagcaccaacctgcagccctacatcaagagagctgctgccagcaagctgcagagcgctgagaagctgatgtacatctgcacagaccagctgggcctggagcaggactttgagcagaagcagatgcctgagggcaagctgaatgtggatggcttcctgctgtgcattgatgtgtcccagggctgcaacaggaagtttgatgaccagctgaagtttgtgaacaacctgtttgtgcagctgagcaagagcaagaagcctgtgatcatcgccgccaccaagtgtgatgaatgtgtggaccactacctgcgggaggtgcaggcctttgccagcaacaagaagaacctgctggtggtggagaccagcgcccgcttcaacgtgaacatcgagacctgcttcaccgccctggtgcagatgctggacaagaccaggagcaagcccaagatcatcccctacctggatgcctacaagacccagaggcagctggtggtgacagccacagacaagtttgagaagctggtgcagacagtgcgggactaccacgccacctggaagacagtgagcaacaagctgaagaaccacccagactatgaggagtacatcaacctggagggcaccaggaaggccaggaacaccttcagcaagcacatcgagcagctgaagcaggagcacatcaggaagaggcgggaggagtacatcaacaccctgccccgggccttcaacaccctgctgcccaacctggaggagattgagcacctgaactggagcgaggccctgaagctgatggagaagagagctgacttccagctgtgctttgtggtgctggagaagaccccctgggatgaaacagaccacatcgacaagatcaatgaccggcgcatcccctttgacctgctgagcaccctggaggccgagaaggtgtaccagaaccacgtgcagcacctgatcagcgagaagagaagagtggagatgaaggagaagttcaagaagaccctggagaagatccagttcatcagccctggccagccctgggaggaggtgatgtgctttgtgatggaggatgaggcctacaagtacatcacagaagctgacagcaaggaggtgtatggccgccaccagcgggagatcgtggagaaggccaaggaggagttccaggagatgctgtttgagcacagcgagctgttctatgacctggacctgaatgccacccccagcagtgacaagatgtctgagatccacacagtgctgtctgaggagccccgctacaaggccctgcagaagctggccccagaccgggagagcctgctgctgaagcacatcggctttgtgtaccaccccaccaaggagacctgcctgagcggccagaactgcacagacatcaaggtggagcagctgctggccagcagcctgctgcagctggaccacggccgcctgcggctgtaccatgacagcaccaacatcgacaaggtgaacctcttcatcctgggcaaggatggcctggcccaggagctggccaatgagatccgcacccagagcacagatgatgaatatgccctggatggcaagatctatgagctggacctgcggcctgtggatgccaagagcccctacttcctgagccagctgtggacagctgccttcaagccccacggctgcttctgtgtgttcaacagcattgagagcctgtccttcatcggggagttcatcggcaagatcagaacagaggccagccagatcaggaaggacaagtacatggccaacctgcccttcaccctcatcctggccaaccagagggacagcatcagcaagaacctgcccatcctgcggcaccagggccagcagctggccaacaagctgcagtgcccctttgtggatgtgcctgctggcacctaccccaggaagttcaatgagacccagatcaagcaggccctgcggggcgtgctggagagcgtgaagcacaacctggatgtggtgagccccatcccagccaacaaggacctgtctgaggccgacctgcgcatcgtgatgtgtgccatgtgtggggaccccttctctgtggacctgatcctgagccccttcctggacagccacagctgcagcgctgcccaggccggccagaacaacagcctgatgctggacaagatcatcggggagaagagaagacgcatccagatcaccatcctgagctaccacagcagcattggagtgaggaaggatgagctggtgcacggctacatcctggtgtacagcgccaagaggaaggcctccatgggcatgctgcgggccttcctgtctgaggtgcaggacaccatccctgtgcagctggtggccgtgacagacagccaggccgacttctttgaaaatgaggccatcaaggagctgatgacagaaggagagcacatcgccacagagatcacagccaagttcaccgccctgtacagcctgagccagtaccaccggcagacagaggtgttcaccctcttcttcagtgatgtgctggagaagaagaacatgattgagaacagctacctgagtgacaacacccgggagagcacccaccagagtgaagatgtgttcctgcccagcccccgggactgcttcccctacaacaactacccagacagtgatgatgacacagaggcccccccaccctacagccccatcggagatgatgtgcagctgctgcccacccccagcgacaggagccgctaccgcctggacctggagggcaatgagtaccccatccacagcacccccaactgccacgaccacgagaggaaccacaaggtgcccccacccatcaagcccaagcctgtggtgcccaagaccaacgtgaagaagctggaccccaacctgctgaagaccatcgaggccggcatcggcaagaaccccaggaagcagaccagccgggtgcccctggcccaccctgaggacatggaccccagcgacaactatgcagagcccatcgacaccatcttcaagcagaagggctacagtgatgagatctacgtggtgcctgatgacagccagaaccgcatcaagatccggaacagctttgtgaacaacacccagggagatgaggagaatggcttcagtgacaggaccagcaagagccatggagagcggcggcccagcaagtacaagtacaagagcaagaccctcttcagcaaggccaagagctactacagaaggacccacagtgatgccagtgatgatgaggccttcaccaccagcaagaccaagaggaagggccgccaccggggcagcgaggaggaccccctgctgagccctgtggagacctggaagggcggcatcgacaacccagccatcaccagtgaccaggagctggatgacaagaagatgaagaagaagacccacaaggtgaaggaggacaagaagaagaagaagaccaagaacttcaacccccccaccaggaggaactgggagagcaactacttcggcatgcccctgcaggacctggtgacagctgagaagcccatccccctgtttgtggagaagtgtgtggagttcatcgaggacaccggcctgtgcacagagggcctgtacagagtgtctggcaacaagacagaccaggacaacatccagaagcagtttgaccaggaccacaacatcaacctggtgtccatggaggtgacagtgaatgctgtggccggggccctgaaggccttctttgctgacctgcctgaccccctcatcccctacagcctgcaccctgagctgctggaggccgccaagatcccagacaagacagagcggctgcacgccctgaaggagatcgtgaagaagttccaccctgtgaactatgatgtgttccgctacgtgatcacccacctgaacagagtgtcccagcagcacaagatcaacctgatgacagctgacaacctgagcatctgcttctggcccaccctgatgaggccagactttgagaaccgggagttcctgagcaccaccaagatccaccagagcgtggtggagaccttcatccagcagtgccagttcttcttctacaacggggagatcgtggagaccaccaacatcgtggcccctcctccacccagcaaccctggccagctggtggagcccatggtgcccctgcagctgcccccacccctgcagccccagctgatccagccccagctgcagacagaccccctgggcatcatctag

SEQ ID NO: 167945 - DNA, 726 bp, Artificial Sequence
  Description of Artificial Sequence: Synthetic coding sequence
atgcccctgcaggacctggtgacagctgagaagcccatccccctgtttgtggagaagtgtgtggagttcatcgaggacaccggcctgtgcacagagggcctgtacagagtgtctggcaacaagacagaccaggacaacatccagaagcagtttgaccaggaccacaacatcaacctggtgtccatggaggtgacagtgaatgctgtggccggggccctgaaggccttctttgctgacctgcctgaccccctcatcccctacagcctgcaccctgagctgctggaggccgccaagatcccagacaagacagagcggctgcacgccctgaaggagatcgtgaagaagttccaccctgtgaactatgatgtgttccgctacgtgatcacccacctgaacagagtgtcccagcagcacaagatcaacctgatgacagctgacaacctgagcatctgcttctggcccaccctgatgaggccagactttgagaaccgggagttcctgagcaccaccaagatccaccagagcgtggtggagaccttcatccagcagtgccagttcttcttctacaacggggagatcgtggagaccaccaacatcgtggcccctcctccacccagcaaccctggccagctggtggagcccatggtgcccctgcagctgcccccacccctgcagccccagctgatccagccccagctgcagacagaccccctgggcatcatctag

SEQ ID NO: 167946 - DNA, 4509 bp, Artificial Sequence; identical to SEQ ID NO: 167942
  Description of Artificial Sequence: Synthetic coding sequence

SEQ ID NO: 167947 - DNA, 414 bp, Artificial Sequence
  Description of Artificial Sequence: Synthetic coding sequence
atgcccctgcaggacctggtgacagctgagaagcccatccccctgtttgtggagaagtgtgtggagttcatcgaggacaccggcctgtgcacagagggcctgtacagagtgtctggcaacaagacagaccaggacaacatccagaagcagtttgaccaggaccacaacatcaacctggtgtccatggaggtgacagtgaatgctgtggccggggccctgaaggccttctttgctgacctgcctgaccccctcatcccctacagcctgcaccctgagctgctggaggccgccaagatcccagacaagacagagcggctgcacgccctgaaggagatcgtgaagaagttccaccctgtgaactatgatgtgttccgctacgtgatcacccacctgaacagagtgtcccagcagtag

SEQ ID NO: 167948 - DNA, 114 bp, Artificial Sequence
  Description of Artificial Sequence: Synthetic coding sequence
atgatggccaagaacaaggagccccggccccccagctacaccatcagcatcgtgggcctgtctggaacagagaaggacaagggcaactgtggggtgggcaagagctgcctgtag

SEQ ID NO: 167949 - DNA, 423 bp, Artificial Sequence
  Description of Artificial Sequence: Synthetic coding sequence
atgatggccaagaacaaggagccccggccccccagctacaccatcagcatcgtgggcctgtctggaacagagaaggacaagggcaactgtggggtgggcaagagctgcctgtgcaacagatttgtgcgcagcaaggcagatgagtactacccagagcacacctctgtgctgagcaccatcgactttggaggccgggtggtgaacaatgaccacttcctgtactggggagacatcatccagaacagtgaagatggagtggagtgcaagatccacgtgattgagcagacagagttcattgatgaccagaccttcctgccccacaggagcaccaacctgcagccctacatcaagagagctgctgccagcaagctgcagagcgctgagaagctgatgtacatctgcacagaccagctgggcctgtag

SEQ ID NO: 167950 - DNA, 4506 bp, Artificial Sequence; identical to SEQ ID NO: 167944
  Description of Artificial Sequence: Synthetic coding sequence

SEQ ID NO: 167951 - DNA, 2316 bp, Artificial Sequence
  Description of Artificial Sequence: Synthetic coding sequence
atgagcggccgctctgtgcggctgcggtctgtgcccatccagagcctgtctgagctggagcgggcccggctgcaggaggtggccttctaccagctgcagcaggactgtgacctgagctgccagatcaccatccccaaggatggccagaagaggaagaagagcctgaggaagaagctggacagcctgggcaaggagaagaacaaggacaaggagttcatcccccaggccttcggcatgcccctgagccaggtgattgccaatgaccgggcctacaagctgaagcaggacctgcagagagatgagcagaaggatgccagtgactttgtggccagcctgctgccctttggaaacaagaggcagaacaaggagctgagcagcagcaacagcagcctgagcagcaccagcgagaccccaaatgaaagcaccagccccaacaccccagagcccgccccccgggccaggagaagaggagccatgtctgtggacagcatcacagacctggatgacaaccagagccggctgctggaggccctgcagctgagcctgcctgctgaggcccagagcaagaaggagaaggcccgggacaagaagctgagcctgaaccccatctaccggcaggtgccccggctggtggacagctgctgccagcacctggagaagcacggcctgcagacagtgggcatcttccgggtgggcagcagcaagaagagggtgcggcagctgcgggaggagtttgaccggggcattgatgtgtccctggaggaggagcacagcgtgcatgatgtggccgccctgctgaaggagttcctgcgggacatgccagaccccctgctgacccgggagctgtacacagccttcatcaacaccctgctgctggagcctgaggagcagctgggcaccctgcagctgctgatctacctgctgcccccctgcaactgtgacaccctgcaccggctgctgcagttcctgagcatcgtggcccggcatgctgatgacaacatcagcaaggatggccaggaggtgacaggcaacaagatgaccagcctgaacctggccaccatcttcggccccaacctgctgcacaagcagaagagcagtgacaaggagttctctgtgcagagcagcgcccgggcagaggagagcacagccatcatcgctgtggtgcagaagatgattgaaaattatgaggccctcttcatggtgcccccagacctgcagaatgaggtgctgatcagcctgctggagacagatcctgatgtggtggactacctgctgcggaggaaggccagccagagcagcagcccagacatgctgcagagcgaggtgtccttctctgtgggcggccgccacagcagcacagacagcaacaaggccagcagcggggacatcagcccctatgacaacaacagccctgtgctgtctgagaggagcctgctggccatgcaggaggatgctgcccctgggggcagcgagaagctgtacagagtgcccggccagttcatgctggtgggccacctgagcagcagcaagagccgggagagcagccctggcccccggctgggcaaggacctgtctgaggagccctttgacatctggggcacctggcacagcaccctgaagagcggcagcaaggaccccggcatgacaggcagcagcggggacatctttgagagcagcagcctgcgggccggcccctgcagcctgagccagggcaacctgagccccaactggccccgctggcagggcagccctgctgagctggacagcgacacccagggcgcccggaggacccaggccgccgccccagccacagagggccgggcccaccctgctgtgtcccgggcctgcagcaccccccacgtgcaggtggccggcaaggccgagcggcccacagcccggtctgagcagtacctgaccctgagcggggcccatgacctgtctgagagcgagctggatgtggccggcctgcagagccgggccaccccccagtgccagaggccccacggcagcggcagagatgacaagaggcctcctccaccctacccaggccctgggaagccagctgctgctgctgcctggatccagggccccccagagggcgtggagacccccacagaccagggcggccaggccgctgagcgggagcagcaggtgacccagaagaagctgagcagcgccaacagcctgcctgctggggagcaggacagcccccggctgggagatgctggctggctggactggcagcgggagcgctggcagatctgggagctgctgagcacagacaacccagatgccctgcctgagaccctggtgtag

SEQ ID NO: 167952 - DNA, 2925 bp, Artificial Sequence
  Description of Artificial Sequence: Synthetic coding sequence
atgtctgcccagagcctgctgcacagcgtcttcagctgcagcagccctgccagcagcagcgctgccagcgccaagggcttcagcaagaggaagctgcggcagaccaggagcctggaccctgccctgattggaggctgcggcagtgatgaagctggagctgagggcagcgcccggggggccacagctggccgcctgtacagccccagcctgcctgctgagagcctgggcccccggctggccagcagcagccggggccccccaccccgggccacccggctgcccccacctggccccctgtgcagcagcttcagcacccccagcaccccccaggagaagagccccagcggcagcttccactttgattatgaggtgcccctgggccggggcggcctgaagaagtccatggcctgggacctgcccagcgtgctggccggccctgccagcagccgcagcgccagcagcatcctgtgcagcagcggcggcggccccaacggcatctttgccagcccccggcgctggctgcagcagaggaagttccagagccccccagacagccggggccacccctacgtggtgtggaagtctgagggggacttcacctggaacagcatgagcggccgctctgtgcggctgcggtctgtgcccatccagagcctgtctgagctggagcgggcccggctgcaggaggtggccttctaccagctgcagcaggactgtgacctgagctgccagatcaccatccccaaggatggccagaagaggaagaagagcctgaggaagaagctggacagcctgggcaaggagaagaacaaggacaaggagttcatcccccaggccttcggcatgcccctgagccaggtgattgccaatgaccgggcctacaagctgaagcaggacctgcagagagatgagcagaaggatgccagtgactttgtggccagcctgctgcccttcggcaacaagaggcagaacaaggagctgagcagcagcaacagcagcctgagcagcaccagcgagaccccaaatgaaagcaccagccccaacaccccagagcccgccccccgggcccggcggcggggggccatgtctgtggacagcatcacagacctggatgacaaccagagccggctgctggaggccctgcagctgagcctgcctgctgaggcccagagcaagaaggagaaggcccgggacaagaagctgagcctgaaccccatctaccggcaggtgccccggctggtggacagctgctgccagcacctggagaagcacggcctgcagacagtgggcatcttccgggtgggcagcagcaagaagagggtgcggcagctgcgggaggagtttgaccggggcattgatgtgtccctggaggaggagcacagcgtgcatgatgtggccgccctgctgaaggagttcctgcgggacatgccagaccccctgctgacccgggagctgtacacagccttcatcaacaccctgctgctggagcctgaggagcagctgggcaccctgcagctgctgatctacctgctgcccccctgcaactgtgacaccctgcaccggctgctgcagttcctgagcatcgtggcccggcatgctgatgacaacatcagcaaggatggccaggaggtgactggaaacaagatgaccagcctgaacctggccaccatcttcggccccaacctgctgcacaagcagaagagcagtgacaaggagttctctgtgcagagcagcgcccgggcagaggagagcacagccatcatcgctgtggtgcagaagatgattgagaactatgaggccctcttcatggtgcccccagacctgcagaatgaggtgctgatcagcctgctggagacagatcctgatgtggtggactacctgctgcggaggaaggccagccagagcagcagcccagacatgctgcagagcgaggtgtccttctctgtgggcggccgccacagcagcacagacagcaacaaggccagcagcggggacatcagcccctatgacaacaacagccctgtgctgtctgagaggagcctgctggccatgcaggaggatgctgcccctgggggcagcgagaagctgtacagagtgcccggccagttcatgctggtgggccacctgagcagcagcaagagccgggagagcagccctggcccccggctgggcaaggacctgtctgaggagccctttgacatctggggcacctggcacagcaccctgaagagcggcagcaaggaccccggcatgacaggcagcagcggggacatctttgagagcagcagcctgcgggccggcccctgcagcctgagccagggcaacctgagccccaactggccccgctggcagggcagccctgctgagctggacagcgacacccagggcgcccggaggacccaggccgccgccccagccacagagggccgggcccaccctgctgtgtcccgggcctgcagcacccctcatgtgcaggtggccggcaaggccgagcggcccacagcccggtctgagcagtacctgaccctgagcggggcccatgacctgtctgagagcgagctggatgtggccggcctgcagagccgggccaccccccagtgccagaggcctcatggcagcggcagagatgacaagaggcctcctccaccctacccaggccctgggaagccagctgctgctgctgcctggatccagggccccccagagggcgtggagacccccacagaccagggcggccaggccgctgagcgggagcagcaggtgacccagaagaagctgagcagcgccaacagcctgcctgctggggagcaggacagcccccggctgggagatgctggctggctggactggcagcgggagcgctggcagatctgggagctgctgagcacagacaacccagatgccctgcctgagaccctggtgtag

SEQ ID NO: 167953 - DNA, 1806 bp, Artificial Sequence
  Description of Artificial Sequence: Synthetic coding sequence
ctggagctgtatgacctgcagatcctgggcaccaagccacccatgaacagcgacacccacaggaactttgaccccacagccaccctgaggaaccagggcgacttcacctggaacagcatgagcggccgctctgtgcggctgcggtctgtgcccatccagagcctgtctgagctggagcgggcccggctgcaggaggtggccttctaccagctgcagcaggactgtgacctgagctgccagatcaccatccccaaggatggccagaagaggaagaagagcctgaggaagaagctggacagcctgggcaaggagaagaacaaggacaaggagttcatcccccaggccttcggcatgcccctgagccaggtgattgccaatgaccgggcctacaagctgaagcaggacctgcagagagatgagcagaaggatgccagtgactttgtggccagcctgctgcccttcggcaacaagaggcagaacaaggagctgagcagcagcaacagcagcctgagcagcaccagcgagaccccaaatgaaagcaccagccccaacaccccagagcccgccccccgggcccggcggcggggggccatgtctgtggacagcatcacagacctggatgacaaccagagccggctgctggaggccctgcagctgagcctgcctgctgaggcccagagcaagaaggagaaggcccgggacaagaagctgagcctgaaccccatctaccggcaggtgccccggctggtggacagctgctgccagcacctggagaagcacggcctgcagacagtgggcatcttccgggtgggcagcagcaagaagagggtgcggcagctgcgggaggagtttgaccggggcattgatgtgtccctggaggaggagcacagcgtgcatgatgtggccgccctgctgaaggagttcctgcgggacatgccagaccccctgctgacccgggagctgtacacagccttcatcaacaccctgctgctggagcctgaggagcagctgggcaccctgcagctgctgatctacctgctgcccccctgcaactgtgacaccctgcaccggctgctgcagttcctgagcatcgtggcccggcatgctgatgacaacatcagcaaggatggccaggaggtgactggaaacaagatgaccagcctgaacctggccaccatcttcggccccaacctgctgcacaagcagaagagcagtgacaaggagttctctgtgcagagcagcgcccgggcagaggagagcacagccatcatcgctgtggtgcagaagatgattgagaactatgaggccctcttcatggtgcccccagacctgcagaatgaggtgctgatcagcctgctggagacagatcctgatgtggtggactacctgctgcggaggaaggccagccagagcagcagcccagacatgctgcagagcgaggtgtccttctctgtgggcggccgccacagcagcacagacagcaacaaggccagcagcggggacatcagcccctatgacaacaacagccctgtgctgtctgagaggagcctgctggccatgcaggaggatgctgcccctgggggcagcgagaagctgtacagagtgcccggccagttcatgctggtgggccacctgagcagcagcaagagccgggagagcagccctggcccccggctgggcaaaggaaactggagcctggccagccgccgctggcccaagcaggccaccctgctgctgctgcacgtggcctggtgtggggccctgcggaccttcagcagcagcctgccctacctgatgttcctgtag

SEQ ID NO: 167954 - DNA, 2298 bp, Artificial Sequence
  Description of Artificial Sequence: Synthetic coding sequence
atgtctgcccagagcctgctgcacagcgtcttcagctgcagcagccctgccagcagcagcgctgccagcgccaagggcttcagcaagaggaagctgcggcagaccaggagcctggaccctgccctgattggaggctgcggcagtgatgaagctggagctgagggcagcgcccggggggccacagctggccgcctgtacagccccagcctgcctgctgagagcctgggcccccggctggccagcagcagccggggccccccaccccgggccacccggctgcccccacctggccccctgtgcagcagcttcagcacccccagcaccccccaggagaagagccccagcggcagcttccactttgattatgaggtgcccctgggccggggcggcctgaagaagtccatggcctgggacctgcccagcgtgctggccggccctgccagcagccgcagcgccagcagcatcctgtgcagcagcggcggcggccccaacggcatctttgccagcccccggcgctggctgcagcagaggaagttccagagccccccagacagccggggccacccctacgtggtgtggaagtctgagggggacttcacctggaacagcatgagcggccgctctgtgcggctgcggtctgtgcccatccagagcctgtctgagctggagcgggcccggctgcaggaggtggccttctaccagctgcagcaggactgtgacctgagctgccagatcaccatccccaaggatggccagaagaggaagaagagcctgaggaagaagctggacagcctgggcaaggagaagaacaaggacaaggagttcatcccccaggccttcggcatgcccctgagccaggtgattgccaatgaccgggcctacaagctgaagcaggacctgcagagagatgagcagaaggatgccagtgactttgtggccagcctgctgcccttcggcaacaagaggcagaacaaggagctgagcagcagcaacagcagcctgagcagcaccagcgagaccccaaatgaaagcaccagccccaacaccccagagcccgccccccgggcccggcggcggggggccatgtctgtggacagcatcacagacctggatgacaaccagagccggctgctggaggccctgcagctgagcctgcctgctgaggcccagagcaagaaggagaaggcccgggacaagaagctgagcctgaaccccatctaccggcaggtgccccggctggtggacagctgctgccagcacctggagaagcacggcctgcagacagtgggcatcttccgggtgggcagcagcaagaagagggtgcggcagctgcgggaggagtttgaccggggcattgatgtgtccctggaggaggagcacagcgtgcatgatgtggccgccctgctgaaggagttcctgcgggacatgccagaccccctgctgacccgggagctgtacacagccttcatcaacaccctgctgctggagcctgaggagcagctgggcaccctgcagctgctgatctacctgctgcccccctgcaactgtgacaccctgcaccggctgctgcagttcctgagcatcgtggcccggcatgctgatgacaacatcagcaaggatggccaggaggtgactggaaacaagatgaccagcctgaacctggccaccatcttcggccccaacctgctgcacaagcagaagagcagtgacaaggagttctctgtgcagagcagcgcccgggcagaggagagcacagccatcatcgctgtggtgcagaagatgattgagaactatgaggccctcttcatggtgcccccagacctgcagaatgaggtgctgatcagcctgctggagacagatcctgatgtggtggactacctgctgcggaggaaggccagccagagcagcagcccagacatgctgcagagcgaggtgtccttctctgtgggcggccgccacagcagcacagacagcaacaaggccagcagcggggacatcagcccctatgacaacaacagccctgtgctgtctgagaggagcctgctggccatgcaggaggatgctgcccctgggggcagcgagaagctgtacagagtgcccggccagttcatgctggtgggccacctgagcagcagcaagagccgggagagcagccctggcccccggctgggcaaaggaaactggagcctggccagccgccgctggcccaagcaggccaccctgctgctgctgcacgtggcctggtgtggggccctgcggaccttcagcagcagcctgccctacctgatgttcctgtag

SEQ ID NO: 167955 - DNA, 2073 bp, Artificial Sequence
  Description of Artificial Sequence: Synthetic coding sequence
atgtctgcccagagcctgctgcacagcgtcttcagctgcagcagccctgccagcagcagcgctgccagcgccaagggcttcagcaagaggaagctgcggcagaccaggagcctggaccctgccctgattggaggctgcggcagtgatgaagctggagctgagggcagcgcccggggggccacagctggccgcctgtacagccccagcctgcctgctgagagcctgggcccccggctggccagcagcagccggggccccccaccccgggccacccggctgcccccacctggccccctgtgcagcagcttcagcacccccagcaccccccaggagaagagccccagcggcagcttccactttgattatgaggtgcccctgggccggggcggcctgaagaagtccatggcctgggacctgcccagcgtgctggccggccctgccagcagccgcagcgccagcagcatcctgtgcagcagcggcggcggccccaacggcatctttgccagcccccggcgctggctgcagcagaggaagttccagagccccccagacagccggggccacccctacgtggtgtggaagtctgagctggagctgtatgacctgcagatcctgggcaccaagccacccatgaacagcgacacccacaggaactttgaccccacagccaccctgaggaaccagggcgacttcacctggaacagcatgagcggccgctctgtgcggctgcggtctgtgcccatccagagcctgtctgagctggagcgggcccggctgcaggaggtggccttctaccagctgcagcaggactgtgacctgagctgccagatcaccatccccaaggatggccagaagaggaagaagagcctgaggaagaagctggacagcctgggcaaggagaagaacaaggacaaggagttcatcccccaggccttcggcatgcccctgagccaggtgattgccaatgaccgggcctacaagctgaagcaggacctgcagagagatgagcagaaggatgccagtgactttgtggccagcctgctgcccttcggcaacaagaggcagaacaaggagctgagcagcagcaacagcagcctgagcagcaccagcgagaccccaaatgaaagcaccagccccaacaccccagagcccgccccccgggcccggcggcggggggccatgtctgtggacagcatcacagacctggatgacaaccagagccggctgctggaggccctgcagctgagcctgcctgctgaggcccagagcaagaaggagaaggcccgggacaagaagctgagcctgaaccccatctaccggcaggtgccccggctggtggacagctgctgccagcacctggagaagcacggcctgcagacagtgggcatcttccgggtgggcagcagcaagaagagggtgcggcagctgcgggaggagtttgaccggggcattgatgtgtccctggaggaggagcacagcgtgcatgatgtggccgccctgctgaaggagttcctgcgggacatgccagaccccctgctgacccgggagctgtacacagccttcatcaacaccctgctgctggagcctgaggagcagctgggcaccctgcagctgctgatctacctgctgcccccctgcaactgtgacaccctgcaccggctgctgcagttcctgagcatcgtggcccggcatgctgatgacaacatcagcaaggatggccaggaggtgactggaaacaagatgaccagcctgaacctggccaccatcttcggccccaacctgctgcacaagcagaagagcagtgacaaggagttctctgtgcagagcagcgcccgggcagaggagagcacagccatcatcgctgtggtgcagaagatgattgagaactatgaggccctcttcatggtgcccccagacctgcagaatgaggtgctgatcagcctgctggagacagatcctgatgtggtggactacctgctgcggaggaaggccagccagagcagcaccagctctgtgctgcctgctgctgtgcaggcctgcccccagtacccagcctccatgttcaccccctag

SEQ ID NO: 167956 - DNA, 2316 bp, Artificial Sequence; identical to SEQ ID NO: 167951
  Description of Artificial Sequence: Synthetic coding sequence

SEQ ID NO: 167957 - DNA, 1404 bp, Artificial Sequence
  Description of Artificial Sequence: Synthetic coding sequence
atgtaccgcatctttggagacttcacctggaacagcatgagcggccgctctgtgcggctgcggtctgtgcccatccagagcctgtctgagctggagcgggcccggctgcaggaggtggccttctaccagctgcagcaggactgtgacctgagctgccagatcaccatccccaaggatggccagaagaggaagaagagcctgaggaagaagctggacagcctgggcaaggagaagaacaaggacaaggagttcatcccccaggccttcggcatgcccctgagccaggtgattgccaatgaccgggcctacaagctgaagcaggacctgcagagagatgagcagaaggatgccagtgactttgtggccagcctgctgccctttggaaacaagaggcagaacaaggagctgagcagcagcaacagcagcctgagcagcaccagcgagaccccaaatgaaagcaccagccccaacaccccagagcccgccccccgggccaggagaagaggagccatgtctgtggacagcatcacagacctggatgacaaccagagccggctgctggaggccctgcagctgagcctgcctgctgaggcccagagcaagaaggagaaggcccgggacaagaagctgagcctgaaccccatctaccggcaggtgccccggctggtggacagctgctgccagcacctggagaagcacggcctgcagacagtgggcatcttccgggtgggcagcagcaagaagagggtgcggcagctgcgggaggagtttgaccggggcattgatgtgtccctggaggaggagcacagcgtgcatgatgtggccgccctgctgaaggagttcctgcgggacatgccagaccccctgctgacccgggagctgtacacagccttcatcaacaccctgctgctggagcctgaggagcagctgggcaccctgcagctgctgatctacctgctgcccccctgcaactgtgacaccctgcaccggctgctgcagttcctgagcatcgtggcccggcatgctgatgacaacatcagcaaggatggccaggaggtgacaggcaacaagatgaccagcctgaacctggccaccatcttcggccccaacctgctgcacaagcagaagagcagtgacaaggagttctctgtgcagagcagcgcccgggcagaggagagcacagccatcatcgctgtggtgcagaagatgattgaaaattatgaggccctcttcatggtgcccccagacctgcagaatgaggtgctgatcagcctgctggagacagatcctgatgtggtggactacctgctgcggaggaaggccagccagagcagcaccagctctgtgctgcctgctgctgtgcaggcctgcccccagtacccagcctccatgttcaccccctag

SEQ ID NO: 167958 - DNA, 1815 bp, Artificial Sequence
  Description of Artificial Sequence: Synthetic coding sequence
atgaagaggctgcacatcttcggccccaagatccacagcagcggcggcctgtggcagcagaagggggacttcacctggaacagcatgagcggccgctctgtgcggctgcggtctgtgcccatccagagcctgtctgagctggagcgggcccggctgcaggaggtggccttctaccagctgcagcaggactgtgacctgagctgccagatcaccatccccaaggatggccagaagaggaagaagagcctgaggaagaagctggacagcctgggcaaggagaagaacaaggacaaggagttcatcccccaggccttcggcatgcccctgagccaggtgattgccaatgaccgggcctacaagctgaagcaggacctgcagagagatgagcagaaggatgccagtgactttgtggccagcctgctgccctttggaaacaagaggcagaacaaggagctgagcagcagcaacagcagcctgagcagcaccagcgagaccccaaatgaaagcaccagccccaacaccccagagcccgccccccgggccaggagaagaggagccatgtctgtggacagcatcacagacctggatgacaaccagagccggctgctggaggccctgcagctgagcctgcctgctgaggcccagagcaagaaggagaaggcccgggacaagaagctgagcctgaaccccatctaccggcaggtgccccggctggtggacagctgctgccagcacctggagaagcacggcctgcagacagtgggcatcttccgggtgggcagcagcaagaagagggtgcggcagctgcgggaggagtttgaccggggcattgatgtgtccctggaggaggagcacagcgtgcatgatgtggccgccctgctgaaggagttcctgcgggacatgccagaccccctgctgacccgggagctgtacacagccttcatcaacaccctgctgctggagcctgaggagcagctgggcaccctgcagctgctgatctacctgctgcccccctgcaactgtgacaccctgcaccggctgctgcagttcctgagcatcgtggcccggcatgctgatgacaacatcagcaaggatggccaggaggtgacaggcaacaagatgaccagcctgaacctggccaccatcttcggccccaacctgctgcacaagcagaagagcagtgacaaggagttctctgtgcagagcagcgcccgggcagaggagagcacagccatcatcgctgtggtgcagaagatgattgaaaattatgaggccctcttcatggtgcccccagacctgcagaatgaggtgctgatcagcctgctggagacagatcctgatgtggtggactacctgctgcggaggaaggccagccagagcagcagcccagacatgctgcagagcgaggtgtccttctctgtgggcggccgccacagcagcacagacagcaacaaggccagcagcggggacatcagcccctatgacaacaacagccctgtgctgtctgagaggagcctgctggccatgcaggaggatgctgcccctgggggcagcgagaagctgtacagagtgcccggccagttcatgctggtgggccacctgagcagcagcaagagccgggagagcagccctggcccccggctgggcaaggacctgtctgaggagccctttgacatctggggcacctggcacagcaccctgaagagcggcagcaaggaccccggcatgacaggcaccacccccctgctgaacatcagcagccaggaggaccaccggcagaaggacctgcggctcatcttcaagatctacccctag

SEQ ID NO: 167959 - DNA, 918 bp, Artificial Sequence
  Description of Artificial Sequence: Synthetic coding sequence
atggccggccaggaccctgccctgagcaccagccaccccttctatgatgtggcccggcacggcatcctgcaggtggccggagatgacagatttggaagaagagtggtgaccttcagctgctgcaggatgccacccagccatgagctggaccaccagaggctgctggagtacctgaagtacaccctggaccagtatgtggagaatgactacaccatcgtgtacttccactacggcctgaacagcaggaacaagcccagcctgggctggctgcagagcgcctacaaggagtttgacaggaagtacaagaagaacctgaaggccctgtatgtggtgcaccccaccagcttcatcaaggtgctgtggaacatcctgaagcccctcatcagccacaagtttgggaagaaggtgatctacttcaactacctgtctgagctgcacgagcacctgaagtatgaccagctggtgattcctcctgaggtgctgcgctatgatgagaagctgcagagcctgcacgagggccgcaccccaccacccaccaagaccccaccaccccggccccccctgcccacccagcagtttggagtgtccctgcagtacctgaaggacaagaaccagggcgagctgatcccccctgtgctgcgcttcaccgtgacctacctgcgggagaagggcctgaggacagagggcctcttccgccgcagcgcctctgtgcagacagtgcgggagatccagaggctgtacaaccagggcaagcctgtgaactttgatgattatggagacatccacatcccagctgtgatcctgaagaccttcctgcgggagctgccccagcccctgctgaccttccaggcctatgagcagatcctgggcatcacctgtgtgcctggagagcacctgcagcagaatgagcagctgtag

SEQ ID NO: 167960 - DNA, 1302 bp, Artificial Sequence
  Description of Artificial Sequence: Synthetic coding sequence
atggccggccaggaccctgccctgagcaccagccaccccttctatgatgtggcccggcacggcatcctgcaggtggccggagatgacagatttggaagaagagtggtgaccttcagctgctgcaggatgccacccagccatgagctggaccaccagaggctgctggagtacctgaagtacaccctggaccagtatgtggagaatgactacaccatcgtgtacttccactacggcctgaacagcaggaacaagcccagcctgggctggctgcagagcgcctacaaggagtttgacaggaagtacaagaagaacctgaaggccctgtatgtggtgcaccccaccagcttcatcaaggtgctgtggaacatcctgaagcccctcatcagccacaagtttgggaagaaggtgatctacttcaactacctgtctgagctgcacgagcacctgaagtatgaccagctggtgattcctcctgaggtgctgcgctatgatgagaagctgcagagcctgcacgagggccgcaccccaccacccaccaagaccccaccaccccggccccccctgcccacccagcagtttggagtgtccctgcagtacctgaaggacaagaaccagggcgagctgatcccccctgtgctgcgcttcaccgtgacctacctgcgggagaagggcctgaggacagagggcctcttccgccgcagcgcctctgtgcagacagtgcgggagatccagaggctgtacaaccagggcaagcctgtgaactttgatgattatggagacatccacatcccagctgtgatcctgaagaccttcctgcgggagctgccccagcccctgctgaccttccaggcctatgagcagatcctgggcatcacctgtgtggagagcagcctgcgggtgacaggctgccggcagatcctgcggagcctgcctgagcacaactacgtggtgctgcgctacctgatgggcttcctgcatgctgtgtcccgggagagcatcttcaacaagatgaacagcagcaacctggcctgtgtgtttggcctgaacctgatctggcccagccagggcgtgagcagcctgagcgccctggtgcccctgaacatgttcacagagctgctgattgagtactatgagaagatcttcagcaccccagaggcccctggagagcacggcctggccccctgggagcagggcagcagagctgcccccctgcaggaggccgtgcccaggacccaggccaccggcctgaccaagcccaccctgccccccagccccctgatggccgcccggcggcggctgtag

SEQ ID NO: 167961 - DNA, 1668 bp, Artificial Sequence
  Description of Artificial Sequence: Synthetic coding sequence
atgagcagccccagcctgagtgacctgggcaagcgggagcctgctgctgctgctgatgagcggggcacccagcagaggcgggcctgtgccaatgccacctggaacagcatccacaatggagtgattgctgtgttccagaggaagggcctgcctgaccaggagctgttcagcctgaatgaaggagtgcggcagctgctgaagacagagctgggcagcttcttcacagagtacctgcagaaccagctgctgaccaagggcatggtgatcctgcgggacaagatccgcttctatgaggagctgcagagggacaaggctgctgctgctgctgtgctgggcgctgtgaggaagaggccttctgtggtgcccatggccggccaggaccctgccctgagcaccagccaccccttctatgatgtggcccggcacggcatcctgcaggtggccggagatgacagatttggaagaagagtggtgaccttcagctgctgcaggatgccacccagccatgagctggaccaccagaggctgctggagtacctgaagtacaccctggaccagtatgtggagaatgactacaccatcgtgtacttccactacggcctgaacagcaggaacaagcccagcctgggctggctgcagagcgcctacaaggagtttgacaggaagtacaagaagaacctgaaggccctgtatgtggtgcaccccaccagcttcatcaaggtgctgtggaacatcctgaagcccctcatcagccacaagtttgggaagaaggtgatctacttcaactacctgtctgagctgcacgagcacctgaagtatgaccagctggtgattcctcctgaggtgctgcgctatgatgagaagctgcagagcctgcacgagggccgcaccccaccacccaccaagaccccaccaccccggccccccctgcccacccagcagtttggagtgtccctgcagtacctgaaggacaagaaccagggcgagctgatcccccctgtgctgcgcttcaccgtgacctacctgcgggagaagggcctgaggacagagggcctcttccgccgcagcgcctctgtgcagacagtgcgggagatccagaggctgtacaaccagggcaagcctgtgaactttgatgattatggagacatccacatcccagctgtgatcctgaagaccttcctgcgggagctgccccagcccctgctgaccttccaggcctatgagcagatcctgggcatcacctgtgtggagagcagcctgcgggtgacaggctgccggcagatcctgcggagcctgcctgagcacaactacgtggtgctgcgctacctgatgggcttcctgcatgctgtgtcccgggagagcatcttcaacaagatgaacagcagcaacctggcctgtgtgtttggcctgaacctgatctggcccagccagggcgtgagcagcctgagcgccctggtgcccctgaacatgttcacagagctgctgattgagtactatgagaagatcttcagcaccccagaggcccctggagagcacggcctggccccctgggagcagggcagcagagctgcccccctgcaggaggccgtgcccaggacccaggccaccggcctgaccaagcccaccctgccccccagccccctgatggccgcccggcggcggctgtag

SEQ ID NO: 167962 - DNA, 1395 bp, Artificial Sequence
  Description of Artificial Sequence: Synthetic coding sequence
atggccggccaggaccctgccctgagcaccagccaccccttctatgatgtggcccggcacggcatcctgcaggtggccggagatgacagatttggaagaagagtggtgaccttcagctgctgcaggatgccacccagccatgagctggaccaccagaggctgctggagtacctgaagtacaccctggaccagtatgtggagaatgactacaccatcgtgtacttccactacggcctgaacagcaggaacaagcccagcctgggctggctgcagagcgcctacaaggagtttgacaggaaggatggagacctgaccatgtggccccggctggtgagcaacagcaagctgaagaggagcagccacctgagcctgcccaagtactgggactaccgctacaagaagaacctgaaggccctgtatgtggtgcaccccaccagcttcatcaaggtgctgtggaacatcctgaagcccctcatcagccacaagtttgggaagaaggtgatctacttcaactacctgtctgagctgcacgagcacctgaagtatgaccagctggtgatccccccagaggtgctgcgctatgatgagaagctgcagagcctgcacgagggccgcaccccaccacccaccaagaccccaccacccaggcctcccctgcccacccagcagtttggagtgtccctgcagtacctgaaggacaagaaccagggcgagctgatcccccctgtgctgcgcttcaccgtgacctacctgcgggagaagggcctgaggacagagggcctcttcagaagaagtgcctctgtgcagacagtgcgggagatccagaggctgtacaaccagggcaagcctgtgaactttgatgattatggagacatccacatcccagctgtgatcctgaagaccttcctgcgggagctgccccagcccctgctgaccttccaggcctatgagcagatcctgggcatcacctgtgtggagagcagcctgcgggtgacaggctgccggcagatcctgcggagcctgcctgagcacaactacgtggtgctgcgctacctgatgggcttcctgcatgctgtgtcccgggagagcatcttcaacaagatgaacagcagcaacctggcctgtgtgtttggcctgaacctgatctggcccagccagggcgtgagcagcctgagcgccctggtgcccctgaacatgttcacagagctgctgattgagtactatgagaagatcttcagcaccccagaggcccctggagaacatggcctggccccctgggagcagggcagccgggccgcccccctgcaggaggccgtgcccaggacccaggccaccggcctgaccaagcccaccctgccccccagccccctgatggccgcccggcggcggctgtag

SEQ ID NO: 167963 - DNA, 393 bp, Artificial Sequence
  Description of Artificial Sequence: Synthetic coding sequence
atggccggccaggaccctgccctgagcaccagccaccccttctatgatgtggcccggcacggcatcctgcaggtggccggagatgacagatttggaagaagagtggtgaccttcagctgctgcaggatgccacccagccatgagctggaccaccagaggctgctggagtacctgaagtacaccctggaccagtatgtggagaatgactacaccatcgtgtacttccactacggcctgaacagcaggaacaagcccagcctgggctggctgcagagcgcctacaaggagtttgacaggaaggatggagacctgaccatgtggccccggctggtgagcaacagcaagctgaagaggagcagccacctgagcctgcccaagtactgggactactag

SEQ ID NO: 167964 - DNA, 348 bp, Artificial Sequence
  Description of Artificial Sequence: Synthetic coding sequence
atggccggccaggaccctgccctgagcaccagccaccccttctatgatgtggcccggcacggcatcctgcaggtggccggagatgacagatttggaagaagagtggtgaccttcagctgctgcaggatgccacccagccatgagctggaccaccagaggctgctggagtacctgaagtacaccctggaccagtatgtggagaatgactacaccatcgtgtacttccactacggcctgaacagcaggaacaagcccagcctgggctggctgcagagcgcctacaaggagtttgacaggaagtacaagaagaacctgaaggccctgtatgtggtgcaccccaccagctag

SEQ ID NO: 167965 - DNA, 1932 bp, Artificial Sequence
  Description of Artificial Sequence: Synthetic coding sequence
atgaggaccctgcggcggctgaagttcatgagcagccccagcctgagtgacctgggcaagcgggagcctgctgctgctgctgatgagcggggcacccagcagaggcgggcctgtgccaatgccacctggaacagcatccacaacggggtgattgctgtgttccagaggaagggcctgcctgaccaggagctgttcagcctgaatgaaggagtgcggcagctgctgaagacagagctgggcagcttcttcacagagtacctgcagaaccagctgctgaccaagggcatggtgatcctgcgggacaagatccgcttctatgagggccagaagctgctggacagcctggccgagacctgggacttcttcttcagtgatgtgctgcccatgctgcaggccatcttctaccctgtgcagggcaaggagcccagcgtgcggcagctggccctgctgcacttcagaaatgccatcaccctgtctgtgaagctggaggatgccctggcccgggcccacgcccgggtgcccccagccatcgtgcagatgctgctggtgctgcagggcgtgcatgagagccggggcgtgacagaggactacctgcggctggagaccctggtgcagaaggtggtgagcccctacctgggcacctacggcctgcacagcagcgagggccccttcacccacagctgcatcctggagctgcagagggacaaggctgctgctgctgctgtgctgggcgctgtgaggaagaggccttctgtggtgcccatggccggccaggaccctgccctgagcaccagccaccccttctatgatgtggcccggcacggcatcctgcaggtggccggagatgacagatttggaagaagagtggtgaccttcagctgctgcaggatgccacccagccatgagctggaccaccagaggctgctggagtacaagaagaacctgaaggccctgtatgtggtgcaccccaccagcttcatcaaggtgctgtggaacatcctgaagcccctcatcagccacaagtttgggaagaaggtgatctacttcaactacctgtctgagctgcacgagcacctgaagtatgaccagctggtgattcctcctgaggtgctgcgctatgatgagaagctgcagagcctgcacgagggccgcaccccaccacccaccaagaccccaccaccccggccccccctgcccacccagcagtttggagtgtccctgcagtacctgaaggacaagaaccagggcgagctgatcccccctgtgctgcgcttcaccgtgacctacctgcgggagaagggcctgaggacagagggcctcttccgccgcagcgcctctgtgcagacagtgcgggagatccagaggctgtacaaccagggcaagcctgtgaactttgatgattatggagacatccacatcccagctgtgatcctgaagaccttcctgcgggagctgccccagcccctgctgaccttccaggcctatgagcagatcctgggcatcacctgtgtggagagcagcctgcgggtgacaggctgccggcagatcctgcggagcctgcctgagcacaactacgtggtgctgcgctacctgatgggcttcctgcatgctgtgtcccgggagagcatcttcaacaagatgaacagcagcaacctggcctgtgtgtttggcctgaacctgatctggcccagccagggcgtgagcagcctgagcgccctggtgcccctgaacatgttcacagagctgctgattgagtactatgagaagatcttcagcaccccagaggcccctggagagcacggcctggccccctgggagcagggcagcagagctgcccccctgcaggaggccgtgcccaggacccaggccaccggcctgaccaagcccaccctgccccccagccccctgatggccgcccggcggcggctgtag

SEQ ID NO: 167966 - DNA, 2322 bp, Artificial Sequence
  Description of Artificial Sequence: Synthetic coding sequence
cagacccagacagagagcctgaccctgtgcagcggggaggccgagcggcggggcaaggaggagtggccagacagccaccactacccaggccccaccccagcccctgagagcagtgatggcccccacaaggtgacagtgctggccaccatgctgagcagccgctggtggcccagctcctggggcatcctgggcctgggccccaggagccccccccggggcagccagctgtgtgccctgtatgccttcacctacacaggagcagatggccagcaggtgtccctggccgagggggaccgcttcctgctgctgaggaagaccaacagcgactggtggctggcccggcggctggaggcccccagcaccagccggcccatctttgtgcctgctgcctacatgattgaggagagcatccccagccagagccccaccaccgtcatccctggccagctgctgtggaccccaggccccaagctgttccacggcagcctggaggagctgagccaggccctgcccagccgggcccaggccagcagcgagcagcccccacccctgcccaggaagatgtgccgctctgtgtccacagacaacctgagccccagcctgctgaagcccttccaggagggccccagcggccgcagcctgagccaggaggacctgcccagcgaggccagcgccagcacagctggcccccagcccctgatgtctgagccccctgtgtactgcaacctggtggacctgcggcgctgccccaggagccccccacctggccctgcctgccccctgctgcagaggctggatgcctgggagcagcacctggaccccaacagcggccgctgcttctacatcaacagcctgaccggctgcaagtcctggaagcccccaagaagaagccgctctgagaccaaccctggctccatggagggcacccagaccctgaagaggaacaatgatgtgctgcagccccaggccaagggcttcagaagtgacaccggcaccccagagcccctggacccccagggcagcctgagcctgagccagaggaccagccagctggaccccccagccctgcaggccccccggcccctgccccagctgctggatgacccccatgaggtggagaagagcggcctgctgaacatgaccaagatcgcccagggcggcaggaagctgaggaagaactggggccccagctgggtggtgctgaccggcaacagcctggtgttctaccgggagcccccacccacagcccccagcagcggctggggccctgctggcagcaggcctgagagctctgtggacctgcggggagctgccctggcccacggccgccacctgagcagcagaagaaatgtgctgcacatccgcaccatccctggccacgagttcctgctgcagagcgaccacgagacagagctgcgggcctggcaccgggccctgaggacagtgattgagcggctggaccgggagaaccccctggagctgcggctgagcggcagcggccctgctgagctgtctgctggggaggatgaggaggaggagagcgagctggtgtccaagcccctgctgcggctgagcagcagaagaagcagcatccggggccctgagggcacagagcagaacagagtgaggaacaagctgaagaggctcatcgccaagaggcctcccctgcagagcctgcaggagcggggcctgctgcgggaccaggtgtttggctgccagctggagagcctgtgccagcgggagggggacacagtgcccagcttcctgcggctgtgcatcgctgctgtggacaagaggggcctggatgtggatggcatctacagagtgtctggcaacctggccgtggtgcagaagctgcgcttcctggtggaccgggagagagctgtgaccagtgatggccgctacgtgtttcctgagcagcccggccaggagggccgcctggacctggacagcacagagtgggatgacatccacgtggtgactggagccctgaagctgttcctgcgggagctgccccagcccctggtgccccccctgctgctgccccacttccgggccgccctggccctgagccagatccaggagctgattggctccatgcccaagcccaaccacgacaccctgcgctacctgctggagcacctgtgccgggtgattgcccacagcgacaagaacaggatgaccccccacaacctgggcatcgtgtttggccccaccctcttccggcctgagcaggagaccagtgaccctgctgcccacgccctgtacccaggccagctggtgcagctgatgctgaccaacttcaccagcctcttcccctag

SEQ ID NO: 167967 - DNA, 2253 bp, Artificial Sequence
  Description of Artificial Sequence: Synthetic coding sequence
atgctgagcagccgctggtggcccagctcctggggcatcctgggcctgggccccaggagccccccccggggcagccagctgtgtgccctgtatgccttcacctacaccggggctgatggccagcaggtgtccctggccgagggggaccgcttcctgctgctgaggaagaccaacagcgactggtggctggcccggcggctggaggcccccagcaccagccggcccatctttgtgcctgctgcctacatgattgaggagagcatccccagccagagccccaccaccgtcatccctggccagctgctgtggaccccaggccccaagctgttccacggcagcctggaggagctgagccaggccctgcccagccgggcccaggccagcagcgagcagcccccacccctgcccaggaagatgtgccgctctgtgtccacagacaacctgagccccagcctgctgaagcccttccaggagggccccagcggccgcagcctgagccaggaggacctgcccagcgaggccagcgccagcacagctggcccccagcccctgatgtctgagccccctgtgtactgcaacctggtggacctgcggcgctgccccaggagccccccacctggccctgcctgccccctgctgcagaggctggatgcctgggagcagcacctggaccccaacagcggccgctgcttctacatcaacagcctgaccggctgcaagtcctggaagccaccccggcgcagccgctctgagaccaaccctggctccatggagggcacccagaccctgaagagaaataatgatgtgctgcagccccaggccaagggcttcagaagtgacaccggcaccccagagcccctggacccccagggcagcctgagcctgagccagaggaccagccagctggaccccccagccctgcaggccccccggcccctgccccagctgctggatgacccccatgaggtggagaagagcggcctgctgaacatgaccaagatcgcccagggcggcaggaagctgaggaagaactggggccccagctgggtggtgctgactggaaacagcctggtgttctaccgggagcccccacccacagcccccagcagcggctggggccctgctggcagcaggcctgagagctctgtggacctgcggggggccgccctggcccacggccgccacctgagcagcagaagaaatgtgctgcacatccgcaccatccctggccacgagttcctgctgcagagcgaccatgaaacagagctgcgggcctggcaccgggccctgaggacagtcatcgagcggctggtgcgctgggtggaggcccggcgggaggcccccaccggccgggaccagggcagcggggaccgggagaaccccctggagctgcggctgagcggcagcggccctgctgagctgtctgctggggaggatgaggaggaggagagcgagctggtgtccaagcccctgctgcggctgagcagcagaagaagcagcatccggggccctgagggcacagagcagaacagagtgaggaacaagctgaagaggctcatcgccaagaggcctcccctgcagagcctgcaggagcggggcctgctgcgggaccaggtgtttggctgccagctggagagcctgtgccagcgggagggggacacagtgcccagcttcctgcggctgtgcatcgctgctgtggacaagaggggcctggatgtggatggcatctacagagtgtctggcaacctggccgtggtgcagaagctgcgcttcctggtggaccgggagagagctgtgaccagtgatggccgctacgtgtttcctgagcagcccggccaggagggccgcctggacctggacagcacagagtgggatgacatccacgtggtgactggagccctgaagctgttcctgcgggagctgccccagcccctggtgccccccctgctgctgccccacttccgggccgccctggccctgtctgagagcgagcagtgcctgagccagatccaggagctgattggctccatgcccaagcccaaccacgacaccctgcgctacctgctggagcacctgtgcagggtcatcgcccacagcgacaagaacaggatgaccccccacaacctgggcatcgtgtttggccccaccctcttccggcctgagcaggagaccagtgaccctgctgcccacgccctgtacccaggccagctggtgcagctgatgctgaccaacttcaccagcctcttcccctag

SEQ ID NO: 167968 - DNA, 2196 bp, Artificial Sequence
  Description of Artificial Sequence: Synthetic coding sequence
atgctgagcagccgctggtggcccagctcctggggcatcctgggcctgggccccaggagccccccccggggcagccagctgtgtgccctgtatgccttcacctacaccggggctgatggccagcaggtgtccctggccgagggggaccgcttcctgctgctgaggaagaccaacagcgactggtggctggcccggcggctggaggcccccagcaccagccggcccatctttgtgcctgctgcctacatgattgaggagagcatccccagccagagccccaccaccgtcatccctggccagctgctgtggaccccaggccccaagctgttccacggcagcctggaggagctgagccaggccctgcccagccgggcccaggccagcagcgagcagcccccacccctgcccaggaagatgtgccgctctgtgtccacagacaacctgagccccagcctgctgaagcccttccaggagggccccagcggccgcagcctgagccaggaggacctgcccagcgaggccagcgccagcacagctggcccccagcccctgatgtctgagccccctgtgtactgcaacctggtggacctgcggcgctgccccaggagccccccacctggccctgcctgccccctgctgcagaggctggatgcctgggagcagcacctggaccccaacagcggccgctgcttctacatcaacagcctgaccggctgcaagtcctggaagccaccccggcgcagccgctctgagaccaaccctggctccatggagggcacccagaccctgaagagaaataatgatgtgctgcagccccaggccaagggcttcagaagtgacaccggcaccccagagcccctggacccccagggcagcctgagcctgagccagaggaccagccagctggaccccccagccctgcaggccccccggcccctgccccagctgctggatgacccccatgaggtggagaagagcggcctgctgaacatgaccaagatcgcccagggcggcaggaagctgaggaagaactggggccccagctgggtggtgctgactggaaacagcctggtgttctaccgggagcccccacccacagcccccagcagcggctggggccctgctggcagcaggcctgagagctctgtggacctgcggggggccgccctggcccacggccgccacctgagcagcagaagaaatgtgctgcacatccgcaccatccctggccacgagttcctgctgcagagcgaccatgaaacagagctgcgggcctggcaccgggccctgaggacagtcatcgagcggctggaccgggagaaccccctggagctgcggctgagcggcagcggccctgctgagctgtctgctggagaagatgaggaggaggagagcgagctggtgtccaagcccctgctgcggctgagcagccgccgcagcagcatccggggccctgagggcacagagcagaacagagtgaggaacaagctgaagaggctgattgccaagaggcctcccctgcagagcctgcaggagcggggcctgctgcgggaccaggtgtttggctgccagctggagagcctgtgccagcgggagggggacacagtgcccagcttcctgcggctgtgcatcgctgctgtggacaagaggggcctggatgtggatggcatctacagagtgtctggcaacctggccgtggtgcagaagctgcgcttcctggtggaccgggagagagctgtgaccagtgatggccgctacgtgtttcctgagcagcccggccaggagggccgcctggacctggacagcacagagtgggatgacatccacgtggtgactggagccctgaagctgttcctgcgggagctgccccagcccctggtgccccccctgctgctgccccacttccgggccgccctggccctgtctgagagcgagcagtgcctgagccagatccaggagctgattggctccatgcccaagcccaaccacgacaccctgcgctacctgctggagcacctgtgccgggtgattgcccacagcgacaagaacaggatgaccccccacaacctgggcatcgtgtttggccccaccctcttccggcctgagcaggagaccagtgaccctgctgcccacgccctgtacccaggccagctggtgcagctgatgctgaccaacttcaccagcctcttcccctag

SEQ ID NO: 167969 - DNA, 2466 bp, Artificial Sequence
  Description of Artificial Sequence: Synthetic coding sequence
atgaggcggggcagcagtgacagctgtgccagcggcagccaggtggccggcaccaccgtggccggccctgcccaccctgagagcctgaccctgtgcagcggggaggccgagcggcggggcaaggaggagtggccagacagccaccactacccaggccccaccccagcccctgagagcagtgatggcccccacaaggtgacagtgctggccaccatgctgagcagccgctggtggcccagctcctggggcatcctgggcctgggccccaggagccccccccggggcagccagctgtgtgccctgtatgccttcacctacacaggagcagatggccagcaggtgtccctggccgagggggaccgcttcctgctgctgaggaagaccaacagcgactggtggctggcccggcggctggaggcccccagcaccagccggcccatctttgtgcctgctgcctacatgattgaggagagcatccccagccagagccccaccaccgtcatccctggccagctgctgtggaccccaggccccaagctgttccacggcagcctggaggagctgagccaggccctgcccagccgggcccaggccagcagcgagcagcccccacccctgcccaggaagatgtgccgctctgtgtccacagacaacctgagccccagcctgctgaagcccttccaggagggccccagcggccgcagcctgagccaggaggacctgcccagcgaggccagcgccagcacagctggcccccagcccctgatgtctgagccccctgtgtactgcaacctggtggacctgcggcgctgccccaggagccccccacctggccctgcctgccccctgctgcagaggctggatgcctgggagcagcacctggaccccaacagcggccgctgcttctacatcaacagcctgaccggctgcaagtcctggaagcccccaagaagaagccgctctgagaccaaccctggctccatggagggcacccagaccctgaagaggaacaatgatgtgctgcagccccaggccaagggcttcagaagtgacaccggcaccccagagcccctggacccccagggcagcctgagcctgagccagaggaccagccagctggaccccccagccctgcaggccccccggcccctgccccagctgctggatgacccccatgaggtggagaagagcggcctgctgaacatgaccaagatcgcccagggcggcaggaagctgaggaagaactggggccccagctgggtggtgctgaccggcaacagcctggtgttctaccgggagcccccacccacagcccccagcagcggctggggccctgctggcagcaggcctgagagctctgtggacctgcggggagctgccctggcccacggccgccacctgagcagcagaagaaatgtgctgcacatccgcaccatccctggccacgagttcctgctgcagagcgaccacgagacagagctgcgggcctggcaccgggccctgaggacagtgattgagcggctggtgcgctgggtggaggcccggcgggaggcccccaccggccgggaccagggcagcggggaccgggagaaccccctggagctgcggctgagcggcagcggccctgctgagctgtctgctggagaagatgaggaggaggagagcgagctggtgtccaagcccctgctgcggctgagcagccgccgcagcagcatccggggccctgagggcacagagcagaacagagtgaggaacaagctgaagaggctgattgccaagaggcctcccctgcagagcctgcaggagcggggcctgctgcgggaccaggtgtttggctgccagctggagagcctgtgccagcgggagggggacacagtgcccagcttcctgcggctgtgcatcgctgctgtggacaagaggggcctggatgtggatggcatctacagagtgtctggcaacctggccgtggtgcagaagctgcgcttcctggtggaccgggagagagctgtgaccagtgatggccgctacgtgtttcctgagcagcccggccaggagggccgcctggacctggacagcacagagtgggatgacatccacgtggtgactggagccctgaagctgttcctgcgggagctgccccagcccctggtgccccccctgctgctgccccacttccgggccgccctggccctgtctgagagcgagcagtgcctgagccagatccaggagctgattggctccatgcccaagcccaaccacgacaccctgcgctacctgctggagcacctgtgccgggtgattgcccacagcgacaagaacaggatgaccccccacaacctgggcatcgtgtttggccccaccctcttccggcctgagcaggagaccagtgaccctgctgcccacgccctgtacccaggccagctggtgcagctgatgctgaccaacttcaccagcctcttcccctag

SEQ ID NO: 167970 - DNA, 900 bp, Artificial Sequence
  Description of Artificial Sequence: Synthetic coding sequence
atgaccaagatcgcccagggcggcaggaagctgaggaagaactggggccccagctgggtggtgctgactggaaacagcctggtgttctaccgggagcccccacccacagcccccagcagcggctggggccctgctggcagcaggcctgagagctctgtggacctgcggggggccgccctggcccacggccgccacctgagcagcagaagaaatgtgctgcacatccgcaccatccctggccacgagttcctgctgcagagcgaccatgaaacagagctgcgggcctggcaccgggccctgaggacagtcatcgagcggctggaccgggagaaccccctggagctgcggctgagcggcagcggccctgctgagctgtctgctggagaagatgaggaggaggagagcgagctggtgtccaagcccctgctgcggctgagcagccgccgcagcagcatccggggccctgagggcacagagcagaacagagtgaggaacaagctgaagaggctgattgccaagaggcctcccctgcagagcctgcaggagcggggcctgctgcgggaccaggtgtttggctgccagctggagagcctgtgccagcgggagggggacacagtgcccagcttcctgcggctgtgcatcgctgctgtggacaagaggggcctggatgtggatggcatctacagagtgtctggcaacctggccgtggtgcagaagctgcgcttcctggtggaccgggagagagctgtgaccagtgatggccgctacgtgtttcctgagcagcccggccaggccctgtctgagagcgagcagtgcctgagccagatccaggagctgattggctccatgcccaagcccaaccacgacaccctgcgctacctgctggagcacctgtgctag

SEQ ID NO: 167971 - DNA, 1923 bp, Artificial Sequence
  Description of Artificial Sequence: Synthetic coding sequence
atgctgagcagccgctggtggcccagctcctggggcatcctgggcctgggccccaggagccccccccggggcagccagctgtgtgccctgtatgccttcacctacaccggggctgatggccagcaggtgtccctggccgagggggaccgcttcctgctgctgaggaagaccaacagcgactggtggctggcccggcggctggaggcccccagcaccagccggcccatctttgtgcctgctgcctacatgattgaggagagcatccccagccagagccccaccaccgtcatccctggccagctgctgtggaccccaggccccaagctgttccacggcagcctggaggagctgagccaggccctgcccagccgggcccaggccagcagcgagcagcccccacccctgcccaggaagatgtgccgctctgtgtccacagacaacctgagccccagcctgctgaagcccttccaggagggccccagcggccgcagcctgagccaggaggacctgcccagcgaggccagcgccagcacagctggcccccagcccctgatgtctgagccccctgtgtactgcaacctggtggacctgcggcgctgccccaggagccccccacctggccctgcctgccccctgctgcagaggctggatgcctgggagcagcacctggaccccaacagcggccgctgcttctacatcaacagcctgaccggctgcaagtcctggaagccaccccggcgcagccgctctgagaccaaccctggctccatggagggcacccagaccctgaagagaaataatgatgtgctgcagccccaggccaagggcttcagaagtgacaccggcaccccagagcccctggacccccagggcagcctgagcctgagccagaggaccagccagctggaccccccagccctgcaggccccccggcccctgccccagctgctggatgacccccatgaggtggagaagagcggcctgctgaacatgaccaagatcgcccagggcggcaggaagctgaggaagaactggggccccagctgggtggtgctgactggaaacagcctggtgttctaccgggagcccccacccacagcccccagcagcggctggggccctgctggcagcaggcctgagagctctgtggacctgcggggggccgccctggcccacggccgccacctgagcagcagaagaaatgtgctgcacatccgcaccatccctggccacgagttcctgctgcagagcgaccatgaaacagagctgcgggcctggcaccgggccctgaggacagtcatcgagcggctggaccgggagaaccccctggagctgcggctgagcggcagcggccctgctgagctgtctgctggagaagatgaggaggaggagagcgagctggtgtccaagcccctgctgcggctgagcagccgccgcagcagcatccggggccctgagggcacagagcagaacagagtgaggaacaagctgaagaggctgattgccaagaggcctcccctgcagagcctgcaggagcggggcctgctgcgggaccaggtgtttggctgccagctggagagcctgtgccagcgggagggggacacagtgcccagcttcctgcggctgtgcatcgctgctgtggacaagaggggcctggatgtggatggcatctacagagtgtctggcaacctggccgtggtgcagaagctgcgcttcctggtggaccgggagagagctgtgaccagtgatggccgctacgtgtttcctgagcagcccggccaggagggccgcctggacctggacagcacagagtgggatgacatccacgtggtgactggagccctgaagctgttcctgcgggagctgccccagcccctggtgccccccctgctgctgccccacttccgggccgccctgggctag

SEQ ID NO: 167972 - DNA, 1644 bp, Artificial Sequence
  Description of Artificial Sequence: Synthetic coding sequence
atgtctgagccccctgtgtactgcaacctggtggacctgcggcgctgccccaggagccccccacctggccctgcctgccccctgctgcagaggctggatgcctgggagcagcacctggaccccaacagcggccgctgcttctacatcaacagcctgaccggctgcaagtcctggaagccaccccggcgcagccgctctgagaccaaccctggctccatggagggcacccagaccctgaagagaaataatgatgtgctgcagccccaggccaagggcttcagaagtgacaccggcaccccagagcccctggacccccagggcagcctgagcctgagccagaggaccagccagctggaccccccagccctgcaggccccccggcccctgccccagctgctggatgacccccatgaggtggagaagagcggcctgctgaacatgaccaagatcgcccagggcggcaggaagctgaggaagaactggggccccagctgggtggtgctgactggaaacagcctggtgttctaccgggagcccccacccacagcccccagcagcggctggggccctgctggcagcaggcctgagagctctgtggacctgcggggggccgccctggcccacggccgccacctgagcagcagaagaaatgtgctgcacatccgcaccatccctggccacgagttcctgctgcagagcgaccatgaaacagagctgcgggcctggcaccgggccctgaggacagtcatcgagcggctggaccgggagaaccccctggagctgcggctgagcggcagcggccctgctgagctgtctgctggagaagatgaggaggaggagagcgagctggtgtccaagcccctgctgcggctgagcagccgccgcagcagcatccggggccctgagggcacagagcagaacagagtgaggaacaagctgaagaggctgattgccaagaggcctcccctgcagagcctgcaggagcggggcctgctgcgggaccaggtgtttggctgccagctggagagcctgtgccagcgggagggggacacagtgcccagcttcctgcggctgtgcatcgctgctgtggacaagaggggcctggatgtggatggcatctacagagtgtctggcaacctggccgtggtgcagaagctgcgcttcctggtggaccgggagagagctgtgaccagtgatggccgctacgtgtttcctgagcagcccggccaggagggccgcctggacctggacagcacagagtgggatgacatccacgtggtgactggagccctgaagctgttcctgcgggagctgccccagcccctggtgccccccctgctgctgccccacttccgggccgccctggccctgtctgagagcgagcagtgcctgagccagatccaggagctgattggctccatgcccaagcccaaccacgacaccctgcgctacctgctggagcacctgtgccgggtgattgcccacagcgacaagaacaggatgaccccccacaacctgggcatcgtgtttggccccaccctcttccggcctgagcaggagaccagtgaccctgctgcccacgccctgtacccaggccagctggtgcagctgatgctgaccaacttcaccagcctcttcccctag

SEQ ID NO: 167973 - DNA, 894 bp, Artificial Sequence
  Description of Artificial Sequence: Synthetic coding sequence
atgtctgagccccctgtgtactgcaacctggtggacctgcggcgctgccccaggagccccccacctggccctgcctgccccctgctgcagaggctggatgcctgggagcagcacctggaccccaacagcggccgctgcttctacatcaacagcctgaccggctgcaagtcctggaagccaccccggcgcagccgctctgagaccaaccctggctccatggagggcacccagaccctgaagagaaataatgatgtgctgcagccccaggccaagggcttcagaagtgacaccggcaccccagagcccctggacccccagggcagcctgagcctgagccagaggaccagccagctggaccccccagccctgcaggccccccggcccctgccccagctgctggatgacccccatgaggtggagaagagcggcctgctgaacatgaccaagatcgcccagggcggcaggaagctgaggaagaactggggccccagctgggtggtgctgactggaaacagcctggtgttctaccgggagcccccacccacagcccccagcagcggctggggccctgctggcagcaggcctgagagctctgtggacctgcggggggccgccctggcccacggccgccacctgagcagcagaagaaatgtgctgcacatccgcaccatccctggccacgagttcctgctgcagagcgaccatgaaacagagctgcgggcctggcaccgggccctgaggacagtcatcgagcggctggaccgggagaaccccctggagctgcggctgagcggcagcggccctgctgagctgtctgctggagaagatgaggaggaggagagcgagctggtgtccaagcccctgctgcggctgagcagccgccgcagcagctag

SEQ ID NO: 167974 - DNA, 186 bp, Artificial Sequence
  Description of Artificial Sequence: Synthetic coding sequence
atgtctgagccccctgtgtactgcaacctggtggacctgcggcgctgccccaggagccccccacctggccctgcctgccccctgctgcagaggctggatgcctgggagcagcacctggaccccaacagcggccgctgcttctacatcaacagcctgaccggctgcaagtcctggaagccaccctag

SEQ ID NO: 167975 - DNA, 471 bp, Artificial Sequence
  Description of Artificial Sequence: Synthetic coding sequence
tgagaaggagacacagtgcccagcttcctgcggctgtgcatcgctgctgtggacaagaggggcctggatgtggatggcatctacagagtgtctggcaacctggccgtggtgcagaagctgcgcttcctggtggaccgggagagagctgtgaccagtgatggccgctacgtgtttcctgagcagcccggccaggccctgtctgagagcgagcagtgcctgagccagatccaggagctgattggctccatgcccaagcccaaccacgacaccctgcgctacctgctggagcacctgtgcagggtcatcgcccacagcgacaagaacaggatgaccccccacaacctgggcatcgtgtttggccccaccctcttccggcctgagcaggagaccagtgaccctgctgcccacgccctgtacccaggccagctggtgcagctgatgctgaccaacttcaccagcctcttcccctag

SEQ ID NO: 167976 - DNA, 396 bp, Artificial Sequence
  Description of Artificial Sequence: Synthetic coding sequence
atgtctgagccccctgtgtactgcaacctggtggacctgcggcgctgccccaggagccccccacctggccctgcctgccccctgctgcagaggctggatgcctgggagcagcacctggaccccaacagcggccgctgcttctacatcaacagcctgaccggctgcaagtcctggaagccaccccggcgcagccgctctgagaccaaccctggctccatggagggcacccagaccctgaagagaaataatgatgtgctgcagccccaggccaagggcttcagaagtgacaccggcaccccagagcccctggacccccagggcagcctgagcctgagccagaggaccagccagctggaccccccagccctgcaggccccccggcccctgccccagtag

SEQ ID NO: 167977 - DNA, 2028 bp, Artificial Sequence
  Description of Artificial Sequence: Synthetic coding sequence
gagcccggcagcggcagccgggaccccggccctggcattgctgagccagacctgggccggcctgctggccacctgcgggctgacaccagccctgctgagccccgggagatggaggactttgcccggggggccgccagccctggccccagccggcccggcctggtgcctgtgtccatcatcggggctgaagatgaagattttgaaaatgagctggagaccaacagcgaggagcagaacagccagttccagagcctggagcaggtgaagaggaggcctgcccacctgatggccctgctgcagcacgtggccctgcagtttgagcccggccccctgctgtgctgcctgcatgctgacatgctgggcagcctgggccccaaggaggccaagaaggccttcctggacttctaccacagcttcctggagaagacagctgtgctgcgggtgcctgtgcccccaaatgtggcctttgagctggacaggaccagggctgacctgatcagtgaagatgtgcagaggagatttgtgcaggaggtggtgcagagccagcaggtggccgtgggccggcagctggaggacttccgcagcaagaggctgatgggcatgaccccctgggagcaggagctggcccagctggaggcctgggtgggccgggaccgggccagctatgaggcccgggagcggcacgtggccgagcggctgctgatgcacctggaggagatgcagcacaccatcagcacagatgaggagaagtctgctgctgtggtgaatgccatcggcctgtacatgaggcacctgggcgtgaggaccaagagcggggacaagaagagcggcaggaacttcttcaggaagaaggtgatgggcaacagaagaagtgatgagcccgccaagaccaagaagggcctgagcagcatcctggatgctgcccgctggaacagaggagagccccaggtgcctgacttccgccacctgaaggccgaggtggatgctgagaagccaggggccacagacaggaagggcggcgtgggcatgcccagccgggacaggaacatcggggcccctggccaggacaccccaggagtgtccctgcaccccctgagcctggacagcccagaccgggagcccggggctgatgcccccctggagctgggggacagcagcccccagggccccatgagcctggagagcctggcccctcctgagagcacagatgaaggagctgagacagagcgctgccccggctggggcgctggggccggcggcgtggcctactgggccctggtgggcggctgccgggtgacagctgccatctgtgcctgcctgagccaggccctggcccctcatgcccccctgctgctgagcggcagcggccacagcagccccttcttcttccccttcctgatcagcctgctgctgccccactgcccccccttcctgctgtccttcctgttccccctgctgctgcccctgctgcccttcttcaccaaccccagccccccacccttcctgagcaccacccccagcatctccttcatcagcagccccctgctgagccacctgcccccacccctcttccccccccacagcagcctgacctgggtgttcttcccccacctgcccagccccagcgacctgcctgccaccttccacttcttcagccccagccccttctccttcaagccaccctgccccctgccccccaccccccggctggccccagcctcctggtgccccagcctgaaccccccacccctgtgcagcgtgccctggggcccctgccccccctacagctggggcgccggcagcgccagctgccccagcctgtgccgctgctttggagaccccctggtgggcgccggccgctgggtgcgcttccacctgggcccccccctgaccctgtgccccagcctgccccggcgctggaagcgctgggtgcccggcccctgggtgggggagggcctggcccccccacccttcctgcctgccccacccctgagcccctggcccctgccccccctgcacagcctgtag

SEQ ID NO: 167978 - DNA, 2784 bp, Artificial Sequence
  Description of Artificial Sequence: Synthetic coding sequence
atggccagcctgagcacctggagcagccctgctgagccccgggagatggaggactttgcccggggagctgccagccctggccccagcaggcctggcctggtgcctgtgtccatcattggagcagaagatgaggactttgaaaatgagctggagaccaacagcgaggagcagaacagccagttccagagcctggagcaggtgaagagaagacctgcccacctgatggccctgctgcagcacgtggccctgcagtttgagcccggccccctgctgtgctgcctgcacgccgacatgctgggcagcctgggccccaaggaggccaagaaggccttcctggacttctaccacagcttcctggagaagacagctgtgctgcgggtgcctgtgccccccaacgtggcctttgagctggacaggaccagggctgacctgatcagtgaagatgtgcagaggagatttgtgcaggaggtggtgcagagccagcaggtggccgtgggccggcagctggaggacttccgcagcaagaggctgatgggcatgaccccctgggagcaggagctggcccagctggaggcctgggtgggccgggaccgggccagctatgaggcccgggagagacatgtggccgagcggctgctgatgcacctggaggagatgcagcacaccatcagcacagatgaggagaagtctgctgctgtggtgaatgccatcggcctgtacatgaggcacctgggcgtgaggaccaagagcggggacaagaagtctggaagaaacttcttcaggaagaaggtgatgggcaacagaagaagtgatgagcccgccaagaccaagaagggcctgagcagcatcctggatgctgcccgctggaacagaggagagccccaggtgcctgacttccgccacctgaaggccgaggtggatgctgagaagccaggggccacagacagaaaaggaggagtgggcatgcccagccgggacagaaatattggagcccctggccaggacaccccaggagtgtccctgcaccccctgagcctggacagcccagaccgggagcctggagcagatgcccccctggagctgggggacagcagcccccagggccccatgagcctggagagcctggcccctcctgagagcacagatgagggcgctgagacagagagccctgagcctggagatgaaggagagcccggccgcagcggcctggagctggagcctgaggagcccccaggctggagggagctggtgcccccagacaccctgcacagcctgcccaagagccaggtgaagaggcaggaggtgatcagcgagctgctggtgacagaggccgcccacgtgaggatgctgcgggtgctgcatgacctcttcttccagcccatggctgaatgtctcttcttccccctggaggagctgcagaacatcttccccagcctggatgagctgattgaggtgcacagcctcttcctggaccggctgatgaagaggcggcaggagagcggctacctgattgaggagattggagatgtgctgctggccaggtttgatggagctgagggctcctggttccagaagatcagcagccgcttctgcagccggcagagctttgccctggagcagctgaaggccaagcagaggaaggacccccgcttctgtgcctttgtgcaggaggccgagagccggccccgctgccggcggctgcagctgaaggacatgatccccacagagatgcagaggctgaccaagtaccccctgctgctgcagagcatcggccagaacacagaggagcccacagagcgggagaaggtggagctggccgctgagtgctgccgggagatcctgcaccacgtgaaccaggccgtgcgggacatggaggacctgctgcggctgaaggactaccagaggcggctggacctgagccacctgcggcagagcagtgaccccatgctgtctgagttcaagaacctggacatcaccaagaagaagctggtgcatgagggccccctgacctggagggtgaccaaggacaaggctgtggaggtgcacgtgctgctgctggatgacctgctgctgctgctgcagaggcaggatgagcggctgctgctgaagagccacagcaggaccctgacccccaccccagatggcaagaccatgctgcggcctgtgctgcggctgaccagcgccatgacccgggaggtggccacagaccacaaggccttctacgtgctcttcacctgggaccaggaggcccagatctatgagctggtggcccagacagtgtctgagaggaagaactggtgtgccctgatcacagaaacagctggcagcctgaaggtgcctgccccagccagccggcccaagccccggcccagccccagcagcacccgggagcccctgctgagcagcagtgaaaatggaaatggaggccgggagaccagccctgcagatgccaggacagagcgcatcctgagtgacctgctgcccttctgccggcccggccctgagggccagctggccgccacagccctgaggaaggtgctgagcctgaagcagctgctcttccctgctgaggaggacaacggggccggccccccaagagatggagatggagtgcctgggggcggccccctgagccctgcccggacccaggagatccaggagaacctgctgagcctggaggagaccatgaagcagctggaggagctggaggaggagttctgccgcctgcggcccctgctgagccagctgggcggcaacagcgtgccccagcccggctgcacctag

SEQ ID NO: 167979 - DNA, 2640 bp, Artificial Sequence
  Description of Artificial Sequence: Synthetic coding sequence
atggaggactttgcccggggggccgccagccctggccccagccggcccggcctggtgcctgtgtccatcatcggggctgaagatgaagattttgaaaatgagctggagaccaacagcgaggagcagaacagccagttccagagcctggagcaggtgaagaggaggcctgcccacctgatggccctgctgcagcacgtggccctgcagtttgagcccggccccctggtgctgcgggtgcctgtgccccccaacgtggcctttgagctggacaggaccagggctgacctgatcagtgaagatgtgcagaggagatttgtgcaggaggtggtgcagagccagcaggtggccgtgggccggcagctggaggacttccgcagcaagaggctgatgggcatgaccccctgggagcaggagctggcccagctggaggcctgggtgggccgggaccgggccagctatgaggcccgggagagacatgtggccgagcggctgctgatgcacctggaggagatgcagcacaccatcagcacagatgaggagaagtctgctgctgtggtgaatgccatcggcctgtacatgaggcacctgggcgtgaggaccaagagcggggacaagaagtctggaagaaacttcttcaggaagaaggtgatgggcaacagaagaagtgatgagcccgccaagaccaagaagggcctgagcagcatcctggatgctgcccgctggaacagaggagagccccaggtgcctgacttccgccacctgaaggccgaggtggatgctgagaagccaggggccacagacagaaaaggaggagtgggcatgcccagccgggacagaaatattggagcccctggccaggacaccccaggagtgtccctgcaccccctgagcctggacagcccagaccgggagcctggagcagatgcccccctggagctgggggacagcagcccccagggccccatgagcctggagagcctggcccctcctgagagcacagatgagggcgctgagacagagagccctgagcctggagatgaaggagagcccggccgcagcggcctggagctggagcctgaggagcccccaggctggagggagctggtgcccccagacaccctgcacagcctgcccaagagccaggtgaagaggcaggaggtgatcagcgagctgctggtgacagaggccgcccacgtgaggatgctgcgggtgctgcatgacctcttcttccagcccatggctgaatgtctcttcttccccctggaggagctgcagaacatcttccccagcctggatgagctgattgaggtgcacagcctcttcctggaccggctgatgaagaggcggcaggagagcggctacctgattgaggagattggagatgtgctgctggccaggtttgatggagctgagggctcctggttccagaagatcagcagccgcttctgcagccggcagagctttgccctggagcagctgaaggccaagcagaggaaggacccccgcttctgtgcctttgtgcaggaggccgagagccggccccgctgccggcggctgcagctgaaggacatgatccccacagagatgcagaggctgaccaagtaccccctgctgctgcagagcatcggccagaacacagaggagcccacagagcgggagaaggtggagctggccgctgagtgctgccgggagatcctgcaccacgtgaaccaggccgtgcgggacatggaggacctgctgcggctgaaggactaccagaggcggctggacctgagccacctgcggcagagcagtgaccccatgctgtctgagttcaagaacctggacatcaccaagaagaagctggtgcatgagggccccctgacctggagggtgaccaaggacaaggctgtggaggtgcacgtgctgctgctggatgacctgctgctgctgctgcagaggcaggatgagcggctgctgctgaagagccacagcaggaccctgacccccaccccagatggcaagaccatgctgcggcctgtgctgcggctgaccagcgccatgacccgggaggtggccacagaccacaaggccttctacgtgctcttcacctgggaccaggaggcccagatctatgagctggtggcccagacagtgtctgagaggaagaactggtgtgccctgatcacagaaacagctggcagcctgaaggtgcctgccccagccagccggcccaagccccggcccagccccagcagcacccgggagcccctgctgagcagcagtgaaaatggaaatggaggccgggagaccagccctgcagatgccaggacagagcgcatcctgagtgacctgctgcccttctgccggcccggccctgagggccagctggccgccacagccctgaggaaggtgctgagcctgaagcagctgctcttccctgctgaggaggacaacggggccggccccccaagagatggagatggagtgcctgggggcggccccctgagccctgcccggacccaggagatccaggagaacctgctgagcctggaggagaccatgaagcagctggaggagctggaggaggagttctgccgcctgcggcccctgctgagccagctgggcggcaacagcgtgccccagcccggctgcacctag

SEQ ID NO: 167980 - DNA, 2739 bp, Artificial Sequence
  Description of Artificial Sequence: Synthetic coding sequence
atggaggactttgcccggggggccgccagccctggccccagccggcccggcctggtgcctgtgtccatcatcggggctgaagatgaagattttgaaaatgagctggagaccaacagcgaggagcagaacagccagttccagagcctggagcaggtgaagaggaggcctgcccacctgatggccctgctgcagcacgtggccctgcagtttgagcccggccccctgctgtgctgcctgcatgctgacatgctgggcagcctgggccccaaggaggccaagaaggccttcctggacttctaccacagcttcctggagaagacagctgtgctgcgggtgcctgtgcccccaaatgtggcctttgagctggacaggaccagggctgacctgatcagtgaagatgtgcagaggagatttgtgcaggaggtggtgcagagccagcaggtggccgtgggccggcagctggaggacttccgcagcaagaggctgatgggcatgaccccctgggagcaggagctggcccagctggaggcctgggtgggccgggaccgggccagctatgaggcccgggagcggcacgtggccgagcggctgctgatgcacctggaggagatgcagcacaccatcagcacagatgaggagaagtctgctgctgtggtgaatgccatcggcctgtacatgaggcacctgggcgtgaggaccaagagcggggacaagaagagcggcaggaacttcttcaggaagaaggtgatgggcaacagaagaagtgatgagcccgccaagaccaagaagggcctgagcagcatcctggatgctgcccgctggaacagaggagagccccaggtgcctgacttccgccacctgaaggccgaggtggatgctgagaagccaggggccacagacaggaagggcggcgtgggcatgcccagccgggacaggaacatcggggcccctggccaggacaccccaggagtgtccctgcaccccctgagcctggacagcccagaccgggagcccggggctgatgcccccctggagctgggggacagcagcccccagggccccatgagcctggagagcctggcccctcctgagagcacagatgaaggagctgagacagagagccctgagcctggagatgaaggagagcccggccgcagcggcctggagctggagcctgaggagcccccaggctggagggagctggtgcccccagacaccctgcacagcctgcccaagagccaggtgaagaggcaggaggtgatcagcgagctgctggtgacagaagctgcccacgtgaggatgctgcgggtgctgcatgacctcttcttccagcccatggccgagtgcctcttcttccccctggaggagctgcagaacatcttccccagcctggatgagctgattgaggtgcacagcctcttcctggaccggctgatgaagaggcggcaggagagcggctacctgattgaggagattggagatgtgctgctggccaggtttgatggagctgagggctcctggttccagaagatcagcagccgcttctgcagccggcagagctttgccctggagcagctgaaggccaagcagaggaaggacccccgcttctgtgcctttgtgcaggaggccgagagccggccccgctgccggcggctgcagctgaaggacatgatccccacagagatgcagaggctgaccaagtaccccctgctgctgcagagcatcggccagaacacagaggagcccacagagcgggagaaggtggagctggccgctgagtgctgccgggagatcctgcaccacgtgaaccaggccgtgcgggacatggaggacctgctgcggctgaaggactaccagaggcggctggacctgagccacctgcggcagagcagtgaccccatgctgtctgagttcaagaacctggacatcaccaagaagaagctggtgcatgagggccccctgacctggagggtgaccaaggacaaggctgtggaggtgcacgtgctgctgctggatgacctgctgctgctgctgcagaggcaggatgagcggctgctgctgaagagccacagcaggaccctgacccccaccccagatggcaagaccatgctgcggcctgtgctgcggctgaccagcgccatgacccgggaggtggccacagaccacaaggccttctacgtgctcttcacctgggaccaggaggcccagatctatgagctggtggcccagacagtgtctgagaggaagaactggtgtgccctgatcacagaaacagctggcagcctgaaggtgcctgccccagccagccggcccaagccccggcccagccccagcagcacccgggagcccctgctgagcagcagtgaaaatggaaatggaggccgggagaccagccctgcagatgccaggacagagcgcatcctgagtgacctgctgcccttctgcaggcctggccctgagggccagctggccgccacagccctgaggaaggtgctgagcctgaagcagctgctcttcccagcagaagaagataatggagctggccccccaagagatggagatggagtgcctgggggcggccccctgagccctgcccggacccaggagatccaggagaacctgctgagcctggaggagaccatgaagcagctggaggagctggaggaggagttctgccgcctgcggcccctgctgagccagctgggcggcaacagcgtgccccagcccggctgcacctag

SEQ ID NO: 167981 - DNA, 2847 bp, Artificial Sequence
  Description of Artificial Sequence: Synthetic coding sequence
atggccagcctgagcacctggagcagccctgctgagccccgggagatggaggactttgcccggggagctgccagccctggccccagcaggcctggcctggtgcctgtgtccatcattggagcagaagatgaggactttgaaaatgagctggagaccaacagcgaggagcagaacagccagttccagagcctggagcaggtgaagagaagacctgcccacctgatggccctgctgcagcacgtggccctgcagtttgagcccggccccctggtgctgcgggtgcctgtgcccccaaatgtggcctttgagctggacaggaccagggctgacctgatcagtgaagatgtgcagaggagatttgtgcaggaggtggtgcagagccagcaggtggccgtgggccggcagctggaggacttccgcagcaagaggctgatgggcatgaccccctgggagcaggagctggcccagctggaggcctgggtgggccgggaccgggccagctatgaggcccgggagcggcacgtggccgagcggctgctgatgcacctggaggagatgcagcacaccatcagcacagatgaggagaagtctgctgctgtggtgaatgccatcggcctgtacatgaggcacctgggcgtgaggaccaagagcggggacaagaagagcggcaggaacttcttcaggaagaaggtgatgggcaacagaagaagtgatgagcccgccaagaccaagaagggcctgagcagcatcctggatgctgcccgctggaacagaggagagccccaggtgcctgacttccgccacctgaaggccgaggtggatgctgagaagccaggggccacagacaggaagggcggcgtgggcatgcccagccgggacaggaacatcggggcccctggccaggacaccccaggagtgtccctgcaccccctgagcctggacagcccagaccgggagcccggggctgatgcccccctggagctgggggacagcagcccccagggccccatgagcctggagagcctggcccctcctgagagcacagatgaaggagctgagacagagagccctgagcctggagatgaaggagagcccggccgcagcggcctggagctggagcctgaggagcccccaggctggagggagctggtgcccccagacaccctgcacagcctgcccaagagccaggtgaagaggcaggaggtgatcagcgagctgctggtgacagaagctgcccacgtgaggatgctgcgggtgctgcatgacctcttcttccagcccatggccgagtgcctcttcttccccctggaggagctgcagaacatcttccccagcctggatgagctgattgaggtgcacagcctcttcctggaccggctgatgaagaggcggcaggagagcggctacctgattgaggagattggagatgtgctgctggccaggtttgatggagctgagggctcctggttccagaagatcagcagccgcttctgcagccggcagagctttgccctggagcagctgaaggccaagcagaggaaggacccccgcttctgtgcctttgtgcaggaggccgagagccggccccgctgccggcggctgcagctgaaggacatgatccccacagagatgcagaggctgaccaagtaccccctgctgctgcagagcatcggccagaacacagaggagcccacagagcgggagaaggtggagctggccgctgagtgctgccgggagatcctgcaccacgtgaaccaggccgtgcgggacatggaggacctgctgcggctgaaggactaccagaggcggctggacctgagccacctgcggcagagcagtgaccccatgctgtctgagttcaagaacctggacatcaccaagaagaagctggtgcatgagggccccctgacctggagggtgaccaaggacaaggctgtggaggtgcacgtgctgctgctggatgacctgctgctgctgctgcagaggcaggatgagcggctgctgctgaagagccacagcaggaccctgacccccaccccagatggcaagaccatgctgcggcctgtgctgcggctgaccagcgccatgacccgggaggtggccacagaccacaaggccttctacgtgctcttcacctgggaccaggaggcccagatctatgagctggtggcccagacagtgtctgagaggaagaactggtgtgccctgatcacagaaacagctggcagcctgaaggtgcctgccccagccagccggcccaagccccggcccagccccagcagcacccgggagcccctgctgagcagcagtgaaaatggaaatggaggccgggagaccagccctgcagatgccaggacagagcgcatcctgagtgacctgctgcccttctgcaggcctggccctgagggccagctggccgccacagccctgaggaagggcgtgggcggcggcatcctgcccccagagaccccacctgtgtctgcctggggcgagctgtgccccccagcctggctgcacctgcgcttcccccccaggaaggccttctgcaagaaggagagaaatggaggagaagatgtgcgggaccacccccacccccacagctgccgcagcatcagccaccctgagggcctgcggcggggcagctgtggcccccggctgggcggggcccagctgggcctgctggcccctcatgagccccggcccagcctgcccccagccctgtgcctgggggacagcggcctgcacagcggcggccaccacggggaccccggccacctgagcatcgcctgtggcggccaccccagcacccccacccccaagtgcctgcggagcgtcttcatcccctag

SEQ ID NO: 167982 - DNA, 4023 bp, Artificial Sequence
  Description of Artificial Sequence: Synthetic coding sequence
atgaggcctcctggcttcctgagccgggcccccagcctgaacagagctgagcggggcatctggagctgcagcatggaccagcgggagcccctgcccccagccccagcagaaaatgagatgaagtatgacaccaacaacaatgaggaggaggagggggagcagtttgattttgattctggagatgagatccctgaggccgaccggcaggcccccagcgcccctgagaccggcggggccggggccagcgaggccccagcccccactggaggagaagatggagctggagctgagaccacccctgtggccgagcccaccaagctggtgctgcccatgaaggtgaacccctacagcgtgattgacatcacccccttccaggaggaccagccccccacccctgtgcccagcgctgaggaggagaatgtgggcctgcacgtgccctgtggctacctggtgcctgtgccctgtggctatgctgtgcccagcaacctgcccctgctgctgcctgcctacagcagccctgtgatcatctgtgccaccagcctggatgaggaggccgagaccccagaggtgacagaggaccggcagcccaacagcctgagcagcgaggagccccccaccagcgaggaccaggtgggccgggaggacagcgccctggcccgctgggccgctgaccctgccaacacagcctggatggagaaccctgaggaggccatctatgatgatgtgcccagagaaaattctgattctgagccagatgagatgatctatgatgatgtggagaatggagatgaaggaggcaacagcagcctggagtatggctggagcagcagcgagtttgagagctatgaggagcagagcgacagcgagtgcaagaatggcatccccaggagcttcctgcggagcaaccacaagaagcagctgagccatgacctgacccggctgaaggagcactatgagaagaagatgagggacctgatggccagcacagtgggcgtggtggagatccagcagctgcggcagaagcatgagctgaagatgcagaagctggtgaaggccgccaaggatggcaccaaggatggcctggagaggaccagggctgctgtgaagaggggccgctccttcatccgcaccaagagcctgattgcccaggaccacaggagcagcctggaggaggagcagaacctcttcattgatgtggactgcaagcaccctgaggccatcctgacccccatgcctgagggcctgagccagcagcaggtggtgcggcgctacatcctgggctctgtggtggacagcgagaagaactacgtggatgccctgaagaggatcctggagcagtatgagaagcccctgtctgagatggagcccaaggtgctgtctgagaggaagctgaagacagtgttctacagagtgaaggagatcctgcagtgccacagcctcttccagatcgccctggccagccgggtgtctgagtgggacagcgtggagatgattggagatgtgtttgtggccagcttcagcaagtccatggtgctggatgcctacagtgaatatgtgaacaacttcagcacagctgtggccgtgctgaagaagacctgtgccaccaagccagccttcctggagttcctgaagcaggagcaggaggccagcccagacaggaccaccctgtacagcctgatgatgaagcccatccagcgcttcccccagttcatcctgctgctgcaggacatgctgaagaacaccagcaagggccacccagaccggctgcccctgcagatggccctgacagagctggagaccctggccgagaagctgaatgaaaggaagagagatgctgaccagagatgtgaggtgaagcagatcgccaaggccatcaatgaaagatacctgaacaagctgctgagcagcggcagccgctacctgatccgcagtgatgacatgattgagaccgtgtacaatgacagaggagagatcgtgaagaccaaggagcggcgggtcttcatgctgaatgatgtgctgatgtgtgccaccgtgagcagccggcccagccatgacagccgggtgatgagcagccagcgctacctgctgaagtggagcgtgcccctgggccacgtggatgccatcgagtatggcagcagcgctggcaccggggagcacagccgccacctggccgtgcaccccccagagagcctggccgtggtggccaatgccaagcccaacaaggtgtacatgggccctggccagctgtaccaggacctgcagaacctgctgcatgacctgaatgtgattggccagatcacccagctgattggcaacctgaagggcaactaccagaacctgaaccagagcgtggcccatgactggaccagcggcctgcagaggctcatcctgaagaaggaggatgagatccgggctgctgactgctgccgcatccagctgcagctgcccgggaagcaggacaagagcggccggcccaccttcttcaccgctgtgttcaacaccttcaccccagccatcaaggagagctgggtgaacagcctgcagatggccaagctggccctggaggaggagaaccacatgggctggttctgtgtggaggatgatggcaaccacatcaagaaggagaagcaccccctgctggtgggccacatgcctgtgatggtggccaagcagcaggagttcaagattggcagctgcacccaccagatgggccagatcgccatcgtgtccttccagaacagcacccccaaggtgattgagtgcttcaacgtggagagccgcatcctgtgcatgctgtatgtgcctgtggaggagaagaggcgggagcccggggcccccccagaccctgagaccccagctgtgcgggccagtgatgtgcccaccatctgtgtgggcacagaggagggcagcatcagcatctacaagagcagccagggcagcaagaaggtgcggctgcagcacttcttcaccccagagaagagcacagtgatgagcctggcctgcaccagccagagcctgtatgccggcctggtgaatggagctgtggccagctatgcccgggccccagatggctcctgggacagcgagccccagaaggtgatcaagctgggcgtgctgcctgtgcgcagcctgctgatgatggaggacaccctgtgggccgccagcggcggccaggtgttcatcatctctgtggagacccatgctgtggagggccagctggaggcccaccaggaggagggcatggtgatcagccacatggctgtgtctggagtgggcatctggatcgccttcaccagcggcagcaccctgcggctcttccacacagagaccctgaagcacctgcaggacatcaacatcgccacccctgtgcacaacatgctgcccggccaccagaggctgtctgtgaccagcctgctggtgtgccacggcctgctgatggtgggcaccagcctgggcgtgctggtggccctgcctgtgccccggctgcagggcatccccaaggtgacaggccggggcatggtgtcctaccacgcccacaacagccctgtgaagttcatcgtgctggccacagccctgcacgagaaggacaaggacaagagccgggacagcctggcccctggccctgagccccaggatgaggaccagaaggatgccctgcccagcggcggggccggcagcagcctgagccagggcgaccctgatgctgccatctggctgggggacagcctgggctccatgacccagaagagtgacctgagcagcagcagcggcagcctgagcctgagccacggcagcagcagcctggagcacagaagtgaggacagcaccatctatgacctgctgaaggaccctgtgtccctgcggagcaaggcccggcgggccaagaaggccaaggccagcagcgccctggtggtgtgtggcggccagggccaccggcgggtgcacaggaaggcccggcagccccaccaggaggagctggcccccaccgtgatggtgtggcagatccccctgctgaacatctag

SEQ ID NO: 167983 - DNA, 4035 bp, Artificial Sequence
  Description of Artificial Sequence: Synthetic coding sequence
atggaccagcgggagcccctgcccccagccccagcagaaaatgagatgaagtatgacaccaacaacaatgaggaggaggagggggagcagtttgattttgattctggagatgagatccctgaggccgaccggcaggcccccagcgcccctgagaccggcggggccggggccagcgaggccccagcccccactggaggagaagatggagctggagctgagaccacccctgtggccgagcccaccaagctggtgctgcccatgaaggtgaacccctacagcgtgattgacatcacccccttccaggaggaccagccccccacccctgtgcccagcgctgaggaggagaatgtgggcctgcacgtgccctgtggctacctggtgcctgtgccctgtggctatgctgtgcccagcaacctgcccctgctgctgcctgcctacagcagccctgtgatcatctgtgccaccagcctggatgaggaggagaccccagaggtgacagaagatcggcagcccaacagcctgagcagcgaggagccccccaccagcgaggaccaggtgggcagagaagattctgccctggcccgctgggccgctgaccctgccaacacagcctggatggagaaccctgaggaggccatctatgatgatgtgccccgggagaacagcgacagcgagccagatgagatgatctatgatgatgtggagaatggagatgagggcggcaacagcagcctggagtatggctggagcagcagcgagtttgagagctatgaggagcagagcgacagcgagtgcaagaatggcatccccaggagcttcctgcggagcaaccacaagaagcagctgagccatgacctgacccggctgaaggagcactatgagaagaagatgagggacctgatggccagcacagtgggcgtggtggagatccagcagctgcggcagaagcatgagctgaagatgcagaagctggtgaaggccgccaaggatggcaccaaggatggcctggagaggaccagggctgctgtgaagaggggccgctccttcatccgcaccaagagcctcatcgcccaggaccacaggagcagcctggaggaggagcagaacctcttcattgatgtggactgcaagcaccctgaggccatcctgacccccatgcctgagggcctgagccagcagcaggtggtgcggcgctacatcctgggctctgtggtggacagcgagaagaactacgtggatgccctgaagaggatcctggagcagtatgagaagcccctgtctgagatggagcccaaggtgctgtctgagaggaagctgaagacagtgttctacagagtgaaggagatcctgcagtgccacagcctcttccagatcgccctggccagccgggtgtctgagtgggacagcgtggagatgattggagatgtgtttgtggccagcttcagcaagtccatggtgctggatgcctacagtgaatatgtgaacaacttcagcacagctgtggccgtgctgaagaagacctgtgccaccaagccagccttcctggagttcctgaagcaggagcaggaggccagcccagacaggaccaccctgtacagcctgatgatgaagcccatccagcgcttcccccagttcatcctgctgctgcaggacatgctgaagaacaccagcaagggccacccagaccggctgcccctgcagatggccctgacagagctggagaccctggccgagaagctgaatgaaaggaagagagatgctgaccagagatgtgaggtgaagcagatcgccaaggccatcaatgaaagatacctgaacaagctgctgagcagcggcagccgctacctgatccgcagtgatgacatgattgaaacagtgtacaatgacagaggagaaattgtgaagaccaaggagaggagggtcttcatgctgaatgatgtgctgatgtgtgccaccgtgagcagccggcccagccatgacagccgggtgatgagcagccagcgctacctgctgaagtggagcgtgcccctgggccacgtggatgccattgaatatggcagcagcgctggcactggagagcacagccgccacctggccgtgcaccccccagagagcctggccgtggtggccaatgccaagcccaacaaggtgtacatgggccctggccagctgtaccaggacctgcagaacctgctgcatgacctgaatgtcatcggccagatcacccagctgattggcaacctgaagggcaactaccagaacctgaaccagagcgtggcccatgactggaccagcggcctgcagaggctcatcctgaagaaggaggatgagatccgggctgctgactgctgccgcatccagctgcagctgcccgggaagcaggacaagagcggccggcccaccttcttcaccgctgtgttcaacaccttcaccccagccatcaaggagagctgggtgaacagcctgcagatggccaagctggccctggaggaggagaaccacatgggctggttctgtgtggaggatgatggcaaccacatcaagaaggagaagcaccccctgctggtgggccacatgcctgtgatggtggccaagcagcaggagttcaagattgaatgtgccgcctacaaccctgagccctacctgaacaatgaaagccagcctgacagcttcagcacagcccacggcttcctgtggattggcagctgcacccaccagatgggccagatcgccatcgtgtccttccagaacagcacccccaaggtgattgagtgcttcaacgtggagagccgcatcctgtgcatgctgtatgtgcctgtggaggagaagaggcgggagcccggggcccccccagaccctgagaccccagctgtgcgggccagtgatgtgcccaccatctgtgtgggcacagaggagggcagcatcagcatctacaagagcagccagggcagcaagaaggtgcggctgcagcacttcttcaccccagagaagagcacagtgatgagcctggcctgcaccagccagagcctgtatgccggcctggtgaatggagctgtggccagctatgcccgggccccagatggctcctgggacagcgagccccagaaggtgatcaagctgggcgtgctgcctgtgcgcagcctgctgatgatggaggacaccctgtgggccgccagcggcggccaggtgttcatcatctctgtggagacccatgctgtggagggccagctggaggcccaccaggaggagggcatggtgatcagccacatggctgtgtctggagtgggcatctggatcgccttcaccagcggcagcaccctgcggctcttccacacagagaccctgaagcacctgcaggacatcaacatcgccacccctgtgcacaacatgctgcccggccaccagaggctgtctgtgaccagcctgctggtgtgccacggcctgctgatggtgggcaccagcctgggcgtgctggtggccctgcctgtgccccggctgcagggcatccccaaggtgacaggccggggcatggtgtcctaccacgcccacaacagccctgtgaagttcatcgtgctggccacagccctgcacgagaaggacaaggacaagagccgggacagcctggcccctggccctgagccccaggatgaggaccagaaggatgccctgcccagcggcggggccggcagcagcctgagccagggcgaccctgatgctgccatctggctgggggacagcctgggctccatgacccagaagagtgacctgagcagcagcagcggcagcctgagcctgagccacggcagcagcagcctggagcacagaagtgaggacagcaccatctatgacctgctgaaggaccctgtgtccctgcggagcaaggcccggcgggccaagaaggccaaggccagcagcgccctggtggtgtgtggcggccagggccaccggcgggtgcacaggaaggcccggcagccccaccaggaggagctggcccccaccgtgatggtgtggcagatccccctgctgaacatctag

SEQ ID NO: 167984 - DNA, 1833 bp, Artificial Sequence
  Description of Artificial Sequence: Synthetic coding sequence
atgaggcctcctggcttcctgagccgggcccccagcctgaacagagctgagcggggcatctggagctgcagcatggaccagcgggagcccctgcccccagccccagcagaaaatgagatgaagtatgacaccaacaacaatgaggaggaggagggggagcagtttgattttgattctggagatgagatccctgaggccgaccggcaggcccccagcgcccctgagaccggcggggccggggccagcgaggccccagcccccactggaggagaagatggagctggagctgagaccacccctgtggccgagcccaccaagctggtgctgcccatgaaggtgaacccctacagcgtgattgacatcacccccttccaggaggaccagccccccacccctgtgcccagcgctgaggaggagaatgtgggcctgcacgtgccctgtggctacctggtgcctgtgccctgtggctatgctgtgcccagcaacctgcccctgctgctgcctgcctacagcagccctgtgatcatctgtgccaccagcctggatgaggaggccgagaccccagaggtgacagaggaccggcagcccaacagcctgagcagcgaggagccccccaccagcgaggaccaggtgggccgggaggacagcgccctggcccgctgggccgctgaccctgccaacacagcctggatggagaaccctgaggaggccatctatgatgatgtgcccagagaaaattctgattctgagccagatgagatgatctatgatgatgtggagaatggagatgaaggaggcaacagcagcctggagtatggctggagcagcagcgagtttgagagctatgaggagcagagcgacagcgagtgcaagaatggcatccccaggagcttcctgcggagcaaccacaagaagcagatgcagaagctggtgaaggccgccaaggatggcaccaaggatggcctggagaggaccagggctgctgtgaagaggggccgctccttcatccgcaccaagagcctcatcgcccaggaccacaggagcagcctggaggaggagcagaacctcttcattgatgtggactgcaagcaccctgaggccatcctgacccccatgcctgagggcctgagccagcagcaggtggtgcggcgctacatcctgggctctgtggtggacagcgagaagaactacgtggatgccctgaagaggatcctggagcagtatgagaagcccctgtctgagatggagcccaaggtgctgtctgagaggaagctgaagacagtgttctacagagtgaaggagatcctgcagtgccacagcctcttccagatcgccctggccagccgggtgtctgagtgggacagcgtggagatgattggagatgtgtttgtggccagcttcagcaagtccatggtgctggatgcctacagtgaatatgtgaacaacttcagcacagctgtggccgtgctgaagaagacctgtgccaccaagccagccttcctggagttcctgaagcaggagcaggaggccagcccagacaggaccaccctgtacagcctgatgatgaagcccatccagcgcttcccccagttcatcctgctgctgcaggacatgctgaagaacaccagcaagggccacccagaccggctgcccctgcagatggccctgacagagctggagaccctggccgagaagctgaatgaaaggaagagagatgctgaccagagatgtgaggtgaagcagatcgccaaggccatcaatgaaagatacctgaacaaggtggagcggggcttcctgcagctgtacagcaagatcatctttgccctgtgctag

SEQ ID NO: 167985 - DNA, 4110 bp, Artificial Sequence
  Description of Artificial Sequence: Synthetic coding sequence
atgaggcctcctggcttcctgagccgggcccccagcctgaacagagctgagcggggcatctggagctgcagcatggaccagcgggagcccctgcccccagccccagcagaaaatgagatgaagtatgacaccaacaacaatgaggaggaggagggggagcagtttgattttgattctggagatgagatccctgaggccgaccggcaggcccccagcgcccctgagaccggcggggccggggccagcgaggccccagcccccactggaggagaagatggagctggagctgagaccacccctgtggccgagcccaccaagctggtgctgcccatgaaggtgaacccctacagcgtgattgacatcacccccttccaggaggaccagccccccacccctgtgcccagcgctgaggaggagaatgtgggcctgcacgtgccctgtggctacctggtgcctgtgccctgtggctatgctgtgcccagcaacctgcccctgctgctgcctgcctacagcagccctgtgatcatctgtgccaccagcctggatgaggaggccgagaccccagaggtgacagaggaccggcagcccaacagcctgagcagcgaggagccccccaccagcgaggaccaggtgggccgggaggacagcgccctggcccgctgggccgctgaccctgccaacacagcctggatggagaaccctgaggaggccatctatgatgatgtgcccagagaaaattctgattctgagccagatgagatgatctatgatgatgtggagaatggagatgaaggaggcaacagcagcctggagtatggctggagcagcagcgagtttgagagctatgaggagcagagcgacagcgagtgcaagaatggcatccccaggagcttcctgcggagcaaccacaagaagcagctgagccatgacctgacccggctgaaggagcactatgagaagaagatgagggacctgatggccagcacagtgggcgtggtggagatccagcagctgcggcagaagcatgagctgaagatgcagaagctggtgaaggccgccaaggatggcaccaaggatggcctggagaggaccagggctgctgtgaagaggggccgctccttcatccgcaccaagagcctgattgcccaggaccacaggagcagcctggaggaggagcagaacctcttcattgatgtggactgcaagcaccctgaggccatcctgacccccatgcctgagggcctgagccagcagcaggtggtgcggcgctacatcctgggctctgtggtggacagcgagaagaactacgtggatgccctgaagaggatcctggagcagtatgagaagcccctgtctgagatggagcccaaggtgctgtctgagaggaagctgaagacagtgttctacagagtgaaggagatcctgcagtgccacagcctcttccagatcgccctggccagccgggtgtctgagtgggacagcgtggagatgattggagatgtgtttgtggccagcttcagcaagtccatggtgctggatgcctacagtgaatatgtgaacaacttcagcacagctgtggccgtgctgaagaagacctgtgccaccaagccagccttcctggagttcctgaagcaggagcaggaggccagcccagacaggaccaccctgtacagcctgatgatgaagcccatccagcgcttcccccagttcatcctgctgctgcaggacatgctgaagaacaccagcaagggccacccagaccggctgcccctgcagatggccctgacagagctggagaccctggccgagaagctgaatgaaaggaagagagatgctgaccagagatgtgaggtgaagcagatcgccaaggccatcaatgaaagatacctgaacaagctgctgagcagcggcagccgctacctgatccgcagtgatgacatgattgagaccgtgtacaatgacagaggagagatcgtgaagaccaaggagcggcgggtcttcatgctgaatgatgtgctgatgtgtgccaccgtgagcagccggcccagccatgacagccgggtgatgagcagccagcgctacctgctgaagtggagcgtgcccctgggccacgtggatgccatcgagtatggcagcagcgctggcaccggggagcacagccgccacctggccgtgcaccccccagagagcctggccgtggtggccaatgccaagcccaacaaggtgtacatgggccctggccagctgtaccaggacctgcagaacctgctgcatgacctgaatgtgattggccagatcacccagctgattggcaacctgaagggcaactaccagaacctgaaccagagcgtggcccatgactggaccagcggcctgcagaggctcatcctgaagaaggaggatgagatccgggctgctgactgctgccgcatccagctgcagctgcccgggaagcaggacaagagcggccggcccaccttcttcaccgctgtgttcaacaccttcaccccagccatcaaggagagctgggtgaacagcctgcagatggccaagctggccctggaggaggagaaccacatgggctggttctgtgtggaggatgatggcaaccacatcaagaaggagaagcaccccctgctggtgggccacatgcctgtgatggtggccaagcagcaggagttcaagattgaatgtgccgcctacaaccctgagccctacctgaacaatgaaagccagcctgacagcttcagcacagcccacggcttcctgtggattggcagctgcacccaccagatgggccagatcgccatcgtgtccttccagaacagcacccccaaggtgattgagtgcttcaacgtggagagccgcatcctgtgcatgctgtatgtgcctgtggaggagaagagaagagagcccggggcccccccagaccctgagaccccagctgtgcgggccagtgatgtgcccaccatctgtgtgggcacagaggagggcagcatcagcatctacaagagcagccagggcagcaagaaggtgcggctgcagcacttcttcaccccagagaagagcacagtgatgagcctggcctgcaccagccagagcctgtatgccggcctggtgaatggagctgtggccagctatgcccgggccccagatggctcctgggacagcgagccccagaaggtgatcaagctgggcgtgctgcctgtgcgcagcctgctgatgatggaggacaccctgtgggccgccagcggcggccaggtgttcatcatctctgtggagacccatgctgtggagggccagctggaggcccaccaggaggagggcatggtgatcagccacatggctgtgtctggagtgggcatctggatcgccttcaccagcggcagcaccctgcggctcttccacacagagaccctgaagcacctgcaggacatcaacatcgccacccctgtgcacaacatgctgcccggccaccagaggctgtctgtgaccagcctgctggtgtgccacggcctgctgatggtgggcaccagcctgggcgtgctggtggccctgcctgtgccccggctgcagggcatccccaaggtgacaggccggggcatggtgtcctaccacgcccacaacagccctgtgaagttcatcgtgctggccacagccctgcacgagaaggacaaggacaagagccgggacagcctggcccctggccctgagccccaggatgaggaccagaaggatgccctgcccagcggcggggccggcagcagcctgagccagggcgaccctgatgctgccatctggctgggggacagcctgggctccatgacccagaagagtgacctgagcagcagcagcggcagcctgagcctgagccacggcagcagcagcctggagcacaggtctgaggacagcaccatctatgacctgctgaaggaccctgtgtccctgcggagcaaggcccggcgggccaagaaggccaaggccagcagcgccctggtggtgtgtggcggccagggccacagaagagtgcacaggaaggcccggcagccccaccaggaggagctggcccccaccgtgatggtgtggcagatccccctgctgaacatctag

SEQ ID NO: 167986 - DNA, 4107 bp, Artificial Sequence
  Description of Artificial Sequence: Synthetic coding sequence
atgaggcctcctggcttcctgagccgggcccccagcctgaacagagctgagcggggcatctggagctgcagcatggaccagcgggagcccctgcccccagccccagcagaaaatgagatgaagtatgacaccaacaacaatgaggaggaggagggggagcagtttgattttgattctggagatgagatccctgaggccgaccggcaggcccccagcgcccctgagaccggcggggccggggccagcgaggccccagcccccactggaggagaagatggagctggagctgagaccacccctgtggccgagcccaccaagctggtgctgcccatgaaggtgaacccctacagcgtgattgacatcacccccttccaggaggaccagccccccacccctgtgcccagcgctgaggaggagaatgtgggcctgcacgtgccctgtggctacctggtgcctgtgccctgtggctatgctgtgcccagcaacctgcccctgctgctgcctgcctacagcagccctgtgatcatctgtgccaccagcctggatgaggaggccgagaccccagaggtgacagaggaccggcagcccaacagcctgagcagcgaggagccccccaccagcgaggaccaggtgggccgggaggacagcgccctggcccgctgggccgctgaccctgccaacacagcctggatggagaaccctgaggaggccatctatgatgatgtgcccagagaaaattctgattctgagccagatgagatgatctatgatgatgtggagaatggagatgaaggaggcaacagcagcctggagtatggctggagcagcagcgagtttgagagctatgaggagcagagcgacagcgagtgcaagaatggcatccccaggagcttcctgcggagcaaccacaagaagcagctgagccatgacctgacccggctgaaggagcactatgagaagaagatgagggacctgatggccagcacagtgggcgtggtggagatccagcagctgcggcagaagcatgagctgaagatgcagaagctggtgaaggccgccaaggatggcaccaaggatggcctggagaggaccagggctgctgtgaagaggggccgctccttcatccgcaccaagagcctgattgcccaggaccacaggagcagcctggaggaggagcagaacctcttcattgatgtggactgcaagcaccctgaggccatcctgacccccatgcctgagggcctgagccagcagcaggtggtgcggcgctacatcctgggctctgtggtggacagcgagaagaactacgtggatgccctgaagaggatcctggagcagtatgagaagcccctgtctgagatggagcccaaggtgctgtctgagaggaagctgaagacagtgttctacagagtgaaggagatcctgcagtgccacagcctcttccagatcgccctggccagccgggtgtctgagtgggacagcgtggagatgattggagatgtgtttgtggccagcttcagcaagtccatggtgctggatgcctacagtgaatatgtgaacaacttcagcacagctgtggccgtgctgaagaagacctgtgccaccaagccagccttcctggagttcctgaaggagcaggaggccagcccagacaggaccaccctgtacagcctgatgatgaagcccatccagcgcttcccccagttcatcctgctgctgcaggacatgctgaagaacaccagcaagggccacccagaccggctgcccctgcagatggccctgacagagctggagaccctggccgagaagctgaatgaaaggaagagagatgctgaccagagatgtgaggtgaagcagatcgccaaggccatcaatgaaagatacctgaacaagctgctgagcagcggcagccgctacctgatccgcagtgatgacatgattgaaacagtgtacaatgacagaggagaaattgtgaagaccaaggagaggagggtcttcatgctgaatgatgtgctgatgtgtgccaccgtgagcagccggcccagccatgacagccgggtgatgagcagccagcgctacctgctgaagtggagcgtgcccctgggccacgtggatgccattgaatatggcagcagcgctggcactggagagcacagccgccacctggccgtgcaccccccagagagcctggccgtggtggccaatgccaagcccaacaaggtgtacatgggccctggccagctgtaccaggacctgcagaacctgctgcatgacctgaatgtcatcggccagatcacccagctgattggcaacctgaagggcaactaccagaacctgaaccagagcgtggcccatgactggaccagcggcctgcagaggctcatcctgaagaaggaggatgagatccgggctgctgactgctgccgcatccagctgcagctgcccgggaagcaggacaagagcggccggcccaccttcttcaccgctgtgttcaacaccttcaccccagccatcaaggagagctgggtgaacagcctgcagatggccaagctggccctggaggaggagaaccacatgggctggttctgtgtggaggatgatggcaaccacatcaagaaggagaagcaccccctgctggtgggccacatgcctgtgatggtggccaagcagcaggagttcaagattgaatgtgccgcctacaaccctgagccctacctgaacaatgaaagccagcctgacagcttcagcacagcccacggcttcctgtggattggcagctgcacccaccagatgggccagatcgccatcgtgtccttccagaacagcacccccaaggtgattgagtgcttcaacgtggagagccgcatcctgtgcatgctgtatgtgcctgtggaggagaagaggcgggagcccggggcccccccagaccctgagaccccagctgtgcgggccagtgatgtgcccaccatctgtgtgggcacagaggagggcagcatcagcatctacaagagcagccagggcagcaagaaggtgcggctgcagcacttcttcaccccagagaagagcacagtgatgagcctggcctgcaccagccagagcctgtatgccggcctggtgaatggagctgtggccagctatgcccgggccccagatggctcctgggacagcgagccccagaaggtgatcaagctgggcgtgctgcctgtgcgcagcctgctgatgatggaggacaccctgtgggccgccagcggcggccaggtgttcatcatctctgtggagacccatgctgtggagggccagctggaggcccaccaggaggagggcatggtgatcagccacatggctgtgtctggagtgggcatctggatcgccttcaccagcggcagcaccctgcggctcttccacacagagaccctgaagcacctgcaggacatcaacatcgccacccctgtgcacaacatgctgcccggccaccagaggctgtctgtgaccagcctgctggtgtgccacggcctgctgatggtgggcaccagcctgggcgtgctggtggccctgcctgtgccccggctgcagggcatccccaaggtgacaggccggggcatggtgtcctaccacgcccacaacagccctgtgaagttcatcgtgctggccacagccctgcacgagaaggacaaggacaagagccgggacagcctggcccctggccctgagccccaggatgaggaccagaaggatgccctgcccagcggcggggccggcagcagcctgagccagggcgaccctgatgctgccatctggctgggggacagcctgggctccatgacccagaagagtgacctgagcagcagcagcggcagcctgagcctgagccacggcagcagcagcctggagcacagaagtgaggacagcaccatctatgacctgctgaaggaccctgtgtccctgcggagcaaggcccggcgggccaagaaggccaaggccagcagcgccctggtggtgtgtggcggccagggccaccggcgggtgcacaggaaggcccggcagccccaccaggaggagctggcccccaccgtgatggtgtggcagatccccctgctgaacatctag

SEQ ID NO: 167987 - DNA, 2949 bp, Artificial Sequence
  Description of Artificial Sequence: Synthetic coding sequence
atgctgcccagcagctcctggggcaagaggaagctgcggggccgcctgggctgggtgcggagtgatgcccggggcgtgatgtgggcccggcaggagggcctgcaccacccccacccccatgctgtgatccgctgccccagcagcagcagcagctctgtgtcctgcagcggggacagcgaggaggaggacatgggcctgctggaggtgtctgtgtctgacatcaagcccccagcccctgagctgggccccatgcctgagggcctgagcccccagcaggtggtgagaagacacatcctgggcagcatcgtgcagagcgagggcagctatgtggagagcctgaagaggatcctgcaggactacagaaaccccctgatggagatggagcccaaggccctgagcgccaggaagtgccaggtggtgttcttccgggtgaaggagatcctgcactgccacagcatgttccagatcgccctgagcagccgggtggccgagtgggacagcacagagaagattggagacctgtttgtggccagtgacatgctgaagaacaccccccggggccacccagaccggctgagcctgcagctggccctgacagagctggagaccctggccgagaagctgaatgagcagaagaggctggccgaccaggtggccgagatccagcagctgaccaagtctgtgtctgacaggagcagcctgaacaagctgctgaccagcggccagaggcagctgctgctgtgtgagaccctgacagagaccgtgtatggagaccggggccagctgatcaagagcaaggagcggcgggtcttcctgctgaatgacatgctggtgtgtgccaacatcaacttcaagggccagctggagatcagcagcctggtgcccctgggccccaagtatgtggtgaagtggaacacagccctgccccaggtgcaggtggtggaggtgggccaggacggcggcacctatgacaaggacaacgtgctgatccagcacagcggggccaagaaggccagcgccagcggccaggcccagaacaaggtgtacctgggcccccccaggctcttccaggagctgcaggacctgcagaaggacctggccgtggtggagcagatcaccctgctgatcagcaccctgcacggcacctaccagaacctgaacatgacagtggcccaggactggtgcctggccctgcagaggctgatgagggtgaaggaggaggagatccacagcgccaacaagtgccgcctgcggctgctgctgcccgggaagccagacaagagcggccggcccatctccttcatggtggtgttcatcacccccaaccccctgagcaagatctcctgggtgaaccggctgcacctggccaagattggcctgcgggaggagaaccagcccggctggctgtgcccagatgaggacaagaagagcaaggcccccttctggtgccccatcctggcctgctgcatcccagccttcagcagccgggccctgagcctgcagctgggcgccctggtgcacagccctgtgaactgccccctgctgggcttctctgctgtgtccaccagcctgccccagggctacctgtgggtgggcggcggccaggagggcgctgggggccaggtggagatcttcagcctgaaccggcccagccccaggacagtgaagagcttccccctggccgcccctgtgctgtgcatggagtacatccctgagctggaggaggaggccgagagcagagatgagagccccaccgtggccgaccccagcgccaccgtgcaccccaccatctgcctgggcctgcaggacggcagcatcctgctgtacagctctgtggacaccggcacccagtgcctggtgtcctgccgcagccctggcctgcagcctgtgctgtgcctgcggcacagccccttccacctgctggccggcctgcaggacggcaccctggccgcctaccccaggaccagcggcggcgtgctgtgggacctggagagcccccctgtgtgcctgactgtgggccctggccctgtgaggaccctgctgagcctggaggatgctgtgtgggccagctgtggcccctgggtgacagtgctggaggccaccaccctgcagccccagcagagctttgaggcccaccaggatgaggccgtgtctgtgacccacatggtgaaggccggcagcggcgtgtggatggccttcagcagcggcaccagcatccgcctcttccacacagagaccctggagcacctgcaggagatcaacatcgccaccaggaccaccttcctgctgcccggccagaagcacctgtgtgtgaccagcctgctgatctgccagggcctgctgtgggtgggcacagaccagggcgtcatcgtgctgctgcctgtgccccggctggagggcatccccaagatcaccgggaagggcatggtgtccctgaatggccactgcggccctgtggccttcctggccgtggccaccagcatcctggccccagacatcctgcggagtgaccaggaggaggccgagggccccagggctgaggaggacaagccagatggccaggcccacgagcccatgccagacagccacgtgggccgggagctgaccaggaagaagggcatcctgctgcagtaccgcctgcggagcacagcccacctgcccggccccctgctgtccatgagggagcccgccccagcagatggagctgccctggagcacagtgaagaagatggcagcatctatgagatggctgatgatcctgacatctgggtgcgcagccggccctgtgccagagatgcccacaggaaggagatctgcagcgtggccatcatcagcggcggccagggctacagaaactttggaagtgccctgggcagcagcggccggcaggccccctgtggggagacagacagcaccctgctgatctggcaggtgcccctgatgctgtag

SEQ ID NO: 167988 - DNA, 3840 bp, Artificial Sequence
  Description of Artificial Sequence: Synthetic coding sequence
atggccagcagcaaccccccaccccagcctgccatcggggaccagctggtgcctggggtgcccggccccagcagcgaggccgaggatgatcctggagaggcctttgaatttgatgacagtgatgatgaggaggacaccagcgctgccctgggcgtgcccagcctggcccctgagcgggacacagatcctcctctcatccacctggacagcatccctgtgacagatcctgaccctgctgctgcccctcctggcactggagtgcctgcctgggtgtccaatggagatgctgctgatgctgccttcagcggggcccggcacagctcctggaagaggaagagcagcagaagaattgaccgcttcaccttccctgccctggaggaggatgtgatctatgatgatgtgccctgtgagagcccagatgcccaccagcccggggctgagaggaacctgctgtatgaagatgcccaccgggccggggccccccggcaggccgaggacctgggctggagcagcagcgagtttgagagctacagtgaagattctggagaggaggccaagccagaggtggaggtggagcccgccaagcaccgggtgtccttccagcccaagctgagcccagacctgacccggctgaaggagagatatgcccggaccaagagggacatcctggccctgcgggtgggcggccgggacatgcaggagctgaagcacaagtatgactgcaagatgacccagctgatgaaggccgccaagagcggcaccaaggatggcctggagaagaccaggatggctgtgatgaggaaggtgtccttcctgcacaggaaggatgtgctgggggacagcgaggaggaggacatgggcctgctggaggtgtctgtgtctgacatcaagcccccagcccctgagctgggccccatgcctgagggcctgagcccccagcaggtggtgagaagacacatcctgggcagcatcgtgcagagcgagggcagctatgtggagagcctgaagaggatcctgcaggactacagaaaccccctgatggagatggagcccaaggccctgagcgccaggaagtgccaggtggtgttcttccgggtgaaggagatcctgcactgccacagcatgttccagatcgccctgagcagccgggtggccgagtgggacagcacagagaagattggagacctgtttgtggccagcttcagcaagtccatggtgctggatgtgtacagcgactatgtgaacaacttcaccagcgccatgagcatcatcaagaaggcctgcctgaccaagccagccttcctggagttcctgaagaggcggcaggtgtgcagcccagacagagtgaccctgtatggcctgatggtgaagcccatccagcgcttcccccagttcatcctgctgctgcaggacatgctgaagaacaccccccggggccacccagaccggctgagcctgcagctggccctgacagagctggagaccctggccgagaagctgaatgagcagaagaggctggccgaccaggtggccgagatccagcagctgaccaagtctgtgtctgacaggagcagcctgaacaagctgctgaccagcggccagaggcagctgctgctgtgtgagaccctgacagagaccgtgtatggagaccggggccagctgatcaagagcaaggagcggcgggtcttcctgctgaatgacatgctggtgtgtgccaacatcaacttcaagccagccaaccaccggggccagctggagatcagcagcctggtgcccctgggccccaagtatgtggtgaagtggaacacagccctgccccaggtgcaggtggtggaggtgggccaggacggcggcacctatgacaaggacaacgtgctgatccagcacagcggggccaagaaggccagcgccagcggccaggcccagaacaaggtgtacctgggcccccccaggctcttccaggagctgcaggacctgcagaaggacctggccgtggtggagcagatcaccctgctgatcagcaccctgcacggcacctaccagaacctgaacatgacagtggcccaggactggtgcctggccctgcagaggctgatgagggtgaaggaggaggagatccacagcgccaacaagtgccgcctgcggctgctgctgcccgggaagccagacaagagcggccggcccatctccttcatggtggtgttcatcacccccaaccccctgagcaagatctcctgggtgaaccggctgcacctggccaagattggcctgcgggaggagaaccagcccggctggctgtgcccagatgaggacaagaagagcaaggcccccttctggtgccccatcctggcctgctgcatcccagccttcagcagccgggccctgagcctgcagctgggcgccctggtgcacagccctgtgaactgccccctgctgggcttctctgctgtgtccaccagcctgccccagggctacctgtgggtgggcggcggccaggagggcgccggcggccaggtggagatcttcagcctgaaccggcccagccccaggacagtgaagagcttccccctggccgcccctgtgctgtgcatggagtacatccctgagctggaggaggaggccgagagcagagatgagagccccaccgtggccgaccccagcgccaccgtgcaccccaccatctgcctgggcctgcaggacggcagcatcctgctgtacagctctgtggacaccggcacccagtgcctggtgtcctgccgcagccctggcctgcagcctgtgctgtgcctgcggcacagccccttccacctgctggccggcctgcaggacggcaccctggccgcctaccccaggaccagcggaggagtgctgtgggacctggagagcccccctgtgtgcctgactgtgggccctggccctgtgaggaccctgctgagcctggaggatgctgtgtgggccagctgtggcccctgggtgacagtgctggaggccaccaccctgcagccccagcagagctttgaggcccaccaggatgaagctgtgtctgtgacccacatggtgaaggccggcagcggcgtgtggatggccttcagcagcggcaccagcatccgcctcttccacacagagaccctggagcacctgcaggagatcaacatcgccaccaggaccaccttcctgctgcccggccagaagcacctgtgtgtgaccagcctgctgatctgccagggcctgctgtgggtgggcacagaccagggcgtgattgtgctgctgcctgtgccccggctggagggcatccccaagatcaccgggaagggcatggtgtccctgaatggccactgcggccctgtggccttcctggccgtggccaccagcatcctggccccagacatcctgcggagtgaccaggaggaggccgagggccccagggctgaggaggacaagccagatggccaggcccacgagcccatgccagacagccacgtgggccgggagctgaccaggaagaagggcatcctgctgcagtaccgcctgcggagcacagcccacctgcccggccccctgctgtccatgagggagcccgccccagcagatggagctgccctggagcacagcgaggaggatggcagcatctatgagatggctgatgatcctgacatctgggtgcgcagccggccctgtgccagagatgcccacaggaaggagatctgcagcgtggccatcatcagcggcggccagggctacagaaactttggcagcgccctgggcagcagcggccggcaggccccctgtggggagacagacagcaccctgctgatctggcaggtgcccctgatgctgtag

SEQ ID NO: 167989 - DNA, 3159 bp, Artificial Sequence
  Description of Artificial Sequence: Synthetic coding sequence
atgctgcccagcagctcctggggcaagaggaagctgcggggccgcctgggctgggtgcggagtgatgcccggggcgtgatgtgggcccggcaggagggcctgcaccacccccacccccatgctgtgatccgctgccccagcagcagcagcagctctgtgtcctgcagcggggacagcgaggaggaggacatgggcctgctggaggtgtctgtgtctgacatcaagcccccagcccctgagctgggccccatgcctgagggcctgagcccccagcaggtggtgagaagacacatcctgggcagcatcgtgcagagcgagggcagctatgtggagagcctgaagaggatcctgcaggactacagaaaccccctgatggagatggagcccaaggccctgagcgccaggaagtgccaggtggtgttcttccgggtgaaggagatcctgcactgccacagcatgttccagatcgccctgagcagccgggtggccgagtgggacagcacagagaagattggagacctgtttgtggccagcttcagcaagtccatggtgctggatgtgtacagcgactatgtgaacaacttcaccagcgccatgagcatcatcaagaaggcctgcctgaccaagccagccttcctggagttcctgaagaggcggcaggtgtgcagcccagacagagtgaccctgtatggcctgatggtgaagcccatccagcgcttcccccagttcatcctgctgctgcaggacatgctgaagaacaccccccggggccacccagaccggctgagcctgcagctggccctgacagagctggagaccctggccgagaagctgaatgagcagaagaggctggccgaccaggtggccgagatccagcagctgaccaagtctgtgtctgacaggagcagcctgaacaagctgctgaccagcggccagaggcagctgctgctgtgtgagaccctgacagagaccgtgtatggagaccggggccagctgatcaagagcaaggagcggcgggtcttcctgctgaatgacatgctggtgtgtgccaacatcaacttcaagggccagctggagatcagcagcctggtgcccctgggccccaagtatgtggtgaagtggaacacagccctgccccaggtgcaggtggtggaggtgggccaggacggcggcacctatgacaaggacaacgtgctgatccagcacagcggggccaagaaggccagcgccagcggccaggcccagaacaaggtgtacctgggcccccccaggctcttccaggagctgcaggacctgcagaaggacctggccgtggtggagcagatcaccctgctgatcagcaccctgcacggcacctaccagaacctgaacatgacagtggcccaggactggtgcctggccctgcagaggctgatgagggtgaaggaggaggagatccacagcgccaacaagtgccgcctgcggctgctgctgcccgggaagccagacaagagcggccggcccatctccttcatggtggtgttcatcacccccaaccccctgagcaagatctcctgggtgaaccggctgcacctggccaagattggcctgcgggaggagaaccagcccggctggctgtgcccagatgaggacaagaagagcaaggcccccttctggtgccccatcctggcctgctgcatcccagccttcagcagccgggccctgagcctgcagctgggcgccctggtgcacagccctgtgaactgccccctgctgggcttctctgctgtgtccaccagcctgccccagggctacctgtgggtgggcggcggccaggagggcgctgggggccaggtggagatcttcagcctgaaccggcccagccccaggacagtgaagagcttccccctggccgcccctgtgctgtgcatggagtacatccctgagctggaggaggaggccgagagcagagatgagagccccaccgtggccgaccccagcgccaccgtgcaccccaccatctgcctgggcctgcaggacggcagcatcctgctgtacagctctgtggacaccggcacccagtgcctggtgtcctgccgcagccctggcctgcagcctgtgctgtgcctgcggcacagccccttccacctgctggccggcctgcaggacggcaccctggccgcctaccccaggaccagcggcggcgtgctgtgggacctggagagcccccctgtgtgcctgactgtgggccctggccctgtgaggaccctgctgagcctggaggatgctgtgtgggccagctgtggcccctgggtgacagtgctggaggccaccaccctgcagccccagcagagctttgaggcccaccaggatgaggccgtgtctgtgacccacatggtgaaggccggcagcggcgtgtggatggccttcagcagcggcaccagcatccgcctcttccacacagagaccctggagcacctgcaggagatcaacatcgccaccaggaccaccttcctgctgcccggccagaagcacctgtgtgtgaccagcctgctgatctgccagggcctgctgtgggtgggcacagaccagggcgtcatcgtgctgctgcctgtgccccggctggagggcatccccaagatcaccgggaagggcatggtgtccctgaatggccactgcggccctgtggccttcctggccgtggccaccagcatcctggccccagacatcctgcggagtgaccaggaggaggccgagggccccagggctgaggaggacaagccagatggccaggcccacgagcccatgccagacagccacgtgggccgggagctgaccaggaagaagggcatcctgctgcagtaccgcctgcggagcacagcccacctgcccggccccctgctgtccatgagggagcccgccccagcagatggagctgccctggagcacagtgaagaagatggcagcatctatgagatggctgatgatcctgacatctgggtgcgcagccggccctgtgccagagatgcccacaggaaggagatctgcagcgtggccatcatcagcggcggccagggctacagaaactttggaagtgccctgggcagcagcggccggcaggccccctgtggggagacagacagcaccctgctgatctggcaggtgcccctgatgctgtag

SEQ ID NO: 167990 - DNA, 3723 bp, Artificial Sequence
  Description of Artificial Sequence: Synthetic coding sequence
atggccagcagcaaccccccaccccagcctgccatcggggaccagctggtgcctggggtgcccggccccagcagcgaggccgaggatgatcctggagaggcctttgaatttgatgacagtgatgatgaggaggacaccagcgctgccctgggcgtgcccagcctggcccctgagcgggacacagatcctcctctcatccacctggacagcatccctgtgacagatcctgaccctgctgctgcccctcctggcactggagtgcctgcctgggtgtccaatggagatgctgctgatgctgccttcagcggggcccggcacagctcctggaagaggaagagcagcagaagaattgaccgcttcaccttccctgccctggaggaggatgtgatctatgatgatgtgccctgtgagagcccagatgcccaccagcccggggctgagaggaacctgctgtatgaagatgcccaccgggccggggccccccggcaggccgaggacctgggctggagcagcagcgagtttgagagctacagtgaagattctggagaggaggccaagccagaggtggaggtggagcccgccaagcaccgggtgtccttccagcccaagatgacccagctgatgaaggccgccaagagcggcaccaaggatggcctggagaagaccaggatggctgtgatgaggaaggtgtccttcctgcacaggaaggatgtgctgggggacagcgaggaggaggacatgggcctgctggaggtgtctgtgtctgacatcaagcccccagcccctgagctgggccccatgcctgagggcctgagcccccagcaggtggtgcggcggcacatcctgggcagcatcgtgcagagcgagggcagctatgtggagagcctgaagaggatcctgcaggactacagaaaccccctgatggagatggagcccaaggccctgagcgccaggaagtgccaggtggtgttcttccgggtgaaggagatcctgcactgccacagcatgttccagatcgccctgagcagccgggtggccgagtgggacagcacagagaagatcggggacctgtttgtggccagcttcagcaagtccatggtgctggatgtgtacagcgactatgtgaacaacttcaccagcgccatgagcatcatcaagaaggcctgcctgaccaagccagccttcctggagttcctgaagaggcggcaggtgtgcagcccagacagagtgaccctgtatggcctgatggtgaagcccatccagcgcttcccccagttcatcctgctgctgcaggacatgctgaagaacaccccccggggccacccagaccggctgagcctgcagctggccctgacagagctggagaccctggccgagaagctgaatgagcagaagaggctggccgaccaggtggccgagatccagcagctgaccaagtctgtgtctgacaggagcagcctgaacaagctgctgaccagcggccagaggcagctgctgctgtgtgagaccctgacagaaacagtgtatggagaccggggccagctgatcaagagcaaggagaggagggtcttcctgctgaatgacatgctggtgtgtgccaacatcaacttcaagccagccaaccaccggggccagctggagatcagcagcctggtgcccctgggccccaagtatgtggtgaagtggaacacagccctgccccaggtgcaggtggtggaggtgggccaggacggcggcacctatgacaaggacaacgtgctgatccagcacagcggggccaagaaggccagcgccagcggccaggcccagaacaaggtgtacctgggcccccccaggctcttccaggagctgcaggacctgcagaaggacctggccgtggtggagcagatcaccctgctgatcagcaccctgcacggcacctaccagaacctgaacatgacagtggcccaggactggtgcctggccctgcagaggctgatgagggtgaaggaggaggagatccacagcgccaacaagtgccgcctgcggctgctgctgcccgggaagccagacaagagcggccggcccatctccttcatggtggtgttcatcacccccaaccccctgagcaagatctcctgggtgaaccggctgcacctggccaagattggcctgcgggaggagaaccagcccggctggctgtgcccagatgaggacaagaagagcaaggcccccttctggtgccccatcctggcctgctgcatcccagccttcagcagccgggccctgagcctgcagctgggcgccctggtgcacagccctgtgaactgccccctgctgggcttctctgctgtgtccaccagcctgccccagggctacctgtgggtgggcggcggccaggagggcgctgggggccaggtggagatcttcagcctgaaccggcccagccccaggacagtgaagagcttccccctggccgcccctgtgctgtgcatggagtacatccctgagctggaggaggaggccgagagcagagatgagagccccaccgtggccgaccccagcgccaccgtgcaccccaccatctgcctgggcctgcaggacggcagcatcctgctgtacagctctgtggacaccggcacccagtgcctggtgtcctgccgcagccctggcctgcagcctgtgctgtgcctgcggcacagccccttccacctgctggccggcctgcaggacggcaccctggccgcctaccccaggaccagcggcggcgtgctgtgggacctggagagcccccctgtgtgcctgactgtgggccctggccctgtgaggaccctgctgagcctggaggatgctgtgtgggccagctgtggcccctgggtgacagtgctggaggccaccaccctgcagccccagcagagctttgaggcccaccaggatgaggccgtgtctgtgacccacatggtgaaggccggcagcggcgtgtggatggccttcagcagcggcaccagcatccgcctcttccacacagagaccctggagcacctgcaggagatcaacatcgccaccaggaccaccttcctgctgcccggccagaagcacctgtgtgtgaccagcctgctgatctgccagggcctgctgtgggtgggcacagaccagggcgtcatcgtgctgctgcctgtgccccggctggagggcatccccaagatcaccgggaagggcatggtgtccctgaatggccactgcggccctgtggccttcctggccgtggccaccagcatcctggccccagacatcctgcggagtgaccaggaggaggccgagggccccagggctgaggaggacaagccagatggccaggcccacgagcccatgccagacagccacgtgggccgggagctgaccaggaagaagggcatcctgctgcagtaccgcctgcggagcacagcccacctgcccggccccctgctgtccatgagggagcccgccccagcagatggagctgccctggagcacagtgaagaagatggcagcatctatgagatggctgatgatcctgacatctgggtgcgcagccggccctgtgccagagatgcccacaggaaggagatctgcagcgtggccatcatcagcggcggccagggctacagaaactttggaagtgccctgggcagcagcggccggcaggccccctgtggggagacagacagcaccctgctgatctggcaggtgcccctgatgctgtag

SEQ ID NO: 167991 - DNA, 1467 bp, Artificial Sequence
  Description of Artificial Sequence: Synthetic coding sequence
atgacccagctgatgaaggccgccaagagcggcaccaaggatggcctggagaagaccaggatggctgtgatgaggaaggtgtccttcctgcacaggaaggatgtgctgggggacagcgaggaggaggacatgggcctgctggaggtgtctgtgtctgacatcaagcccccagcccctgagctgggccccatgcctgagggcctgagcccccagcaggtggtgagaagacacatcctgggcagcatcgtgcagagcgagggcagctatgtggagagcctgaagaggatcctgcaggactacagaaaccccctgatggagatggagcccaaggccctgagcgccaggaagtgccaggtggtgttcttccgggtgaaggagatcctgcactgccacagcatgttccagatcgccctgagcagccgggtggccgagtgggacagcacagagaagattggagacctgtttgtggccagcttcagcaagtccatggtgctggatgtgtacagcgactatgtgaacaacttcaccagcgccatgagcatcatcaagaaggcctgcctgaccaagccagccttcctggagttcctgaagaggcggcaggtgtgcagcccagacagagtgaccctgtatggcctgatggtgaagcccatccagcgcttcccccagttcatcctgctgctgcaggacatgctgaagaacaccccccggggccacccagaccggctgagcctgcagctggccctgacagagctggagaccctggccgagaagctgaatgagcagaagaggctggccgaccaggtggccgagatccagcagctgaccaagtctgtgtctgacaggagcagcctgaacaagctgctgaccagcggccagaggcagctgctgctgtgtgagaccctgacagagaccgtgtatggagaccggggccagctgatcaagagcaaggagcggcgggtcttcctgctgaatgacatgctggtgtgtgccaacatcaacttcaagccagccaaccaccggggccagctggagatcagcagcctggtgcccctgggccccaagtatgtggtgaagtggaacacagccctgccccaggtgcaggtggtggaggtgggccaggacggcggcacctatgacaaggacaacgtgctgatccagcacagcggggccaagaaggccagcgccagcggccaggcccagaacaaggtgtacctgggcccccccaggctcttccaggagctgcaggacctgcagaaggacctggccgtggtggagcagatcaccctgctgatcagcaccctgcacggcacctaccagaacctgaacatgacagtggcccaggactggtgcctggccctgcagaggctgatgagggtgaaggaggaggagatccacagcgccaacaagtgccgcctgcggctgctgctgcccgggaagccagacaagggcacctggagcgacatgtag

SEQ ID NO: 167992 - DNA, 3204 bp, Artificial Sequence
  Description of Artificial Sequence: Synthetic coding sequence
atggccagcagcaaccccccaccccagcctgccatcggggaccagctggtgcctggggtgcccggccccagcagcgaggccgaggatgatcctggagaggcctttgaatttgatgacagtgatgatgaggaggacaccagcgctgccctgggcgtgcccagcctggcccctgagcgggacacagatcctcctctcatccacctggacagcatccctgtgacagatcctgaccctgctgctgcccctcctggcactggagtgcctgcctgggtgtccaatggagatgctgctgatgctgccttcagcggggcccggcacagctcctggaagaggaagagcagcagaagaattgaccgcttcaccttccctgccctggaggaggatgtgatctatgatgatgtgccctgtgagagcccagatgcccaccagcccggggctgagaggaacctgctgtatgaagatgcccaccgggccggggccccccggcaggccgaggacctgggctggagcagcagcgagtttgagagctacagtgaagattctggagaggaggccaagccagaggtggaggtggagcccgccaagcaccgggtgtccttccagcccaagctgagcccagacctgacccggctgaaggagagatatgcccggaccaagagggacatcctggccctgcgggtgggcggccgggacatgcaggagctgaagcacaagtatgactgcaagatgacccagctgatgaaggccgccaagagcggcaccaaggatggcctggagaagaccaggatggctgtgatgaggaaggtgtccttcctgcacaggaaggatgtgctgggggacagcgaggaggaggacatgggcctgctggaggtgtctgtgtctgacatcaagcccccagcccctgagctgggccccatgcctgagggcctgagcccccagcaggtggtgagaagacacatcctgggcagcatcgtgcagagcgagggcagctatgtggagagcctgaagaggatcctgcaggactacagaaaccccctgatggagatggagcccaaggccctgagcgccaggaagtgccaggtggtgttcttccgggtgaaggagatcctgcactgccacagcatgttccagatcgccctgagcagccgggtggccgagtgggacagcacagagaagattggagacctgtttgtggccagcttcagcaagtccatggtgctggatgtgtacagcgactatgtgaacaacttcaccagcgccatgagcatcatcaagaaggcctgcctgaccaagccagccttcctggagttcctgaagaggcggcaggtgtgcagcccagacagagtgaccctgtatggcctgatggtgaagcccatccagcgcttcccccagttcatcctgctgctgcaggacatgctgaagaacaccccccggggccacccagaccggctgagcctgcagctggccctgacagagctggagaccctggccgagaagctgaatgagcagaagaggctggccgaccaggtggccgagatccagcagctgaccaagtctgtgtctgacaggagcagcctgaacaagctgctgaccagcggccagaggcagctgctgctgtgtgagaccctgacagagaccgtgtatggagaccggggccagctgatcaagagcaaggagcggcgggtcttcctgctgaatgacatgctggtgtgtgccaacatcaacttcaagggccagctggagatcagcagcctggtgcccctgggccccaagtatgtggtgaagtggaacacagccctgccccaggtgcaggtggtggaggtgggccaggacggcggcacctatgacaaggacaacgtgctgatccagcacagcggggccaagaaggccagcgccagcggccaggcccagaacaaggtgtacctgggcccccccaggctcttccaggagctgcaggacctgcagaaggacctggccgtggtggagcagatcaccctgctgatcagcaccctgcacggcacctaccagaacctgaacatgacagtggcccaggactggtgcctggccctgcagaggctgatgagggtgaaggaggaggagatccacagcgccaacaagtgccgcctgcggctgctgctgcccgggaagccagacaagagcggccggcccatctccttcatggtggtgttcatcacccccaaccccctgagcaagatctcctgggtgaaccggctgcacctggccaagattggcctgcgggaggagaaccagcccggctggctgtgcccagatgaggacaagaagagcaaggcccccttctggtgccccatcctggcctgctgcatcccagccttcagcagccgggccctgagcctgcagctgggcgccctggtgcacagccctgtgaactgccccctgctgggcttctctgctgtgtccaccagcctgccccagggctacctgtgggtgggcggcggccaggagggcgctgggggccaggtggagatcttcagcctgaaccggcccagccccaggacagtgaagagcttccccctggccgcccctgtgctgtgcatggagtacatccctgagctggaggaggaggccgagagcagagatgagagccccaccgtggccgaccccagcgccaccgtgcaccccaccatctgcctgggcctgcaggacggcagcatcctgctgtacagctctgtggacaccggcacccagtgcctggtgtcctgccgcagccctggcctgcagcctgtgctgtgcctgcggcacagccccttccacctgctggccggcctgcaggacggcaccctggccgcctaccccaggaccagcggcggcgtgctgtgggacctggagagcccccctgtgtgcctgactgtgggccctggccctgtgaggaccctgctgagcctggaggatgctgtgtgggccagctgtggcccctgggtgacagtgctggaggccaccaccctgcagccccagcagagctttgaggcccaccaggatgaggccgtgtctgtgacccacatggtgaaggccggcagcggcgtgtggatggccttcagcagcggcaccagcatccgcctcttccacacagagaccctggagcacctgcaggagatcaacatcgccaccaggaccaccttcctgctgcctgacaggagcctcatcaagtgcagcccccgggcctag

SEQ ID NO: 167993 - DNA, 3723 bp, Artificial Sequence; identical to SEQ ID NO: 167990
  Description of Artificial Sequence: Synthetic coding sequence

SEQ ID NO: 167994 - DNA, 3129 bp, Artificial Sequence
  Description of Artificial Sequence: Synthetic coding sequence
atgctgcccagcagctcctggggcaagaggaagctgcggggccgcctgggctgggtgcggagtgatgcccggggcgtgatgtgggcccggcaggagggcctgcaccacccccacccccatgctgtgatccgctgccccagcagcagcagcagctctgtgtcctgcagcggggacagcgaggaggaggacatgggcctgctggaggtgtctgtgtctgacatcaagcccccagcccctgagctgggccccatgcctgagggcctgagcccccagcaggtggtgagaagacacatcctgggcagcatcgtgcagagcgagggcagctatgtggagagcctgaagaggatcctgcaggactacagaaaccccctgatggagatggagcccaaggccctgagcgccaggaagtgccaggtggtgttcttccgggtgaaggagatcctgcactgccacagcatgttccagatcgccctgagcagccgggtggccgagtgggacagcacagagaagattggagacctgtttgtggccagcttcagcaagtccatggtgctggatgtgtacagcgactatgtgaacaacttcaccagcgccatgagcatcatcaagaaggcctgcctgaccaagccagccttcctggagttcctgaagaggcggcaggtgtgcagcccagacagagtgaccctgtatggcctgatggtgaagcccatccagcgcttcccccagttcatcctgctgctgcaggacatgctgaagaacaccccccggggccacccagaccggctgagcctgcagctggccctgacagagctggagaccctggccgagaagctgaatgagcagaagaggctggccgaccaggtggccgagatccagcagctgaccaagtctgtgtctgacaggagcagcctgaacaagctgctgaccagcggccagaggcagctgctgctgtgtgagaccctgacagagaccgtgtatggagaccggggccagctgatcaagagcaaggagcggcgggtcttcctgctgaatgacatgctggtgtgtgccaacatcaacttcaagggccagctggagatcagcagcctggtgcccctgggccccaagtatgtggtgaagtggaacacagccctgccccaggtgcaggtggtggaggtgggccaggacggcggcacctatgacaaggacaacgtgctgatccagcacagcggggccaagaaggccagcgccagcggccaggcccagaacaaggtgtacctgggcccccccaggctcttccaggagctgcaggacctgcagaaggacctggccgtggtggagcagatcaccctgctgatcagcaccctgcacggcacctaccagaacctgaacatgacagtggcccaggactggtgcctggccctgcagaggctgatgagggtgaaggaggaggagatccacagcgccaacaagtgccgcctgcggctgctgctgcccgggaagccagacaagagcggccggcccatctccttcatggtggtgttcatcacccccaaccccctgagcaagatctcctgggtgaaccggctgcacctggccaagattggcctgcgggaggagaaccagcccggctggctgtgcccagatgaggacaagaagagcaaggcccccttctggtgccccatcctggcctgctgcatcccagccttcagcagccgggccctgagcctgcagctgggcgccctggtgcacagccctgtgaactgccccctgctgggcttctctgctgtgtccaccagcctgccccagggctacctgtgggtgggcggcggccaggagggcgctgggggccaggtggagatcttcagcctgaaccggcccagccccaggacagtgaagagcttccccctggccgcccctgtgctgtgcatggagtacatccctgagctggaggaggaggccgagagcagagatgagagccccaccgtggccgaccccagcgccaccgtgcaccccaccatctgcctgggcctgcaggacggcagcatcctgctgtacagctctgtggacaccggcacccagtgcctggtgtcctgccgcagccctggcctgcagcctgtgctgtgcctgcggcacagccccttccacctgctggccggcctgcaggacggcaccctggccgcctaccccaggaccagcggcggcgtgctgtgggacctggagagcccccctgtgtgcctgactgtgggccctggccctgtgaggaccctgctgagcctggaggatgctgtgtgggccagctgtggcccctgggtgacagtgctggaggccaccaccctgcagccccagcagagctttgaggcccaccaggatgaggccgtgtctgtgacccacatggtgaaggccggcagcggcgtgtggatggccttcagcagcggcaccagcatccgcctcttccacacagagaccctggagcacctgcaggagatcaacatcgccaccaggaccaccttcctgctgcccggccagaagcacctgtgtgtgaccagcctgctgatctgccagggcctgctgtgggtgggcacagaccagggcgtcatcgtgctgctgcctgtgccccggctggagggcatccccaagatcaccgggaagggcatggtgtccctgaatggccactgcggccctgtggccttcctggccgtggccaccagcatcctggccccagacatcctgcggagtgaccaggaggaggccgagggccccagggctgaggaggacaagccagatggccaggcccacgagcccatgccagacagccacgtgggccgggagctgaccaggaagaagggcatcctgctgcagtaccgcctgcggagcacagcccacctgcccggccccctgctgtccatgagggagcccgccccagcagatggagctgccctggagcacagtgaagaagatggcagcatctatgagatggccttcttcctgaaggccaagaacaccaagccccacaactgcctggccagccctgtgtccctggtgtgggccctggccggcctgcagggcagccacacccccctgctggagggctgtgtgcgggtgtctgtgtgtgaatgtgtgggctggtgtgtgaacatctacaagtag

SEQ ID NO: 167995 - DNA, 4578 bp, Artificial Sequence
  Description of Artificial Sequence: Synthetic coding sequence
atgagcggcacccagagcaccatcacagaccgcttccccctgaagaagcccatccgccacggcagcatcctgaaccgggagagccccacagacaagaagcagaaggtggagagaattgccagccatgactttgaccccaccggcctggtgcagagatgtgtgatcatccagaaggatgacaatggatttggcctgactgtgtctggggacaaccctgtgtttgtgcagagcgtgaaggaggatggagctgccatgagagctggggtgcagacaggagaccgcatcatcaaggtgaatggcaccctggtgacccacagcaaccacctggaggtggtgaagctgatcaagagcggcagctatgtggccctgactgtgcagggccggcccccaggcagcccccagatccccctggccgacagcgaggtggagcccagcgtgattggccacatgagccccatcatgaccagcccccacagccctggggccagcggcaacatggagcgcatcaccagccctgtgctgatgggagaggagaacaacgtggtgcacaaccagaaggtggagatcctgaggaagatgctgcagaaggagcaggagcggctgcagctgctgcaggaggactacaacagaacaccagcccagaggctgctgaaggagatccaggaggccaagaagcacatcccccagctgcaggagcagctgagcaaggccaccggcagcgcccaggatggagctgtggtgacccccagccggcccctgggggacaccctgactgtgtctgaggccgagacagatcctggagatgtgctgggccgcacagactgcagcagtggagatgccagccggcccagcagtgacaatgctgacagccccaagagcggccccaaggagcgcatctacctggaggagaaccctgagaagtctgagaccatccaggacacagacacccagagcctggtgggcagccccagcaccagaattgccccccacatcatcggggctgaagatgatgactttggaacagaacatgagcagatcaatggccagtgcagctgcttccagagcattgagctgctgaagagcaggcctgcccacctggccgtgttcctgcaccacgtggtgtcccagtttgatcctgccaccctgctgtgctacctgtacagcgacctgtacaagcacaccaacagcaaggagacccggcgcatcttcctggagttccaccagttcttcctggacagaagtgcccacctgaaggtgtctgtgcctgatgagatgtctgctgacctggagaagaggaggcctgagctgatccctgaggacctgcaccgccactacatccagaccatgcaggagcgggtgcaccctgaggtgcagaggcacctggaggacttccggcagaagaggtccatgggcctgaccctggccgagagcgagctgaccaagctggatgctgagcgggacaaggaccggctgaccctggagaaggagaggacctgtgccgagcagatcgtggccaagattgaggaggtgctgatgacagcccaggccgtggaggaggacaagagcagcaccatgcagtatgtgatcctgatgtacatgaagcacctgggcgtgaaggtgaaggagcccaggaacctggagcacaagagaggaagaattggcttcctgcccaagatcaagcagagcatgaagaaggacaaggagggggaggagaagggcaagagaagaggcttccccagcatcctgggccccccccggcggcccagcagacatgacaacagcgccatcggccgggccatggagctgcagaaggcccggcaccccaagcacctgagcacccccagctctgtgtccccagagccccaggacagcgccaagctgcggcagagcggcctggccaatgaaggaacagatgctggctacctgcctgccaacagcatgagctctgtggccagcggggccagcttcagccaggagggcggcaaggaaaatgacaccggcagcaagcaggtgggggagaccagcgcccctggggacaccctggatggcacccccaggaccctgaacacagtgtttgacttccccccaccacccctggaccaggtgcaggaggaggagtgtgaggtggagcgggtgacagaacatggcacccccaagcccttcaggaagtttgacagcgtggcctttggagagagccagagtgaagatgagcagtttgaaaatgacctggagacagatcctcccaactggcagcagctggtgtcccgggaggtgctgctgggcctgaagccctgtgagatcaagaggcaggaggtgatcaatgagctgttctacacagagcgggcccacgtgaggaccctgaaggtgctggaccaggtgttctaccagagggtgtcccgggagggcatcctgagccccagcgagctgaggaagatcttcagcaacctggaggacatcctgcagctgcacatcggcctgaatgagcagatgaaggctgtgaggaagagaaatgagaccagcgtcatcgaccagattggagaggacctgctgacctggttcagcggccctggagaggagaagctgaagcacgccgccgccaccttctgcagcaaccagccctttgccctggagatgatcaagagccggcagaagaaggacagccgcttccagacctttgtgcaggatgctgagagcaaccccctgtgccggcggctgcagctgaaggacatcatccccacccagatgcagaggctgaccaagtaccccctgctgctggacaacatcgccaagtacacagagtggcccacagagcgggagaaggtgaagaaggctgctgaccactgccggcagatcctgaactacgtgaaccaggccgtgaaggaggccgagaacaagcagaggctggaggactaccagaggcggctggacaccagcagcctgaagctgtctgagtacccaaatgtggaggagctgaggaacctggacctgaccaagaggaagatgattcatgagggccccctggtgtggaaggtgaacagagacaagaccatcgacctgtacaccctgctgctggaggacatcctggtgctgctgcagaagcaggatgaccggctggtgctgcgctgccacagcaagatcctggccagcacagctgacagcaagcacaccttcagccctgtgatcaagctgagcacagtgctggtgcggcaggtggccacagacaacaaggccctgtttgtgatctccatgtctgacaacggggcccagatctatgagctggtggcccagacagtgtctgagaagacagtgtggcaggacctgatctgcaggatggccgcctctgtgaaggagcagagcaccaagcccatccccctgccccagagcaccccaggagagggggacaatgatgaggaggaccccagcaagctgaaggaggagcagcacggcatctctgtgacaggcctgcagagcccagaccgggacctgggcctggagagcaccctcatcagcagcaagccccagagccacagcctgagcaccagcggcaagtctgaggtgcgggacctgtttgtggccgagcggcagtttgccaaggagcagcacacagatggcaccctgaaggaggtgggggaggactaccagatcgccatcccagacagccacctgcctgtgtctgaggagcgctgggccctggatgccctgaggaacctgggcctgctgaagcagctgctggtgcagcagctgggcctgacagagaagtctgtgcaggaggactggcagcacttcccccgctacagaacagccagccagggcccccagacagacagcgtcatccagaacagcgagaacatcaaggcctaccacagcggggagggccacatgcccttcagaacaggcaccggggacatcgccacctgctacagccccaggaccagcacagagagctttgccccccgggacagcgtgggcctggccccccaggacagccaggccagcaacatcctggtgatggaccacatgatcatgaccccagagatgcccaccatggagcctgagggcggcctggatgacagcggggagcacttctttgatgcccgggaggcccacagtgatgagaaccccagtgaaggagatggagctgtgaacaaggaggagaaggatgtgaacctgcgcatcagcggcaactacctgatcctggatggctatgaccctgtgcaggagagcagcacagatgaggaggtggccagcagcctgaccctgcagcccatgacaggcatcccagctgtggagagcacccaccagcagcagcacagcccccagaacacccacagtgatggagccatcagccccttcaccccagagttcctggtgcagcagcgctggggcgccatggagtacagctgctttgagatccagagccccagcagctgtgccgacagccagagccagatcatggagtacatccacaagattgaagctgacctggagcacctgaagaaggtggaggagagctacaccatcctgtgccagaggctggccggcagcgccctgacagacaagcacagcgacaagagctag

SEQ ID NO: 167996 - DNA, 4635 bp, Artificial Sequence
  Description of Artificial Sequence: Synthetic coding sequence
atgagcggcacccagagcaccatcacagaccgcttccccctgaagaagcccatccgccacggcagcatcctgaaccgggagagccccacagacaagaagcagaaggtggagagaattgccagccatgactttgaccccacagacagcagcagcaagaagaccaagagcagcagcgaggagagccgctctgagatctacggcctggtgcagcgctgcgtcatcatccagaaggatgacaatggcttcggcctgactgtgtctggggacaaccctgtgtttgtgcagagcgtgaaggaggatggagctgccatgagagctggggtgcagacaggagaccgcatcatcaaggtgaatggcaccctggtgacccacagcaaccacctggaggtggtgaagctgatcaagagcggcagctatgtggccctgactgtgcagggccggcccccaggcagcccccagatccccctggccgacagcgaggtggagcccagcgtcatcggccacatgagccccatcatgaccagcccccacagccctggggccagcggcaacatggagcgcatcaccagccctgtgctgatgggagaagaaaataatgtggtgcacaaccagaaggtggagatcctgaggaagatgctgcagaaggagcaggagcggctgcagctgctgcaggaggactacaacagaacaccagcccagaggctgctgaaggagatccaggaggccaagaagcacatcccccagctgcaggagcagctgagcaaggccactggaagtgcccaggatggagctgtggtgacccccagccggcccctgggggacaccctgactgtgtctgaggccgagacagatcctggagatgtgctgggccgcacagactgcagcagtggagatgccagccggcccagcagtgacaatgctgacagccccaagagcggccccaaggagcgcatctacctggaggagaaccctgagaagtctgagaccatccaggacacagacacccagagcctggtgggcagccccagcacccgcatcgccccccacatcattggagcagaagatgatgactttggaacagagcacgagcagatcaatggccagtgcagctgcttccagagcattgagctgctgaagagcaggcctgcccacctggccgtgttcctgcaccacgtggtgtcccagtttgatcctgccaccctgctgtgctacctgtacagcgacctgtacaagcacaccaacagcaaggagacccggcgcatcttcctggagttccaccagttcttcctggacagaagtgcccacctgaaggtgtctgtgcctgatgagatgtctgctgacctggagaagagaagacctgagctgatccctgaggacctgcaccgccactacatccagaccatgcaggagcgggtgcaccctgaggtgcagaggcacctggaggacttccggcagaagaggtccatgggcctgaccctggccgagagcgagctgaccaagctggatgctgagcgggacaaggaccggctgaccctggagaaggagaggacctgtgccgagcagatcgtggccaagattgaggaggtgctgatgacagcccaggccgtggaggaggacaagagcagcaccatgcagtatgtgatcctgatgtacatgaagcacctgggcgtgaaggtgaaggagcccaggaacctggagcacaagaggggccgcatcggcttcctgcccaagatcaagcagagcatgaagaaggacaaggagggggaggagaagggcaagaggcggggcttccccagcatcctgggccccccaagaagacccagcagacatgacaacagcgccatcggccgggccatggagctgcagaaggcccggcaccccaagcacctgagcacccccagctctgtgtccccagagccccaggacagcgccaagctgcggcagagcggcctggccaatgaaggaacagatgctggctacctgcctgccaacagcatgagctctgtggccagcggggccagcttcagccaggagggcggcaaggaaaatgacaccggcagcaagcaggtgggggagaccagcgcccctggggacaccctggatggcacccccaggaccctgaacacagtgtttgacttccccccaccacccctggaccaggtgcaggaggaggagtgtgaggtggagcgggtgacagagcacggcacccccaagcccttcaggaagtttgattctgtggccttcggggagagccagagtgaagatgagcagtttgaaaatgacctggagacagacccccccaactggcagcagctggtgtcccgggaggtgctgctgggcctgaagccctgtgagatcaagaggcaggaggtgatcaatgaactcttctacacagagcgggcccacgtgaggaccctgaaggtgctggaccaggtgttctaccagagggtgtcccgggagggcatcctgagccccagcgagctgaggaagatcttcagcaacctggaggacatcctgcagctgcacatcggcctgaatgagcagatgaaggctgtgaggaagagaaatgagacctctgtgattgaccagatcggggaggacctgctgacctggttcagcggccctggagaggagaagctgaagcatgctgctgccaccttctgcagcaaccagccctttgccctggagatgatcaagagccggcagaagaaggacagccgcttccagacctttgtgcaggatgctgagagcaaccccctgtgccggcggctgcagctgaaggacatcatccccacccagatgcagaggctgaccaagtaccccctgctgctggacaacatcgccaagtacacagagtggcccacagagcgggagaaggtgaagaaggctgctgaccactgccggcagatcctgaactacgtgaaccaggccgtgaaggaggccgagaacaagcagaggctggaggactaccagaggcggctggacaccagcagcctgaagctgtctgagtaccccaacgtggaggagctgaggaacctggacctgaccaagaggaagatgatccacgagggccccctggtgtggaaggtgaacagagacaagaccatcgacctgtacaccctgctgctggaggacatcctggtgctgctgcagaagcaggatgaccggctggtgctgcgctgccacagcaagatcctggccagcacagctgacagcaagcacaccttcagccctgtgatcaagctgagcacagtgctggtgcggcaggtggccacagacaacaaggccctcttcgtcatctccatgtctgacaatggagcccagatctatgagctggtggcccagacagtgtctgagaagacagtgtggcaggacctgatctgcaggatggccgcctctgtgaaggagcagagcaccaagcccatccccctgccccagagcaccccaggagagggggacaatgatgaggaggaccccagcaagctgaaggaggagcagcacggcatctctgtgacaggcctgcagagcccagaccgggacctgggcctggagagcaccctcatcagcagcaagccccagagccacagcctgagcaccagcggcaagtctgaggtgcgggacctgtttgtggccgagcggcagtttgccaaggagcagcacacagatggcaccctgaaggaggtgggggaggactaccagatcgccatcccagacagccacctgcctgtgtctgaggagcgctgggccctggatgccctgaggaacctgggcctgctgaagcagctgctggtgcagcagctgggcctgacagagaagtctgtgcaggaggactggcagcacttcccccgctacagaacagccagccagggcccccagacagattctgtcatccagaacagcgagaacatcaaggcctaccacagcggggagggccacatgcccttcagaactggaactggagacatcgccacctgctacagccccaggaccagcacagagagctttgccccccgggacagcgtgggcctggccccccaggacagccaggccagcaacatcctggtgatggaccacatgatcatgaccccagagatgcccaccatggagcctgagggcggcctggatgattctggagagcacttctttgatgcccgggaggcccacagtgatgagaaccccagtgaaggagatggagctgtgaacaaggaggagaaggatgtgaacctgcgcatcagcggcaactacctgatcctggatggctatgaccctgtgcaggagagcagcacagatgaggaggtggccagcagcctgaccctgcagcccatgacaggcatcccagctgtggagagcacccaccagcagcagcacagcccccagaacacccacagtgatggagccatcagccccttcaccccagagttcctggtgcagcagcgctggggcgccatggagtacagctgctttgagatccagagccccagcagctgtgccgacagccagagccagatcatggagtacatccacaagattgaggccgacctggagcacctgaagaaggtggaggagagctacaccatcctgtgccagaggctggccggcagcgccctgacagacaagcacagcgacaagagctag

SEQ ID NO: 167997 - DNA, 2409 bp, Artificial Sequence
  Description of Artificial Sequence: Synthetic coding sequence
atggactgtggccccccagccaccctgcagccccacctgaccggccccccaggcacagcccaccaccctgtggccgtgtgccagcaggagagcctgagctttgctgagctgcctgccctgaagccacccagccctgtgtgcctggacctcttccctgtggcccctgaggagctgcgggcccctggcagccgctggagcctgggcaccccagcccccctgcagggcctgctgtggcccctgagccctgggggcagtgacacagagatcaccagcggcggcatgaggcccagcagagctggctcctggccccactgccctggggcccagcccccagccctggagggcccctggagccccaggcacacccagccccagaggcgggccagccacggcagcgagaagaagagcgcctggaggaagatgagggtgtaccagcgggaggaggtgcccggctgcccagaggcccatgctgtgttcctggagcccggccaggtggtgcaggagcaggccctgagcacagaggagccccgggtggagctgagcggcagcaccagggtgtccctggagggccctgagcggcggcgcttcagcgccagcgagctgatgacccggctgcacagcagcctgcggctgggcagaaattctgctgcccgggccctgatcagcggcagcggcaccggggccgcccgggagggcaaggccagcggcatggaggcccggtctgtggagatgtctggggacagagtgtccaggcctgcccctggggacagccgggagggggactggagcgagccccggctggacacccaggaggagccccccctgggcagccgcagcaccaatgaaagacggcagagccgcttcctgctgaacagcgtgctgtaccaggagtacagtgatgtggccagcgcccgggagctgcggcggcagcagcgggaggaggagggccctggagatgaagctgagggcgctgaggagggccctggccccccccgggccaacctgagccccagcagcagcttccgggcccagaggtctgcccggggcagcaccttcagcctgtggcaggacatcccagatgtgcggggcagcggcgtgctggccaccctgagcctgcgggactgcaagctgcaggaggccaagtttgagctgatcaccagcgaggccagctacatccacagcctgtctgtggccgtgggccacttcctgggcagcgctgagctgtctgagtgcctgggcgcccaggacaagcagtggctgttcagcaagctgcctgaggtgaagagcaccagcgagcgcttcctgcaggacctggagcagaggctggaggctgatgtgctgcgcttctctgtgtgtgatgtggtgctggaccactgcccagccttcagaagagtgtacctgccctacgtgaccaaccaggcctaccaggagaggacctaccagaggctgctgctggagaacccccgcttccctggcatcctggcccggctggaggagagccctgtgtgccagaggctgcccctgaccagcttcctgatcctgcccttccagaggatcacccggctgaagatgctggtggagaacatcctgaagaggacagcccagggctctgaagatgaggacatggccaccaaggccttcaatgccctgaaggagctggtgcaggagtgcaatgcctctgtgcagagcatgaagaggacagaggagctgatccacctgagcaagaagatccactttgagggcaagatcttccccctcatcagccaggcccgctggctggtgcgccacggggagctggtggagctggcccccctgcctgctgcccccccagccaagctgaagctgagcagcaaggctgtgtacctgcacctgttcaatgactgcctgctgctgagcaggaggaaggagctgggcaagtttgctgtgtttgtgcacgccaagatggccgagctgcaggtgcgggacctgagcctgaagctgcagggcatccctggccacgtgttcctgctgcagctgctgcacggccagcacatgaagcaccagttcctgctgcgggccaggacagagagcgagaagcagcgctggatcagcgccctgtgccccagcagcccccaggaggacaaggaggtgatcagtgaaggagaggactgcccccaggtgcagtgtgtgaggacctacaaggccctgcacccagatgagctgaccctggagaagacagacatcctgtctgtgaggacctggaccagtgatggctggctggagggcgtgcggctggctgatggagagaagggctgggtgccccaggcctacgtggaggagatcagcagcctgagcgcccggctgaggaacctgcgggagaacaagagggtgaccagcgccaccagcaagctgggggaggcccctgtgtag

SEQ ID NO: 167998 - DNA, 1575 bp, Artificial Sequence
  Description of Artificial Sequence: Synthetic coding sequence
atggactgtggccccccagccaccctgcagccccacctgaccggccccccaggcacagcccaccaccctgtggccgtgtgccagcaggagagcctgagctttgctgagctgcctgccctgaagccacccagccctgtgtgcctggacctcttccctgtggcccctgaggagctgcgggcccctggcagccgctggagcctgggcaccccagcccccctgcagggcctgctgtggcccctgagccctgggggcagtgacacagagatcaccagcggcggcatgaggcccagcagagctggctcctggccccactgccctggggcccagcccccagccctggagggcccctggagccccaggcacacccagccccagaggcgggccagccacggcagcgagaagaagagcgcctggaggaagatgagggtgtaccagcgggaggaggtgcccggctgcccagaggcccatgctgtgttcctggagcccggccaggtggtgcaggagcaggccctgagcacagaggagccccgggtggagctgagcggcagcaccagggtgtccctggagggccctgagcggcggcgcttcagcgccagcgagctgatgacccggctgcacagcagcctgcggctgggcagaaattctgctgcccgggccctgatcagcggcagcggcaccggggccgcccgggagggcaaggccagcggcatggaggcccggtctgtggagatgtctggggacagagtgtccaggcctgcccctggggacagccgggagggggactggagcgagccccggctggacacccaggaggagccccccctgggcagccgcagcaccaatgaaagacggcagagccgcttcctgctgaacagcgtgctgtaccaggagtacagtgatgtggccagcgcccgggagctgcggcggcagcagcgggaggaggagggccctggagatgaagctgagggcgctgaggagggccctggccccccccgggccaacctgagccccagcagcagcttccgggcccagaggtctgcccggggcagcaccttcagcctgtggcaggacatcccagatgtgcggggcagcggcgtgctggccaccctgagcctgcgggactgcaagctgcaggaggccaagtttgagctgatcaccagcgaggccagctacatccacagcctgtctgtggccgtgggccacttcctgggcagcgctgagctgtctgagtgcctgggcgcccaggacaagcagtggctgttcagcaagctgcctgaggtgaagagcaccagcgagcgcttcctgcaggacctggagcagaggctggaggctgatgtgctgcgcttctctgtgtgtgatgtggtgctggaccactgcccagccttcagaagagtgtacctgccctacgtgaccaaccaggcctaccaggagaggacctaccagaggctgctgctggagaacccccgcttccctggcatcctggcccggctggaggagagccctgtgtgccagaggctgcccctgaccagcttcctgatcctgcagcccccaggcggccagggcggccaccagtag

SEQ ID NO: 167999 - DNA, 1509 bp, Artificial Sequence
  Description of Artificial Sequence: Synthetic coding sequence
atggactgtggccccccagccaccctgcagccccacctgaccggccccccaggcacagcccaccaccctgtggccgtgtgccagcaggagagcctgagctttgctgagctgcctgccctgaagccacccagccctgtgtgcctggacctcttccctgtggcccctgaggagctgcgggcccctggcagccgctggagcctgggcaccccagcccccctgcagggcctgctgtggcccctgagccctgggggcagtgacacagagatcaccagcggcggcatgaggcccagcagagctggctcctggccccactgccctggggcccagcccccagccctggagggcccctggagccccaggcacacccagccccagaggcgggccagccacggcagcgagaagaagagcgcctggaggaagatgagggtgtaccagcgggaggaggtgcccggctgcccagaggcccatgctgtgttcctggagcccggccaggtggtgcaggagcaggccctgagcacagaggagccccgggtggagctgagcggcagcaccagggtgtccctggagggccctgagcggcggcgcttcagcgccagcgagctgatgacccggctgcacagcagcctgcggctgggcagaaattctgctgcccgggccctgatcagcggcagcggcaccggggccgcccgggagggcaaggccagcggcatggaggcccggtctgtggagatgtctggggacagagtgtccaggcctgcccctggggacagccgggagggggactggagcgagccccggctggacacccaggaggagccccccctgggcagccgcagcaccaatgaaagacggcagagccgcttcctgctgaacagcgtgctgtaccaggagtacagtgatgtggccagcgcccgggagctgcggcggcagcagcgggaggaggagggccctggagatgaagctgagggcgctgaggagggccctggccccccccgggccaacctgagccccagcagcagcttccgggcccagaggtctgcccggggcagcaccttcagcctgtggcaggacatcccagatgtgcggggcagcggcgtgctggccaccctgagcctgcgggactgcaagctgcaggaggccaagtttgagctgatcaccagcgaggccagctacatccacagcctgtctgtggccgtgggccacttcctgggcagcgctgagctgtctgagtgcctgggcgcccaggacaagcagtggctgttcagcaagctgcctgaggtgaagagcaccagcgagcgcttcctgcaggacctggagcagaggctggaggctgatgtgctgcgcttctctgtgtgtgatgtggtgctggaccactgcccagccttcagaagagtgtacctgccctacgtgaccaaccaggcctaccaggagaggacctaccagaggctgctgcgggagaacaagagggtgaccagcgccaccagcaagctgggggaggcccctgtgtag

SEQ ID NO: 168000 - DNA, 504 bp, Artificial Sequence
  Description of Artificial Sequence: Synthetic coding sequence
gagcggctggcccagtttcctgctgctggccggggcagccctggccccccaggggcccggctgggcgtgggcctggagaagggccggggccgggaggtgtggaggcctggggtgtggggctgtgaggcccgggccagcgaggtgaactggagctgcccctttgatcctgtgtgtgccctgccccaggccaagtttgagctgatcaccagcgaggccagctacatccacagcctgtctgtggccgtgggccacttcctgggcagcgctgagctgtctgaatgtctgggcgcccaggacaagcagtggctgttcagcaagctgcctgaggtgaagagcaccagcgagcgcttcctgcaggacctggagcagaggctggaggctgatgtgctgcgcttctctgtgtgtgatgtggtgctggaccactgcccagccttccggcgggtgtacctgccctacgtgaccaaccaggcctaccaggagaggacctaccagaggctgctgtag

SEQ ID NO: 168001 - DNA, 924 bp, Artificial Sequence
  Description of Artificial Sequence: Synthetic coding sequence
tgaagagaccggggccaggagcggctggcccagtttcctgctgctggccggggcagccctggccccccaggggcccggctgggcgtgggcctggagaagggccggggccgggaggtgtggaggcctggggtgtggggctgtgaggcccgggccagcgaggtgaactggagctgcccctttgatcctgtgtgtgccctgccccaggccaagtttgagctgatcaccagcgaggccagctacatccacagcctgtctgtggccgtgggccacttcctgggcagcgctgagctgtctgaatgtctgggcgcccaggacaagcagtggctgttcagcaagctgcctgaggtgaagagcaccagcgagcgcttcctgcaggacctggagcagaggctggaggctgatgtgctgcgcttctctgtgtgtgatgtggtgctggaccactgcccagccttccggcgggtgtacctgccctacgtgaccaaccaggcctaccaggagaggacctaccagaggctgctgctggagaacccccgcttccctggcatcctggcccggctggaggagagccctgtgtgccagaggctgcccctgaccagcttcctgatcctgcccttccagaggatcacccggctgaagatgctggtggagaacatcctgaagaggacagcccagggctctgaagatgaggacatggccaccaaggccttcaatgccctgaaggagctggtgcaggagtgcaatgcctctgtgcagagcatgaagaggacagaggagctgatccacctgagcaagaagatccactttgagggcaagatcttccccctcatcagccaggcccgctggctggtgagacatggagagctggtggagctggcccccctgcctgctgcccccccagccaagctgaagctgagcagcaagtag

SEQ ID NO: 168002 - DNA, 1581 bp, Artificial Sequence
  Description of Artificial Sequence: Synthetic coding sequence
atggtggccaaggactaccccttctacctgactgtgaagagggccaactgcagcctggagctgcccccagccagcggccctgccaaggatgctgaggagcccagcaacaagagggtgaagcccctgagccgggtgaccagcctggccaacctgatcccccctgtgaaggccacccccctgaagcgcttcagccagaccctgcagaggagcatctccttccgctctgagagcaggccagacatcctggccccccggccctggagcagaaatgctgcccccagcagcaccaagaggcgggacagcaagctgtggagcgagacctttgatgtgtgtgtgaaccagatgctgaccagcaaggagatcaagaggcaggaggccatctttgagctgagccagggcgaggaggacctgattgaggacctgaagctggccaagaaggcctaccatgaccccatgctgaagctgagcatcatgacagagcaggagctgaaccagatcttcggcaccctggacagcctcatccccctgcacgaggagctgctgagccagctgagagatgtgaggaagccagatggcagcacagagcacgtgggccccatcctggtgggctggctgccctgcctgagcagctatgacagctactgcagcaaccaggtggccgccaaggccctgctggaccacaagaagcaggaccaccgggtgcaggacttcctgcagcgctgcctggagagccccttcagcaggaagctggacctgtggaacttcctggacatccccaggagccggctggtgaagtaccccctgctgctgcgggagatcctgcggcacaccccaaatgacaacccagaccagcagcacctggaggaggccatcaacatcatccagggcatcgtggccgagatcaacaccaagacaggagagagtgaatgtcgctactacaaggagcggctgctgtacctggaggagggccagaaggacagcctgattgacagcagccgggtgctgtgctgccacggggagctgaagaacaacagaggagtgaagctgcacgtgttcctgttccaggaggtgctggtgatcaccagggctgtgacccacaatgagcagctgtgctaccagctgtaccggcagcccatccctgtgaaggacctgctgctggaggacctgcaggatggagaggtgcggctgggcggcagcctgcggggggccttcagcaacaatgaaagaatcaagaacttcttccgggtgtccttcaagaatggcagccagagccagacccacagcctgcaggccaatgacaccttcaacaagcagcagtggctgaactgcatccggcaggccaaggagaccgtgctgtgtgccgccggccaggccggcgtgctggacagcgagggcagcttcctgaaccccaccaccggcagccgggagctgcagggcgagaccaagctggagcagatggaccagagcgacagcgagagtgactgcagcatggacaccagcgaggtgtccctggactgtgagaggatggagcagacagacagcagctgtggcaacagcagacatggagagagcaatgtgtag

SEQ ID NO: 168003 - DNA, 1677 bp, Artificial Sequence
  Description of Artificial Sequence: Synthetic coding sequence
atggacagcagcacagccatgaaccagtgcagctgccggggcatggaggagaacaaggagcggcccaagaggcagaggcagaacaacttccccatgttccccagccccaaggcctggaacttccggggcaggaagaggaagcagagcacccaggatgaagatgctgtgtccctgtgcagcctggacatcagcgagcccagcaacaagagggtgaagcccctgagccgggtgaccagcctggccaacctgatcccccctgtgaaggccacccccctgaagcgcttcagccagaccctgcagaggagcatctccttccgctctgagagcaggccagacatcctggccccccggccctggagcagaaatgctgcccccagcagcaccaagaggcgggacagcaagctgtggagcgagacctttgatgtgtgtgtgaaccagatgctgaccagcaaggagatcaagaggcaggaggccatctttgagctgagccagggcgaggaggacctgattgaggacctgaagctggccaagaaggcctaccatgaccccatgctgaagctgagcatcatgacagagcaggagctgaaccagatcttcggcaccctggacagcctcatccccctgcacgaggagctgctgagccagctgagagatgtgaggaagccagatggcagcacagagcacgtgggccccatcctggtgggctggctgccctgcctgagcagctatgacagctactgcagcaaccaggtggccgccaaggccctgctggaccacaagaagcaggaccaccgggtgcaggacttcctgcagcgctgcctggagagccccttcagcaggaagctggacctgtggaacttcctggacatccccaggagccggctggtgaagtaccccctgctgctgcgggagatcctgcggcacaccccaaatgacaacccagaccagcagcacctggaggaggccatcaacatcatccagggcatcgtggccgagatcaacaccaagacaggagagagtgaatgtcgctactacaaggagcggctgctgtacctggaggagggccagaaggacagcctgattgacagcagccgggtgctgtgctgccacggggagctgaagaacaacagaggagtgaagctgcacgtgttcctgttccaggaggtgctggtgatcaccagggctgtgacccacaatgagcagctgtgctaccagctgtaccggcagcccatccctgtgaaggacctgctgctggaggacctgcaggatggagaggtgcggctgggcggcagcctgcggggggccttcagcaacaatgaaagaatcaagaacttcttccgggtgtccttcaagaatggcagccagagccagacccacagcctgcaggccaatgacaccttcaacaagcagcagtggctgaactgcatccggcaggccaaggagaccgtgctgtgtgccgccggccaggccggcgtgctggacagcgagggcagcttcctgaaccccaccaccggcagccgggagctgcagggcgagaccaagctggagcagatggaccagagcgacagcgagagtgactgcagcatggacaccagcgaggtgtccctggactgtgagaggatggagcagacagacagcagctgtggcaacagcagacatggagagagcaatgtgtag

SEQ ID NO: 168004 - DNA, 1599 bp, Artificial Sequence
  Description of Artificial Sequence: Synthetic coding sequence
atgattgaggtgtgccaccacaactggctgctgtggctgtgccccagcaagtttggcatcttcatgtgctgcctggccagcaccaccggccagatggagctgcggaggacccgggagcccagcaacaagagggtgaagcccctgagccgggtgaccagcctggccaacctgatcccccctgtgaaggccacccccctgaagcgcttcagccagaccctgcagaggagcatctccttccgctctgagagcaggccagacatcctggccccccggccctggagcagaaatgctgcccccagcagcaccaagaggcgggacagcaagctgtggagcgagacctttgatgtgtgtgtgaaccagatgctgaccagcaaggagatcaagaggcaggaggccatctttgagctgagccagggcgaggaggacctgattgaggacctgaagctggccaagaaggcctaccatgaccccatgctgaagctgagcatcatgacagagcaggagctgaaccagatcttcggcaccctggacagcctcatccccctgcacgaggagctgctgagccagctgagagatgtgaggaagccagatggcagcacagagcacgtgggccccatcctggtgggctggctgccctgcctgagcagctatgacagctactgcagcaaccaggtggccgccaaggccctgctggaccacaagaagcaggaccaccgggtgcaggacttcctgcagcgctgcctggagagccccttcagcaggaagctggacctgtggaacttcctggacatccccaggagccggctggtgaagtaccccctgctgctgcgggagatcctgcggcacaccccaaatgacaacccagaccagcagcacctggaggaggccatcaacatcatccagggcatcgtggccgagatcaacaccaagacaggagagagtgaatgtcgctactacaaggagcggctgctgtacctggaggagggccagaaggacagcctgattgacagcagccgggtgctgtgctgccacggggagctgaagaacaacagaggagtgaagctgcacgtgttcctgttccaggaggtgctggtgatcaccagggctgtgacccacaatgagcagctgtgctaccagctgtaccggcagcccatccctgtgaaggacctgctgctggaggacctgcaggatggagaggtgcggctgggcggcagcctgcggggggccttcagcaacaatgaaagaatcaagaacttcttccgggtgtccttcaagaatggcagccagagccagacccacagcctgcaggccaatgacaccttcaacaagcagcagtggctgaactgcatccggcaggccaaggagaccgtgctgtgtgccgccggccaggccggcgtgctggacagcgagggcagcttcctgaaccccaccaccggcagccgggagctgcagggcgagaccaagctggagcagatggaccagagcgacagcgagagtgactgcagcatggacaccagcgaggtgtccctggactgtgagaggatggagcagacagacagcagctgtggcaacagcagacatggagagagcaatgtgtag

SEQ ID NO: 168005 - DNA, 2073 bp, Artificial Sequence
  Description of Artificial Sequence: Synthetic coding sequence
atgccctgggaggagcctgctggggagaagcccagctgcagccacagccagaaggccttccacatggagcccgcccagaagccctgcttcaccacagacatggtgacctgggccctgctgtgcatctctgctgagaccgtgcggggggaggcccccagccagccccggggcatcccccacaggagccctgtgtctgtggatgacctgtggctggagaagacccagaggaagaagctgcagaagcaggcccacgtggagcggcggctgcacatcggggctgtgcacaaggatggagtgaagtgctggaggaagaccatcatcaccagccctgagagcctgaacctgcccaggaggagccaccccctgagccagagcgcccccaccggcctgaaccacatgggctggccagagcacaccccaggcacagccatgccagatggagccctggacacagctgtgtgtgctgatgaggtgggcagcgaggaggacctgtatgatgacctgcacagcagcagccaccactacagccaccctgggggcggcggggagcagctggccatcaatgagctgatcagtgatggctctgtggtgtgtgccgaggccctgtgggaccacgtgaccatggatgaccaggagctgggcttcaaggctggagatgtgattgaggtgatggatgccaccaaccgggagtggtggtggggccgggtggctgatggagagggctggttccctgccagctttgtgcggctgcgggtgaaccaggatgagccagcagatgatgatgcccccctggccggcaacagcggggctgaagatggcggcgctgaggcccagagcagcaaggaccagatgaggaccaacgtcatcaatgagatcctgagcacagagcgggactacatcaagcacctgcgggacatctgtgagggctacgtgcggcagtgcaggaagagagctgacatgttcagcgaggagcagctgcggaccatcttcggcaacatcgaggacatctaccgctgccagaaggcctttgtgaaggccctggagcagcgcttcaaccgggagcggccccacctgtctgagctgggcgcctgcttcctggagcaccaggccgacttccagatctacagcgagtactgcaacaaccaccccaatgcctgtgtggagctgagccggctgaccaagctgagcaaatatgtgtacttctttgaggcctgccgcctgctgcagaagatgattgacatcagcctggatggcttcctgctgacccctgtgcagaagatctgcaagtaccccctgcagctggccgagctgctgaagtacacccacccccagcaccgggacttcaaggatgtggaggccgccctgcacgccatgaagaatgtggcccagctgatcaatgaaaggaagaggcggctggagaacatcgacaagatcgcccagtggcagagcagcattgaggactgggagggggaggacctgctggtgcgcagcagcgagctgatctacagcggggagctgaccagggtgacccagccccaggccaagagccagcagaggatgttcttcctgtttgaccaccagctgatctactgcaagaaggacctgctgcggagagatgtgctgtactacaagggccgcctggacatggatggcctggaggtggtggacctggaggatggcaaggaccgggacctgcacgtgtccatcaagaatgccttccggctgcacagaggagccaccggggacagccacctgctgtgcaccaggaagccagagcagaagcagcgctggctgaaggcctttgcccgggagcgggagcaggtgcagctggaccaggagaccggcttcagcatcacagagctgcagaggaagcaggccatgctgaatgccagcaagcagcaggtgacaggcaagcccaaggctgtgggccggccctgctacctgacccggcagaagcacccagccctgcccagcaaccggccccagcagcaggtgctggtgctggccgagcccaggaggaagcccagcaccttctggcacagcatcagccggctggcccccttcaggaagtag

SEQ ID NO: 168006 - DNA, 1860 bp, Artificial Sequence
  Description of Artificial Sequence: Synthetic coding sequence
atgaggccagatggccagcaggccctggatgctgtggtgcgcagctttgactgccacagcgaggccgccctgcggcagagaaatgatgtgatctactgcagcctgcccaggacagcccagggcatcgtgcagcgggaggaccagctggaggtgctggtgtccctgcgggaggtgtggggcagaagaagaggaagagatggcacctgcaccggggccatgccagatggagccctggacacagctgtgtgtgctgatgaggtgggcagcgaggaggacctgtatgatgacctgcacagcagcagccaccactacagccaccctgggggcggcggggagcagctggccatcaatgaactcatcagtgatggctctgtggtgtgtgccgaggccctgtgggaccacgtgaccatggatgaccaggagctgggcttcaaggctggagatgtgattgaggtgatggatgccaccaaccgggagtggtggtggggccgggtggctgatggagagggctggttccctgccagctttgtgcggctgcgggtgaaccaggatgagccagcagatgatgatgcccccctggccggcaacagcggggctgaagatggaggagctgaggcccagagcagcaaggaccagatgaggaccaacgtcatcaatgagatcctgagcacagagcgggactacatcaagcacctgcgggacatctgtgagggctacgtgcggcagtgcaggaagagagctgacatgttttctgaggagcagctgcggaccatctttggaaatattgaggacatctaccgctgccagaaggcctttgtgaaggccctggagcagcgcttcaaccgggagcggccccacctgtctgagctgggcgcctgcttcctggagcaccaggccgacttccagatctacagcgagtactgcaacaaccaccccaatgcctgtgtggagctgagccggctgaccaagctgagcaaatatgtgtacttctttgaggcctgccgcctgctgcagaagatgattgacatcagcctggatggcttcctgctgacccctgtgcagaagatctgcaagtaccccctgcagctggccgagctgctgaagtacacccacccccagcaccgggacttcaaggatgtggaggccgccctgcacgccatgaagaatgtggcccagctgatcaatgaaaggaagaggcggctggagaacatcgacaagatcgcccagtggcagagcagcattgaggactgggagggggaggacctgctggtgcgcagcagcgagctgatctacagcggggagctgaccagggtgacccagccccaggccaagagccagcagaggatgttcttcctgtttgaccaccagctgatctactgcaagaaggacctgctgcggagagatgtgctgtactacaagggccgcctggacatggatggcctggaggtggtggacctggaggatggcaaggaccgggacctgcacgtgtccatcaagaatgccttccggctgcacagaggagccactggagacagccacctgctgtgcaccaggaagccagagcagaagcagcgctggctgaaggcctttgcccgggagcgggagcaggtgcagctggaccaggagaccggcttcagcatcacagagctgcagaggaagcaggccatgctgaatgccagcaagcagcaggtgacaggcaagcccaaggctgtgggccggccctgctacctgacccggcagaagcacccagccctgcccagcaaccggccccagcagcaggtgctggtgctggccgagcccaggaggaagcccagcaccttctggcacagcatcagccggctggcccccttcaggaagtag

SEQ ID NO: 168007 - DNA, 2013 bp, Artificial Sequence
  Description of Artificial Sequence: Synthetic coding sequence
atgccctgggaggagcctgctggggagaagcccagctgcagccacagccagaaggccttccacatggagcccgcccagaagccctgcttcaccacagacatggtgacctgggccctgctgtgcatctctgctgagaccgtgcggggggaggcccccagccagccccggggcatcccccacaggagccctgtgtctgtggatgacctgtggctggagaagacccagaggaagaagctgcagaagcaggcccacgtggagcggcggctgcacatcggggctgtgcacaaggatggagtgaagtgctggaggaagaccatcatcaccagccctgagagcctgaacctgcccaggaggagccaccccctgagccagagcgcccccaccggcctgaaccacatgggctggccagagcacaccccaggcacagccatgccagatggagccctggacacagctgtgtgtgctgatgaggtgggcagcgaggaggacctgtatgatgacctgcacagcagcagccaccactacagccaccctgggggcggcggggagcagctggccatcaatgagctgatcagtgatggctctgtggtgtgtgccgaggccctgtgggaccacgtgaccatggatgaccaggagctgggcttcaaggctggagatgtgattgaggtgatggatgccaccaaccgggagtggtggtggggccgggtggctgatggagagggctggttccctgccagctttgtgcggctgcgggtgaaccaggatgagccagcagatgatgatgcccccctggccggcaacagcggggctgaagatggcggcgctgaggcccagagcagcaaggaccagatgaggaccaacgtcatcaatgagatcctgagcacagagcgggactacatcaagcacctgcgggacatctgtgagggctacgtgcggcagtgcaggaagagagctgacatgttcagcgaggagcagctgcggaccatcttcggcaacatcgaggacatctaccgctgccagaaggcctttgtgaaggccctggagcagcgcttcaaccgggagcggccccacctgtctgagctgggcgcctgcttcctggagcaccaggccgacttccagatctacagcgagtactgcaacaaccaccccaatgcctgtgtggagctgagccggctgaccaagctgagcaaatatgtgtacttctttgaggcctgccgcctgctgcagaagatgattgacatcagcctggatggcttcctgctgacccctgtgcagaagatctgcaagtaccccctgcagctggccgagctgctgaagtacacccacccccagcaccgggacttcaaggatgtggaggccgccctgcacgccatgaagaatgtggcccagctgatcaatgaaaggaagaggcggctggagaacatcgacaagatcgcccagtggcagagcagcattgaggactgggagggggaggacctgctggtgcgcagcagcgagctgatctacagcggggagctgaccagggtgacccagccccaggccaagagccagcagaggatgttcttcctgtttgaccaccagctgatctactgcaagaaggacctgctgcggagagatgtgctgtactacaagggccgcctggacatggatggcctggaggtggtggacctggaggatggcaaggaccgggacctgcacgtgtccatcaagaatgccttccggctgcacagaggagccaccggggacagccacctgctgtgcaccaggaagccagagcagaagcagcgctggctgaaggcctttgcccgggagcgggagcaggtgcagctggaccaggagaccggcttcagcatcacagagctgcagaggaagcaggccatgctgaatgccagcaagcagcaggtgacaggcaagcccaagggccgcaggacagctgcccccccaccccggctgcccggcccctacccagctgacatcatccccttcagcgagccccagagccaggccagctag

SEQ ID NO: 168008 - DNA, 1893 bp, Artificial Sequence
  Description of Artificial Sequence: Synthetic coding sequence
atgccctgggaggagcctgctggggagaagcccagctgcagccacagccagaaggccttccacatggagcccgcccagaagccctgcttcaccacagacatggtgacctgggccctgctgtgcatctctgctgagaccgtgcggggggaggcccccagccagccccggggcatcccccacaggagccctgtgtctgtggatgacctgtggctggagaagacccagaggaagaagctgcagaagcaggcccacgtggagcggcggctgcacatcggggctgtgcacaaggatggagtgaagtgctggaggaagaccatcatcaccagccctgagagcctgaacctgcccaggaggagccaccccctgagccagagcgcccccaccggcctgaaccacatgggctggccagagcacaccccaggcacagccatgccagatggagccctggacacagctgtgtgtgctgatgaggtgggcagcgaggaggacctgtatgatgacctgcacagcagcagccaccactacagccaccctgggggcggcggggagcagctggccatcaatgagctgatcagtgatggctctgtggtgtgtgccgaggccctgtgggaccacgtgaccatggatgaccaggagctgggcttcaaggctggagatgtgattgaggtgatggatgccaccaaccgggagtggtggtggggccgggtggctgatggagagggctggttccctgccagctttgtgcggctgcgggtgaaccaggatgagccagcagatgatgatgcccccctggccggcaacagcggggctgaagatggcggcgctgaggcccagagcagcaaggaccagatgaggaccaacgtcatcaatgagatcctgagcacagagcgggactacatcaagcacctgcgggacatctgtgagcaggccgacttccagatctacagcgagtactgcaacaaccaccccaatgcctgtgtggagctgagccggctgaccaagctgagcaaatatgtgtacttctttgaggcctgccgcctgctgcagaagatgattgacatcagcctggatggcttcctgctgacccctgtgcagaagatctgcaagtaccccctgcagctggccgagctgctgaagtacacccacccccagcaccgggacttcaaggatgtggaggccgccctgcacgccatgaagaatgtggcccagctgatcaatgaaaggaagaggcggctggagaacatcgacaagatcgcccagtggcagagcagcattgaggactgggagggggaggacctgctggtgcgcagcagcgagctgatctacagcggggagctgaccagggtgacccagccccaggccaagagccagcagaggatgttcttcctgtttgaccaccagctgatctactgcaagaaggacctgctgcggagagatgtgctgtactacaagggccgcctggacatggatggcctggaggtggtggacctggaggatggcaaggaccgggacctgcacgtgtccatcaagaatgccttccggctgcacagaggagccaccggggacagccacctgctgtgcaccaggaagccagagcagaagcagcgctggctgaaggcctttgcccgggagcgggagcaggtgcagctggaccaggagaccggcttcagcatcacagagctgcagaggaagcaggccatgctgaatgccagcaagcagcaggtgacaggcaagcccaaggctgtgggccggccctgctacctgacccggcagaagcacccagccctgcccagcaaccggccccagcagcaggtgctggtgctggccgagcccaggaggaagcccagcaccttctggcacagcatcagccggctggcccccttcaggaagtag

SEQ ID NO: 168009 - DNA, 579 bp, Artificial Sequence
  Description of Artificial Sequence: Synthetic coding sequence
atgccctgggaggagcctgctggggagaagcccagctgcagccacagccagaaggccttccacatggagcccgcccagaagccctgcttcaccacagacatggtgacctgggccctgctgtgcatctctgctgagaccgtgcggggggaggcccccagccagccccggggcatcccccacaggagccctgtgtctgtggatgacctgtggctggagaagacccagaggaagaagctgcagaagcaggcccacgtggagcggcggctgcacatcggggctgtgcacaaggatggagtgaagtgctggaggaagaccatcatcaccagccctgagagcctgaacctgcccaggaggagccaccccctgagccagagcgcccccaccggcctgaaccacatgggctggccagagcacaccccaggcacagctgtgggccggccctgctacctgacccggcagaagcacccagccctgcccagcaaccggccccagcagcaggtgctggtgctggccgagcccaggaggaagcccagcaccttctggcacagcatcagccggctggcccccttcaggaagtag

SEQ ID NO: 168010 - DNA, 2013 bp, Artificial Sequence; identical to SEQ ID NO: 168007
  Description of Artificial Sequence: Synthetic coding sequence

SEQ ID NO: 168011 - DNA, 4794 bp, Artificial Sequence
  Description of Artificial Sequence: Synthetic coding sequence
atggaggccgaggaggcccagagaggagccagcccccccatcagcgccatcgaggagttcagcatcatccctgaggcccccatgaggagcagccaggtgtctgccctgggcctggaggcccaggaggatgaggaccccagctacaagtggagggaggagcaccggctgagcgccacccagcagagcgagctgagagatgtgtgtgactatgccatcgagaccatgcccagcttccccaaggagggcagcgcagatgtggagcccaaccaggagagcctggtggccgaggcctgtgacaccccagagcactgggaggccgtgccccagagcctggccggccggcaggcccggaccctggcccctcctgagctgtgggcctgccccatccagagcgagcacctggacatggcccccttcagcagtgacctgggcagcgaggaggaggaggtggagttctggccaggcctgaccagcctgaccctgggcagcggccaggccgaggaggaggaggagaccagcagtgacaacagcggccagacccgctactacagcccctgtgaggagcaccctgctgagaccaaccagaatgaaggcagcgagagcggcaccatccggcagggcgaggagctgcccccagaggagctgcaggagagccagggcctgctgcacccccaggaggtgcaggtgctggaggagcagggccagcaggaggccggcttccggggggagggcaccctgcgggaggatgtgtgtgctgatggcctgctgggggaggagcagatgattgagcaggtgaatgatgagaagggggagcagaagcagaagcaggagcaggtgcaggatgtgatgctgggccggcagggcgagaggatgggcctgaccggggagcctgagggcctgaatgatggagagtgggagcaggaggacatggagaggaaggcccagggccagggcggccctgagcagggcgaggagaggaagcgggagctgcaggtgcctgaagaaaatagagctgacagccaggatgagaagagccagaccttcctgggcaagtctgaggaggtgacaggcaagcaggaggaccacggcatcaaggagaagggcgtgcctgtgtctggccaggaggccaaggagcctgagagctgggatggcggccgcctgggcgctgtgggccgggcccggagccgggaggaggagaatgagcaccacggccccagcatgcctgccctgattgcccctgaggacagcccccactgtgacctcttccctggggccagctacctgatgacccagatccctggcacccagacagagagcagagctgaggagctgagccctgctgccctgagccccagcctggagcccatccgctgcagccaccagcccatcagcctgctgggcagcttcctgacagaggagagcccagacaaggagattgaccagaacagccagcaggaggagagccggctgaggaagggcaccgtgagcagccagggcacagaggtggtgtttgccagcgcctctgtgaccccacccaggaccccagattctgccccacccagccctgctgaggcctaccccatcaccccagcctctgtgtctgcccggccccctgtggccttcccccggcgggagaccagctgtgccgcccgggcccctgagacagccagcgcccccctgtccatggatgaccccagcccctgtggcaccagcgagatgtgcccagctgccctgtatggcttccccagcacaggcaccagccccccccggcccccagccaacagcacaggcaccgtgcagcacctgcggagtgacagcttccctggcagccacaggacagagcagaccccagacctggtgggcatgctgctgagctacagccacagcgagctgccccagaggcctcccaagccagccatctacagctctgtgaccccaagaagagaccggcgcagcggccgggactacagcacagtgtctgccagccccacagccctgagcaccctgaagcaggacagccaggagagcatcagcaacctggagcggcccagcagcccccccagcatccagccctgggtgagcccccacaacccagcctttgccacagagagccctgcctacggcagcagccccagctttgtgtccatggaggatgtgcgcatccacgagcccctgcccccacctccaccccagaggcgggacacccaccccagcgtggtggagacagatggccacgcccgggtggtggtgcccaccctgaagcagcacagccaccccccacccctggccctgggcagcggcctgcacgccccccacaagggccccctgccccaggccagtgaccctgctgtggcccggcagcaccggcccctgcccagcaccccagacagcagccaccacgcccaggccaccccccgctggagatacaacaagcccctgccccccaccccagacctgccccagccccacctgccccccatcagcgcccctggcagcagccgcatctaccggcccctgccccccctgcccatcattgatcctcccacagagcccccacccctgccccccaagagccggggccgcagccgcagcacccggggcggccacatgaacagcggcggccacgccaagaccaggcctgcctgccaggactggacagtgcccctgcctgccagcgctggccgcacctcctggcccccagccacagcccggagcacagagagcttcaccagcaccagccgcagcaagtctgaggtgtccccaggcatggccttcagcaacatgaccaacttcctgtgccccagcagccccaccaccccctggaccccagagctgcagggccccaccagcaaggatgaggccggcgtgtctgagcaccctgaggccccagcccgggagcccctgcggaggaccaccccccagcagggcgccagcggccctggccgcagccctgtgggccaggcccggcagcctgagaagcccagccacctgcacctggagaaggccagctcctggccccaccggcgggacagcggccggcccccaggggacagcagcggccaggccgtggcccccagcgagggcgccaacaagcacaagggctggagccggcagggcctgcggcggcccagcatcctgcctgagggcagcagtgacagccggggccctgctgtggagaagcaccctggccccagcgacacagtggtgttccgggagaagaagcccaaggaggtgatgggcggcttcagccgccgctgcagcaagctgatcaacagcagccagctgctgtaccaggagtacagtgatgtggtgctgaacaaggagatccagagccagcagaggctggagagcctgtctgagaccccaggccccagcagcccccggcagcccaggaaggccctggtgtcctctgagagctacctgcagaggctgtccatggccagcagcggcagcctgtggcaggagatccctgtggtgaggaacagcacagtgctgctgtccatgacccatgaggaccagaagctgcaggaggtgaagtttgagctgattgtgtctgaggccagctacctgcggagcctgaacattgctgtggaccacttccagctgagcaccagcctgcgggccaccctgagcaaccaggagcaccagtggctgttcagccggctgcaggatgtgagagatgtgtctgccaccttcctgagtgacctggaggagaactttgagaacaacatcttctccttccaggtgtgtgatgtggtgctgaaccacgccccagacttcagaagagtgtacctgccctacgtgaccaaccagacctaccaggagaggaccttccagagcctgatgaacagcaacagcaacttccgggaggtgctggagaagctggagagtgaccctgtgtgccagaggctgagcctgaagagcttcctgatcctgcccttccagaggatcacccggctgaagctgctgctgcagaacatcctgaagaggacccagcccggcagcagcgaggaggccgaggccaccaaggcccaccacgccctggagcagctgatccgggactgcaacaacaacgtgcagagcatgagaagaacagaggagctgatctacctgagccagaagattgaatttgagtgcaagatcttccccctcatcagccagagccgctggctggtgaagagcggggagctgacagccctggagttcagcgccagccctggcctgcggaggaagctgaacaccaggcctgtgcacctgcacctgttcaatgactgcctgctgctgagccggccccgggagggcagccgcttcctggtgtttgaccacgcccccttcagcagcatccggggggagaagtgtgagatgaagctgcacggcccccacaagaacctcttccgcctcttcctgcggcagaacacccagggcgcccaggccgagttcctgttcagaacagagacccagagcgagaagctgcgctggatcagcgccctggccatgccccgggaggagctggacctgctggagtgctacaacagcccccaggtgcagtgcctgcgggcctacaagcccagagaaaatgatgagctggccctggagaaggcagatgtggtgatggtgacccagcagagcagtgatggctggctggagggcgtgcggctgagtgatggagagcggggctggttccctgtgcagcaggtggagttcatcagcaaccctgaggtgcgggcccagaacctgaaggaggcccaccgggtgaagacagccaagctgcagctggtggagcagcaggcctag

SEQ ID NO: 168012 - DNA, 1197 bp, Artificial Sequence
  Description of Artificial Sequence: Synthetic coding sequence
atggccagcagcggcagcctgtggcaggagatccctgtggtgaggaacagcacagtgctgctgtccatgacccatgaggaccagaagctgcaggaggtgaagtttgagctgattgtgtctgaggccagctacctgcggagcctgaacattgctgtggaccacttccagctgagcaccagcctgcgggccaccctgagcaaccaggagcaccagtggctgttcagccggctgcaggatgtgagagatgtgtctgccaccttcctgagtgacctggaggagaactttgagaacaacatcttctccttccaggtgtgtgatgtggtgctgaaccacgccccagacttccggcgggtgtacctgccctacgtgaccaaccagacctaccaggagaggaccttccagagcctgatgaacagcaacagcaacttccgggaggtgctggagaagctggagagtgaccctgtgtgccagaggctgagcctgaagagcttcctgatcctgcccttccagaggatcacccggctgaagctgctgctgcagaacatcctgaagaggacccagcccggcagcagcgaggaggccgaggccaccaaggcccaccacgccctggagcagctgatccgggactgcaacaacaacgtgcagagcatgagaagaacagaggagctgatctacctgagccagaagattgaatttgagtgcaagatcttccccctcatcagccagagccgctggctggtgaagtctggagagctgacagccctggagttcagcgccagccctggcctgcggaggaagctgaacaccaggcctgtgcacctgcacctgttcaatgactgcctgctgctgagccggccccgggagagcgagaagctgcgctggatcagcgccctggccatgccccgggaggagctggacctgctggagtgctacaacagcccccaggtgcagtgcctgcgggcctacaagccccgggagaatgatgagctggccctggagaaggcagatgtggtgatggtgacccagcagagcagtgatggctggctggagggcgtgcggctgagtgatggagagcggggctggttccctgtgcagcaggtggagttcatcagcaaccctgaggtgcgggcccagaacctgaaggaggcccaccgggtgaagacagccaagctgcagctggtggagcagcaggcctag

SEQ ID NO: 168013 - DNA, 1560 bp, Artificial Sequence
  Description of Artificial Sequence: Synthetic coding sequence
atgggcggcttcagccgccgctgcagcaagctgatcaacagcagccagctgctgtaccaggagtacagtgatgtggtgctgaacaaggagatccagagccagcagaggctggagagcctgtctgagaccccaggccccagcagcccccggcagcccaggaaggccctggtgtcctctgagagctacctgcagaggctgtccatggccagcagcggcagcctgtggcaggagatccctgtggtgaggaacagcacagtgctgctgtccatgacccatgaggaccagaagctgcaggaggtgaagtttgagctgattgtgtctgaggccagctacctgcggagcctgaacattgctgtggaccacttccagctgagcaccagcctgcgggccaccctgagcaaccaggagcaccagtggctgttcagccggctgcaggatgtgagagatgtgtctgccaccttcctgagtgacctggaggagaactttgagaacaacatcttctccttccaggtgtgtgatgtggtgctgaaccacgccccagacttcagaagagtgtacctgccctacgtgaccaaccagacctaccaggagaggaccttccagagcctgatgaacagcaacagcaacttccgggaggtgctggagaagctggagagtgaccctgtgtgccagaggctgagcctgaagagcttcctgatcctgcccttccagaggatcacccggctgaagctgctgctgcagaacatcctgaagaggacccagcccggcagcagcgaggaggccgaggccaccaaggcccaccacgccctggagcagctgatccgggactgcaacaacaacgtgcagagcatgagaagaacagaggagctgatctacctgagccagaagattgaatttgagtgcaagatcttccccctcatcagccagagccgctggctggtgaagagcggggagctgacagccctggagttcagcgccagccctggcctgcggaggaagctgaacaccaggcctgtgcacctgcacctgttcaatgactgcctgctgctgagccggccccgggagggcagccgcttcctggtgtttgaccacgcccccttcagcagcatccggggggagaagtgtgagatgaagctgcacggcccccacaagaacctcttccgcctcttcctgcggcagaacacccagggcgcccaggccgagttcctgttcagaacagagacccagagcgagaagctgcgctggatcagcgccctggccatgccccgggaggagctggacctgctggagtgctacaacagcccccaggtgcagtgcctgcgggcctacaagcccagagaaaatgatgagctggccctggagaaggcagatgtggtgatggtgacccagcagagcagtgatggctggctggagggcgtgcggctgagtgatggagagcggggctggttccctgtgcagcaggtggagttcatcagcaaccctgaggtgcgggcccagaacctgaaggaggcccaccgggtgaagacagccaagctgcagctggtggagcagcaggcctag

SEQ ID NO: 168014 - DNA, 2394 bp, Artificial Sequence
  Description of Artificial Sequence: Synthetic coding sequence
tgagtggtggtgcccaccctgaagcagcacagccaccccccacccctggccctgggcagcggcctgcacgccccccacaagggccccctgccccaggccagtgaccctgctgtggcccggcagcaccggcccctgcccagcaccccagacagcagccaccacgcccaggccaccccccgctggagatacaacaagcccctgccccccaccccagacctgccccagccccacctgccccccatcagcgcccctggcagcagccgcatctaccggcccctgccccccctgcccatcattgatcctcccacagagcccccacccctgccccccaagagccggggccgcagccgcagcacccggggcggccacatgaacagcggcggccacgccaagaccaggcctgcctgccaggactggacagtgcccctgcctgccagcgctggccgcacctcctggcccccagccacagcccggagcacagagagcttcaccagcaccagccgcagcaagtctgaggtgtccccaggcatggccttcagcaacatgaccaacttcctgtgccccagcagccccaccaccccctggaccccagagctgcagggccccaccagcaaggatgaggccggcgtgtctgagcaccctgaggccccagcccgggagcccctgcggaggaccaccccccagcagggcgccagcggccctggccgcagccctgtgggccaggcccggcagcctgagaagcccagccacctgcacctggagaaggccagctcctggccccaccggcgggacagcggccggcccccaggggacagcagcggccaggccgtggcccccagcgagggcgccaacaagcacaagggctggagccggcagggcctgcggcggcccagcatcctgcctgagggcagcagtgacagccggggccctgctgtggagaagcaccctggccccagcgacacagtggtgttccgggagaagaagcccaaggaggtgatgggcggcttcagccgccgctgcagcaagctgatcaacagcagccagctgctgtaccaggagtacagtgatgtggtgctgaacaaggagatccagagccagcagaggctggagagcctgtctgagaccccaggccccagcagcccccggcagcccaggaaggccctggtgtcctctgagagctacctgcagaggctgtccatggccagcagcggcagcctgtggcaggagatccctgtggtgaggaacagcacagtgctgctgtccatgacccatgaggaccagaagctgcaggaggtgaagtttgagctgattgtgtctgaggccagctacctgcggagcctgaacattgctgtggaccacttccagctgagcaccagcctgcgggccaccctgagcaaccaggagcaccagtggctgttcagccggctgcaggatgtgagagatgtgtctgccaccttcctgagtgacctggaggagaactttgagaacaacatcttctccttccaggtgtgtgatgtggtgctgaaccacgccccagacttcagaagagtgtacctgccctacgtgaccaaccagacctaccaggagaggaccttccagagcctgatgaacagcaacagcaacttccgggaggtgctggagaagctggagagtgaccctgtgtgccagaggctgagcctgaagagcttcctgatcctgcccttccagaggatcacccggctgaagctgctgctgcagaacatcctgaagaggacccagcccggcagcagcgaggaggccgaggccaccaaggcccaccacgccctggagcagctgatccgggactgcaacaacaacgtgcagagcatgagaagaacagaggagctgatctacctgagccagaagattgaatttgagtgcaagatcttccccctcatcagccagagccgctggctggtgaagagcggggagctgacagccctggagttcagcgccagccctggcctgcggaggaagctgaacaccaggcctgtgcacctgcacctgttcaatgactgcctgctgctgagccggccccgggagagcgagaagctgcgctggatcagcgccctggccatgccccgggaggagctggacctgctggagtgctacaacagcccccaggtgcagtgcctgcgggcctacaagcccagagaaaatgatgagctggccctggagaaggcagatgtggtgatggtgacccagcagagcagtgatggctggctggagggcgtgcggctgagtgatggagagcggggctggttccctgtgcagcaggtggagttcatcagcaaccctgaggtgcgggcccagaacctgaaggaggcccaccgggtgaagacagccaagctgcagctggtggagcagcaggcctag

SEQ ID NO: 168015 - DNA, 2958 bp, Artificial Sequence
  Description of Artificial Sequence: Synthetic coding sequence
atgagccgcatcgagagcctgacccgggccagaattgacaggagccgggagctggccagcaagacccgggagaaggagaagatgaaggaggccaaggatgcccgctacaccaacggccacctgttcaccaccatctctgtgtctggcatgaccatgtgctacgcctgcaacaagagcatcacagccaaggaggccctgatctgccccacctgcaatgtgaccatccacaaccgctgcaaggacaccctggccaactgcaccaaggtgaagcagaagcagcagaaggccgccctgctgaagaacaacacagccctgcagagcgtgtccctgcggagcaagaccaccatccgggagcggcccagcagcgccatctaccccagcgacagcttccggcagagcctgctgggcagccggcggggccgcagcagcctgagcctggccaagtctgtgtccaccaccaacattgctggccacttcaatgatgagagccccctgggcctgcggcgcatcctgagccagagcacagacagcctgaacatgaggaacagaaccctgtctgtggagagcctgattgatgaggaggtgatctacagcgagctgatgtctgactttgagatggatgagaaggactttgctgctgacagctggagcctggccgtggacagcagcttcctgcagcagcacaagaaggaggtgatgaagcagcaggatgtgatctatgagctgatccagacagagctgcaccacgtgaggaccctgaagatcatgaccaggctcttcagaacaggcatgctggaggagctgcacctggagcccggggtggtgcagggcctcttcccctgtgtggatgagctgagtgacatccacacccgcttcctgagccagctgctggagcggcggcggcaggccctgtgccccggcagcaccaggaacttcgtcatccaccggctgggggacctgctgatcagccagttcagcggccccagcgctgagcagatgtgcaagacctacagcgagttctgcagccgccacagcaaggccctgaagctgtacaaggagctgtatgcccgggacaagcgcttccagcagttcatcaggaaggtgaccaggcctgctgtgctgaagagacatggagtgcaggagtgcatcctgctggtgacccagaggatcaccaagtaccccctgctgatcagccgcatcctgcagcacagccatggaattgaggaggagcggcaggacctgaccacagccctgggcctggtgaaggagctgctgagcaatgtggatgagggcatctaccagctggagaagggggcccggctgcaggagatctacaacaggatggacccccgggcccagacccctgtgcctgggaagggccccttcggccgggaggagctgctgcggaggaagctgattcatgatggctgcctgctgtggaagacagccaccggccgcttcaaggatgtgctggtgctgctgatgacagatgtgctggtgttcctgcaggagaaggaccagaagtacatcttccccaccctggacaagcccagcgtggtgtccctgcagaacctgattgtgcgggacatcgccaaccaggagaagggcatgttcctgatctctgctgcccctcctgagatgtatgaggtgcacacagccagcagagatgacaggagcacctggatccgggtcatccagcagagcgtgaggacctgccccagccgggaggacttccccctgattgaaacagaagatgaggcctacctgcggcgcatcaagatggagctgcagcagaaggaccgggccctggtggagctgctgcgggagaaggtgggcctgtttgctgagatgacccacttccaggccgaggaggatggcggcagcggcatggccctgcccaccctgccccggggcctcttccgctctgagagcctggagagccccagaggagagcggctgctgcaggatgccatccgggaggtggagggcctgaaggacctgctggtgggccctggggtggagctgctgctgaccccccgggagcccgccctgcccctggagccagacagcggcggcaacaccagccctggggtgacagccaatggagaggcccggaccttcaacggcagcattgagctgtgcagagctgacagcgacagcagccagagggacagaaatggaaaccagctgcggagcccccaggaggaggccctgcagaggctggtgaacctgtatggcctgctgcacggcctgcaggccgctgtggcccagcaggacaccctgatggaggcccgcttccctgagggccctgagcggcgggagaagctgtgccgggccaacagcagagatggagaggccggccgggccggggccgcccctgtggcccctgagaagcaggccacagagctggccctgctgcagaggcagcacgccctgctgcaggaggagctgcggcgctgccggcggctgggggaggagcgggccacagaagctggcagcctggaggcccggctgcgggagagcgagcaggcccgggccctgctggagcgggaggccgaggaggcccggcggcagctggccgccctgggccagacagagcccctgcctgctgaggccccctgggcccggcggcctgtggaccccaggagaagaagcctgcctgctggagatgccctgtacctgtccttcaaccccccccagcccagccggggcacagaccggctggacctgcctgtgaccaccaggtctgtgcacaggaactttgaggaccgggagcggcaggagctgggcagccctgaggagcggctgcaggacagcagtgaccctgacaccggcagcgaggaggagggcagcagccggctgagccccccccacagcccccgggacttcaccaggatgcaggacatccctgaggagacagagagcagagatggagaggccgtggccagcgagagctag

SEQ ID NO: 168016 - DNA, 2877 bp, Artificial Sequence
  Description of Artificial Sequence: Synthetic coding sequence
atgaaggaggccaaggatgcccgctacaccaacggccacctgttcaccaccatctctgtgtctggcatgaccatgtgctacgcctgcaacaagagcatcacagccaaggaggccctgatctgccccacctgcaatgtgaccatccacaaccgctgcaaggacaccctggccaactgcaccaaggtgaagcagaagcagcagaaggccgccctgctgaagaacaacacagccctgcagagcgtgtccctgcggagcaagaccaccatccgggagcggcccagcagcgccatctaccccagcgacagcttccggcagagcctgctgggcagcagaagaggccgcagcagcctgagcctggccaagtctgtgtccaccaccaacattgctggccacttcaatgatgagagccccctgggcctgcggcgcatcctgagccagagcacagacagcctgaacatgaggaacagaaccctgtctgtggagagcctgattgatgaggaggtgatctacagcgagctgatgtctgactttgagatggatgagaaggactttgctgctgacagctggagcctggccgtggacagcagcttcctgcagcagcacaagaaggaggtgatgaagcagcaggacgtcatctatgagctgatccagacagagctgcaccacgtgaggaccctgaagatcatgaccaggctcttcagaacaggcatgctggaggagctgcacctggagcccggggtggtgcagggcctcttcccctgtgtggatgagctgagtgacatccacacccgcttcctgagccagctgctggagcggcggcggcaggccctgtgccccggcagcaccaggaactttgtgatccaccggctgggggacctgctgatcagccagttcagcggccccagcgctgagcagatgtgcaagacctacagcgagttctgcagccgccacagcaaggccctgaagctgtacaaggagctgtatgcccgggacaagcgcttccagcagttcatcaggaaggtgaccaggcctgctgtgctgaagagacatggagtgcaggagtgcatcctgctggtgacccagaggatcaccaagtaccccctgctgatcagccgcatcctgcagcacagccacggcatcgaggaggagcggcaggacctgaccacagccctgggcctggtgaaggagctgctgagcaatgtggatgagggcatctaccagctggagaagggggcccggctgcaggagatctacaacaggatggacccccgggcccagacccctgtgcctgggaagggccccttcggccgggaggagctgctgcggaggaagctgattcatgatggctgcctgctgtggaagacagccaccggccgcttcaaggatgtgctggtgctgctgatgacagatgtgctggtgttcctgcaggagaaggaccagaagtacatcttccccaccctggacaagcccagcgtggtgtccctgcagaacctgattgtgcgggacatcgccaaccaggagaagggcatgttcctgatctctgctgcccctcctgagatgtatgaggtgcacacagccagcagagatgacaggagcacctggatccgggtcatccagcagagcgtgaggacctgccccagccgggaggacttccccctcatcgagacagaagatgaggcctacctgcggcgcatcaagatggagctgcagcagaaggaccgggccctggtggagctgctgcgggagaaggtgggcctgtttgctgagatgacccacttccaggccgaggaggatggcggcagcggcatggccctgcccaccctgccccggggcctcttccgctctgagagcctggagagccccagaggagagcggctgctgcaggatgccatccgggaggtggagggcctgaaggacctgctggtgggccctggggtggagctgctgctgaccccccgggagcccgccctgcccctggagccagattctgggggcaacaccagccctggggtgacagccaacggggaggcccggaccttcaacggcagcattgagctgtgcagagctgacagcgacagcagccagagggacagaaatggaaaccagctgcggagcccccaggaggaggccctgcagaggctggtgaacctgtatggcctgctgcacggcctgcaggccgctgtggcccagcaggacaccctgatggaggcccgcttccctgagggccctgagcggcgggagaagctgtgccgggccaacagcagagatggagaggccggccgggccggggccgcccctgtggcccctgagaagcaggccacagagctggccctgctgcagaggcagcacgccctgctgcaggaggagctgcggcgctgccggcggctgggggaggagcgggccacagaggccggcagcctggaggcccggctgcgggagagcgagcaggcccgggccctgctggagcgggaggccgaggaggcccggcggcagctggccgccctgggccagacagagcccctgcctgctgaggccccctgggcccggcggcctgtggacccccggcggcgcagcctgcctgctggagatgccctgtacctgtccttcaaccccccccagcccagccggggcacagaccggctggacctgcctgtgaccaccaggtctgtgcacaggaactttgaagatcgggagcggcaggagctgggcagccctgaggagcggctgcaggacagcagtgaccctgacaccggcagcgaggaggagggcagcagccggctgagccccccccacagcccccgggacttcaccaggatgcaggacatccctgaggagacagagagcagagatggagaggccgtggccagcgagagctag

SEQ ID NO: 168017 - DNA, 2961 bp, Artificial Sequence
  Description of Artificial Sequence: Synthetic coding sequence
atgagccgcatcgagagcctgacccgggccagaattgacaggagccgggagctggccagcaagacccgggagaaggagaagatgaaggaggccaaggatgcccgctacaccaacggccacctgttcaccaccatctctgtgtctggcatgaccatgtgctacgcctgcaacaagagcatcacagccaaggaggccctgatctgccccacctgcaatgtgaccatccacaaccgctgcaaggacaccctggccaactgcaccaaggtgaagcagaagcagcagaaggccgccctgctgaagaacaacacagccctgcagagcgtgtccctgcggagcaagaccaccatccgggagcggcccagcagcgccatctaccccagcgacagcttccggcagagcctgctgggcagccggcggggccgcagcagcctgagcctggccaagtctgtgtccaccaccaacattgctggccacttcaatgatgagagccccctgggcctgcggcgcatcctgagccagagcacagacagcctgaacatgaggaacagaaccctgtctgtggagagcctgattgatgaggccgaggtgatctacagcgagctgatgtctgactttgagatggatgagaaggactttgctgctgacagctggagcctggccgtggacagcagcttcctgcagcagcacaagaaggaggtgatgaagcagcaggacgtcatctatgagctgatccagacagagctgcaccacgtgaggaccctgaagatcatgaccaggctcttcagaacaggcatgctggaggagctgcacctggagcccggggtggtgcagggcctcttcccctgtgtggatgagctgagtgacatccacacccgcttcctgagccagctgctggagcggcggcggcaggccctgtgccccggcagcaccaggaactttgtgatccaccggctgggggacctgctgatcagccagttcagcggccccagcgctgagcagatgtgcaagacctacagcgagttctgcagccgccacagcaaggccctgaagctgtacaaggagctgtatgcccgggacaagcgcttccagcagttcatcaggaaggtgaccaggcctgctgtgctgaagagacatggagtgcaggagtgcatcctgctggtgacccagaggatcaccaagtaccccctgctgatcagccgcatcctgcagcacagccacggcatcgaggaggagcggcaggacctgaccacagccctgggcctggtgaaggagctgctgagcaatgtggatgagggcatctaccagctggagaagggggcccggctgcaggagatctacaacaggatggacccccgggcccagacccctgtgcctgggaagggccccttcggccgggaggagctgctgcggaggaagctgattcatgatggctgcctgctgtggaagacagccaccggccgcttcaaggatgtgctggtgctgctgatgacagatgtgctggtgttcctgcaggagaaggaccagaagtacatcttccccaccctggacaagcccagcgtggtgtccctgcagaacctgattgtgcgggacatcgccaaccaggagaagggcatgttcctgatctctgctgcccctcctgagatgtatgaggtgcacacagccagcagagatgacaggagcacctggatccgggtcatccagcagagcgtgaggacctgccccagccgggaggacttccccctcatcgagacagaagatgaggcctacctgcggcgcatcaagatggagctgcagcagaaggaccgggccctggtggagctgctgcgggagaaggtgggcctgtttgctgagatgacccacttccaggccgaggaggatggcggcagcggcatggccctgcccaccctgccccggggcctcttccgctctgagagcctggagagccccagaggagagcggctgctgcaggatgccatccgggaggtggagggcctgaaggacctgctggtgggccctggggtggagctgctgctgaccccccgggagcccgccctgcccctggagccagattctgggggcaacaccagccctggggtgacagccaacggggaggcccggaccttcaacggcagcattgagctgtgcagagctgacagcgacagcagccagagggacagaaatggaaaccagctgcggagcccccaggaggaggccctgcagaggctggtgaacctgtatggcctgctgcacggcctgcaggccgctgtggcccagcaggacaccctgatggaggcccgcttccctgagggccctgagcggcgggagaagctgtgccgggccaacagcagagatggagaggccggccgggccggggccgcccctgtggcccctgagaagcaggccacagagctggccctgctgcagaggcagcacgccctgctgcaggaggagctgcggcgctgccggcggctgggggaggagcgggccacagaggccggcagcctggaggcccggctgcgggagagcgagcaggcccgggccctgctggagcgggaggccgaggaggcccggcggcagctggccgccctgggccagacagagcccctgcctgctgaggccccctgggcccggcggcctgtggacccccggcggcgcagcctgcctgctggagatgccctgtacctgtccttcaaccccccccagcccagccggggcacagaccggctggacctgcctgtgaccaccaggtctgtgcacaggaactttgaagatcgggagcggcaggagctgggcagccctgaggagcggctgcaggacagcagtgaccctgacaccggcagcgaggaggagggcagcagccggctgagccccccccacagcccccgggacttcaccaggatgcaggacatccctgaggagacagagagcagagatggagaggccgtggccagcgagagctag

SEQ ID NO: 168018 - DNA, 2964 bp, Artificial Sequence
  Description of Artificial Sequence: Synthetic coding sequence
atgtgctgctgctgcggctgctgccccctgctggcccacctggagcagggcagcctgcgggagaggacccgggagaaggagaagatgaaggaggccaaggatgcccgctacaccaacggccacctgttcaccaccatctctgtgtctggcatgaccatgtgctacgcctgcaacaagagcatcacagccaaggaggccctgatctgccccacctgcaatgtgaccatccacaaccgctgcaaggacaccctggccaactgcaccaaggtgaagcagaagcagcagaaggccgccctgctgaagaacaacacagccctgcagagcgtgtccctgcggagcaagaccaccatccgggagcggcccagcagcgccatctaccccagcgacagcttccggcagagcctgctgggcagcagaagaggccgcagcagcctgagcctggccaagtctgtgtccaccaccaacattgctggccacttcaatgatgagagccccctgggcctgcggcgcatcctgagccagagcacagacagcctgaacatgaggaacagaaccctgtctgtggagagcctgattgatgaagctgaggtgatctacagcgagctgatgtctgactttgagatggatgagaaggactttgctgctgacagctggagcctggccgtggacagcagcttcctgcagcagcacaagaaggaggtgatgaagcagcaggatgtgatctatgagctgatccagacagagctgcaccacgtgaggaccctgaagatcatgaccaggctcttcagaacaggcatgctggaggagctgcacctggagcccggggtggtgcagggcctcttcccctgtgtggatgagctgagtgacatccacacccgcttcctgagccagctgctggagcggcggcggcaggccctgtgccccggcagcaccaggaacttcgtcatccaccggctgggggacctgctgatcagccagttcagcggccccagcgctgagcagatgtgcaagacctacagcgagttctgcagccgccacagcaaggccctgaagctgtacaaggagctgtatgcccgggacaagcgcttccagcagttcatcaggaaggtgaccaggcctgctgtgctgaagagacatggagtgcaggagtgcatcctgctggtgacccagaggatcaccaagtaccccctgctgatcagccgcatcctgcagcacagccatggaattgaggaggagcggcaggacctgaccacagccctgggcctggtgaaggagctgctgagcaatgtggatgagggcatctaccagctggagaagggggcccggctgcaggagatctacaacaggatggacccccgggcccagacccctgtgcctgggaagggccccttcggccgggaggagctgctgcggaggaagctgattcatgatggctgcctgctgtggaagacagccaccggccgcttcaaggatgtgctggtgctgctgatgacagatgtgctggtgttcctgcaggagaaggaccagaagtacatcttccccaccctggacaagcccagcgtggtgtccctgcagaacctgattgtgcgggacatcgccaaccaggagaagggcatgttcctgatctctgctgcccctcctgagatgtatgaggtgcacacagccagcagagatgacaggagcacctggatccgggtcatccagcagagcgtgaggacctgccccagccgggaggacttccccctgattgaaacagaagatgaggcctacctgcggcgcatcaagatggagctgcagcagaaggaccgggccctggtggagctgctgcgggagaaggtgggcctgtttgctgagatgacccacttccaggccgaggaggatggcggcagcggcatggccctgcccaccctgccccggggcctcttccgctctgagagcctggagagccccagaggagagcggctgctgcaggatgccatccgggaggtggagggcctgaaggacctgctggtgggccctggggtggagctgctgctgaccccccgggagcccgccctgcccctggagccagacagcggcggcaacaccagccctggggtgacagccaatggagaggcccggaccttcaacggcagcattgagctgtgcagagctgacagcgacagcagccagagggacagaaatggaaaccagctgcggagcccccaggaggaggccctgcagaggctggtgaacctgtatggcctgctgcacggcctgcaggccgctgtggcccagcaggacaccctgatggaggcccgcttccctgagggccctgagcggcgggagaagctgtgccgggccaacagcagagatggagaggccggccgggccggggccgcccctgtggcccctgagaagcaggccacagagctggccctgctgcagaggcagcacgccctgctgcaggaggagctgcggcgctgccggcggctgggggaggagcgggccacagaagctggcagcctggaggcccggctgcgggagagcgagcaggcccgggccctgctggagcgggaggccgaggaggcccggcggcagctggccgccctgggccagacagagcccctgcctgctgaggccccctgggcccggcggcctgtggaccccaggagaagaagcctgcctgctggagatgccctgtacctgtccttcaaccccccccagcccagccggggcacagaccggctggacctgcctgtgaccaccaggtctgtgcacaggaactttgaggaccgggagcggcaggagctgggcagccctgaggagcggctgcaggacagcagtgaccctgacaccggcagcgaggaggagggcagcagccggctgagccccccccacagcccccgggacttcaccaggatgcaggacatccctgaggagacagagagcagagatggagaggccgtggccagcgagagctag

SEQ ID NO: 168019 - DNA, 2877 bp, Artificial Sequence; identical to SEQ ID NO: 168016
  Description of Artificial Sequence: Synthetic coding sequence

SEQ ID NO: 168020 - DNA, 1548 bp, Artificial Sequence
  Description of Artificial Sequence: Synthetic coding sequence
atgctgagcaagtctgtgcctgtgtctggcatcaactgcctgctggacagaagtgacacagatggaaatgtgtcccagagcagcgccatcgacctgaggaagcgctgcagccagctggagggccacagcggcaccagggtgggcagcagcctgcggcagaccttctccttcctgagcggcatgaccgggaaggccaagacccgggagaaggagaagatgaaggaggccaaggatgcccgctacaccaacggccacctgttcaccaccatctctgtgtctggcatgaccatgtgctacgcctgcaacaagagcatcacagccaaggaggccctgatctgccccacctgcaatgtgaccatccacaaccgctgcaaggacaccctggccaactgcaccaaggtgaagcagaagcagcagaaggccgccctgctgaagaacaacacagccctgcagagcgtgtccctgcggagcaagaccaccatccgggagcggcccagcagcgccatctaccccagcgacagcttccggcagagcctgctgggcagcagaagaggccgcagcagcctgagcctggccaagtctgtgtccaccaccaacattgctggccacttcaatgatgagagccccctgggcctgcggcgcatcctgagccagagcacagacagcctgaacatgaggaacagaaccctgtctgtggagagcctgattgatgaagctgaggtgatctacagcgagctgatgtctgactttgagatggatgagaaggactttgctgctgacagctggagcctggccgtggacagcagcttcctgcagcagcacaagaaggaggtgatgaagcagcaggatgtgatctatgagctgatccagacagagctgcaccacgtgaggaccctgaagatcatgaccaggctcttcagaacaggcatgctggaggagctgcacctggagcccggggtggtgcagggcctcttcccctgtgtggatgagctgagtgacatccacacccgcttcctgagccagctgctggagcggcggcggcaggccctgtgccccggcagcaccaggaacttcgtcatccaccggctgggggacctgctgatcagccagttcagcggccccagcgctgagcagatgtgcaagacctacagcgagttctgcagccgccacagcaaggccctgaagctgtacaaggagctgtatgcccgggacaagcgcttccagcagttcatcaggaaggtgaccaggcctgctgtgctgaagagacatggagtgcaggagtgcatcctgctggtgacccagaggatcaccaagtaccccctgctgatcagccgcatcctgcagcacagccatggaattgaggaggagcggcaggacctgaccacagccctgggcctggtgaaggagctgctgagcaatgtggatgagggcatctaccagctggagaagggggcccggctgcaggagatctacaacctgctgctgctcttcagcctgagccccagcttcatggaggccctgggggacaacctggcctcctggagctag

SEQ ID NO: 168021 - DNA, 1332 bp, Artificial Sequence
  Description of Artificial Sequence: Synthetic coding sequence
atgaaggaggccaaggatgcccgctacaccaacggccacctgttcaccaccatctctgtgtctggcatgaccatgtgctacgcctgcaacaagagcatcacagccaaggaggccctgatctgccccacctgcaatgtgaccatccacaaccgctgcaaggacaccctggccaactgcaccaaggtgaagcagaagcagcagaaggccgccctgctgaagaacaacacagccctgcagagcgtgtccctgcggagcaagaccaccatccgggagcggcccagcagcgccatctaccccagcgacagcttccggcagagcctgctgggcagcagaagaggccgcagcagcctgagcctggccaagtctgtgtccaccaccaacattgctggccacttcaatgatgagagccccctgggcctgcggcgcatcctgagccagagcacagacagcctgaacatgaggaacagaaccctgtctgtggagagcctgattgatgaagctgaggtgatctacagcgagctgatgtctgactttgagatggatgagaaggactttgctgctgacagctggagcctggccgtggacagcagcttcctgcagcagcacaagaaggaggtgatgaagcagcaggatgtgatctatgagctgatccagacagagctgcaccacgtgaggaccctgaagatcatgaccaggctcttcagaacaggcatgctggaggagctgcacctggagcccggggtggtgcagggcctcttcccctgtgtggatgagctgagtgacatccacacccgcttcctgagccagctgctggagcggcggcggcaggccctgtgccccggcagcaccaggaacttcgtcatccaccggctgggggacctgctgatcagccagttcagcggccccagcgctgagcagatgtgcaagacctacagcgagttctgcagccgccacagcaaggccctgaagctgtacaaggagctgtatgcccgggacaagcgcttccagcagttcatcaggaaggtgaccaggcctgctgtgctgaagagacatggagtgcaggagtgcatcctgctggtgacccagaggatcaccaagtaccccctgctgatcagccgcatcctgcagcacagccatggaattgaggaggagcggcaggacctgaccacagccctgggcctggtgaaggagctgctgagcaatgtggatgagggcatctaccagctggagaagggggcccggctgcaggagatctacaacctgctgctgctcttcagcctgagccccagcttcatggaggccctgggggacaacctggcctcctggagctag

SEQ ID NO: 168022 - DNA, 4167 bp, Artificial Sequence
  Description of Artificial Sequence: Synthetic coding sequence
atgagccggcccccacccaccgggaagatgcctggggcccctgagacagcccctggagatggagctggggccagccggcagaggaagctggaggccctgatccgggaccccaggagccccatcaacgtggagagcctgctggatggcctgaacagcctggtgctggacctggacttccctgccctgaggaagaacaagaacatcgacaacttcctgaacagatatgagaagatcgtgaagaagatccggggcctgcagatgaaggccgaggactatgatgtggtgaaggtgattggccgcggggcctttggagaggtgcagctggtgcgccacaaggccagccagaaggtgtatgccatgaagctgctgagcaagtttgagatgatcaagagaagtgacagcgccttcttctgggaggagcgggacatcatggcctttgccaacagcccctgggtggtgcagctgttctacgccttccaggatgaccgctacctgtacatggtgatggagtacatgcctggaggagacctggtgaacctgatgagcaactatgatgtgcctgagaagtgggccaagttctacacagctgaggtggtgctggccctggatgccatccacagcatgggcctcatccacagagatgtgaagccagacaacatgctgctggacaagcacggccacctgaagctggccgactttggcacctgcatgaagatggatgagaccggcatggtgcactgtgacacagctgtgggcaccccagactacatcagccctgaggtgctgaagagccagggcggagatggcttctacggccgggagtgtgactggtggagcgtgggcgtcttcctgtatgagatgctggtgggggacacccccttctacgccgacagcctggtgggcacctacagcaagatcatggaccacaagaacagcctgtgcttcccagaagatgctgagatcagcaagcacgccaagaacctgatctgtgccttcctgacagaccgggaggtgcggctgggcagaaatggagtggaggagatccggcagcaccccttcttcaagaatgaccagtggcactgggacaacatccgggagacagctgcccctgtggtgcctgagctgagcagtgacatcgacagcagcaactttgatgacattgaagatgacaagggagatgtggagaccttccccatccccaaggcctttgtgggcaaccagctgcccttcatcggcttcacctactaccgggagaacctgctgctgagtgacagccccagctgccgggagacagacagcatccagagcaggaagaatgaggagagccaggagatccagaagaagctgtacaccctggaggagcacctgagcaatgagatgcaggccaaggaggagctggagcagaagtgcaagtctgtgaacacccggctggagaagacagccaaggagctggaggaggagatcaccctgaggaagtctgtggagagcgccctgcggcagctggagcgggagaaggccctgctgcagcacaagaatgctgagtaccagaggaaggctgaccatgaagctgacaagaagaggaacctggagaatgatgtgaacagcctgaaggaccagctggaggacctgaagaagaggaaccagaacagccagatcagcacagagaaggtgaaccagctgcagaggcagctggatgagaccaatgccctgctgaggacagaaagtgacacagctgcccggctgaggaagacccaggccgagagcagcaagcagatccagcagctggagagcaacaacagagacctgcaggacaagaactgcctgctggagacagccaagctgaagctggagaaggagttcatcaacctgcagagcgccctggagagcgagcggcgggacaggacccacggcagcgagatcatcaatgacctgcagggccgcatctgtggcctggaggaggacctgaagaatggcaagatcctgctggccaaggtggagctggagaagaggcagctgcaggagcgcttcacagacctggagaaggagaagagcaacatggagattgacatgacctaccagctgaaggtgatccagcagagcctggagcaggaggaggccgagcacaaggccaccaaggcccggctggccgacaagaacaagatctatgagagcattgaggaggccaagtctgaggccatgaaggagatggagaagaagctgctggaggagaggaccctgaagcagaaggtggagaacctgctgctggaggccgagaagcgctgcagcctgctggactgtgacctgaagcagagccagcagaagatcaatgagctgctgaagcagaaggatgtgctgaatgaagatgtgaggaacctgaccctgaagattgagcaggagacccagaagcgctgcctgacccagaatgacctgaagatgcagacccagcaggtgaacaccctgaagatgtctgagaagcagctgaagcaggagaacaaccacctgatggagatgaagatgaacctggagaagcagaatgctgagctgaggaaggagcggcaggatgctgatggccagatgaaggagctgcaggaccagctggaggccgagcagtacttcagcaccctgtacaagacccaggtgcgggagctgaaggaggagtgtgaggagaagaccaagctgggcaaggagctgcagcagaagaagcaggagctgcaggatgagcgggacagcctggccgcccagctggagatcaccctgaccaaggctgacagcgagcagctggcccggagcattgctgaggagcagtacagcgacctggagaaggagaagatcatgaaggagctggagatcaaggagatgatggcccggcacaagcaggagctgacagagaaggatgccaccatcgccagcctggaggagaccaacagaaccctgaccagtgatgtggccaacctggccaatgagaaggaggagctgaacaacaagctgaaggatgtgcaggagcagctgagccggctgaaggatgaggagatctctgctgctgccatcaaggcccagtttgagaagcagctgctgacagagaggaccctgaagacccaggccgtgaacaagctggccgagatcatgaacaggaaggagcctgtgaagagaggaaatgacacagatgtgcggaggaaggagaaggagaacaggaagctgcacatggagctgaagtctgagcgggagaagctgacccagcagatgatcaagtaccagaaggagctgaatgagatgcaggcccagattgctgaggagagccagatcagaattgagctgcagatgaccctggacagcaaggacagcgacatcgagcagctgcggagccagctgcaggccctgcacatcggcctggacagcagcagcatcggcagcggccctggagatgctgaggctgatgatggcttccctgagagccggctggagggctggctgagcctgcctgtgaggaacaacaccaagaagtttggctgggtgaagaagtatgtgattgtgagcagcaagaagatcctcttctatgattctgagcaggacaaggagcagagcaacccctacatggtgctggacatcgacaagctgttccacgtgcggcctgtgacccagacagatgtgtacagagcagatgccaaggagatcccccgcatcttccagatcctgtatgccaatgaaggagagagcaagaaggagcaggagttccctgtggagcctgtgggggagaagagcaactacatctgccacaagggccacgagttcatccccaccctgtaccacttccccaccaactgtgaggcctgcatgaagcccctgtggcacatgttcaagcccccaccagccctggagtgccgccgctgccacatcaagtgccacaaggaccacatggacaagaaggaggagatcatcgccccctgcaaggtgtactatgacatcagcacagccaagaacctgctgctgctggccaacagcacagaggagcagcagaagtgggtgtcccggctggtgaagaagatccccaagaagcccccagccccagacccctttgcccggagcagccccaggacctccatgaagatccagcagaaccagagcatccggcggcccagccggcagctggcccccaacaagcccagctag

SEQ ID NO: 168023 - DNA, 2241 bp, Artificial Sequence
  Description of Artificial Sequence: Synthetic coding sequence
atgatctacaaggtggagtgtggcctggaggaggacctgaagaatggcaagatcctgctggccaaggtggagctggagaagaggcagctgcaggagcgcttcacagacctggagaaggagaagagcaacatggagattgacatgacctaccagctgaaggtgatccagcagagcctggagcaggaggaggccgagcacaaggccaccaaggcccggctggccgacaagaacaagatctatgagagcattgaggaggccaagtctgaggccatgaaggagatggagaagaagctgctggaggagaggaccctgaagcagaaggtggagaacctgctgctggaggccgagaagcgctgcagcctgctggactgtgacctgaagcagagccagcagaagatcaatgagctgctgaagcagaaggatgtgctgaatgaagatgtgaggaacctgaccctgaagattgagcaggagacccagaagcgctgcctgacccagaatgacctgaagatgcagacccagcaggtgaacaccctgaagatgtctgagaagcagctgaagcaggagaacaaccacctgatggagatgaagatgaacctggagaagcagaatgctgagctgaggaaggagcggcaggatgctgatggccagatgaaggagctgcaggaccagctggaggccgagcagtacttcagcaccctgtacaagacccaggtgcgggagctgaaggaggagtgtgaggagaagaccaagctgggcaaggagctgcagcagaagaagcaggagctgcaggatgagcgggacagcctggccgcccagctggagatcaccctgaccaaggctgacagcgagcagctggcccggagcattgctgaggagcagtacagcgacctggagaaggagaagatcatgaaggagctggagatcaaggagatgatggcccggcacaagcaggagctgacagagaaggatgccaccatcgccagcctggaggagaccaacagaaccctgaccagtgatgtggccaacctggccaatgagaaggaggagctgaacaacaagctgaaggatgtgcaggagcagctgagccggctgaaggatgaggagatctctgctgctgccatcaaggcccagtttgagaagcagctgctgacagagaggaccctgaagacccaggccgtgaacaagctggccgagatcatgaacaggaaggagcctgtgaagagaggaaatgacacagatgtgcggaggaaggagaaggagaacaggaagctgcacatggagctgaagtctgagcgggagaagctgacccagcagatgatcaagtaccagaaggagctgaatgagatgcaggcccagattgctgaggagagccagatcagaattgagctgcagatgaccctggacagcaaggacagcgacatcgagcagctgcggagccagctgcaggccctgcacatcggcctggacagcagcagcatcggcagcggccctggagatgctgaggctgatgatggcttccctgagagccggctggagggctggctgagcctgcctgtgaggaacaacaccaagaagtttggctgggtgaagaagtatgtgattgtgagcagcaagaagatcctcttctatgattctgagcaggacaaggagcagagcaacccctacatggtgctggacatcgacaagctgttccacgtgcggcctgtgacccagacagatgtgtacagagcagatgccaaggagatcccccgcatcttccagatcctgtatgccaatgaaggagagagcaagaaggagcaggagttccctgtggagcctgtgggggagaagagcaactacatctgccacaagggccacgagttcatccccaccctgtaccacttccccaccaactgtgaggcctgcatgaagcccctgtggcacatgttcaagcccccaccagccctggagtgccgccgctgccacatcaagtgccacaaggaccacatggacaagaaggaggagatcatcgccccctgcaaggtgtactatgacatcagcacagccaagaacctgctgctgctggccaacagcacagaggagcagcagaagtgggtgtcccggctggtgaagaagatccccaagaagcccccagccccagacccctttgcccggagcagccccaggacctccatgaagatccagcagaaccagagcatccggcggcccagccggcagctggcccccaacaagcccagctag

SEQ ID NO: 168024 - DNA, 3438 bp, Artificial Sequence
  Description of Artificial Sequence: Synthetic coding sequence
atggtgcactgtgacacagctgtgggcaccccagactacatcagccctgaggtgctgaagagccagggcggagatggcttctacggcagagaatgtgactggtggagcgtgggcgtcttcctgtatgagatgctggtgggggacacccccttctatgctgacagcctggtgggcacctacagcaagatcatggaccacaagaacagcctgtgcttcccagaagatgctgagatcagcaagcacgccaagaacctgatctgtgccttcctgacagaccgggaggtgcggctgggcagaaatggagtggaggagatccggcagcaccccttcttcaagaatgaccagtggcactgggacaacatccgggagacagctgcccctgtggtgcctgagctgagcagtgacatcgacagcagcaactttgatgacattgaagatgacaagggagatgtggagaccttccccatccccaaggcctttgtgggcaaccagctgcccttcatcggcttcacctactaccgggagaacctgctgctgagtgacagccccagctgccgggagacagacagcatccagagcaggaagaatgaggagagccaggagatccagaagaagctgtacaccctggaggagcacctgagcaatgagatgcaggccaaggaggagctggagcagaagtgcaagtctgtgaacacccggctggagaagacagccaaggagctggaggaggagatcaccctgaggaagtctgtggagagcgccctgcggcagctggagcgggagaaggccctgctgcagcacaagaatgctgagtaccagaggaaggctgaccacgaggccgacaagaagaggaacctggagaatgatgtgaacagcctgaaggaccagctggaggacctgaagaagaggaaccagaacagccagatcagcacagagaaggtgaaccagctgcagaggcagctggatgagaccaatgccctgctgaggacagaaagtgacacagctgcccggctgaggaagacccaggccgagagcagcaagcagatccagcagctggagagcaacaacagagacctgcaggacaagaactgcctgctggagacagccaagctgaagctggagaaggagttcatcaacctgcagagcgccctggagagcgagcggcgggacaggacccacggcagcgagatcatcaatgacctgcagggccgcatctgtggcctggaggaggacctgaagaatggcaagatcctgctggccaaggtggagctggagaagaggcagctgcaggagcgcttcacagacctggagaaggagaagagcaacatggagattgacatgacctaccagctgaaggtgatccagcagagcctggagcaggaggaggccgagcacaaggccaccaaggcccggctggccgacaagaacaagatctatgagagcattgaggaggccaagtctgaggccatgaaggagatggagaagaagctgctggaggagaggaccctgaagcagaaggtggagaacctgctgctggaggccgagaagcgctgcagcctgctggactgtgacctgaagcagagccagcagaagatcaatgagctgctgaagcagaaggatgtgctgaatgaagatgtgaggaacctgaccctgaagattgagcaggagacccagaagcgctgcctgacccagaatgacctgaagatgcagacccagcaggtgaacaccctgaagatgtctgagaagcagctgaagcaggagaacaaccacctgatggagatgaagatgaacctggagaagcagaatgctgagctgaggaaggagcggcaggatgctgatggccagatgaaggagctgcaggaccagctggaggccgagcagtacttcagcaccctgtacaagacccaggtgcgggagctgaaggaggagtgtgaggagaagaccaagctgggcaaggagctgcagcagaagaagcaggagctgcaggatgagcgggacagcctggccgcccagctggagatcaccctgaccaaggctgacagcgagcagctggcccggagcattgctgaggagcagtacagcgacctggagaaggagaagatcatgaaggagctggagatcaaggagatgatggcccggcacaagcaggagctgacagagaaggatgccaccatcgccagcctggaggagaccaacagaaccctgaccagtgatgtggccaacctggccaatgagaaggaggagctgaacaacaagctgaaggatgtgcaggagcagctgagccggctgaaggatgaggagatctctgctgctgccatcaaggcccagtttgagaagcagctgctgacagagaggaccctgaagacccaggccgtgaacaagctggccgagatcatgaacaggaaggagcctgtgaagagaggaaatgacacagatgtgcggaggaaggagaaggaaaataggaagctgcacatggagctgaagtctgagcgggagaagctgacccagcagatgatcaagtaccagaaggagctgaatgagatgcaggcccagattgctgaggagagccagatccgcatcgagctgcagatgaccctggacagcaaggacagcgacatcgagcagctgcggagccagctgcaggccctgcacatcggcctggacagcagcagcatcggcagcggccctggagatgctgaggctgatgatggcttccctgagagccggctggagggctggctgagcctgcctgtgaggaacaacaccaagaagtttggctgggtgaagaagtatgtgattgtgagcagcaagaagatcctcttctatgacagcgagcaggacaaggagcagagcaacccctacatggtgctggacatcgacaagctgttccacgtgcggcctgtgacccagacagatgtgtacagagcagatgccaaggagatcccccgcatcttccagatcctgtatgccaatgaaggagagagcaagaaggagcaggagttccctgtggagcctgtgggggagaagagcaactacatctgccacaagggccacgagttcatccccaccctgtaccacttccccaccaactgtgaggcctgcatgaagcccctgtggcacatgttcaagcccccaccagccctggagtgccgccgctgccacatcaagtgccacaaggaccacatggacaagaaggaggagatcatcgccccctgcaaggtgtactatgacatcagcacagccaagaacctgctgctgctggccaacagcacagaggagcagcagaagtgggtgtcccggctggtgaagaagatccccaagaagcccccagccccagacccctttgcccggagcagccccaggacctccatgaagatccagcagaaccagagcatcagaagacccagccggcagctggcccccaacaagcccagctag

SEQ ID NO: 168025 - DNA, 2568 bp, Artificial Sequence
  Description of Artificial Sequence: Synthetic coding sequence
atgtctgaggcccggcgggacagcaccagcagcctgcagaggaagaagccaccctggctgaagctggacatccccagcgctgtgcccctgacagctgaggagcccagcttcctgcagcccctgcggcggcaggccttcctgcggtctgtgtccatgcctgctgagacagcccacatcagcagcccccaccacgagctgcggcggcctgtgctgcagaggcagaccagcatcacccagaccatccggcggggcacagctgactggtttggagtgtccaaggacagcgacagcacccagaagtggcagaggaagagcatccgccactgcagccagagatatggcaagctgaagccccaggtgctgcgggagctggacctgcccagccaggacaacgtgtccctgaccagcacagagaccccaccacccctgtatgtgggcccctgccagctgggcatgcagaagatcatcgaccccctggcccggggccgggccttccgggtggctgatgacacagctgagggcctgagcgccccccacacccctgtgacccctggggccgccagcctgtgcagcttcagcagcagccgcagcggcttccaccggctgcccaggaggaggaagcgggagagcgtggccaagatgtccttccgggctgctgctgccctgatgaagggccgctctgtgagagatggcaccttccggcgggcccagaggaggagcttcaccccagccagcttcctggaggaggacaccacagacttcccagatgagctggacaccagcttctttgcccgggagggcatcctgcacgaggagctgagcacctacccagatgaggtgtttgagagccccagcgaggccgccctgaaggactgggagaaggcccctgagcaggccgacctgaccggcggggccctggacagaagtgagctggagaggagccacctgatgctgcccctggagcggggctggaggaagcagaaggagggcgccgccgccccccagcccaaggtgcggctgcggcaggaggtggtgtccacagctggcccccggcggggccagagaattgctgtgcctgtgaggaagctgtttgcccgggagaagaggccctacggcctgggcatggtgggccgcctgaccaacagaacctacaggaagagaattgacagctttgtgaagaggcagatcgaggacatggatgaccaccggcccttcttcacctactggctgacctttgtgcacagcctggtgaccatcctggccgtgtgcatctatggaattgcccctgtgggcttcagccagcatgaaacagtggacagcgtgctgaggaacagaggagtgtatgaaaatgtgaagtatgtgcagcaggagaacttctggattggccccagcagcgaggccctgatccacctgggcgccaagttcagcccctgcatgaggcaggacccccaggtgcacagcttcatccgcagcgcccgggagcgggagaagcacagcgcctgctgcgtgagaaatgacaggagcggctgtgtgcagaccagcgaggaggagtgcagcagcaccctggccgtgtgggtgaagtggcccatccaccccagcgcccctgagctggccggccacaagaggcagtttggatctgtgtgccaccaggacccccgggtgtgtgatgagcccagcagcgaggacccccatgagtggccagaggacatcaccaagtggcccatctgcaccaagaacagcgctggcaaccacaccaaccacccccacatggactgtgtgatcaccggccggccctgctgcatcggcaccaagggccgctgtgagatcaccagccgggagtactgtgacttcatgaggggctacttccacgaggaggccaccctgtgcagccaggtgcactgcatggatgatgtgtgtggcctgctgcccttcctgaaccctgaggtgcctgaccagttctaccgcctgtggctgagcctcttcctgcacgccggcatcctgcactgcctggtgtccatctgcttccagatgacagtgctgcgggacctggagaagctggccggctggcaccgcatcgccatcatctacctgctgtctggagtgacaggcaacctggccagcgccatcttcctgccctacagagctgaggtgggccctgctggcagccagtttggcatcctggcctgcctgtttgtggagctgttccagagctggcagatcctggcccggccctggagggccttcttcaagctgctggccgtggtgctcttcctgttcaccttcggcctgctgccctggattgacaactttgcccacatcagcggcttcatcagcggcctcttcctgagctttgccttcctgccctacatcagctttgggaagtttgacctgtacaggaagcgctgccagatcatcatcttccaggtggtgttcctgggcctgctggccggcctggtggtgctcttctacgtgtaccctgtgcgctgtgagtggtgtgagttcctgacctgcatccccttcacagacaagttctgtgagaagtatgagctggatgcccagctgcactag

SEQ ID NO: 168026 - DNA, 573 bp, Artificial Sequence
  Description of Artificial Sequence: Synthetic coding sequence
atgtctgaggcccggcgggacagcaccagcagcctgcagaggaagaagccaccctggctgaagctggacatccccagcgctgtgcccctgacagctgaggagcccagcttcctgcagcccctgcggcggcaggccttcctgcggtctgtgtccatgcctgctgagacagcccacatcagcagcccccaccacgagctgcggcggcctgtgctgcagaggcagaccagcatcacccagaccatccgcagcagccggcaggtgcgcttcggccgggtgcacaccctgcccctgctgggcccccgggccgcccggcgggccttcccccagaggcagagcctgtcctggagcctgctgcggggcacagctgactggtttggagtgtccaaggacagcgacagcacccagaagtggcagaggaagagcatccgccactgcagccagagatatggcaagctgaagccccaggtgctgcgggagctggacctgcccagccaggacaacgtgtccctgaccagcacagagaccccaccacccctgtatgtgggcccctgccagctgggcatgcagaagtag

SEQ ID NO: 168027 - DNA, 699 bp, Artificial Sequence
  Description of Artificial Sequence: Synthetic coding sequence
tgaagaccctgctgcatcggcaccaagggccgctgtgagatcaccagccgggagtactgtgacttcatgaggggctacttccacgaggaggccaccctgtgcagccaggtgcactgcatggatgatgtgtgtggcctgctgcccttcctgaaccctgagatgacagtgctgcgggacctggagaagctggccggctggcacagaattgccatcatctacctgctgagcggcgtgactggaaacctggccagcgccatcttcctgccctacagagctgaggtgggccctgctggcagccagtttggcatcctggcctgcctgtttgtggagctgttccagagctggcagatcctggcccggccctggagggccttcttcaagctgctggccgtggtgctcttcctgttcaccttcggcctgctgccctggattgacaactttgcccacatcagcggcttcatcagcggcctcttcctgagctttgccttcctgccctacatcagctttgggaagtttgacctgtacaggaagcgctgccagatcatcatcttccaggtggtgttcctgggcctgctggccggcctggtggtgctcttctacgtgtaccctgtgcgctgtgagtggtgtgagttcctgacctgcatccccttcacagacaagttctgtgagaagtatgagctggatgcccagctgcactag

SEQ ID NO: 168028 - DNA, 492 bp, Artificial Sequence
  Description of Artificial Sequence: Synthetic coding sequence
atgtctgaggcccggcgggacagcaccagcagcctgcagaggaagaagccaccctggctgaagctggacatccccagcgctgtgcccctgacagctgaggagcccagcttcctgcagcccctgcggcggcaggccttcctgcggtctgtgtccatgcctgctgagacagcccacatcagcagcccccaccacgagctgcggcggcctgtgctgcagaggcagaccagcatcacccagaccatccggcggggcacagctgactggtttggagtgtccaaggacagcgacagcacccagaagtggcagaggaagagcatccgccactgcagccagagatatggcaagctgaagccccaggtgctgcgggagctggacctgcccagccaggacaacgtgtccctgaccagcacagagaccccaccacccctgtatgtgggcccctgccagctgggcatgcagaagatcatcgaccccctggcccggggccgctag

SEQ ID NO: 168029 - DNA, 1740 bp, Artificial Sequence
  Description of Artificial Sequence: Synthetic coding sequence
atgtctgaggcccggcgggacagcaccagcagcctgcagaggaagaagccaccctggctgaagctggacatccccagcgctgtgcccctgacagctgaggagcccagcttcctgcagcccctgcggcggcaggccttcctgcggtctgtgtccatgcctgctgagacagcccacatcagcagcccccaccacgagctgcggcggcctgtgctgcagaggcagaccagcatcacccagaccatccggcggggcacagctgactggtttggagtgtccaaggacagcgacagcacccagaagtggcagaggaagagcatccgccactgcagccagagatatggcaagctgaagccccaggtgctgcgggagctggacctgcccagccaggacaacgtgtccctgaccagcacagagaccccaccacccctgtatgtgggcccctgccagctgggcatgcagaagatcatcgaccccctggcccggggccgggccttccgggtggctgatgacacagctgagggcctgagcgccccccacacccctgtgacccctggggccgccagcctgtgcagcttcagcagcagccgcagcggcttccaccggctgcccaggaggaggaagcgggagagcgtggccaagatgtccttccgggctgctgctgccctgatgaagggccgctctgtgagagatggcaccttccggcgggcccagaggaggagcttcaccccagccagcttcctggaggaggacaccacagacttcccagatgagctggacaccagcttctttgcccgggagggcatcctgcacgaggagctgagcacctacccagatgaggtgtttgagagccccagcgaggccgccctgaaggactgggagaaggcccctgagcaggccgacctgaccggcggggccctggacagaagtgagctggagaggagccacctgatgctgcccctggagcggggctggaggaagcagaaggagggcgccgccgccccccagcccaaggtgcggctgcggcaggaggtggtgtccacagctggcccccggcggggccagagaattgctgtgcctgtgaggaagctgtttgcccgggagaagaggccctacggcctgggcatggtgggccgcctgaccaacagaacctacaggaagagaattgacagctttgtgaagaggcagatcgaggacatggatgaccaccggcccttcttcacctactggctgacctttgtgcacagcctggtgaccatcctggccgtgtgcatctatggaattgcccctgtgggcttcagccagcatgaaacagtggacagcgtgctgaggaacagaggagtgtatgaaaatgtgaagtatgtgcagcaggagaacttctggattggccccagctctgtgaggacaggcctgggcgccggccctgctggagctggccctggaggagcccggcggggccaggaggccccagactgtggccgcagcagccccagccctgctgggggcccccaccccccaggccggcaggtgtttgccctgcacgcccctggccctgctggggcccagctgcacagcctgggcgcccgggcccgggaggccctgcggctgctgcgggcccagaggcaggtgggcctgcgggctgacctgggcggcggcgtgctgggcgccttccccaggcctggcctgccccccagcagcgcccgctgcagcctcttccggccccagattgattctgctgagtag

SEQ ID NO: 168030 - DNA, 2571 bp, Artificial Sequence
  Description of Artificial Sequence: Synthetic coding sequence
atggccagcgctgacaagaatggaggctctgtgtcctctgtgagcagcagccggctgcagagcaggaagccacccaacctgagcatcaccatccccccacctgagaaggagacccaggcccctggagagcaggacagcatgctgcctgagggcttccagaacagaaggctgaagaagagccagcccaggacctgggccgcccacaccacagcctgccccccatccttcctgcccaagaggaagaacccagcctacctgaagtctgtgtccctgcaggagcccaggagccgctggcaggagagcagcgagaagaggcctggcttccggcggcaggccagcctgagccagagcatcaggaagggggccgcccagtggtttggagtgtctggggactgggagggccagaggcagcagtggcagaggaggagcctgcaccactgcagcatgagatatggccgcctgaaggccagctgccagagggacctggagctgcccagccaggaggcccccagcttccagggcacagagagccccaagccctgcaagatgcccaagatcgtggaccccctggcccggggccgggccttccgccaccctgaggagatggaccggccccacgccccccacccccccctgaccccaggagtgctgagcctgaccagcttcacctctgtgcgcagcggctacagccacctgcccaggaggaagaggatgtctgtggcccacatgagcctgcaggccgctgctgccctgctgaagggccgctctgtgctggatgccaccggccagcgctgccgggtggtgaagaggagctttgccttccccagcttcctggaggaggatgtggtggatggagctgacacctttgacagcagcttcttcagcaaggaggagatgagctccatgccagatgatgtgtttgagagcccccccctgagcgccagctacttccggggcatcccccacagcgccagccctgtgtccccagatggagtgcagatccccctgaaggagtatggccgggcccctgtgcccggcccccggcggggcaagagaattgccagcaaggtgaagcactttgcctttgacaggaagaagaggcactacggcctgggcgtggtgggcaactggctgaacagaagctacagaagaagcatcagcagcacagtgcagaggcagctggagagctttgacagccaccggccctacttcacctactggctgacctttgtgcacgtgatcatcaccctgctggtgatctgcacctatggaattgcccctgtgggctttgcccagcacgtgaccacccagctggtgctgagaaataaaggagtgtatgagagcgtgaagtacatccagcaggagaacttctgggtgggccccagcagcattgacctgatccacctgggcgccaagttcagcccctgcatcaggaaggatggccagatcgagcagctggtgctgcgggagcgggacctggagcgggacagcggctgctgcgtgcagaatgaccacagcggctgcatccagacccagaggaaggactgcagcgagaccctggccacctttgtgaagtggcaggatgacaccggcccccccatggacaagagtgacctgggccagaagaggaccagcggggctgtgtgccaccaggaccccaggacctgtgaggagcccgccagcagcggggcccacatctggccagatgacatcaccaagtggcccatctgcacagagcaggcccggagcaaccacacaggcttcctgcacatggactgtgagatcaagggccggccctgctgcatcggcaccaagggcagctgtgagatcaccacccgggagtactgtgagttcatgcacggctacttccacgaggaggccaccctgtgcagccaggtgcactgcctggacaaggtgtgtggcctgctgcccttcctgaaccctgaggtgcctgaccagttctaccgcctgtggctgagcctcttcctgcatgctggggtggtgcactgcctggtgtctgtggtgttccagatgaccatcctgcgggacctggagaagctggccggctggcacagaattgccatcatcttcatcctgagcggcatcactggaaacctggccagcgccatcttcctgccctacagagctgaggtgggccctgctggcagccagtttggcctgctggcctgcctgtttgtggagctgttccagagctggcccctgctggagcggccctggaaggccttcctgaacctgagcgccatcgtgctcttcctgttcatctgtggcctgctgccctggattgacaacatcgcccacatcttcggcttcctgagcggcctgctgctggcctttgccttcctgccctacatcaccttcggcaccagtgacaagtacaggaagagggccctgatcctggtgtccctgctggcctttgctggcctgtttgctgccctggtgctgtggctgtacatctaccccatcaactggccctggattgagcacctgacctgcttccccttcaccagccgcttctgtgagaagtatgagctggaccaggtgctgcactag

SEQ ID NO: 168031 - DNA, 2484 bp, Artificial Sequence
  Description of Artificial Sequence: Synthetic coding sequence
atggccagcgctgacaagaatggaggctctgtgtcctctgtgagcagcagccggctgcagagcaggaagccacccaacctgagcatcaccatccccccacctgagaaggagacccaggcccctggagagcaggacagcatgctgcctgagaggaagaacccagcctacctgaagtctgtgtccctgcaggagcccaggagccgctggcaggagagcagcgagaagaggcctggcttccggcggcaggccagcctgagccagagcatcagaaaaggagctgcccagtggtttggagtgtctggggactgggagggccagaggcagcagtggcagaggaggagcctgcaccactgcagcatgagatatggccgcctgaaggccagctgccagagggacctggagctgcccagccaggaggcccccagcttccagggcacagagagccccaagccctgcaagatgcccaagatcgtggaccccctggcccggggccgggccttccgccaccctgaggagatggaccggccccacgccccccacccccccctgaccccaggagtgctgagcctgaccagcttcacctctgtgcgcagcggctacagccacctgcccaggaggaagaggatgtctgtggcccacatgagcctgcaggccgccgccgccctgctgaagggccgctctgtgctggatgccaccggccagcgctgccgggtggtgaagaggagctttgccttccccagcttcctggaggaggatgtggtggatggagctgacacctttgacagcagcttcttcagcaaggaggagatgagctccatgccagatgatgtgtttgagagcccccccctgagcgccagctacttccggggcatcccccacagcgccagccctgtgtccccagatggagtgcagatccccctgaaggagtatggccgggcccctgtgcccggcccccggcggggcaagagaattgccagcaaggtgaagcactttgcctttgacaggaagaagaggcactacggcctgggcgtggtgggcaactggctgaacagaagctaccgccgcagcatcagcagcacagtgcagaggcagctggagagctttgacagccaccggccctacttcacctactggctgacctttgtgcacgtgatcatcaccctgctggtgatctgcacctacggcatcgcccctgtgggctttgcccagcacgtgaccacccagctggtgctgaggaacaagggcgtgtatgaatctgtgaagtacatccagcaggagaacttctgggtgggccccagcagcattgacctgatccacctgggcgccaagttcagcccctgcatcaggaaggatggccagatcgagcagctggtgctgcgggagcgggacctggagcgggacagcggctgctgcgtgcagaatgaccacagcggctgcatccagacccagaggaaggactgcagcgagaccctggccacctttgtgaagtggcaggatgacaccggcccccccatggacaagagtgacctgggccagaagaggaccagcggggctgtgtgccaccaggaccccaggacctgtgaggagcccgccagcagcggggcccacatctggccagatgacatcaccaagtggcccatctgcacagagcaggcccggagcaaccacacaggcttcctgcacatggactgtgagatcaagggccggccctgctgcatcggcaccaagggcagctgtgagatcaccacccgggagtactgtgagttcatgcacggctacttccacgaggaggccaccctgtgcagccaggtgcactgcctggacaaggtgtgtggcctgctgcccttcctgaaccctgaggtgcctgaccagttctaccgcctgtggctgagcctcttcctgcacgccggcgtggtgcactgcctggtgtctgtggtgttccagatgaccatcctgcgggacctggagaagctggccggctggcaccgcatcgccatcatcttcatcctgagcggcatcaccggcaacctggccagcgccatcttcctgccctacagagctgaggtgggccctgctggcagccagtttggcctgctggcctgcctgtttgtggagctgttccagagctggcccctgctggagcggccctggaaggccttcctgaacctgagcgccatcgtgctcttcctgttcatctgtggcctgctgccctggattgacaacatcgcccacatcttcggcttcctgagcggcctgctgctggcctttgccttcctgccctacatcaccttcggcaccagtgacaagtacaggaagagggccctgatcctggtgtccctgctggcctttgctggcctgtttgctgccctggtgctgtggctgtacatctaccccatcaactggccctggattgagcacctgacctgcttccccttcaccagccgcttctgtgagaagtatgagctggaccaggtgctgcactag

SEQ ID NO: 168032 - DNA, 2151 bp, Artificial Sequence
  Description of Artificial Sequence: Synthetic coding sequence
cctggcagcagccgcagccgccaccccctgctgctgctgatctggagcctgggcagcagccagggcccccaccggcagatccggcccccaccaccctgcagacatgctggcacccacgtgcccagccccctgccccacacccaggtgcacagaagacggcaggcctatgcccacctgagcctggtgtgcttcagaagaggagctgcccagtggtttggagtgtctggggactgggagggccagaggcagcagtggcagaggaggagcctgcaccactgcagcatgagatatggccgcctgaaggccagctgccagagggacctggagctgcccagccaggaggcccccagcttccagggcacagagagccccaagccctgcaagatgcccaagatcgtggaccccctggcccggggccgggccttccgccaccctgaggagatggaccggccccacgccccccacccccccctgaccccaggagtgctgagcctgaccagcttcacctctgtgcgcagcggctacagccacctgcccaggaggaagaggatgtctgtggcccacatgagcctgcaggccgctgctgccctgctgaagggccgctctgtgctggatgccaccggccagcgctgccgggtggtgaagaggagctttgccttccccagcttcctggaggaggatgtggtggatggagctgacacctttgacagcagcttcttcagcaaggaggagatgagctccatgccagatgatgtgtttgagagcccccccctgagcgccagctacttccggggcatcccccacagcgccagccctgtgtccccagatggagtgcagatccccctgaaggagtatggccgggcccctgtgcccggcccccggcggggcaagagaattgccagcaaggtgaagcactttgcctttgacaggaagaagaggcactacggcctgggcgtggtgggcaactggctgaacagaagctacagaagaagcatcagcagcacagtgcagaggcagctggagagctttgacagccaccggccctacttcacctactggctgacctttgtgcacgtgatcatcaccctgctggtgatctgcacctatggaattgcccctgtgggctttgcccagcacgtgaccacccagctggtgctgagaaataaaggagtgtatgagagcgtgaagtacatccagcaggagaacttctgggtgggccccagcagcattgacctgatccacctgggcgccaagttcagcccctgcatcaggaaggatggccagatcgagcagctggtgctgcgggagcgggacctggagcgggacagcggctgctgcgtgcagaatgaccacagcggctgcatccagacccagaggaaggactgcagcgagaccctggccacctttgtgaagtggcaggatgacaccggcccccccatggacaagagtgacctgggccagaagaggaccagcggggctgtgtgccaccaggaccccaggacctgtgaggagcccgccagcagcggggcccacatctggccagatgacatcaccaagtggcccatctgcacagagcaggcccggagcaaccacacaggcttcctgcacatggactgtgagatcaagggccggccctgctgcatcggcaccaagggcagctgtgagatcaccacccgggagtactgtgagttcatgcacggctacttccacgaggaggccaccctgtgcagccaggtgcactgcctggacaaggtgtgtggcctgctgcccttcctgaaccctgaggtgcctgaccagttctaccgcctgtggctgagcctcttcctgcatgctggggtggtgcactgcctggtgtctgtggtgttccagatgaccatcctgcgggacctggagaagctggccggctggcacagaattgccatcatcttcatcctgagcggcatcactggaaacctggccagcgccatcttcctgccctacagagctgaggtgaggatgtggaggatgggccccctgccccacatcggcggccagccctgctgcagctacagcacccacctgggcagcgcccggggcacccgctgccccagctgcaccggcctgcacagcggcggcacagccaacctgggcgcctactggctggtgtcctag

SEQ ID NO: 168033 - DNA, 639 bp, Artificial Sequence
  Description of Artificial Sequence: Synthetic coding sequence
atggcccagacagacaagcccacctgcatccccccagagctgcccaagatgctgaaggagtttgccaaggccgccatccgggtgcagccccaggacctgatccagtgggccgctgactactttgaggccctgagcagaggagagaccccacctgtgcgggagaggtctgagcgggtggccctgtgcaacagagctgagctgaccccagagctgctgaagatcctgcacagccaggtggccggccgcctcatcatccgggcagaggagctggcccagatgtggaaggtggtgaacctgcccacagacctcttcaacagcgtgatgaatgtgggccgcttcacagaggagattgagtggctgaagttcctggccctggcctgcagcgccctgggcgtgaccatcaccaagaccctgaagatcgtgtgtgaggtgctgagctgtgaccacaacggcggcagcccccgcatccccttcagcaccttccagttcctgtacacctacatcgccaaggtggatggagagatcagcgccagccacgtgtccaggatgctgaactacatggagcaggaggtgattggaccagatggcatcatcaccgtgaatgacttcacccagaacccccgggtgcagctggagtag

SEQ ID NO: 168034 - DNA, 639 bp, Artificial Sequence; identical to SEQ ID NO: 168033
  Description of Artificial Sequence: Synthetic coding sequence

SEQ ID NO: 168035 - DNA, 351 bp, Artificial Sequence
  Description of Artificial Sequence: Synthetic coding sequence
atggcccagacagacaagcccacctgcatccccccagagctgcccaagatgctgaaggagtttgccaaggccgccatccgggtgcagccccaggacctgatccagtgggccgctgactactttgaggccctgagcagaggagagaccccacctgtgcgggagaggtctgagcgggtggccctgtgcaacagagctgagctgaccccagagctgctgaagatcctgcacagccaggtggccggccgcctcatcatccgggcagaggagctggcccagatgtggaaggtggtgaacctgcccacagacctcttcaacagcgtgatgaatgtgggccgcttcacagaggagtag

SEQ ID NO: 168036 - DNA, 393 bp, Artificial Sequence
  Description of Artificial Sequence: Synthetic coding sequence
atggcccagacagacaagcccacctgcatccccccagagctgcccaagatgctgaaggagtttgccaaggccgccatccgggtgcagccccaggacctgatccagtgggccgctgactactttgaggccctgagcagaggagagaccccacctgtgcgggagaggtctgagcgggtggccctgtgcaacagagctgagctgaccccagagctgctgaagatcctgcacagccaggtggccggccgcctcatcatccgggcagaggagctggcccagatgtggaaggtggtgaacctgcccacagacctcttcaacagcgtgatgaatgtgggccgcttcacagaggagattgagtggctgaagttcctggccctggcctgcagcgccctgtag

SEQ ID NO: 168037 - DNA, 312 bp, Artificial Sequence
  Description of Artificial Sequence: Synthetic coding sequence
atggcccagacagacaagcccacctgcatccccccagagctgcccaagatgctgaaggagtttgccaaggccgccatccgggtgcagccccaggacctgatccagtgggccgctgactactttgaggccctgagcagaggagagaccccacctgtgcgggagaggtctgagcgggtggccctgtgcaacagagctgagctgaccccagagctgctgaagatcctgcacagccaggtggccggccgcctcatcatccgggcagaggagctggcccagatgtggaaggtggtgaacctgcccacagacctgtag

SEQ ID NO: 168038 - DNA, 234 bp, Artificial Sequence
  Description of Artificial Sequence: Synthetic coding sequence
atggcccagacagacaagcccacctgcatccccccagagctgcccaagatgctgaaggagtttgccaaggccgccatccgggtgcagccccaggacctgatccagtgggccgctgactactttgaggccctgagcagaggagagaccccacctgtgcgggagaggtctgagcgggtggccctgtgcaacagagctgagctgaccccagagctgctgaagatcctgcacagctag

SEQ ID NO: 168039 - DNA, 693 bp, Artificial Sequence
  Description of Artificial Sequence: Synthetic coding sequence
atgcccctgcctgacaccatgttctgtgcccagcagatccacatccccccagagctgcctgacatcctgaagcagttcaccaaggccgccatccgcacccagcctgcagatgtgctgcgctggagcgctggctacttcagcgccctgagcagaggagaccccctgcctgtgaaggacaggatggagatgcccacagccacccagaagacagacaccggcctgacccagggcctgctgaaggtgctgcacaagcagtgccaccacaagagatatgtggagctgacagacctggagcagaagtggaagaacctgtgcctgcccaaggagaagttcaaggccctgctgcagctggacccctgtgagaacaagatcaagtggatcaacttcctggccctgggctgcagcatgctgggcggcagcctgaacacagccctgaagcacctgtgtgagatcctgacagatgatcctgagggcggccctgcccgcatccccttcaagaccttctcctatgtgtaccgctacctggcccggctggacagtgatgtgagccccctggagacagagagctacctggccagcctgaaggagaacattgatgccaggaagaatggcatgattggcctgagtgacttcttcttccccaagaggaagctgctggagagcattgaaaattctgaagatgtgggccactag

SEQ ID NO: 168040 - DNA, 693 bp, Artificial Sequence; identical to SEQ ID NO: 168039
  Description of Artificial Sequence: Synthetic coding sequence

SEQ ID NO: 168041 - DNA, 2091 bp, Artificial Sequence
  Description of Artificial Sequence: Synthetic coding sequence
atggatgctgacatggactatgagcggcccaacgtggagaccatcaagtgtgtggtggtgggggacaatgctgtgggcaagaccaggctcatctgtgcccgggcctgcaacaccaccctgacccagtaccagctgctggccacccacgtgcccaccgtgtgggccatcgaccagtacagagtgtgccaggaggtgctggagaggagcagagatgtggtggatgaggtgtctgtgtccctgcggctgtgggacaccttcggggaccaccacaaggacagaagatttgcctacggccgcagtgatgtggtggtgctgtgcttcagcatcgccaaccccaacagcctgaaccacgtgaagtccatgtggtacccagagatcaagcacttctgccccaggacccctgtgatcctggtgggctgccagctggacctgcgctatgctgacctggaggccgtgaacagagcccggcggcccctggcccggcccatcaagagaggagacatcctgcccccagagaagggccgggaggtggccaaggagctgggcctgccctactatgagacctctgtgtttgaccagtttggcatcaaggatgtgtttgacaatgccatccgggccgccctgatcagcagaagacacctgcagttctggaagagccacctgaagaaggtgcagaagcccctgctgcaggcccccttcctgccccccaaggcccctcctcctgtgatcaagatcccagaatgtcccagcatgggcaccaatgaggccgcctgcctgctggacaaccccctgtgtgctgatgtgctcttcatcctgcaggaccaggagcacatctttgcccaccgcatctacctggccaccagcagcagcaagttctatgacctcttcctgatggagtgtgaggagagccccaatggaagtgaaggagcctgtgagaaggagaagcagagccgggacttccagggccgcatcctgtctgtggaccctgaggaggagcgggaggagggccccccacgcatcccccaggccgaccagtggaagagcagcaacaagagcctggtggaggccctgggcctggaggccgagggcgctgtgcctgagacccagaccctgaccggctggagcaagggcttcatcggcatgcaccgggagatgcaggtgaaccccatcagcaagaggatgggccccatgacagtggtgaggatggatgcctctgtgcagcccggccccttccgcaccctgctgcagttcctgtacacaggccagctggatgagaaggagaaggacctggtgggcctggcccagattgctgaggtgctggagatgtttgacctgaggatgatggtggagaacatcatgaacaaggaggccttcatgaaccaggagatcaccaaggccttccacgtgaggaaggccaaccgcatcaaggaatgtctgagcaagggcaccttcagtgatgtgaccttcaagctggatgatggagccatcagcgcccacaagcccctgctgatctgcagctgtgagtggatggccgccatgtttggaggcagctttgtggagagcgccaacagcgaggtgtacctgcccaacatcaacaagatctccatgcaggccgtgctggactacctgtacaccaagcagctgagccccaacctggacctggaccccctggagctgattgccctggccaaccgcttctgcctgccccacctggtggccctggccgagcagcacgctgtgcaggagctgaccaaggccgccaccagcggcgtgggcattgatggagaggtgctgagctacctggagctggcccagttccacaatgcccaccagctggccgcctggtgcctgcaccacatctgcaccaactacaacagcgtgtgcagcaagttcaggaaggagatcaagagcaagtctgctgacaaccaggagtactttgagcggcaccgctggccccctgtgtggtacctgaaggaggaggaccactaccagagggtgaagcgggagcgggagaaggaggacatcgccctgaacaagcacaggagcaggaggaagtggtgcttctggaacagcagccctgctgtggcctag

SEQ ID NO: 168042 - DNA, 2091 bp, Artificial Sequence; identical to SEQ ID NO: 168041
  Description of Artificial Sequence: Synthetic coding sequence

SEQ ID NO: 168043 - DNA, 300 bp, Artificial Sequence
  Description of Artificial Sequence: Synthetic coding sequence
atggatgctgacatggactatgagcggcccaacgtggagaccatcaagtgtgtggtggtgggggacaatgctgtgggcaagaccaggctcatctgtgcccgggcctgcaacaccaccctgacccagtaccagctgctggccacccacgtgcccaccgtgtgggccatcgaccagtacagagtgtgccaggaggtgctggagaggagcagagatgtggtggatgaggtgtctgtgtccctgcggctgtgggacaccttcggggaccaccacaaggacagaagatttgcctatggaagatag

SEQ ID NO: 168044 - DNA, 2184 bp, Artificial Sequence
  Description of Artificial Sequence: Synthetic coding sequence
atggacagcgacatggactatgagcggcccaacgtggagaccatcaagtgtgtggtggtgggggacaatgctgtgggcaagaccaggctcatctgtgcccgggcctgcaatgccaccctgacccagtaccagctgctggccacccacgtgcccaccgtgtgggccatcgaccagtacagagtgtgccaggaggtgctggagaggagcagagatgtggtggatgatgtgtctgtgtccctgcggctgtgggacaccttcggggaccaccacaaggacagaagatttgcctacggccgcagtgatgtggtggtgctgtgcttcagcatcgccaaccccaacagcctgcaccacgtgaagaccatgtggtacccagagatcaagcacttctgcccccgggcccctgtgatcctggtgggctgccagctggacctgcgctatgctgacctggaggccgtgaacagagcccggcggcccctggcccggcccatcaagcccaatgagatcctgcccccagagaagggccgggaggtggccaaggagctgggcatcccctactatgagacctctgtggtggcccagtttggcatcaaggatgtgtttgacaatgccatccgggccgccctgatcagcagaagacacctgcagttctggaagagccacctgagaaatgtgcagaggcccctgctgcaggcccccttcctgccccccaagcccccaccacccatcatcgtggtgcctgacccccccagcagcagcgaggagtgcccagcccacctgctggaggaccccctgtgtgctgatgtgatcctggtgctgcaggagcgggtgcgcatctttgcccacaagatctacctgagcaccagcagcagcaagttctatgacctcttcctgatggacctgtctgagggggagctgggcggccccagcgagcccggcggcacccaccctgaggaccaccagggccacagcgaccagcaccaccaccaccaccaccaccaccacggccgggacttcctgctgcgggccgccagctttgatgtgtgtgagagcgtggatgaggccggcggcagcggccctgctggcctgcgggccagcaccagtgatggcatcctgcggggaaatggcaccggctacctgcccggccggggccgggtgctgagctcctggagccgggcctttgtgtccatccaggaggagatggccgaggaccccctgacctacaagagccggctgatggtggtggtgaagatggacagcagcatccagcccggccccttccgggctgtgctgaagtacctgtacacaggagagctggatgaaaatgaaagagacctgatgcacatcgcccacatcgccgagctgctggaggtgtttgacctgaggatgatggtggccaacatcctgaacaatgaggccttcatgaaccaggagatcaccaaggccttccacgtgcggaggaccaacagagtgaaggagtgcctggccaagggcaccttcagtgatgtgaccttcatcctggatgatggcaccatcagcgcccacaagcccctgctgatcagcagctgtgactggatggccgccatgtttggaggcccctttgtggagagcagcacccgggaggtggtgttcccctacaccagcaagagctgcatgagagctgtgctggagtacctgtacacaggcatgttcaccagcagcccagacctggatgacatgaagctgatcatcctggccaaccggctgtgcctgccccacctggtggccctgacagagcagtacacagtgacaggcctgatggaggccacccagatgatggtggacattgatggagatgtgctggtgttcctggagctggcccagttccactgtgcctaccagctggccgactggtgcctgcaccacatctgcaccaactacaacaacgtgtgcaggaagttcccccgggacatgaaggccatgagccctgagaaccaggagtactttgagaagcaccgctggccccctgtgtggtacctgaaggaggaggaccactaccagagggccaggaaggagcgggagaaggaggactacctgcacctgaagaggcagcccaagaggcgctggctgttctggaacagccccagcagccccagcagcagcgctgccagcagcagcagccccagcagcagcagcgctgtggtgtag

SEQ ID NO: 168045 - DNA, 2250 bp, Artificial Sequence
  Description of Artificial Sequence: Synthetic coding sequence
atgcaggcctggaggaagggcccagatggcccccagaagaccagcagtgacagcatgagccggctgatggacagcgacatggactatgagcggcccaacgtggagaccatcaagtgtgtggtggtgggggacaatgctgtgggcaagaccaggctcatctgtgcccgggcctgcaatgccaccctgacccagtaccagctgctggccacccacgtgcccaccgtgtgggccatcgaccagtacagagtgtgccaggaggtgctggagaggagcagagatgtggtggatgatgtgtctgtgtccctgcggctgtgggacaccttcggggaccaccacaaggacagaagatttgcctacggccgcagtgatgtggtggtgctgtgcttcagcatcgccaaccccaacagcctgcaccacgtgaagaccatgtggtacccagagatcaagcacttctgcccccgggcccctgtgatcctggtgggctgccagctggacctgcgctatgctgacctggaggccgtgaacagagcccggcggcccctggcccggcccatcaagcccaatgagatcctgcccccagagaagggccgggaggtggccaaggagctgggcatcccctactatgagacctctgtggtggcccagtttggcatcaaggatgtgtttgacaatgccatccgggccgccctgatcagcagaagacacctgcagttctggaagagccacctgagaaatgtgcagaggcccctgctgcaggcccccttcctgccccccaagcccccaccacccatcatcgtggtgcctgacccccccagcagcagcgaggagtgcccagcccacctgctggaggaccccctgtgtgctgatgtgatcctggtgctgcaggagcgggtgcgcatctttgcccacaagatctacctgagcaccagcagcagcaagttctatgacctcttcctgatggacctgtctgagggggagctgggcggccccagcgagcccggcggcacccaccctgaggaccaccagggccacagcgaccagcaccaccaccaccaccaccaccaccacggccgggacttcctgctgcgggccgccagctttgatgtgtgtgagagcgtggatgaggccggcggcagcggccctgctggcctgcgggccagcaccagtgatggcatcctgcggggaaatggcaccggctacctgcccggccggggccgggtgctgagctcctggagccgggcctttgtgtccatccaggaggagatggccgaggaccccctgacctacaagagccggctgatggtggtggtgaagatggacagcagcatccagcccggccccttccgggctgtgctgaagtacctgtacacaggagagctggatgaaaatgaaagagacctgatgcacatcgcccacatcgccgagctgctggaggtgtttgacctgaggatgatggtggccaacatcctgaacaatgaggccttcatgaaccaggagatcaccaaggccttccacgtgcggaggaccaacagagtgaaggagtgcctggccaagggcaccttcagtgatgtgaccttcatcctggatgatggcaccatcagcgcccacaagcccctgctgatcagcagctgtgactggatggccgccatgtttggaggcccctttgtggagagcagcacccgggaggtggtgttcccctacaccagcaagagctgcatgagagctgtgctggagtacctgtacacaggcatgttcaccagcagcccagacctggatgacatgaagctgatcatcctggccaaccggctgtgcctgccccacctggtggccctgacagagcagtacacagtgacaggcctgatggaggccacccagatgatggtggacattgatggagatgtgctggtgttcctggagctggcccagttccactgtgcctaccagctggccgactggtgcctgcaccacatctgcaccaactacaacaacgtgtgcaggaagttcccccgggacatgaaggccatgagccctgagaaccaggagtactttgagaagcaccgctggccccctgtgtggtacctgaaggaggaggaccactaccagagggccaggaaggagcgggagaaggaggactacctgcacctgaagaggcagcccaagaggcgctggctgttctggaacagccccagcagccccagcagcagcgctgccagcagcagcagccccagcagcagcagcgctgtggtgtag

SEQ ID NO: 168046 - DNA, 2205 bp, Artificial Sequence
  Description of Artificial Sequence: Synthetic coding sequence
atgaaggcccggagccggctgatggacagcgacatggactatgaaagacccaacgtggagaccatcaagtgtgtggtggtgggggacaatgctgtgggcaagaccaggctcatctgtgcccgggcctgcaatgccaccctgacccagtaccagctgctggccacccacgtgcccaccgtgtgggccatcgaccagtacagagtgtgccaggaggtgctggagaggagcagagatgtggtggatgatgtgtctgtgtccctgcggctgtgggacacctttggagaccaccacaaggacagaagatttgcctacggccgcagtgatgtggtggtgctgtgcttcagcatcgccaaccccaacagcctgcaccacgtgaagaccatgtggtacccagagatcaagcacttctgcccccgggcccctgtgatcctggtgggctgccagctggacctgcgctatgctgacctggaggccgtgaacagagcccggcggcccctggcccggcccatcaagcccaatgagatcctgcccccagagaagggccgggaggtggccaaggagctgggcatcccctactatgagacctctgtggtggcccagtttggcatcaaggatgtgtttgacaatgccatccgggccgccctgatcagccgccgccacctgcagttctggaagagccacctgagaaatgtgcagaggcccctgctgcaggcccccttcctgccccccaagcccccaccacccatcatcgtggtgcctgacccccccagcagcagtgaagaatgtcctgcccacctgctggaggaccccctgtgtgctgatgtgatcctggtgctgcaggagcgggtgcgcatctttgcccacaagatctacctgagcaccagcagcagcaagttctatgacctcttcctgatggacctgtctgagggggagctgggcggccccagcgagcccggcggcacccaccctgaggaccaccagggccacagcgaccagcaccaccaccaccaccaccaccaccacggccgggacttcctgctgcgggccgccagctttgatgtgtgtgagagcgtggatgaagctgggggcagcggccctgctggcctgcgggccagcaccagtgatggcatcctgcggggaaatggaacaggctacctgcccggccggggccgggtgctgagctcctggagccgggcctttgtgtccatccaggaggagatggccgaggaccccctgacctacaagagccggctgatggtggtggtgaagatggacagcagcatccagcccggccccttccgggctgtgctgaagtacctgtacaccggggagctggatgaaaatgaaagagacctgatgcacatcgcccacatcgccgagctgctggaggtgtttgacctgaggatgatggtggccaacatcctgaacaatgaggccttcatgaaccaggagatcaccaaggccttccacgtgcggaggaccaacagagtgaaggaatgtctggccaagggcaccttcagtgatgtgaccttcatcctggatgatggcaccatcagcgcccacaagcccctgctgatcagcagctgtgactggatggccgccatgtttggaggcccctttgtggagagcagcacccgggaggtggtgttcccctacaccagcaagagctgcatgagagctgtgctggagtacctgtacacaggcatgttcaccagcagcccagacctggatgacatgaagctgatcatcctggccaaccggctgtgcctgccccacctggtggccctgacagagcagtacacagtgacaggcctgatggaggccacccagatgatggtggacattgatggagatgtgctggtgttcctggagctggcccagttccactgtgcctaccagctggccgactggtgcctgcaccacatctgcaccaactacaacaacgtgtgcaggaagttcccccgggacatgaaggccatgagccctgagaaccaggagtactttgagaagcaccgctggccccctgtgtggtacctgaaggaggaggaccactaccagagggccaggaaggagcgggagaaggaggactacctgcacctgaagaggcagcccaagaggcgctggctgttctggaacagccccagcagccccagcagcagcgctgccagcagcagcagccccagcagcagcagcgctgtggtgtag

SEQ ID NO: 168047 - DNA, 1836 bp, Artificial Sequence
  Description of Artificial Sequence: Synthetic coding sequence
atgagcatccacatcgtggccctgggcaatgaaggagacaccttccaccaggacaaccggcccagcggcctcatccgcacctacctgggccgcagccccctggtgtctggagatgagagcagcctgctgctgaatgctgccagcacagtggcccggcctgtgttcacagagtaccaggccagcgcctttggaaatgtgaagctggtggtgcatgactgccctgtgtgggacatctttgacagcgactggtacaccagcaggaacctgattggaggagctgacatcatcgtcatcaagtacaacgtgaatgacaagttctccttccacgaggtgaaggacaactacatccctgtgatcaagagggccctgaacagcgtgcctgtgatcatcgctgctgtgggcacccggcagaatgaggagctgccctgcacctgccccctgtgcaccagtgaccggggcagctgtgtgtccaccacagagggcatccagctggccaaggagctgggcgccacctacctggagctgcacagcctggatgacttctacatcggcaagtactttggaggagtgctggagtacttcatgatccaggccctgaaccagaagaccagcgagaagatgaagaagaggaagatgagcaacagcttccacggcatccggcccccccagctggagcagcctgagaagatgcctgtgctgaaggccgaggccagccactacaacagcgacctgaacaacctgctcttctgctgccagtgtgtggatgtggtgttctacaaccccaacctgaagaaggtggtggaggcccacaagatcgtgctgtgtgctgtgagccacgtgttcatgctgctcttcaacgtgaagagccccacagacatccaggacagcagcatcatccgcaccacccaggacctgtttgccatcaacagagacacagccttccctggggccagccatgagagcagcggcaacccccccctgcgggtcatcgtgaaggatgccctcttctgcagctgcctgagtgacatcctgcgcttcatctacagcggggccttccagtgggaggagctggaggaggacatcaggaagaagctgaaggacagcggagatgtgtccaatgtgattgagaaggtgaagtgcatcctgaagaccccaggcaagatcaactgcctgaggaactgcaagacctaccaggccaggaagcccctgtggttctacaacaccagcctgaagttcttcctgaacaagcccatgctggctgatgtggtgtttgagatccagggcaccaccgtgcctgcccaccgggccatcctggtggcccgctgtgaggtgatggccgccatgttcaacggcaactacatggaggccaagtctgtgctgatccctgtgtatggagtgtccaaggagaccttcctgtccttcctggagtacctgtacacagacagctgctgcccagctggcatcttccaggccatgtgcctgctgatctgtgccgagatgtaccaggtgtcccggctgcagcacatctgtgagctgttcatcatcacccagctgcagagcatgcccagccgggagctggcctccatgaacctggacatcgtggacctgctgaagaaggccaagttccaccacagcgactgcctgagcacctggctgctgcacttcatcgccaccaactacctgatcttcagccagaagccagagttccaggacctgtctgtggaggagaggagctttgtggagaagcaccgctggcccagcaacatgtacctgaagcagctggccgagtacaggaagtacatccacagcaggaaatgtcgctgcctggtgatgtag

SEQ ID NO: 168048 - DNA, 354 bp, Artificial Sequence
  Description of Artificial Sequence: Synthetic coding sequence
tgagaaatgtaccaggtgtcccggctgcagcacatctgtgagctgttcatcatcacccagctgcagagcatgcccagccgggagctggcctccatgaacctggacatcgtggacctgctgaagaaggccaagttccaccacagcgactgcctgagcacctggctgctgcacttcatcgccaccaactacctgatcttcagccagaagccagagttccaggacctgtctgtggaggagaggagctttgtggagaagcaccgctggcccagcaacatgtacctgaagcagctggccgagtacaggaagtacatccacagcaggaagtgccgctgcctggtgatcaagaggcactag

SEQ ID NO: 168049 - DNA, 1692 bp, Artificial Sequence
  Description of Artificial Sequence: Synthetic coding sequence
atgttcagcaggaaccacaggagccgggtgacagtggcccggggcagcgccctggagatggagttcaagaggggccgcttccggctgagcctcttcagtgacctgcctgaggacacagagctgcagaggaagctggaccacgagatccgcatgagggagggcgcctgcaagctgctggccgcctgcagccagcgggagcaggccctggaggccaccaagagcctgctggtgtgcaacagccgcatcctgagctacatgggagagctgcagaggaggaaggaggcccaggtgctgggcaagaccagcagaagacccagcgacagcggccccccagctgagaggagcccctgccggggccgggtgtgcatcagtgacctgcgcatccccctgatgtggaaggacacagagtacttcaagaacaagggggacctgcaccgctgggccgtgttcctgctgctgcagctgggggagcacatccaggacacagagatgatcctggtggacaggaccctgacagacatctccttccagagcaatgtgctgtttgctgaggccggccctgactttgagctgcggctggagctgtatggagcctgtgtggaggaggagggcgccctgactggaggccccaagaggctggccaccaagctgagcagcagcctgggccgcagcagtggaagaagagtgcgggccagcctggacagcgctgggggcagcggcagcagccccatcctgctgcccacccctgtggtgggcggcccccgctaccacctgctggcccacaccaccctgaccctggccgctgtgcaggacggcttccgcacccatgacctgaccctggccagccatgaagaaaatcctgcctggctgcccctgtatggctctgtgtgctgccgcctggccgcccagcccctgtgcatgacccagcccacagccagcggcaccctgcgggtgcagcaggccggggagatgcagaactgggcccaggtgcatggagtgctgaagggcaccaacctcttctgctaccggcagccagaagatgctgacaccggggaggagcccctgctgaccatcgctgtgaacaaggagaccagggtgcgggccggggagctggaccaggccctgggccggcccttcaccctgagcatcagcaaccagtatggagatgatgaggtgacccacaccctgcagacagagagccgggaggccctgcagagctggatggaggccctgtggcagctgttctttgacatgagccagtggaagcagtgctgtgatgagatcatgaagattgagaccccagcccccaggaagccaccccaggccctggccaagcagggcagcctgtaccacgagatggccatcgagcccctggatgacattgctgctgtgacagacatcctgacccagcgggagggcgcccggctggagaccccaccaccctggctggccatgttcacagaccagcctgccctgcccaacccctgcagccctgcctctgtggccccagccccagactggacccaccccctgccctggggccggcccaggaccttcagcctggatgctgtgcccccagaccacagcccccgggcccggtctgtggcccccctgcccccccagaggagccccaggacccggggcctgtgcagcaagggccagcccaggacctggctgcagagccctgtgtag

SEQ ID NO: 168050 - DNA, 1653 bp, Artificial Sequence
  Description of Artificial Sequence: Synthetic coding sequence
atgcaggaccggctgcacatcctggaggacctgaacatgctgtacatccggcagatggccctgagcctggaggacacagagctgcagaggaagctggaccacgagatccgcatgagggagggcgcctgcaagctgctggccgcctgcagccagcgggagcaggccctggaggccaccaagagcctgctggtgtgcaacagccgcatcctgagctacatgggagagctgcagaggaggaaggaggcccaggtgctgggcaagaccagccggcggcccagcgacagcggccccccagctgagaggagcccctgccggggccgggtgtgcatcagtgacctgcgcatccccctgatgtggaaggacacagagtacttcaagaacaagggggacctgcaccgctgggccgtgttcctgctgctgcagctgggggagcacatccaggacacagagatgatcctggtggacaggaccctgacagacatctccttccagagcaatgtgctgtttgctgaggccggccctgactttgagctgcggctggagctgtatggagcctgtgtggaggaggagggcgccctgaccggcggccccaagaggctggccaccaagctgagcagcagcctgggccgcagcagcggccggcgggtgcgggccagcctggacagcgctgggggcagcggcagcagccccatcctgctgcccacccctgtggtgggcggcccccgctaccacctgctggcccacaccaccctgaccctggccgctgtgcaggacggcttccgcacccatgacctgaccctggccagccatgaggagaacccagcctggctgcccctgtatggctctgtgtgctgccgcctggccgcccagcccctgtgcatgacccagcccacagccagcggcaccctgcgggtgcagcaggccggggagatgcagaactgggcccaggtgcacggcgtgctgaagggcaccaacctcttctgctaccggcagccagaagatgctgacacaggagaggagcccctgctgaccatcgctgtgaacaaggagaccagggtgcgggccggggagctggaccaggccctgggccggcccttcaccctgagcatcagcaaccagtatggagatgatgaggtgacccacaccctgcagacagagagccgggaggccctgcagagctggatggaggccctgtggcagctgttctttgacatgagccagtggaagcagtgctgtgatgagatcatgaagattgagaccccagcccccaggaagccaccccaggccctggccaagcagggcagcctgtaccacgagatggccatcgagcccctggatgacattgctgctgtgacagacatcctgacccagcgggagggcgcccggctggagaccccaccaccctggctggccatgttcacagaccagcctgccctgcccaacccctgcagccctgcctctgtggccccagccccagactggacccaccccctgccctggggccggcccaggaccttcagcctggatgctgtgcccccagaccacagcccccgggcccggtctgtggcccccctgcccccccagaggagccccaggacccggggcctgtgcagcaagggccagcccaggacctggctgcagagccctgtgtag

SEQ ID NO: 168051 - DNA, 4635 bp, Artificial Sequence
  Description of Artificial Sequence: Synthetic coding sequence
atggattctggccctgtgtaccacggggacagccggcagctgagcgccagcggcgtgcctgtgaatggagcccgggagcccgccggccccagcctgctgggcactggaggcccctggagggtggaccagaagccagactgggaggccgcccctggccctgcccacacagcccggctggaggatgcccatgacctggtggccttctctgctgtggccgaggccgtgtcctcctatggagccctgagcacccggctgtatgagaccttcaaccgggagatgagccgggaggccggcaacaacagccggggcccccggcccggccctgagggctgcagcgctggcagcgaggacctggacaccctgcagacagccctggccctggcccggcacggcatgaagccacccaactgcaactgtgatggcccagaatgtcctgactacctggagtggctggagggcaagatcaagtctgtggtgatggagggcggggaggagcggccccggctgcccggccccctgcccccaggagaggccggcctgcctgcccccagcacccggcccctgctgagcagcgaggtgccccagatcagcccccaggagggcctgcccctgagccagagcgccctgagcatcgccaaggagaagaacatcagcctgcagacagccatcgccatcgaggccctgacccagctgagcagcgccctgccccagcccagccacagcaccccccaggccagctgccccctgcctgaggccctgagccccccagcccccttccgcagcccccagagctacctgcgggcccccagctggcctgtggtgcccccagaggagcacagcagctttgccccagacagcagcgccttccccccagccacccccaggacagagttccctgaggcctggggcacagacaccccaccagccacccccaggagctcctggcccatgccccggcccagcccagaccccatggccgagctggagcagctgctgggcagcgccagtgactacatccagagcgtcttcaagaggcctgaggccctgcccaccaagcccaaggtgaaggtggaggcccccagcagcagccctgccccagcccccagccctgtgctgcagcgggaggcccccacccccagcagcgagccagacacccaccagaaggcccagacagccctgcagcagcacctgcaccacaagaggagcctcttcctggagcaggtgcatgacaccagcttccctgcccccagcgagcccagcgcccctggctggtggcccccacccagcagccctgtgccccggctgcctgacaggcctcccaaggagaagaagaagaagctgcccaccccagctgggggccctgtgggcacagagaaggccgcccctggcatcaagcccagcgtgaggaagcccatccagatcaagaagagccggccccgggaggcccagcccctcttcccccctgtgcggcagatcgtgctggagggcctgcggagccctgccagccaggaggtgcaggcccaccccccagcccccctgcctgccagccagggcagcgctgtgcccctgcccccagagcccagcctggccctgtttgcccccagccccagccgggacagcctgctgccccccacccaggagatgaggagccccagccccatgacagccctgcagcccggcagcacaggccccctgcccccagcagatgacaagctggaggagctgatccggcagtttgaagctgagtttggagacagctttggcctgcccggcccccccagcgtgcccatccaggaccctgagaaccagcagacctgcctgcctgcccctgagagcccctttgccaccaggagccccaagcagatcaagattgagagcagtggagctgtgacagtgctgagcaccacctgcttccacagcgaggagggcggccaggaggccacccccaccaaggccgagaaccccctgacccccaccctgagcggcttcctggagagccccctgaagtacctggacacccccaccaagagcctgctggacaccccagccaagagggcccaggccgagttccccacctgtgactgtgtggagcagatcgtggagaaggatgagggcccctactacacccacctgggcagcggccccaccgtggccagcatccgggagctgatggaggagcgctacggggagaagggcaaggccatcagaattgagaaggtgatctacacaggcaaggagggcaagagcagccggggctgccccatcgccaagtgggtgatcagaagacacaccctggaggagaagctgctgtgcctggtgcgccacagagctggccaccactgccagaatgctgtgattgtcatcctgatcctggcctgggagggcatccccaggagcctgggggacaccctgtaccaggagctgacagacaccctgaggaaatatggcaaccccaccagcagaagatgtggcctgaatgatgacaggacctgtgcctgccagggcaaggaccccaacacctgtggggccagcttctcctttggctgctcctggagcatgtacttcaacggctgcaagtatgcccggagcaagacccccaggaagttccggctggccggggacaaccccaaggaggaggaggtgctgaggaagagcttccaggacctggccacagaggtggcccccctgtacaagaggctggccccccaggcctaccagaaccaggtgaccaatgaggagatcgccatcgactgccgcctgggcctgaaggagggccggccctttgctggggtgacagcctgcatggacttctgtgcccacgcccacaaggaccagcacaacctgtacaacggctgcaccgtggtgtgcaccctgaccaaggaggacaacagatgtgtgggcaagatcccagaagatgagcagctgcacgtgctgcccctgtacaagatggccaacacagatgaatttggaagtgaggagaaccagaatgccaaggtgggcagcggggccatccaggtgctgacagccttcccccgggaggtgcggcggctgcctgagcccgccaagagctgccggcagaggcagctggaggccaggaaggctgctgctgagaagaagaagatccagaaggagaagctgagcaccccagagaagatcaagcaggaggccctggagctggccggcatcaccagtgaccccggcctgagcctgaagggcggcctgagccagcagggcctgaagcccagcctgaaggtggagccccagaaccacttcagcagcttcaagtacagcggaaatgctgtggtggagagctacagcgtgctgggcaactgccggcccagcgacccctacagcatgaacagcgtgtacagctaccacagctactatgcccagcccagcctgacctctgtgaatggcttccacagcaaatatgccctgcccagcttctcctactacggcttccccagcagcaaccctgtgttccccagccagttcctgggccctggggcctggggccacagcggcagcagcggcagctttgagaagaagccagacctgcacgccctgcacaacagcctgagccctgcctatggaggagctgagtttgctgagctgcccagccaggccgtgcccacagatgcccaccaccccaccccccaccaccagcagcctgcctacccaggccccaaggagtacctgctgcccaaggcccccctgctgcacagcgtgtcccgggaccccagcccctttgcccagagcagcaactgctacaacagaagcatcaagcaggagcctgtggaccccctgacccaggccgagcctgtgcccagagatgctgggaagatgggcaagacccccctgtctgaggtgtcccagaatggaggccccagccacctgtggggccagtacagcggcggccccagcatgagccccaagaggaccaatggagtgggcggctcctggggcgtcttcagcagcggggagagccctgccatcgtgcctgacaagctgagcagctttggagccagctgcctggcccccagccacttcacagatggccagtggggcctcttccctggagagggccagcaggccgccagccacagcggcggccgcctgcggggcaagccctggagcccctgcaagtttggaaacagcaccagcgccctggccggccccagcctgacagagaagccctgggccctgggcgctggggacttcaacagcgccctgaagggcagccctggcttccaggacaagctgtggaaccccatgaagggggaggagggccgcatcccagctgctggggccagccagctggtgttctaccagcacaagaacctgaaccagcccaaccacggcctggccctgtgggaggccaagatgaagcagctggccgagcgggcccgggcccggcaggaggaggccgcccggctgggcctgggccagcaggaggccaagctgtatggcaagaagaggaagtggggcggcaccgtggtggccgagccccagcagaaggagaagaagggcgtggtgcccacccggcaggccctggccgtgcccacagacagcgctgtgacagtgagcagctatgcctacaccaaggtgacaggcccctacagccgctggatctag

SEQ ID NO: 168052 - DNA, 468 bp, Artificial Sequence
  Description of Artificial Sequence: Synthetic coding sequence
atgaggcacctgccctacttctgccggggccaggtggtgcggggcttcggccggggcagcaagcagctgggcatccccacagccaacttccctgagcaggtggtggacaacctgcctgctgacatcagcacaggcatctactacggctgggcctctgtgggcagcggagatgtgcacaagatggtggtgtccatcggctggaacccctactacaagaacaccaagaagtccatggagacccacatcatgcacaccttcaaggaggacttctatggagagatcctgaatgtggccatcgtgggctacctgcggcctgagaagaactttgacagcctggagagcctcatcagcgccatccagggcgacatcgaggaggccaagaagaggctggagctgcctgagcacctgaagatcaaggaggacaacttcttccaggtgtccaagagcaagatcatgaatggccactag

SEQ ID NO: 168053 - DNA, 969 bp, Artificial Sequence
  Description of Artificial Sequence: Synthetic coding sequence
atggccgccagcggggagccccagaggcagtggcaggaggaggtggccgctgtggtggtggtgggcagctgcatgacagacctggtgtccctgaccagccggctgcccaagacaggagagaccatccacggccacaagttcttcatcggctttggaggcaagggggccaaccagtgtgtgcaggccgcccggctgggcgccatgacctccatggtgtgcaaggtgggcaaggacagctttggaaatgactacatcgagaacctgaagcagaatgacatcagcacagagttcacctaccagaccaaggatgctgccaccggcacagccagcatcatcgtgaacaatgaaggccagaacatcatcgtgattgtggccggggccaacctgctgctgaacacagaggacctgcgggctgctgccaacgtcatcagccgggccaaggtgatggtgtgccagctggagatcaccccagccaccagcctggaggccctgaccatggcccggcgcagcggcgtgaagaccctcttcaacccagccccagccatcgctgacctggacccccagttctacaccctgagtgatgtgttctgctgcaatgaaagtgaagctgagatcctgaccggcctgactgtgggcagcgctgctgatgctggggaggccgccctggtgctgctgaagaggggctgccaggtggtgatcatcaccctgggcgctgagggctgtgtggtgctgagccagacagagcctgagcccaagcacatccccacagagaaggtgaaggctgtggacaccactggagctggggacagctttgtgggcgccctggccttctacctggcctactaccccaacctgagcctggaggacatgctgaacagaagcaacttcatcgctgctgtgtctgtgcaggccgccggcacccagagcagctacccctacaagaaggacctgcccctgaccctcttctag

SEQ ID NO: 168054 - DNA, 861 bp, Artificial Sequence
  Description of Artificial Sequence: Synthetic coding sequence
atggccgccagcggggagccccagaggcagtggcaggaggaggtggccgctgtggtggtggtgggcagctgcatgacagacctggtgtccctgaccagccggctgcccaagacaggagagaccatccacggccacaagttcttcatcggctttggaggcaagggggccaaccagtgtgtgcaggccgcccggctgggcgccatgacctccatggtgtgcaaggtgggcaaggacagctttggaaatgactacatcgagaacctgaagcagaatgacatcagcacagagttcacctaccagaccaaggatgctgccaccggcacagccagcatcatcgtgaacaatgaaggccagaacatcatcgtgattgtggccggggccaacctgctgctgaacacagaggacctgcgggctgctgccaacgtcatcagccgggccaaggtgatggtgtgccagctggagatcaccccagccaccagcctggaggccctgaccatggcccggcgcagcggcgtgaagaccctcttcaacccagccccagccatcgctgacctggacccccagttctacaccctgagtgatgtgttctgctgcaatgaaagtgaagctgagatcctgaccggcctgactgtgggcagcgctgctgatgctggggaggccgccctggtgctgctgaagaggggctgccaggtggtgatcatcaccctgggcgctgagggctgtgtggtgctgagccagacagagcctgagcccaagcacatccccacagagaaggtgaaggctgtggacaccacctgccggcccggcagccggcccaagtctgaggccgcctctgtgaagaagcagaagcactacaagtag

SEQ ID NO: 168055 - DNA, 861 bp, Artificial Sequence
  Description of Artificial Sequence: Synthetic coding sequence
atgtcctggctgctcttcctggcccaccgggtggccctggccgccctgccctgcagaagaggcagccggggcttcggcatgttttatgctgtgcggcggggcaggaagacaggagtcttcctgacctggaatgaatgtcgggcccaggtggaccgcttccctgctgcccgcttcaagaagtttgccacagaagatgaggcctgggcctttgtgaggaagagcgccagccctgaggtgtctgagggccacgagaaccagcacggccaggagagcgaggccaaggccagcaagaggctgcgggagcccctggatggagatggccacgagagcgctgagccctatgccaagcacatgaagcccagcgtggagcccgcccctcctgtgtcccgggacaccttctcctacatgggagactttgtggtggtgtacacagatggctgctgcagcagcaatggaagaagaagaccccgggccggcatcggcgtgtactggggccctggccaccccctgaatgtgggcatccggctgcccggccggcagaccaaccagagagctgagatccatgctgcctgcaaggccatcgagcaggccaagacccagaacatcaacaagctggtgctgtacacagacagcatgttcaccatcaatggcatcaccaactgggtgcagggctggaagaagaatggctggaagaccagcgctgggaaggaggtgatcaacaaggaggactttgtggccctggagcggctgacccagggcatggacatccagtggatgcacgtgcccggccacagcggcttcatcggaaatgaggaggccgaccggctggcccgggagggcgccaagcagagtgaagattag

SEQ ID NO: 168056 - DNA, 1683 bp, Artificial Sequence
  Description of Artificial Sequence: Synthetic coding sequence
atggagttccggcaggaggagttcaggaagctggccggccgggccctgggcaagctgcaccggctgctggagaagaggcaggagggcgctgagaccctggagctgtctgcagatggccggcctgtgaccacccagacccgggacccccctgtggtggactgcacctgcttcggcctgccccggcgctacatcatcgccatcatgagcggcctgggcttctgcatcagctttggcatccgctgcaacctgggcgtggccatcgtgtccatggtgaacaacagcaccacccacagaggaggccacgtggtggtgcagaaggcccagttctcctgggaccctgagaccgtgggcctcatccacggcagcttcttctggggctacatcgtgacccagatccctgggggcttcatctgccagaagtttgctgccaacagagtgtttggatttgccatcgtggccaccagcaccctgaacatgctgatccccagcgctgcccgggtgcactacggctgtgtgatctttgtgcgcatcctgcagggcctggtggagggcgtgacctacccagcctgccacggcatctggagcaagtgggccccacccctggagaggagccggctggccaccacagccttctgtggcagctatgctggagctgtggtggccatgcccctggccggcgtgctggtgcagtacagcggctggagcagcgtcttctacgtgtatggcagctttggcatcttctggtacctgttctggctgctggtgtcctatgagagccctgccctgcaccccagcatcagcgaggaggagaggaagtacattgaagatgccatcggggagagcgccaagctgatgaaccccctgaccaagttcagcaccccctggaggcgcttcttcacctccatgcctgtgtatgccatcatcgtggccaacttctgccgctcctggaccttctacctgctgctgatcagccagcctgcctactttgaggaggtgtttggatttgagatcagcaaggtgggcctggtgtctgccctgccccacctggtgatgaccatcatcgtgcccatcggcggccagattgctgacttcctgcggagccgccgcatcatgagcaccaccaacgtgaggaagctgatgaactgtggcggcttcggcatggaggccaccctgctgctggtggtgggctacagccacagcaaaggagtggccatctccttcctggtgctggccgtgggcttcagcggctttgccatcagcggcttcaacgtgaaccacctggacatcgcccccaggtatgccagcatcctgatgggcatcagcaatggagtgggcaccctgagcggcatggtgtgccccatcatcgtgggcgccatgaccaagcacaagacccgggaggagtggcagtatgtgttcctgattgccagcctggtgcactacggcggcgtcatcttctacggcgtgtttgccagcggggagaagcagccctgggccgagcctgaggagatgtctgaggagaagtgtggctttgtgggccatgaccagctggccggcagtgatgacagcgagatggaggatgaggccgagcccccaggggcccccccagcccccccacccagctatggagccacccacagcaccttccagccccccaggcctcctcctcctgtgcgggactactag

SEQ ID NO: 168057 - DNA, 939 bp, Artificial Sequence
  Description of Artificial Sequence: Synthetic coding sequence
atggctgctggggtggactgtggagatggagtgggcgcccggcagcacgtgttcctggtgtctgagtacctgaaggatgccagcaagaagatgaagaatggcctgatgtttgtgaagctggtgaacccctgcagcggggagggcgccatctacctgttcaacatgtgcctgcagcagctgtttgaggtgaaggtgttcaaggagaagcaccacagctggttcatcaaccagagcgtgcagagcggcggcctgctgcactttgccacccctgtggaccccctcttcctgctgctgcactacctgatcaaggctgacaaggagggcaagttccagcccctggaccaggtggtggtggacaacgtgttccccaactgcatcctgctgctgaagctgcccggcctggagaagctgctgcaccacgtgacagaggagaagggcaaccctgagattgacaacaagaagtactacaagtacagcaaggagaagaccctgaagtggctggagaagaaggtgaaccagacagtggccgccctgaagaccaacaacgtgaatgtgagcagccgggtgcagagcacagccttcttcagcggggaccaggccagcacagacaaggaggaggactacatccgctatgcccacggcctcatcagtgactacatccccaaggagctgagtgatgacctgagcaagtacctgaagctgcctgagcccagcgccagcctgcccaacccccccagcaagaagatcaagctgagtgatgagcctgtggaggccaaggaggactacaccaagttcaacaccaaggacctgaagacagagaagaagaacagcaagatgacagctgcccagaaggccctggccaaggtggacaagagcggcatgaagagcattgacaccttctttggagtgaagaacaagaagaagattggcaaggtgtag

SEQ ID NO: 168058 - DNA, 774 bp, Artificial Sequence
  Description of Artificial Sequence: Synthetic coding sequence
atggctgctggggtggactgtggagatggagtgggcgcccggcagcacgtgttcctggtgtctgagtacctgaaggatgccagcaagaagatgaagaatggcctgatgtttgtgaagctggtgaacccctgcagcggggagggcgccatctacctgttcaacatgtgcctgcagcagctgtttgaggtgaaggtgttcaaggagaagcaccacagctggttcatcaaccagagcgtgcagagcggcggcctgctgcactttgccacccctgtggaccccctcttcctgctgctgcactacctgatcaaggctgacaaggagggcaagttccagcccctggaccaggtggtggtggacaacgtgttccccaactgcatcctgctgctgaagctgcccggcctggagaagctgctgcaccacgtgacagaggagaagggcaaccctgagattgacaacaagaagtactacaagtacagcaaggagaagaccctgaagtggctggagaagaaggtgaaccagacagtggccgccctgaagaccaacaacgtgaatgtgagcagccgggtgcagagcacagccttcttcagcggggaccaggccagcacagacaaggaggaggactacatccgctatgcccacggcctcatcagtgactacatccccaaggagctgagtgatgacctgagcaagtacctgaagctgcctgagcccagcgccagcctgcccaacccccccagcaagatggccgcccagaggcagaagaggggcaagtag

SEQ ID NO: 168059 - DNA, 996 bp, Artificial Sequence
  Description of Artificial Sequence: Synthetic coding sequence
atggctgctggggtggactgtggagatggagtgggcgcccggcagcacgtgttcctggtgtctgagtacctgaaggatgccagcaagaagatgaagaatggcctgatgtttgtgaagctggtgaacccctgcagcggggagggcgccatctacctgttcaacatgtgcctgcagcagctgtttgaggtgaaggtgttcaaggagaagcaccacagctggttcatcaaccagagcgtgcagagcggcggcctgctgcactttgccacccctgtggaccccctcttcctgctgctgcactacctgatcaaggctgacaaggagggcaagttccagcccctggaccaggtggtggtggacaacgtgttccccaactgcatcctgctgctgaagctgcccggcctggagaagctgctgcaccacgtgacagaggagaagggcaaccctgagattgacaacaagaagtactacaagtacagcaaggagaagaccctgaagtggctggagaagaaggtgaaccagacagtggccgccctgaagaccaacaacgtgaatgtgagcagccgggtgcagagcacagccttcttcagcggggaccaggccagcacagacaaggaggaggactacatccgctatgcccacggcctcatcagtgactacatccccaaggagctgagtgatgacctgagcaagtacctgaagctgcctgagcccagcgccagcctgcccaacccccccagcaagaagatcaagctgagtgatgagcctgtggaggccaaggaggactacaccaagttcaacaccaaggacctgaagacagagaagaagaacagcaagatgacagctgcccagaaggccctggccaaggtggacaagagcggcatgaagagcattgacaccttctttggagtgaagaagaagctggagagatttgagaccctgaagatcaagagcagcaagaacatctgcttcctgcacgtgtctgtgtgccccagctag

SEQ ID NO: 168060 - DNA, 495 bp, Artificial Sequence
  Description of Artificial Sequence: Synthetic coding sequence
atggagagcggagatgaagctgccatcgagcggcaccgggtgcacctgcggagcgccaccctgagagatgctgtgcctgccaccctgcacctgctgccctgtgaggtggccgtggatggccctgcccctgtgggccgcttcttcaccccagccatccggcagggccctgagggcctggaggtgtccttccggggccgctgcctgcggggggaggaggtggccgtgcccccaggcctggtgggctacgtgatggtgacagaggagaagaaggtgtccatgggcaagccagaccccctgcgggacagcggcacagatgaccaggaggaggagcccctggagcgggactttgaccgcttcatcggggccacagccaacttcagccgcttcaccctgtggggcctggagaccatccctggcccagatgccaaggtgcggggggccctgacctggcccagcctggccgccgccatccacgcccaggtgcctgaagattag

SEQ ID NO: 168061 - DNA, 2226 bp, Artificial Sequence
  Description of Artificial Sequence: Synthetic coding sequence
atggagagccgggaccacaacaacccccaggagggccccaccagcagcagtggaagaagagctgctgtggaggacaaccacctgctgatcaaggctgtgcagaatgaagatgtggacctggtgcagcagctgctggagggcggggccaacgtgaacttccaggaggaggagggcggctggacccccctgcacaatgctgtgcagatgagccgggaggacatcgtggagctgctgctgcggcatggagctgaccctgtgctgaggaagaagaatggagccacccccttcatcctggccgccatcgccggctctgtgaagctgctgaagctgttcctgagcaaaggagcagatgtgaatgaatgtgacttctacggcttcaccgccttcatggaggccgctgtgtatggcaaggtgaaggccctgaagttcctgtacaagagaggagccaacgtgaacctgcggaggaagaccaaggaggaccaggagcggctgaggaagggcggggccacagccctgatggatgctgctgagaagggccacgtggaggtgctgaagatcctgctggatgagatgggcgcagatgtgaatgcctgtgacaacatgggcagaaatgccctgatccacgccctgctgagcagtgatgacagtgatgtggaggccatcacccacctgctgctggaccacggggctgatgtgaatgtgcggggggagcggggcaagacccccctcatcctggccgtggagaagaagcacctgggcctggtgcagaggctgctggagcaggagcacatcgagatcaatgacacagacagtgatggcaagacagccctgctgctggccgtggagctgaagctgaagaagattgctgagctgctgtgcaagagaggagccagcacagactgtggggacctggtgatgacagcccggaggaactatgaccacagcctggtgaaggtgctgctgagccatggagccaaggaggacttccaccccccagctgaggactggaagccccagagcagccactggggcgccgccctgaaggacctgcaccgcatctaccggcccatgattggcaagctgaagttcttcattgatgagaagtacaagattgctgacaccagcgagggcggcatctacctgggcttctatgagaagcaggaggtggccgtgaagaccttctgtgagggcagcccccgggcccagcgggaggtgtcctgcctgcagagcagccgggagaacagccacctggtgaccttctacggcagcgagagccaccggggccacctgtttgtgtgtgtgaccctgtgtgagcagaccctggaggcctgcctggatgtgcacagaggagaagatgtggagaatgaagaagatgaatttgccagaaatgtgctgagcagcatcttcaaggctgtgcaggagctgcacctgagctgtggctacacccaccaggacctgcagccccagaacatcctgattgacagcaagaaggccgcccacctggccgactttgacaagagcatcaagtgggccggggacccccaggaggtgaagagggacctggaggacctgggccgcctggtgctgtatgtggtgaagaagggcagcatcagctttgaggacctgaaggcccagagcaatgaggaggtggtgcagctgagcccagatgaggagaccaaggacctgatccacaggctcttccaccctggagagcacgtgcgggactgcctgagtgacctgctgggccaccccttcttctggacctgggagagccgctaccgcaccctgagaaatgtgggcaatgaaagtgacatcaagaccaggaagtctgagagcgagatcctgcggctgctgcagcccggccccagcgagcacagcaagagctttgacaagtggaccaccaagatcaatgaatgtgtgatgaagaagatgaacaagttctatgagaagaggggcaacttctaccagaacacagtgggggacctgctgaagttcatccggaacctgggggagcacattgatgaggagaagcacaagaagatgaagctgaagattggagaccccagcctgtacttccagaagaccttcccagacctggtgatctacgtgtacaccaagctgcagaacacagagtacaggaagcacttcccccagacccacagccccaacaagccccagtgtgatggagctgggggcgccagcggcctggccagccctggctgctag

SEQ ID NO: 168062 - DNA, 2226 bp, Artificial Sequence; identical to SEQ ID NO: 168061
  Description of Artificial Sequence: Synthetic coding sequence

SEQ ID NO: 168063 - DNA, 1959 bp, Artificial Sequence
  Description of Artificial Sequence: Synthetic coding sequence
atggagagccgggaccacaacaacccccaggagggccccaccagcagcagtggaagaagagctgctgtggaggacaaccacctgctgatcaaggctgtgcagaatgaagatgtggacctggtgcagcagctgctggagggcggggccaacgtgaacttccaggaggaggagggcggctggacccccctgcacaatgctgtgcagatgagccgggaggacatcgtggagctgctgctgcggcatggagctgaccctgtgctgaggaagaagaatggagccacccccttcatcctggccgccatcgccggctctgtgaagctgctgaagctgttcctgagcaaaggagcagatgtgaatgaatgtgacttctacggcttcaccgccttcatggaggccgctgtgtatggcaaggtgaaggccctgaagttcctgtacaagagaggagccaacgtgaacctgcggaggaagaccaaggaggaccaggagcggctgaggaagggcggggccacagccctgatggatgctgctgagaagggccacgtggaggtgctgaagatcctgctggatgagatgggcgcagatgtgaatgcctgtgacaacatgggcagaaatgccctgatccacgccctgctgagcagtgatgacagtgatgtggaggccatcacccacctgctgctggaccacggggctgatgtgaatgtgcggggggagcggggcaagacccccctcatcctggccgtggagaagaagcacctgggcctggtgcagaggctgctggagcaggagcacatcgagatcaatgacacagacagtgatggcaagacagccctgctgctggccgtggagctgaagctgaagaagattgctgagctgctgtgcaagagaggagccagcacagactgtggggacctggtgatgacagcccggaggaactatgaccacagcctggtgaaggtgctgctgagccatggagccaaggaggacttccaccccccagctgaggactggaagccccagagcagccactggggcgccgccctgaaggacctgcaccgcatctaccggcccatgattggcaagctgaagttcttcattgatgagaagtacaagattgctgacaccagcgagggcggcatctacctgggcttctatgagaagcaggaggtggccgtgaagaccttctgtgagggcagcccccgggcccagcgggaggtgtcctgcctgcagagcagccgggagaacagccacctggtgaccttctacggcagcgagagccaccggggccacctgtttgtgtgtgtgaccctgtgtgagcagaccctggaggcctgcctggatgtgcacagaggagaagatgtggagaatgaagaagatgaatttgccagaaatgtgctgagcagcatcttcaaggctgtgcaggagctgcacctgagctgtggctacacccaccaggacctgcagccccagaacatcctgattgacagcaagaaggccgcccacctggccgactttgacaagagcatcaagtgggccggggacccccaggaggtgaagagggacctggaggacctgggccgcctggtgctgtatgtggtgaagaagggcagcatcagctttgaggacctgaaggcccagagcaatgaggaggtggtgcagctgagcccagatgaggagaccaaggacctgatccacaggctcttccaccctggagagcacgtgcgggactgcctgagtgacctgctgggccaccccttcttctggacctgggagagccgctaccgcaccctgagaaatgtgggcaatgaaagtgacatcaagaccaggaagtctgagagcgagatcctgcggctgctgcagcccggccccagcgagcacagcaagagctttgacaagtggaccaccaagatgagcaagctgcggcaccggcagatcatcttccccaccacccagaaccagtag

SEQ ID NO: 168064 - DNA, 465 bp, Artificial Sequence
  Description of Artificial Sequence: Synthetic coding sequence
atgattggcaagctgaagttcttcattgatgagaagtacaagattgctgacaccagcgagggcggcatctacctgggcttctatgagaagcaggaggtggccgtgaagaccttctgtgagggcagcccccgggcccagcgggaggtgtcctgcctgcagagcagccgggagaacagccacctggtgaccttctacggcagcgagagccaccggggccacctgtttgtgtgtgtgaccctgtgtgagcagaccctggaggcctgcctggatgtgcacagaggagaagatgtggagaatgaagaagatgaatttgccagaaatgtgctgagcagcatcttcaaggctgtgcaggagctgcacctgagctgtggctacacccaccaggacctgcagccccagaacatcctgattggcccctggacagctggccccctgtgtgggaaggagggcaagcacctgatctag

SEQ ID NO: 168065 - DNA, 465 bp, Artificial Sequence
  Description of Artificial Sequence: Synthetic coding sequence
atggccggccctgtgaaggaccgggaggccttccagaggctgaacttcctgtaccaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagacccagggcagcagcaaccagtag

SEQ ID NO: 168066 - DNA, 489 bp, Artificial Sequence
  Description of Artificial Sequence: Synthetic coding sequence
atggccggccctgtgaaggaccgggaggccttccagaggctgaacttcctgtaccaggccgcccactgtgtgctggcccaggaccctgagaaccaggccctggcccgcttctactgctacacagagaggaccatcgccaagaggctggtgctgcggcggcccctgagcagcagcgccccccgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagaccaagggcagcagcaaccagtag

SEQ ID NO: 168067 - DNA, 534 bp, Artificial Sequence
  Description of Artificial Sequence: Synthetic coding sequence
atggccggccctgtgaaggaccgggaggccttccagaggctgaacttcctgtaccaggtgtccctgcggcagggcccccatggagatggagcccggcggccccgggtgacagcccccctgccccaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagacccagggcagcagcaaccagtag

SEQ ID NO: 168068 - DNA, 489 bp, Artificial Sequence
  Description of Artificial Sequence: Synthetic coding sequence
atggccggccctgtgaaggaccgggaggccttccagaggctgaacttcctgtaccaggccgcccactgtgtgctggcccaggaccctgagaaccaggccctggcccgcttctactgctacacagagaggaccatcgccaagaggctggtgctgcggcggcccctgagcagcagcgccccccgggaccccagcgtgaagaggaccctgtgccggggctgcagcagcctgctggtgcccggcctgacctgcacccaccggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagacccagggcagcagcaaccagtag

SEQ ID NO: 168069 - DNA, 534 bp, Artificial Sequence
  Description of Artificial Sequence: Synthetic coding sequence
atggccggccctgtgaaggaccgggaggccttccagaggctgaacttcctgtaccaggtgtccctgcggcagggcccccatggagatggagcccggcggccccgggtgacagcccccctgccccaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagaccaagggcagcagcaaccagtag

SEQ ID NO: 168070 - DNA, 465 bp, Artificial Sequence
  Description of Artificial Sequence: Synthetic coding sequence
atggccggccctgtgaaggaccgggaggccttccagaggctgaacttcctgtaccaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccaccggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagacccagggcagcagcaaccagtag

SEQ ID NO: 168071 - DNA, 435 bp, Artificial Sequence
  Description of Artificial Sequence: Synthetic coding sequence
atggccggccctgtgaaggaccgggaggccttccagaggctgaacttcctgtaccaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccggggagcgcttccagaccaccaccaccctggccaagcacagccccctgcacttccggccccccagctag

SEQ ID NO: 168072 - DNA, 465 bp, Artificial Sequence; identical to SEQ ID NO: 168070
  Description of Artificial Sequence: Synthetic coding sequence

SEQ ID NO: 168073 - DNA, 465 bp, Artificial Sequence
  Description of Artificial Sequence: Synthetic coding sequence
atggccggccctgtgaaggaccgggaggccttccagaggctgaacttcctgtaccaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagaccaagggcagcagcaaccagtag

SEQ ID NO: 168074 - DNA, 534 bp, Artificial Sequence
  Description of Artificial Sequence: Synthetic coding sequence
atggccggccctgtgaaggaccgggaggccttccagaggctgaacttcctgtaccaggtgtccctgcggcagggcccccatggagatggagcccggcggccccgggtgacagcccccctgccccaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccaccggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagacccagggcagcagcaaccagtag

SEQ ID NO: 168075 - DNA, 435 bp, Artificial Sequence
  Description of Artificial Sequence: Synthetic coding sequence
atggccggccctgtgaaggaccgggaggccttccagaggctgaacttcctgtaccaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccaccggcagaggcgctgccggggccagcgctggacagtgcagacctgcctgacctgccagaggagccagcgcttcctgaatgaccccggccacctgctgtggggagacaggcctgaggcccagctgggcagccaggccggggagcgcttccagaccaccaccaccctggccaagcacagccccctgcacttccggccccccagctag

SEQ ID NO: 168076 - DNA, 465 bp, Artificial Sequence; identical to SEQ ID NO: 168065
  Description of Artificial Sequence: Synthetic coding sequence

SEQ ID NO: 168077 - DNA, 489 bp, Artificial Sequence
  Description of Artificial Sequence: Synthetic coding sequence
atggccggccctgtgaaggaccgggaggccttccagaggctgaacttcctgtaccaggccgcccactgtgtgctggcccaggaccctgagaaccaggccctggcccgcttctactgctacacagagaggaccatcgccaagaggctggtgctgcggcggcccctgagcagcagcgccccccgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagacccagggcagcagcaaccagtag

SEQ ID NO: 168078 - DNA, 435 bp, Artificial Sequence; identical to SEQ ID NO: 168075
  Description of Artificial Sequence: Synthetic coding sequence

SEQ ID NO: 168079 - DNA, 534 bp, Artificial Sequence; identical to SEQ ID NO: 168067
  Description of Artificial Sequence: Synthetic coding sequence

SEQ ID NO: 168080 - DNA, 489 bp, Artificial Sequence; identical to SEQ ID NO: 168068
  Description of Artificial Sequence: Synthetic coding sequence

SEQ ID NO: 168081 - DNA, 534 bp, Artificial Sequence; identical to SEQ ID NO: 168067
  Description of Artificial Sequence: Synthetic coding sequence

SEQ ID NO: 168082 - DNA, 489 bp, Artificial Sequence; identical to SEQ ID NO: 168077
  Description of Artificial Sequence: Synthetic coding sequence

SEQ ID NO: 168083 - DNA, 465 bp, Artificial Sequence; identical to SEQ ID NO: 168070
  Description of Artificial Sequence: Synthetic coding sequence

SEQ ID NO: 168084 - DNA, 435 bp, Artificial Sequence; identical to SEQ ID NO: 168071
  Description of Artificial Sequence: Synthetic coding sequence

SEQ ID NO: 168085 - DNA, 435 bp, Artificial Sequence; identical to SEQ ID NO: 168071
  Description of Artificial Sequence: Synthetic coding sequence

SEQ ID NO: 168086 - DNA, 435 bp, Artificial Sequence; identical to SEQ ID NO: 168071
  Description of Artificial Sequence: Synthetic coding sequence

SEQ ID NO: 168087 - DNA, 534 bp, Artificial Sequence; identical to SEQ ID NO: 168074
  Description of Artificial Sequence: Synthetic coding sequence

SEQ ID NO: 168088 - DNA, 435 bp, Artificial Sequence; identical to SEQ ID NO: 168075
  Description of Artificial Sequence: Synthetic coding sequence

SEQ ID NO: 168089 - DNA, 465 bp, Artificial Sequence; identical to SEQ ID NO: 168065
  Description of Artificial Sequence: Synthetic coding sequence

SEQ ID NO: 168090 - DNA, 534 bp, Artificial Sequence; identical to SEQ ID NO: 168074
  Description of Artificial Sequence: Synthetic coding sequence

SEQ ID NO: 168091 - DNA, 489 bp, Artificial Sequence; identical to SEQ ID NO: 168077
  Description of Artificial Sequence: Synthetic coding sequence

SEQ ID NO: 168092 - DNA, 489 bp, Artificial Sequence; identical to SEQ ID NO: 168068
  Description of Artificial Sequence: Synthetic coding sequence

SEQ ID NO: 168093 - DNA, 765 bp, Artificial Sequence
  Description of Artificial Sequence: Synthetic coding sequence
atggctgtgtttgctgacctggacctgcgggccggcagtgacctgaaggccctgcggggcctggtggagacagctgcccaccgggagctgccccggctgcgggcctggcccaccagctgccacccagaccaccgggccaccctgcgcatcggctacagcgtggtggccatcaaccacatcgtggacttcaaggagaagaagcaggagattgagaagcctgtggccgtgtctgagctgttcaccaccctgcccatcgtgcagggcaagagccggcccatcaagatcctgacccggctgaccatcatcgtgtctgaccccagccactgcaatgtgctgcgggccaccagcagccgggcccggctgtatgatgtggtggccgtgttccccaagacagagaagctgttccacatcgcctgcacccacctggatgtggacctggtgtgcatcaccgtgacagagaagctgcccttctacttcaagaggcctcccatcaacgtggccatcgaccggggcctggcctttgagctggtgtacagccctgccatcaaggacagcaccatgaggcgctacaccatcagcagcgccctgaacctgatgcagatctgcaagggcaagaatgtcatcatcagcagcgctgctgagcggcccctggagatccggggcccctatgatgtggccaacctgggcctgctgtttggcctgtctgagagtgatgccaaggctgctgtgtccaccaactgcagagctgccctgctgcatggatag

SEQ ID NO: 168094 - DNA, 807 bp, Artificial Sequence
  Description of Artificial Sequence: Synthetic coding sequence
atggctgtgtttgctgacctggacctgcgggccggcagtgacctgaaggccctgcggggcctggtggagacagctgcccacctgggctacagcgtggtggccatcaaccacatcgtggacttcaaggagaagaagcaggagattgagaagcctgtggccgtgtctgagctgttcaccaccctgcccatcgtgcagggcaagagccggcccatcaagatcctgacccggctgaccatcatcgtgtctgaccccagccactgcaatgtgctgcgggccaccagcagccgggcccggctgtatgatgtggtggccgtgttccccaagacagagaagctgttccacatcgcctgcacccacctggatgtggacctggtgtgcatcaccgtgacagagaagctgcccttctacttcaagaggcctcccatcaacgtggccatcgaccggggcctggcctttgagctggtgtacagccctgccatcaaggacagcaccatgaggcgctacaccatcagcagcgccctgaacctgatgcagatctgcaagggcaagaatgtcatcatcagcagcgctgctgagcggcccctggagatccggggcccctatgatgtggccaacctgggcctgctgtttggcctgtctgagagtgatgccaaggctgctgtgtccaccaactgcagagctgccctgctgcatggagagaccaggaagacagccttcggcatcatcagcacagtgaagaagccccggcccagtgaaggagatgaggactgcctgcctgccagcaagaaggccaagtgtgagggctag

SEQ ID NO: 168095 - DNA, 768 bp, Artificial Sequence
  Description of Artificial Sequence: Synthetic coding sequence
atggctgtgtttgctgacctggacctgcgggccggcagtgacctgaaggccctgcggggcctggtggagacagctgcccacctgggctacagcgtggtggccatcaaccacatcgtggacttcaaggagaagaagcaggagattgagaagcctgtggccgtgtctgagctgttcaccaccctgcccatcgtgcagggcaagagccggcccatcaagatcctgacccggctgaccatcatcgtgtctgaccccagccactgcaatgtgctgcgggccaccagcagccgggcccggctgtatgatgtggtggccgtgttccccaagacagagaagctgttccacatcgcctgcacccacctggatgtggacctggtgtgcatcaccgtgacagagaagctgcccttctacttcaagaggcctcccatcaacgtggccatcgaccggggcctggcctttgagctggtgtacagccctgccatcaaggacagcaccatgaggcgctacaccatcagcagcgccctgaacctgatgcagatctgcaagggcaagcccctggagatccggggcccctatgatgtggccaacctgggcctgctgtttggcctgtctgagagtgatgccaaggctgctgtgtccaccaactgcagagctgccctgctgcatggagagaccaggaagacagccttcggcatcatcagcacagtgaagaagccccggcccagtgaaggagatgaggactgcctgcctgccagcaagaaggccaagtag

SEQ ID NO: 168096 - DNA, 969 bp, Artificial Sequence
  Description of Artificial Sequence: Synthetic coding sequence
atggctgtgtttgctgacctggacctgcgggccggcagtgacctgaaggccctgcggggcctggtggagacagctgcccacctgggctacagcgtggtggccatcaaccacatcgtggacttcaaggagaagaagcaggagattgagaagcctgtggccgtgtctgagctgttcaccaccctgcccatcgtgcagggcaagagccggcccatcaagatcctgacccggctgaccatcatcgtgtctgaccccagccactgcaatgtgctgcgggccaccagcagccgggcccggctgtatgatgtggtggccgtgttccccaagacagagaagctgttccacatcgcctgcacccacctggatgtggacctggtgtgcatcaccgtgacagagaagctgcccttctacttcaagaggcctcccatcaacgtggccatcgaccggggcctggcctttgagctggtgtacagccctgccatcaaggacagcaccatgaggcgctacaccatcagcagcgccctgaacctgatgcagatctgcaagggcaagaatgtcatcatcagcagcgctgctgagcggcccctggagatccggggcccctatgatgtggccaacctgggcctgctgtttggcctgtctgagagtgatgccaaggctgctgtgtccaccaactgcagagctgccctgctgcatggagagaccaggaagacagccttcggcatcatcagcacagtgaagaagccccggcccagtgaaggagatgaggactgcctgcctgccagcaagaaggccaagtggagccacagcgtgacccaggccggcgtgcagtggcacaacctgggcagcctgcagcccctgcccctgggcctgaagcccagcagccacctgagcctgcccaggacccgcatccagcagaggcagctgctgatcagccaccagagggaccacacccccaagaaccggctgtag

SEQ ID NO: 168097 - DNA, 639 bp, Artificial Sequence
  Description of Artificial Sequence: Synthetic coding sequence
gagattgagaagcctgtggccgtgtctgagctgttcaccaccctgcccatcgtgcagggcaagagccggcccatcaagatcctgacccggctgaccatcatcgtgtctgaccccagccactgcaatgtgctgcgggccaccagcagccgggcccggctgtatgatgtggtggccgtgttccccaagacagagaagctgttccacatcgcctgcacccacctggatgtggacctggtgtgcatcaccgtgacagagaagctgcccttctacttcaagaggcctcccatcaacgtggccatcgaccggggcctggcctttgagctggtgtacagccctgccatcaaggacagcaccatgaggcgctacaccatcagcagcgccctgaacctgatgcagatctgcaagggcaagcccctggagatccggggcccctatgatgtggccaacctgggcctgctgtttggcctgtctgagagtgatgccaaggctgctgtgtccaccaactgcagagctgccctgctgcatggagagaccaggaagacagccttcggcatcatcagcacagtgaagaagccccggcccagtgaaggagatgaggactgcctgcctgccagcaagaaggccaagtgtgagggctag

SEQ ID NO: 168098 - DNA, 852 bp, Artificial Sequence
  Description of Artificial Sequence: Synthetic coding sequence
atggctgctgccccccaggcccctggccggggcagcctgaggaagacccggcccctggtggtgaagaccagcctgaacaacccctacatcatccgctggagcgccctggagagcgaggacatgcacttcatcctgcagaccctggaggaccggctgaaggccatcggcctgcagaagattgaggacaagaagaagaagaacaagacccccttcctgaagaaggagagccgggagaagtgcagcattgctgtggacatcagcgagaacctgaaggagaagaagacagatgccaagcagcaggtgtctggctggaccccagcccacgtgaggaagcagctggccatcggcgtgaatgaggtgacccgggccctggagcggcgggagctgctgctggtgctggtgtgcaagtctgtgaagccagccatgatcaccagccacctgatccagctgagcctgagccgctctgtgcctgcctgccaggtgccccggctgtctgagcgcatcgcccctgtgattggcctgaagtgtgtgctggccctggccttcaagaagaacaccacagactttgtggatgaggtgcgggccatcatcccccgggtgcccagcctgtctgtgccctggctgcaggacagaattgaagattctggagagaacctggagacagagcccctggagagccaggaccgggagctgctggacaccagctttgaggacctgagcaagcccaagaggaagctggctgatggccggcaggcctctgtgaccctgcagcccctgaagatcaagaagctgatccccaaccccaacaagatcaggaagccacccaagagcaagaaggccacccccaagtag

SEQ ID NO: 168099 - DNA, 504 bp, Artificial Sequence
  Description of Artificial Sequence: Synthetic coding sequence
atggctgctgccccccaggcccctggccggggcagcctgaggaagacccggcccctggtggtgaagaccagcctgaacaacccctacatcatccgctggagcgccctggagagcgaggacatgcacttcatcctgcagaccctggaggaccggctgaaggccatcggcctgcagaagattgaggacaagaagaagaagaacaagacccccttcctgaagaaggagagccgggagaagtgcagcattgctgtggacatcagcgagaacctgaaggagaagaagacagatgccaagcagcaggtgtctggctggaccccagcccacgtgaggaagcagctggccatcggcgtgaatgaggtgacccgggccctggagcggcgggagctgctgctggtgctggtgctgaccctgctgccccggctggagtgcagcggggtcatcccagcccactgcaacccagcctcctgggtgcaggccatcctgctgccccagcccccagagtag

SEQ ID NO: 168100 - DNA, 852 bp, Artificial Sequence; identical to SEQ ID NO: 168098
  Description of Artificial Sequence: Synthetic coding sequence

SEQ ID NO: 168101 - DNA, 852 bp, Artificial Sequence; identical to SEQ ID NO: 168098
  Description of Artificial Sequence: Synthetic coding sequence

SEQ ID NO: 168102 - DNA, 510 bp, Artificial Sequence
  Description of Artificial Sequence: Synthetic coding sequence
atggctgctgccccccaggcccctggccggggcagcctgaggaagacccggcccctggtggtgaagaccagcctgaacaacccctacatcatccgctggagcgccctggagagcgaggacatgcacttcatcctgcagaccctggaggaccggctgaaggccatcggcctgcagaagattgaggacaagaagaagaagaacaagacccccttcctgaagaaggagagccgggagaagtgcagcattgctgtggacatcagcgagaacctgaaggagaagaagacagatgccaagcagcaggtgtctggctggaccccagcccacgtgaggaagcagctggccatcggcgtgaatgaggtgacccgggccctggagcggcgggagctgctgctggtgctggtgtgcaagtctgtgaagccagccatgatcaccagccacctgatccagctgagcctgagccgctctgtgcctgcctgccaggtgccccggctgtctgagcgcatcgcctag

SEQ ID NO: 168103 - DNA, 1092 bp, Artificial Sequence
  Description of Artificial Sequence: Synthetic coding sequence
atggccaccctgcggcggctgcgggaggcccccaggcacctgctggtgtgtgagaagagcaactttggaaaccacaagagccgccaccgccacctggtgcagacccactactacaactacagagtgtccttcctgatcccagaatgtggcatcctgtctgaggagctgaagaacctggtgatgaacacaggcccctactactttgtgaagaacctgcccctgcacgagctgatcaccccagagttcatcagcaccttcatcaagaagggcagctgctacgccctgacctacaacacccacattgatgaggacaacacagtggccctgctgcccaacgggaagctgatcctgagcctggacaaggacacctatgaggagaccggcctgcagggccaccccagccagttcagcggcaggaagatcatgaagttcatcgtgtccattgacctgatggagctgagcctgaacctggacagcaagaagtatgaaagaatctcctggagcttcaaggagaagaagcccctgaagtttgacttcctgctggcctggcacaagacaggcagcgaggagagcaccatgatgagctacttcagcaagtaccagatccaggagcaccagcccaaggtggccctgagcaccctgcgggacctgcagtgccctgtgctgcagagcagcgagctggagggcaccccagaggtgtcctgccgggccctggagctgtttgactggctgggcgctgtgttcagcaatgtggacctgaacaatgagcccaacaacttcatcagcacctactgctgcccagagcccagcacagtggtggccaaggcctacctgtgcaccatcaccggcttcatcctgcctgagaagatctgcctgctgctggagcacctgtgccactactttgatgagcccaagctggccccctgggtgaccctgtctgtgcagggctttgctgacagccctgtgtcctgggagaagaatgaacatggcttcagaaaaggaggagagcacctgtacaactttgtgatcttcaacaaccaggactactggctgcagatggctgtgggcgccaatgaccactgccccccatag

SEQ ID NO: 168104 - DNA, 912 bp, Artificial Sequence
  Description of Artificial Sequence: Synthetic coding sequence
atgaacacaggcccctactactttgtgaagaacctgcccctgcacgagctgatcaccccagagttcatcagcaccttcatcaagaagggcagctgctacgccctgacctacaacacccacattgatgaggacaacacagtggccctgctgcccaacgggaagctgatcctgagcctggacaaggacacctatgaggagaccggcctgcagggccaccccagccagttcagcggcaggaagatcatgaagttcatcgtgtccattgacctgatggagctgagcctgaacctggacagcaagaagtatgaaagaatctcctggagcttcaaggagaagaagcccctgaagtttgacttcctgctggcctggcacaagacaggcagcgaggagagcaccatgatgagctacttcagcaagtaccagatccaggagcaccagcccaaggtggccctgagcaccctgcgggacctgcagtgccctgtgctgcagagcagcgagctggagggcaccccagaggtgtcctgccgggccctggagctgtttgactggctgggcgctgtgttcagcaatgtggacctgaacaatgagcccaacaacttcatcagcacctactgctgcccagagcccagcacagtggtggccaaggcctacctgtgcaccatcaccggcttcatcctgcctgagaagatctgcctgctgctggagcacctgtgccactactttgatgagcccaagctggccccctgggtgaccctgtctgtgcagggctttgctgacagccctgtgtcctgggagaagaatgaacatggcttcagaaaaggaggagagcacctgtacaactttgtgatcttcaacaaccaggactactggctgcagatggctgtgggcgccaatgaccactgccccccatag

SEQ ID NO: 168105 - DNA, 717 bp, Artificial Sequence
  Description of Artificial Sequence: Synthetic coding sequence
atgaggcctgctgccctgcggggggccctgctgggctgcctgtgcctggccctgctgtgcctgggcggcgctgacaagaggctgcgggacaaccacgagtggaagaagctgatcatggtgcagcactggccagagaccgtgtgtgagaagatccagaatgactgccgggaccccccagactactggaccatccacggcctgtggccagacaagtctgagggctgcaacagatcctggcccttcaacctggaggagatcaagaagaactggatggagatcacagacagcagcctgcccagccccagcatgggccctgccccaccccgctggatgaggagcaccccccggcgcagcaccctggccgaggcctggaacagcacaggctcctggaccagcactggaggctgtgccctgcccccagctgccctgcccagcggggacctgtgctgccggcccagcctgacagctggcagccggggcgtgggcgtggacctgacagccctgcagcagctgctgcacgtgcactacagcgccaccggcatcatcccagaagaatgttctgagcccaccaagcccttccagatcatcctgcaccacgaccacacagagtgggtgcagagcatcggcatgcccatctggaccatcagcagcagcgagagcgccatcggcaagaccaggacccagcctgcctgtgctgtgctgagccatgacagctag

SEQ ID NO: 168106 - DNA, 624 bp, Artificial Sequence
  Description of Artificial Sequence: Synthetic coding sequence
atgaggcctgctgccctgcggggggccctgctgggctgcctgtgcctggccctgctgtgcctgggcggcgctgacaagaggctgcgggacaaccacgagtggaagaagctgatcatggtgcagcactggccagagaccgtgtgtgagaagatccagaatgactgccgggaccccccagactactggaccatccacggcctgtggccagacaagtctgagggctgcaacagatcctggcccttcaacctggaggagatcaagaagaactggatggagatcacagacagcagcctgcccagccccagcacagacctgctgcctgagatgagggcctactggccagatgtgatccacagcttccccaacagaagccgcttctgtggcacctgtgccgcccaggtggatgccctgaacagccagaagaagtacttcggccgcagcctggagctgtaccgggagctggacctgaaccgctgggtgcggcccagccctggctgcaccagccagtggggcagcctgctgagccccaagccagacagctggatccagggcagcggctgccggccccactgccccccagctgccagcgcctgtgccctgtttggctactgggaccacagctag

SEQ ID NO: 168107 - DNA, 921 bp, Artificial Sequence
  Description of Artificial Sequence: Synthetic coding sequence
atgaggcctgctgccctgcggggggccctgctgggctgcctgtgcctggccctgctgtgcctgggcggcgctgacaagaggctgcgggacaaccacgagtggaagaagctgatcatggtgcagcactggccagagaccgtgtgtgagaagatccagaatgactgccgggaccccccagactactggaccatccacggcctgtggcaggtgagccacaccagcagaagaggcctgctcttcctgttcaagaacatcttcagcctgagcagcaggaacttctccttctacagcctgcagacctccatgaagaagccaccccagcccagcctcatcttcctgatcttctccttcaagccagacaagtctgagggctgcaacagatcctggcccttcaacctggaggagatcaaggacctgctgcctgagatgagggcctactggccagatgtgatccacagcttccccaacagaagccgcttctggaagcatgagtgggagaagcacggcacctgtgccgcccaggtggatgccctgaacagccagaagaagtacttcggccgcagcctggagctgtaccgggagctggacctgaacagcgtgctgctgaagctgggcatcaagcccagcatcaactactaccaggtggccgacttcaaggatgccctggcccgggtgtatggagtcatccccaagatccagtgcctgccccccagccaggatgaggaggtgcagaccatcggccagatcgagctgtgcctgaccaagcaggaccagcagctgcagaactgcacagagcccggggagcagcccagccccaagcaggaggtgtggctggccaacggggctgctgagagccggggcctgcgggtgtgtgaagatggccctgtgttctaccccccacccaagaagaccaagcactag

SEQ ID NO: 168108 - DNA, 771 bp, Artificial Sequence
  Description of Artificial Sequence: Synthetic coding sequence
atgaggcctgctgccctgcggggggccctgctgggctgcctgtgcctggccctgctgtgcctgggcggcgctgacaagaggctgcgggacaaccacgagtggaagaagctgatcatggtgcagcactggccagagaccgtgtgtgagaagatccagaatgactgccgggaccccccagactactggaccatccacggcctgtggccagacaagtctgagggctgcaacagatcctggcccttcaacctggaggagatcaaggacctgctgcctgagatgagggcctactggccagatgtgatccacagcttccccaacagaagccgcttctggaagcatgagtgggagaagcacggcacctgtgccgcccaggtggatgccctgaacagccagaagaagtacttcggccgcagcctggagctgtaccgggagctggacctgaacagcgtgctgctgaagctgggcatcaagcccagcatcaactactaccaggtggccgacttcaaggatgccctggcccgggtgtatggagtcatccccaagatccagtgcctgccccccagccaggatgaggaggtgcagaccatcggccagatcgagctgtgcctgaccaagcaggaccagcagctgcagaactgcacagagcccggggagcagcccagccccaagcaggaggtgtggctggccaacggggctgctgagagccggggcctgcgggtgtgtgaagatggccctgtgttctaccccccacccaagaagaccaagcactag

SEQ ID NO: 168109 - DNA, 765 bp, Artificial Sequence
  Description of Artificial Sequence: Synthetic coding sequence
atgaggcctgctgccctgcggggggccctgctgggctgcctgtgcctggccctgctgtgcctgggcggcgctgacaagaggctgcgggacaaccacgagtggaagaagctgatcatggtgcagcactggccagagaccgtgtgtgagaagatccagaatgactgccgggaccccccagactactggaccatccacggcctgtggccagacaagtctgagggctgcaacagatcctggcccttcaacctggaggagatcaaggacctgctgcctgagatgagggcctactggccagatgtgatccacagcttccccaacagaagccgcttctggaagcatgagtgggagaagcacggcacctgtgccgcccaggtggatgccctgaacagccagaagaagtacttcggccgcagcctggagctgtaccgggagctggacctgaacagcgtgctgctgaagctgggcatcaagcccagcatcaactactaccaggtggccgacttcaaggatgccctggcccgggtgtatggagtcatccccaagatccagtgcctgccccccagccaggatgaggaggtgcagaccatcggccagatcgagctgtgcctgaccaagcaggaccagcagctgcagaactgcacagagcccggggagcagcccagccccaagcaggaggtgtggctggccaacggggctgctgagagccggggcctgcgggtgtgtgaagatggccctgtgttctaccccccacccaagaagacctag

SEQ ID NO: 168110 - DNA, 771 bp, Artificial Sequence; identical to SEQ ID NO: 168108
  Description of Artificial Sequence: Synthetic coding sequence

SEQ ID NO: 168111 - DNA, 471 bp, Artificial Sequence
  Description of Artificial Sequence: Synthetic coding sequence
atggccctggagaagagcctggtgcggctgctgctgctggtgctgatcctgctggtgctgggctgggtgcagcccagcctgggcaaggagagccgggccaagaagttccagaggcagcacatggacagcgacagcagccccagcagcagcagcacctactgcaaccagatgatgagaagaagaaacatgacccagggccgctgcaagcctgtgaacacctttgtgcatgagcccctggtggatgtgcagaatgtgtgcttccaggagaaggtgacctgcaagaatggccagggcaactgctacaagagcaacagctccatgcacatcacagactgccgcctgaccaacggcagccgctaccccaactgtgcctaccgcaccagccccaaggagcggcacatcatcgtggcctgtgagggcagcccctacgtgcctgtgcactttgatgcctctgtggaggacagcacctag

SEQ ID NO: 168112 - DNA, 471 bp, Artificial Sequence; identical to SEQ ID NO: 168111
  Description of Artificial Sequence: Synthetic coding sequence

SEQ ID NO: 168113 - DNA, 471 bp, Artificial Sequence; identical to SEQ ID NO: 168111
  Description of Artificial Sequence: Synthetic coding sequence

SEQ ID NO: 168114 - DNA, 471 bp, Artificial Sequence; identical to SEQ ID NO: 168111
  Description of Artificial Sequence: Synthetic coding sequence

SEQ ID NO: 168115 - DNA, 486 bp, Artificial Sequence
  Description of Artificial Sequence: Synthetic coding sequence
atggtgcccaagctgttcaccagccagatctgcctgctgctgctgctgggcctgctggccgtggagggcagcctgcacgtgaagccaccccagttcacctgggcccagtggtttgagacccagcacatcaacatgaccagccagcagtgcaccaatgccatgcaggtgatcaacaactaccagaggcgctgcaagaaccagaacaccttcctgctgaccacctttgccaacgtggtgaatgtgtgtggcaaccccaacatgacctgccccagcaacaagaccaggaagaactgccaccacagcggcagccaggtgcccctcatccactgcaacctgaccacccccagcccccagaacatcagcaactgccgctatgcccagaccccagccaacatgttctacatcgtggcctgtgacaacagagaccagaggcgggaccccccccagtaccctgtggtgcctgtgcacctggaccgcatcatctag

SEQ ID NO: 168116 - DNA, 483 bp, Artificial Sequence
  Description of Artificial Sequence: Synthetic coding sequence
atggtgcccaagctgttcaccagccagatctgcctgctgctgctgctgggcctgatgggcgtggagggcagcctgcacgcccggcccccccagttcacccgggcccagtggtttgccatccagcacatcagcctgaaccccccacgctgcaccatcgccatgagggccatcaacaactaccgctggcgctgcaagaaccagaacaccttcctgcggaccacctttgccaacgtggtgaatgtgtgtggcaaccagagcatccgctgcccccacaacagaaccctgaacaactgccacaggagccgcttccgggtgcccctgctgcactgtgacctgatcaaccctggggcccagaacatcagcaactgcacctacgccgacaggcctggaagacgcttctacgtggtggcctgtgacaacagagacccccgggacagcccccgctaccctgtggtgcctgtgcacctggacaccaccatctag

SEQ ID NO: 168117 - DNA, 444 bp, Artificial Sequence
  Description of Artificial Sequence: Synthetic coding sequence
atggccctgcagaggacccacagcctgctgctgctgctgctgctgaccctgctgggcctgggcctggtgcagcccagctatggccaggacggcatgtaccagcgcttcctgcggcagcacgtgcaccctgaggagaccggcggcagtgaccgctactgcaacctgatgatgcagaggaggaagatgaccctgtaccactgcaagcgcttcaacaccttcatccacgaggacatctggaacatccgcagcatctgcagcaccaccaacatccagtgcaagaatggcaagatgaactgccacgagggcgtggtgaaggtgacagactgccgggacaccggcagcagccgggcccccaactgccgctaccgggccatcgccagcaccaggagagtggtgattgcctgtgagggcaacccccaggtgcctgtgcactttgatggatag

SEQ ID NO: 168118 - DNA, 444 bp, Artificial Sequence; identical to SEQ ID NO: 168117
  Description of Artificial Sequence: Synthetic coding sequence

SEQ ID NO: 168119 - DNA, 444 bp, Artificial Sequence; identical to SEQ ID NO: 168117
  Description of Artificial Sequence: Synthetic coding sequence

SEQ ID NO: 168120 - DNA, 465 bp, Artificial Sequence
  Description of Artificial Sequence: Synthetic coding sequence
atggccccagcccgggccggctgctgccccctgctgctgctgctgctgggcctgtgggtggccgaggtgctggtgcgggccaagcccaaggacatgaccagcagccagtggttcaagacccagcacgtgcagcccagcccccaggcctgcaacagcgccatgagcatcatcaacaagtacacagagcgctgcaaggacctgaacaccttcctgcacgagcccttcagctctgtggccatcacctgccagacccccaacatcgcctgcaagaacagctgcaagaactgccaccagagccacggccccatgagcctgaccatgggagagctgaccagcggcaagtaccccaactgccgctacaaggagaagcacctgaacaccccctacatcgtggcctgtgaccccccccagcagggcgaccccggctaccccctggtgcctgtgcacctggacaaggtggtgtag

SEQ ID NO: 168121 - DNA, 453 bp, Artificial Sequence
  Description of Artificial Sequence: Synthetic coding sequence
atggtgctgtgcttccccctgctgctgctgctgctggtgctgtggggccctgtgtgccccctgcacgcctggcccaagaggctgaccaaggcccactggtttgagatccagcacatccagcccagccccctgcagtgcaacagagccatgagcggcatcaacaactacacccagcactgcaagcaccagaacaccttcctgcatgacagcttccagaatgtggccgctgtgtgtgacctgctgagcatcgtgtgcaagaacagaagacacaactgccaccagagcagcaagcctgtgaacatgacagactgccgcctgaccagcggcaagtacccccagtgccgctacagcgctgctgcccagtacaagttcttcatcgtggcctgtgaccccccccagaagagtgaccccccctacaagctggtgcctgtgcacctggacagcatcctgtag

SEQ ID NO: 168122 - DNA, 2271 bp, Artificial Sequence
  Description of Artificial Sequence: Synthetic coding sequence
atgcccctgcggcccggcagcctggtgcctgagggcgccggcttccccaagatggccgcagatgtgtctgtgacccaccggccccccctgagccccaagagcggggctgaggtggaggccggagatgctgctgagcggcgggcccctgaggaggagctgccccccctggaccctgaggagatcaggaagaggctggagcacacagagcggcagttcaggaacagaaggaagatcctgatccggggcctgcctggagatgtgaccaaccaggaggtgcatgacctgctgagtgactatgagctgaagtactgctttgtggacaagtacaagggcacagcctttgtgaccctgctgaatggagagcaggccgaggccgccatcaatgccttccaccagagccggctgcgggagcgggagctgtctgtgcagctgcagcccacagatgccctgctgtgtgtggccaacctgccccccagcctgacccagcagcagtttgaggagctggtgcggcccttcggcagcctggagcgctgcttcctggtgtacagcgagaggacaggccagagcaagggctacggctttgctgagtacatgaagaaggacagcgctgcccgggccaagagtgacctgctgggcaagcccctgggccccaggaccctgtatgtgcactggacagatgctggccagctgaccccagccctgctgcacagccgctgcctgtgtgtggaccggctgcccccaggcttcaatgatgtggatgccctgtgccgggccctgtctgctgtgcacagccccaccttctgccagctggcctgtggccaggacggccagctgaagggctttgctgtgctggagtatgaaacagctgagatggccgaggaggcccagcagcaggctgatggcctgagcctgggcggcagccacctgcgggtgtccttctgtgcccctggccccccaggccgctccatgctggccgccctgattgctgcccaggccacagccctgaacagaggcaagggcctgctgcctgagcccaacatcctgcagctgctgaacaacctgggccccagcgccagcctgcagctgctgctgaaccccctgctgcacggcagcgctgggggcaagcagggcctgctgggcgcccccccagccatgcccctgctgaatggacctgccctgagcacagccctgctgcagctggccctgcagacccagggccagaagaagccaggcatcctgggggacagccccctgggcgccctgcagcccggggcccagcctgccaaccccctgctgggggagctgcctgctgggggcggcctgcccccagagctgcccccccggcggggcaagcccccacccctgctgcccagcgtgctgggccctgctggaggagaccgggaggccctgggcctgggccccccagctgcccagctgaccccacctccagcccctgtgggcctgcggggcagcggcctgcggggcctgcagaaggacagcggccccctgcccaccccacctggggtgtccctgctgggggagccccccaaggactaccgcatccccctgaacccctacctgaacctgcacagcctgctgcctgccagcaacctggccggcaaggaggcccggggctggggcggggccggccgcagcagaagacctgctgagggcccccccaccaaccccccagcccctgggggcggcagcagcagcagcaaggccttccagctgaagagccggctgctgagccccctgagcagcgcccggctgcccccagagcccggcctgagtgacagctacagctttgactaccccagcgacatgggcccccggcggctcttcagccacccccgggagcccgccctgggcccccacggccccagccgccacaagatgagccccccacccagcggctttggagagaggagcagcggcggcagcggcggcggccccctgagccacttctacagcggcagccccaccagctacttcaccagcggcctgcaggccggcctgaagcagagccacctgagcaaggccatcggcagcagccccctgggcagcggggagggcctgctgggcctgagccctggccccaacggccacagccacctgctgaagacccccctgggcggccagaagaggagctttgcccacctgctgcccagccctgagcccagccctgagggcagctatgtgggccagcacagccagggcctgggcggccactacgccgacagctacctgaagaggaagaggatcttctag

SEQ ID NO: 168123 - DNA, 1821 bp, Artificial Sequence
  Description of Artificial Sequence: Synthetic coding sequence
atggctgctgatgtgtctgtgacccacaggcctcccctgagccccaagtctggagctgaggtggaggccggagatgctgctgagcggcgggcccctgaggaggagctgccccccctggaccctgaggagatcaggaagaggctggagcacacagagcggcagttcaggaacagaaggaagatcctgatccggggcctgcctggagatgtgaccaaccaggaggtgcatgacctgctgagtgactatgagctgaagtactgctttgtggacaagtacaagggcacagcctttgtgaccctgctgaatggagagcaggccgaggccgccatcaatgccttccaccagagccggctgcgggagcgggagctgtctgtgcagctgcagcccacagatgccctgctgtgtgtggccaacctgccccccagcctgacccagcagcagtttgaggagctggtgcggcccttcggcagcctggagcgctgcttcctggtgtacagcgagaggacaggccagagcaagggctacggctttgctgagtacatgaagaaggacagcgctgcccgggccaagagtgacctgctgggcaagcccctgggccccaggaccctgtatgtgcactggacagatgctggccagctgaccccagccctgctgcacagccgctgcctgtgtgtggaccggctgcccccaggcttcaatgatgtggatgccctgtgccgggccctgtctgctgtgcacagccccaccttctgccagctggcctgtggccaggacggccagctgaagggctttgctgtgctggagtatgaaacagctgagatggccgaggaggcccagcagcaggctgatggcctgagcctgggcggcagccacctgcgggtgtccttctgtgcccctggccccccaggccgctccatgctggccgccctgattgctgcccaggccacagccctgaacagaggcaagggcctgctgcctgagcccaacatcctgcagctgctgaacaacctgggccccagcgccagcctgcagctgctgctgaaccccctgctgcacggcagcgctgggggcaagcagggcctgctgggcgcccccccagccatgcccctgctgaatggacctgccctgagcacagccctgctgcagctggccctgcagacccagggccagaagaagccaggcatcctgggggacagccccctgggcgccctgcagcccggggcccagcctgccaaccccctgctgggggagctgcctgctgggggcggcctgcccccagagctgcccccaagaagaggcaagcccccacccctgctgcccagcgtgctgggccctgctggaggagaccgggaggccctgggcctgggccccccagctgcccagctgaccccacctccagcccctgtgggcctgcggggcagcggcctgcggggccccctgagccacttctacagcggcagccccaccagctacttcaccagcggcctgcaggccggcctgaagcagagccacctgagcaaggccatcggcagcagccccctgggcagcggggagggcctgctgggcctgagccctggccccaacggccacagccacctgctgaaggtgcgggccggcggcggggacatgcagggctgggaggccccagccccccagaggcccctgaccaggcctgccctgcccagcgtgtcccggccccactgggccgccagaaatgctgccctgcccacctgctgcccccggcccagccctgcccagaaggccgccatgtgggccagcaccccccgggccagcgctgccaccaccaggacccccacctag

SEQ ID NO: 168124 - DNA, 2076 bp, Artificial Sequence
  Description of Artificial Sequence: Synthetic coding sequence
atggctgctgctgctggagatggcggcggggagggcggggccggcctgggcagcgctgctggcctgggccctggccctggcctgcggggccagggccccagcgctgaggcccacgagggcgccccagaccccatgcctgctgccctgcaccctgaggaggtggccgcccggctgcagaggatgcagcgggagctgagcaacagaaggaagatcctggtgaagaacctgccccaggacagcaactgccaggaggtgcatgacctgctgaaggactatgacctgaagtactgctacgtggacaggaacaagaggacagcctttgtgaccctgctgaatggagagcaggcccagaatgccatccagatgttccaccagtacagcttccggggcaaggacctgattgtgcagctgcagcccacagatgccctgctgtgcatcaccaacgtgcccatctccttcaccagcgaggagtttgaggagctggtgcgggcctacggcaacatcgagcgctgcttcctggtgtacagcgaggtgacaggccacagcaagggctacggctttgtggagtacatgaagaaggactttgctgccaaggcccggctggagctgctgggccggcagctgggcgccagcgccctgtttgcccagtggatggatgtgaacctgctggccagcgagctgatccacagcaagtgcctgtgcatcgacaagctgcccagcgactacagagattctgaggagctgctgcagatcttcagctctgtgcacaagcctgtgttctgccagctggcccaggatgagggcagctatgtgggcggctttgctgtggtggagtacagcacagctgagcaggccgaggaggtgcagcaggccgcagatggcatgaccatcaagggcagcaaggtgcaggtgtccttctgtgcccctggggcccctggccgcagcaccctggccgccctgattgctgcccagagggtgatgcacagcaaccagaagggcctgctgcctgagcccaaccctgtgcagatcatgaagagcctgaacaacccagccatgctgcaggtgctgctgcagccccagctgtgtggccgggctgtgaagccagctgtgctgggcaccccccacagcctgccccacctgatgaaccccagcatcagccctgccttcctgcacctgaacaaggcccaccagagctctgtgatgggcaacaccagcaacctcttcctgcagaacctgagccacatccccctggcccagcagcagctgatgaagtttgagaacatccacaccaacaacaagccaggcctgctgggggagcccccagctgtggtgctgcagacagccctgggcatcggctctgtgctgcccctgaagaaggagctgggccaccaccacggggaggcccacaagaccagcagcctcatccccacccagaccaccatcacagctggcatgggcatgctgcccttcttccccaaccagcacatcgccggccaggccggccctggccacagcaacacccaggagaagcagcctgccaccgtgggcatggccgagggcaacttcagcggcagccagccctacctgcagagcttccccaacctggccgccggcagcctgctggtgggccaccacaagcagcagcagagccagcccaagggcacagagatcagcagtggagctgccagcaagaaccagaccagcctgctgggggagccccccaaggagatccggctgagcaagaacccctacctgaacctggcctctgtgctgcccagcgtgtgcctgagcagccctgccagcaagaccaccctgcacaagacaggcatcgccagcagcatcctggatgccatcagccagggcagcgagagccagcacgccctggagaagtgcatcgcctacagccccccatttggagactatgcccaggtgagcagcctgagaaatgagaagaggggcagcagctacctgatcagcgcccctgagggcggctctgtggagtgtgtggaccagcacagccagggcaccggggcctactacatggagacctacctgaagaagaagagggtgtactag

SEQ ID NO: 168125 - DNA, 2037 bp, Artificial Sequence
  Description of Artificial Sequence: Synthetic coding sequence
atggctgctgctgctggagatggcggcggggagggcggggccggcctgggcagcgctgctggcctgggccctggccctggcctgcggggccagggccccagcgctgaggcccacgagggcgccccagaccccatgcctgctgccctgcaccctgaggaggtggccgcccggctgcagaggatgcagcgggagctgagcaacagaaggaagatcctggtgaagaacctgccccaggacagcaactgccaggaggtgcatgacctgctgaaggactatgacctgaagtactgctacgtggacaggaacaagaggacagcctttgtgaccctgctgaatggagagcaggcccagaatgccatccagatgttccaccagtacagcttccggggcaaggacctgattgtgcagctgcagcccacagatgccctgctgtgcatcaccaacgtgcccatctccttcaccagcgaggagtttgaggagctggtgcgggcctacggcaacatcgagcgctgcttcctggtgtacagcgaggtgacaggccacagcaagggctacggctttgtggagtacatgaagaaggactttgctgccaaggcccggctggagctgctgggccggcagctgggcgccagcgccctgtttgcccagtggatggatgtgaacctgctggccagcgagctgatccacagcaagtgcctgtgcatcgacaagctgcccagcgactacagagattctgaggagctgctgcagatcttcagctctgtgcacaagcctgtgttctgccagctggcccaggatgagggcagctatgtgggcggctttgctgtggtggagtacagcacagctgagcaggccgaggaggtgcagcaggccgcagatggcatgaccatcaagggcagcaaggtgcaggtgtccttctgtgcccctggggcccctggccgcagcaccctggccgccctgattgctgcccagagggtgatgcacagcaaccagaagggcctgctgcctgagcccaaccctgtgcagatcatgaagagcctgaacaacccagccatgctgcaggtgctgctgcagccccagctgtgtggccgggctgtgaagccagctgtgctgggcaccccccacagcctgccccacctgatgaaccccagcatcagccctgccttcctgcacctgaacaaggcccaccagaacctgagccacatccccctggcccagcagcagctgatgaagtttgagaacatccacaccaacaacaagccaggcctgctgggggagcccccagctgtggtgctgcagacagccctgggcatcggctctgtgctgcccctgaagaaggagctgggccaccaccacggggaggcccacaagaccagcagcctcatccccacccagaccaccatcacagctggcatgggcatgctgcccttcttccccaaccagcacatcgccggccaggccggccctggccacagcaacacccaggagaagcagcctgccaccgtgggcatggccgagggcaacttcagcggcagccagccctacctgcagagcttccccaacctggccgccggcagcctgctggtgggccaccacaagcagcagcagagccagcccaagggcacagagatcagcagcggggccgccagcaagaaccagaccagcctgctgggggagccccccaaggagatccggctgagcaagaacccctacctgaacctggcctctgtgctgcccagcgtgtgcctgagcagccctgccagcaagaccaccctgcacaagacaggaattgccagcagcatcctggatgccatcagccagggcagcgagagccagcacgccctggagaagtgcatcgcctacagccccccatttggagactatgcccaggtgagcagcctgagaaatgagaagaggggcagcagctacctgatcagcgcccctgagggcggctctgtggagtgtgtggaccagcacagccagggcactggagcctactacatggagacctacctgaagaagaagagggtgtactag

SEQ ID NO: 168126 - DNA, 693 bp, Artificial Sequence
  Description of Artificial Sequence: Synthetic coding sequence
atgaccatcaagggcagcaaggtgcaggtgtccttctgtgcccctggggcccctggccgcagcaccctggccgccctgattgctgcccagagggtgatgcacagcaaccagaagggcctgctgcctgagcccaaccctgtgcagatcatgaagagcctgaacaacccagccatgctgcaggtgctgctgcagccccagctgtgtggccgggctgtgaagccagctgtgctgggcaccccccacagcctgccccacctgatgaaccccagcatcagccctgccttcctgcacctgaacaaggcccaccagaaccagaccagcctgctgggggagccccccaaggagatccggctgagcaagaacccctacctgaacctggcctctgtgctgcccagcgtgtgcctgagcagccctgccagcaagaccaccctgcacaagacaggaattgccagcagcatcctggatgccatcagccagggcagcgagagccagcacgccctggagaagtgcatcgcctacagccccccatttggagactatgcccaggtgagcagcctgagaaatgagaagaggggcagcagctacctgatcagcgcccctgagggcggctctgtggagtgtgtggaccagcacagccagggcactggagcctactacatggagacctacctgaagaagaagagggtgtactag

SEQ ID NO: 168127 - DNA, 2379 bp, Artificial Sequence
  Description of Artificial Sequence: Synthetic coding sequence
atgcacgtgatcaagagagatggccggcaggagcgggtgatgtttgacaagatcaccagccgcatccagaagctgtgctacggcctgaacatggactttgtggaccctgcccagatcaccatgaaggtgatccagggcctgtacagcggcgtgaccaccgtggagctggacaccctggccgctgagacagctgccaccctgaccaccaagcacccagactatgccatcctggccgccagaattgctgtgagcaacctgcacaaggagaccaagaaggtgttcagtgatgtgatggaggacctgtacaactacatcaacccccacaacgggaagcacagccccatggtggccaagagcaccctggacatcgtgctggccaacaaggaccggctgaacagcgccatcatctatgaccgggacttctcctacaactacttcggcttcaagaccctggagaggagctacctgctgaagatcaacgggaaggtggccgagcggccccagcacatgctgatgagggtgtctgtgggcatccacaaggaggacattgatgctgccatcgagacctacaacctgctgtctgagcgctggttcacccacgccagccccaccctcttcaatgccggcaccaaccggccccagctgagcagctgcttcctgctgtccatgaaggatgacagcattgagggcatctatgacaccctgaagcagtgtgccctgatcagcaagtctgctgggggcatcggcgtggccgtgtcctgcatccgggccaccggcagctacatcgccggcaccaacggcaacagcaatggcctggtgcccatgctgcgggtgtacaacaacacagcccgctacgtggaccagggcggcaacaagaggcctggggcctttgccatctacctggagccctggcacctggacatctttgagttcctggacctgaagaagaacacaggcaaggaggagcagagggcccgggacctcttctttgccctgtggatcccagacctcttcatgaagagggtggagaccaaccaggactggagcctgatgtgccccaatgaatgtcctggcctggatgaggtgtggggcgaggagtttgagaagctgtatgccagctatgagaagcagggccgggtgaggaaggtggtgaaggcccagcagctgtggtacgccatcatcgagagccagacagagaccggcaccccctacatgctgtacaaggacagctgcaacaggaagagcaaccagcagaacctgggcaccatcaagtgcagcaacctgtgcacagagatcgtggagtacaccagcaaggatgaggtggccgtgtgcaacctggccagcctggccctgaacatgtatgtgaccagcgagcacacctatgacttcaagaagctggccgaggtgaccaaggtggtggtgaggaacctgaacaagatcatcgacatcaactactaccctgtgcctgaggcctgcctgagcaacaagaggcaccggcccatcggcattggagtgcagggcctggctgatgccttcatcctgatgagatacccctttgaatctgctgaggcccagctgctgaacaagcagatctttgagaccatctactatggagccctggaggccagctgtgacctggccaaggagcagggcccctatgagacctatgagggcagccctgtgtccaagggcatcctgcagtatgacatgtggaatgtgacccccacagacctgtgggactggaaggtgctgaaggagaagatcgccaagtatggcatccggaacagcctgctgattgcccccatgcccacagccagcacagcccagatcctgggcaacaatgaaagcattgagccctacaccagcaacatctacaccaggagagtgctgtctggagagttccagatcgtgaacccccacctgctgaaggacctgacagagcggggcctgtggcatgaggagatgaagaaccagatcatcgcctgcaatggcagcatccagagcatccctgagatcccagatgacctgaagcagctgtacaagacagtgtgggagatcagccagaagacagtgctgaagatggctgctgagcggggggccttcatcgaccagagccagagcctgaacatccacatcgccgagcccaactacggcaagctgacctccatgcacttctacggctggaagcagggcctgaagacaggcatgtactacctgcggaccaggcctgctgccaaccccatccagttcaccctgaacaaggagaagctgaaggacaaggagaaggtgtccaaggaggaggaggagaaggagaggaacacagctgccatggtgtgcagcctggagaacagagatgagtgcctgatgtgtggcagctag

SEQ ID NO: 168128 - DNA, 2088 bp, Artificial Sequence
  Description of Artificial Sequence: Synthetic coding sequence
atggaggacctgtacaactacatcaacccccacaacgggaagcacagccccatggtggccaagagcaccctggacatcgtgctggccaacaaggaccggctgaacagcgccatcatctatgaccgggacttctcctacaactacttcggcttcaagaccctggagaggagctacctgctgaagatcaatggcaaggtggccgagcggccccagcacatgctgatgagggtgtctgtgggcatccacaaggaggacattgatgctgccatcgagacctacaacctgctgtctgagcgctggttcacccacgccagccccaccctcttcaatgccggcaccaaccggccccagctgagcagctgcttcctgctgtccatgaaggatgacagcattgagggcatctatgacaccctgaagcagtgtgccctgatcagcaagtctgctgggggcattggagtggccgtgtcctgcatccgggccaccggcagctacatcgccggcaccaatggaaacagcaatggcctggtgcccatgctgcgggtgtacaacaacacagcccgctacgtggaccagggcggcaacaagaggcctggggcctttgccatctacctggagccctggcacctggacatctttgagttcctggacctgaagaagaacacaggcaaggaggagcagagggcccgggacctcttctttgccctgtggatcccagacctcttcatgaagagggtggagaccaaccaggactggagcctgatgtgccccaatgaatgtcctggcctggatgaggtgtggggcgaggagtttgagaagctgtatgccagctatgagaagcagggccgggtgaggaaggtggtgaaggcccagcagctgtggtacgccatcatcgagagccagacagaaacaggcaccccctacatgctgtacaaggacagctgcaacaggaagagcaaccagcagaacctgggcaccatcaagtgcagcaacctgtgcacagaaattgtggagtacaccagcaaggatgaggtggccgtgtgcaacctggccagcctggccctgaacatgtatgtgaccagcgagcacacctatgacttcaagaagctggccgaggtgaccaaggtggtggtgaggaacctgaacaagatcatcgacatcaactactaccctgtgcctgaggcctgcctgagcaacaagaggcaccggcccatcggcatcggcgtgcagggcctggctgatgccttcatcctgatgagatacccctttgagagcgctgaggcccagctgctgaacaagcagatctttgagaccatctactacggggccctggaggccagctgtgacctggccaaggagcagggcccctatgagacctatgagggcagccctgtgtccaagggcatcctgcagtatgacatgtggaatgtgacccccacagacctgtgggactggaaggtgctgaaggagaagatcgccaagtatggcatccggaacagcctgctgattgcccccatgcccacagccagcacagcccagatcctgggcaacaatgaaagcattgagccctacaccagcaacatctacacccggcgggtgctgagcggggagttccagatcgtgaacccccacctgctgaaggacctgacagagcggggcctgtggcatgaggagatgaagaaccagatcatcgcctgcaatggcagcatccagagcatccctgagatcccagatgacctgaagcagctgtacaagacagtgtgggagatcagccagaagacagtgctgaagatggctgctgagcggggggccttcatcgaccagagccagagcctgaacatccacatcgccgagcccaactacggcaagctgacctccatgcacttctacggctggaagcagggcctgaagacaggcatgtactacctgcggaccaggcctgctgccaaccccatccagttcaccctgaacaaggagaagctgaaggacaaggagaaggtgtccaaggaggaggaggagaaggagaggaacacagctgccatggtgtgcagcctggagaacagagatgaatgtctgatgtgtggcagctag

SEQ ID NO: 168129 - DNA, 2118 bp, Artificial Sequence
  Description of Artificial Sequence: Synthetic coding sequence
gatggccggcaggagcgggtgatgtttgacaagatcaccagccgcatccagaagctgtgctacggcctgaacatggactttgtggaccctgcccagatcaccatgaaggtgatccagggcctgtacagcggcgtgaccaccgtggagctggacaccctggccgctgagacagctgccaccctgaagaccctggagaggagctacctgctgaagatcaatggcaaggtggccgagcggccccagcacatgctgatgagggtgtctgtgggcatccacaaggaggacattgatgctgccatcgagacctacaacctgctgtctgagcgctggttcacccacgccagccccaccctcttcaatgccggcaccaaccggccccagctgagcagctgcttcctgctgtccatgaaggatgacagcattgagggcatctatgacaccctgaagcagtgtgccctgatcagcaagtctgctgggggcattggagtggccgtgtcctgcatccgggccaccggcagctacatcgccggcaccaatggaaacagcaatggcctggtgcccatgctgcgggtgtacaacaacacagcccgctacgtggaccagggcggcaacaagaggcctggggcctttgccatctacctggagccctggcacctggacatctttgagttcctggacctgaagaagaacacaggcaaggaggagcagagggcccgggacctcttctttgccctgtggatcccagacctcttcatgaagagggtggagaccaaccaggactggagcctgatgtgccccaatgaatgtcctggcctggatgaggtgtggggcgaggagtttgagaagctgtatgccagctatgagaagcagggccgggtgaggaaggtggtgaaggcccagcagctgtggtacgccatcatcgagagccagacagaaacaggcaccccctacatgctgtacaaggacagctgcaacaggaagagcaaccagcagaacctgggcaccatcaagtgcagcaacctgtgcacagaaattgtggagtacaccagcaaggatgaggtggccgtgtgcaacctggccagcctggccctgaacatgtatgtgaccagcgagcacacctatgacttcaagaagctggccgaggtgaccaaggtggtggtgaggaacctgaacaagatcatcgacatcaactactaccctgtgcctgaggcctgcctgagcaacaagaggcaccggcccatcggcatcggcgtgcagggcctggctgatgccttcatcctgatgagatacccctttgagagcgctgaggcccagctgctgaacaagcagatctttgagaccatctactacggggccctggaggccagctgtgacctggccaaggagcagggcccctatgagacctatgagggcagccctgtgtccaagggcatcctgcagtatgacatgtggaatgtgacccccacagacctgtgggactggaaggtgctgaaggagaagatcgccaagtatggcatccggaacagcctgctgattgcccccatgcccacagccagcacagcccagatcctgggcaacaatgaaagcattgagccctacaccagcaacatctacacccggcgggtgctgagcggggagttccagatcgtgaacccccacctgctgaaggacctgacagagcggggcctgtggcatgaggagatgaagaaccagatcatcgcctgcaatggcagcatccagagcatccctgagatcccagatgacctgaagcagctgtacaagacagtgtgggagatcagccagaagacagtgctgaagatggctgctgagcggggggccttcatcgaccagagccagagcctgaacatccacatcgccgagcccaactacggcaagctgacctccatgcacttctacggctggaagcagggcctgaagacaggcatgtactacctgcggaccaggcctgctgccaaccccatccagttcaccctgaacaaggagaagctgaaggacaaggagaaggtgtccaaggaggaggaggagaaggagaggaacacagctgccatggtgtgcagcctggagaacagagatgaatgtctgatgtgtggcagctag

SEQ ID NO: 168130 - DNA, 1365 bp, Artificial Sequence
  Description of Artificial Sequence: Synthetic coding sequence
atgaagagggtggagaccaaccaggactggagcctgatgtgccccaatgaatgtcctggcctggatgaggtgtggggcgaggagtttgagaagctgtatgccagctatgagaagcagggccgggtgaggaaggtggtgaaggcccagcagctgtggtacgccatcatcgagagccagacagagaccggcaccccctacatgctgtacaaggacagctgcaacaggaagagcaaccagcagaacctgggcaccatcaagtgcagcaacctgtgcacagagatcgtggagtacaccagcaaggatgaggtggccgtgtgcaacctggccagcctggccctgaacatgtatgtgaccagcgagcacacctatgacttcaagaagctggccgaggtgaccaaggtggtggtgaggaacctgaacaagatcatcgacatcaactactaccctgtgcctgaggcctgcctgagcaacaagaggcaccggcccatcggcattggagtgcagggcctggctgatgccttcatcctgatgagatacccctttgaatctgctgaggcccagctgctgaacaagcagatctttgagaccatctactatggagccctggaggccagctgtgacctggccaaggagcagggcccctatgagacctatgagggcagccctgtgtccaagggcatcctgcagtatgacatgtggaatgtgacccccacagacctgtgggactggaaggtgctgaaggagaagatcgccaagtatggcatccggaacagcctgctgattgcccccatgcccacagccagcacagcccagatcctgggcaacaatgaaagcattgagccctacaccagcaacatctacaccaggagagtgctgtctggagagttccagatcgtgaacccccacctgctgaaggacctgacagagcggggcctgtggcatgaggagatgaagaaccagatcatcgcctgcaatggcagcatccagagcatccctgagatcccagatgacctgaagcagctgtacaagacagtgtgggagatcagccagaagacagtgctgaagatggctgctgagcggggggccttcatcgaccagagccagagcctgaacatccacatcgccgagcccaactacggcaagctgacctccatgcacttctacggctggaagcagggcctgaagacaggcatgtactacctgcggaccaggcctgctgccaaccccatccagttcaccctgaacaaggagaagctgaaggacaaggagaaggtgtccaaggaggaggaggagaaggagaggaacacagctgccatggtgtgcagcctggagaacagagatgagtgcctgatgtgtggcagctag

SEQ ID NO: 168131 - DNA, 1170 bp, Artificial Sequence
  Description of Artificial Sequence: Synthetic coding sequence
atgctgagcctgcgggtgcccctggcccccatcacagacccccagcagctgcagctgagccccctgaagggcctgagcctggtggacaaggagaacaccccaccagccctgagcggcaccagggtgctggccagcaagacagcccggcgcatcttccaggagcccacagagcccaagaccaaggctgctgcccctggggtggaggatgagcccctgctgcgggagaacccccggcgcttcgtcatcttccccatcgagtaccatgacatctggcagatgtacaagaaggccgaggccagcttctggacagctgaggaggtggacctgagcaaggacatccagcactgggagagcctgaagccagaggagcgctacttcatcagccacgtgctggccttctttgctgccagtgatggcatcgtgaatgaaaacctggtggagcgcttcagccaggaggtgcagatcacagaggcccgctgcttctacggcttccagatcgccatggagaacatccacagcgagatgtacagcctgctgattgacacctacatcaaggaccccaaggagcgggagttcctgttcaatgccatcgagaccatgccctgtgtgaagaagaaggctgactgggccctgcgctggattggagacaaggaggccacctatggagagcgggtggtggcctttgctgctgtggagggcatcttcttcagcggcagctttgccagcatcttctggctgaagaagaggggcctgatgcctggcctgaccttcagcaatgaactcatcagcagagatgagggcctgcactgtgactttgcctgcctgatgttcaagcacctggtgcacaagcccagcgaggagcgggtgcgggagatcatcatcaatgctgtgagaattgagcaggagttcctgacagaggccctgcctgtgaagctgattggcatgaactgcaccctgatgaagcagtacatcgagtttgtggccgaccggctgatgctggagctgggcttcagcaaggtgttccgggtggagaacccctttgacttcatggagaacatcagcctggagggcaagaccaacttctttgagaagagggtgggggagtaccagaggatgggcgtgatgagcagccccacagagaacagcttcaccctggatgctgacttctag

SEQ ID NO: 168132 - DNA, 1350 bp, Artificial Sequence
  Description of Artificial Sequence: Synthetic coding sequence
atgggccgggtgggcggcatggcccagcccatgggccgggccggggcccccaagcccatgggccgggccggcagcgcccggcggggccgcttcaagggctgctggagcgagggcagccctgtgcaccctgtgcctgctgtgctgtcctggctgctggccctgctgcgctgtgccagcaccatgctgagcctgcgggtgcccctggcccccatcacagacccccagcagctgcagctgagccccctgaagggcctgagcctggtggacaaggagaacaccccaccagccctgagcggcaccagggtgctggccagcaagacagcccggcgcatcttccaggagcccacagagcccaagaccaaggctgctgcccctggggtggaggatgagcccctgctgcgggagaacccccggcgcttcgtcatcttccccatcgagtaccatgacatctggcagatgtacaagaaggccgaggccagcttctggacagctgaggaggtggacctgagcaaggacatccagcactgggagagcctgaagccagaggagcgctacttcatcagccacgtgctggccttctttgctgccagtgatggcatcgtgaatgaaaacctggtggagcgcttcagccaggaggtgcagatcacagaggcccgctgcttctacggcttccagatcgccatggagaacatccacagcgagatgtacagcctgctgattgacacctacatcaaggaccccaaggagcgggagttcctgttcaatgccatcgagaccatgccctgtgtgaagaagaaggctgactgggccctgcgctggattggagacaaggaggccacctatggagagcgggtggtggcctttgctgctgtggagggcatcttcttcagcggcagctttgccagcatcttctggctgaagaagaggggcctgatgcctggcctgaccttcagcaatgaactcatcagcagagatgagggcctgcactgtgactttgcctgcctgatgttcaagcacctggtgcacaagcccagcgaggagcgggtgcgggagatcatcatcaatgctgtgagaattgagcaggagttcctgacagaggccctgcctgtgaagctgattggcatgaactgcaccctgatgaagcagtacatcgagtttgtggccgaccggctgatgctggagctgggcttcagcaaggtgttccgggtggagaacccctttgacttcatggagaacatcagcctggagggcaagaccaacttctttgagaagagggtgggggagtaccagaggatgggcgtgatgagcagccccacagagaacagcttcaccctggatgctgacttctag

SEQ ID NO: 168133 - DNA, 1056 bp, Artificial Sequence
  Description of Artificial Sequence: Synthetic coding sequence
atgggagaccctgagaggcctgaggccgccggcctggaccaggatgagaggagcagcagtgacaccaatgaaagtgagatcaagagcaatgaggagcccctgctgaggaagagcagccgccgcttcgtcatcttccccatccagtacccagacatctggaagatgtacaagcaggcccaggccagcttctggacagctgaggaggtggacctgagcaaggacctgccccactggaacaagctgaaggcagatgagaagtacttcatcagccacatcctggccttctttgctgccagtgatggcatcgtgaatgaaaacctggtggagcgcttcagccaggaggtgcaggtgcctgaggcccgctgcttctacggcttccagatcctgattgaaaatgtgcacagcgagatgtacagcctgctgattgacacctacatccgggaccccaagaagcgggagttcctgttcaatgccatcgagaccatgccctacgtgaagaagaaggctgactgggccctgcgctggattgctgacaggaagagcacctttggagagcgggtggtggcctttgctgctgtggagggcgtcttcttcagcggcagctttgctgccatcttctggctgaagaagaggggcctgatgcctggcctgaccttcagcaatgaactcatcagcagagatgagggcctgcactgtgactttgcctgcctgatgttccagtacctggtgaacaagcccagcgaggagcgggtgcgggagatcatcgtggatgctgtgaagattgagcaggagttcctgacagaggccctgcctgtgggcctgattggcatgaactgcatcctgatgaagcagtacatcgagtttgtggccgaccggctgctggtggagctgggcttcagcaaggtgttccaggccgagaacccctttgacttcatggagaacatcagcctggagggcaagaccaacttctttgagaagagggtgtctgagtaccagagatttgctgtgatggccgagaccacagacaacgtgttcaccctggatgctgacttctag

SEQ ID NO: 168134 - DNA, 900 bp, Artificial Sequence
  Description of Artificial Sequence: Synthetic coding sequence
atgggagaccctgagaggcctgaggccgccggcctggaccaggatgaggtggacctgagcaaggacctgccccactggaacaagctgaaggcagatgagaagtacttcatcagccacatcctggccttctttgctgccagtgatggcatcgtgaatgaaaacctggtggagcgcttcagccaggaggtgcaggtgcctgaggcccgctgcttctacggcttccagatcctgattgaaaatgtgcacagcgagatgtacagcctgctgattgacacctacatccgggaccccaagaagcgggagttcctgttcaatgccatcgagaccatgccctacgtgaagaagaaggctgactgggccctgcgctggattgctgacaggaagagcacctttggagagcgggtggtggcctttgctgctgtggagggcgtcttcttcagcggcagctttgctgccatcttctggctgaagaagaggggcctgatgcctggcctgaccttcagcaatgaactcatcagcagagatgagggcctgcactgtgactttgcctgcctgatgttccagtacctggtgaacaagcccagcgaggagcgggtgcgggagatcatcgtggatgctgtgaagattgagcaggagttcctgacagaggccctgcctgtgggcctgattggcatgaactgcatcctgatgaagcagtacatcgagtttgtggccgaccggctgctggtggagctgggcttcagcaaggtgttccaggccgagaacccctttgacttcatggagaacatcagcctggagggcaagaccaacttctttgagaagagggtgtctgagtaccagagatttgctgtgatggccgagaccacagacaacgtgttcaccctggatgctgacttctag

SEQ ID NO: 168135 - DNA, 420 bp, Artificial Sequence
  Description of Artificial Sequence: Synthetic coding sequence
atgggagaccctgagaggcctgaggccgccggcctggaccaggatgagggcctgcactgtgactttgcctgcctgatgttccagtacctggtgaacaagcccagcgaggagcgggtgcgggagatcatcgtggatgctgtgaagattgagcaggagttcctgacagaggccctgcctgtgggcctgattggcatgaactgcatcctgatgaagcagtacatcgagtttgtggccgaccggctgctggtggagctgggcttcagcaaggtgttccaggccgagaacccctttgacttcatggagaacatcagcctggagggcaagaccaacttctttgagaagagggtgtctgagtaccagagatttgctgtgatggccgagaccacagacaacgtgttcaccctggatgctgacttctag

SEQ ID NO: 168136 - DNA, 201 bp, Artificial Sequence
  Description of Artificial Sequence: Synthetic coding sequence
atgggagaccctgagaggcctgaggccgccggcctggaccaggatgaggtgttccaggccgagaacccctttgacttcatggagaacatcagcctggagggcaagaccaacttctttgagaagagggtgtctgagtaccagagatttgctgtgatggccgagaccacagacaacgtgttcaccctggatgctgacttctag

SEQ ID NO: 168137 - DNA, 132 bp, Artificial Sequence
  Description of Artificial Sequence: Synthetic coding sequence
atgggagaccctgagaggcctgaggccgccggcctggaccaggatgagaggagcagcagtgacaccaatgaaagtgagatcaagagcaatgaggagcccctgctgaggaagagcagccgccgctccttctag

SEQ ID NO: 168138 - DNA, 894 bp, Artificial Sequence
  Description of Artificial Sequence: Synthetic coding sequence
atgtacaagcaggcccaggccagcttctggacagctgaggaggtggacctgagcaaggacctgccccactggaacaagctgaaggcagatgagaagtacttcatcagccacatcctggccttctttgctgccagtgatggcatcgtgaatgaaaacctggtggagcgcttcagccaggaggtgcaggtgcctgaggcccgctgcttctacggcttccagatcctgattgaaaatgtgcacagcgagatgtacagcctgctgattgacacctacatccgggaccccaagaagcgggagttcctgttcaatgccatcgagaccatgccctacgtgaagaagaaggctgactgggccctgcgctggattgctgacaggaagagcacctttggagagcgggtggtggcctttgctgctgtggagggcgtcttcttcagcggcagctttgctgccatcttctggctgaagaagaggggcctgatgcctggcctgaccttcagcaatgaactcatcagcagagatgagggcctgcactgtgactttgcctgcctgatgttccagtacctggtgaacaagcccagcgaggagcgggtgcgggagatcatcgtggatgctgtgaagattgagcaggagttcctgacagaggccctgcctgtgggcctgattggcatgaactgcatcctgatgaagcagtacatcgagtttgtggccgaccggctgctggtggagctgggcttcagcaaggtgttccaggccgagaacccctttgacttcatggagaacatcagcctggagggcaagaccaacttctttgagaagagggtgtctgagtaccagagatttgctgtgatggccgagaccacagacaacgtgttcaccctggatgctgacttctag

SEQ ID NO: 168139 - DNA, 1824 bp, Artificial Sequence
  Description of Artificial Sequence: Synthetic coding sequence
atggaggccccagctgctggcctcttcctgctgctgctgctgggcacctgggccccagcccctggcagcgccagcagcgaggcccctcctctcatcaatgaagatgtgaagaggacagtggacctgagcagccacctggccaaggtgacagctgaggtggtgctggcccacctgggcggcggcagcaccagccgggccaccagcttcctgctggccctggagcctgagctggaggcccggctggcccacctgggcgtgcaggtgaagggagaagatgaggaggagaacaacctggaggtgcgggagaccaagatcaagggcaagagcggccgcttcttcaccgtgaagctgcctgtggccctggaccccggggccaagatcagcgtcatcgtggagaccgtgtacacccacgtgctgcacccctaccccacccagatcacccagagcgagaagcagtttgtggtgtttgagggcaaccactacttctacagcccctaccccaccaagacccagaccatgagggtgaagctggccagcagaaatgtggagagctacaccaagctgggcaaccccaccaggtctgaggacctgctggactatggccccttcagagatgtgcctgcctacagccaggacaccttcaaggtgcactatgagaacaacagccccttcctgaccatcacctccatgaccagggtcatcgaggtgagccactggggcaacattgctgtggaggagaatgtggacctgaagcacactggagctgtgctgaagggccccttcagccgctatgactaccagaggcagcctgacagcggcatcagcagcatccgctccttcaagaccatcctgcctgctgctgcccaggatgtgtactacagagatgaaattggaaatgtgtccaccagccacctgctgatcctggatgattctgtggagatggagatccggccccgcttccccctgtttggaggctggaagacccactacatcgtgggctacaacctgcccagctatgagtacctgtacaacctgggggaccagtatgccctgaagatgagatttgtggaccacgtgtttgatgagcaggtgattgacagcctgactgtgaagatcatcctgcctgagggcgccaagaacattgaaattgacagcccctatgagatcagccgggccccagatgagctgcactacacctacctggacaccttcggccggcctgtgattgtggcctacaagaagaacctggtggagcagcacatccaggacatcgtggtgcactacaccttcaacaaggtgctgatgctgcaggagcccctgctggtggtggccgccttctacatcctcttcttcaccgtcatcatctacgtgcggctggacttcagcatcaccaaggaccctgctgctgaggccaggatgaaggtggcctgcatcacagagcaggtgctgaccctggtgaacaagagaattggcctgtaccgccactttgatgaaacagtgaaccgctacaagcagagccgggacatcagcaccctgaacagcggcaagaagagcctggagacagagcacaaggccctgaccagcgagatcgccctgctgcagagccggctgaagacagagggcagtgacctgtgtgacagagtgtctgagatgcagaagctggatgcccaggtgaaggagctggtgctgaagtctgctgtggaggccgagcggctggtggccggcaagctgaagaaggacacctacattgaaaatgagaagctgatcagcggcaagaggcaggagctggtgaccaagattgaccacatcctggatgccctgtag

SEQ ID NO: 168140 - DNA, 1308 bp, Artificial Sequence
  Description of Artificial Sequence: Synthetic coding sequence
atgagggtgaagctggccagcagaaatgtggagagctacaccaagctgggcaaccccaccaggtctgaggacctgctggactatggccccttcagagatgtgcctgcctacagccaggacaccttcaaggtgcactatgagaacaacagccccttcctgaccatcacctccatgaccagggtcatcgaggtgagccactggggcaacattgctgtggaggagaatgtggacctgaagcacactggagctgtgctgaagggccccttcagccgctatgactaccagaggcagcctgacagcggcatcagcagcatccgctccttcaagaccatcctgcctgctgctgcccaggatgtgtactacagagatgaaattggaaatgtgtccaccagccacctgctgatcctggatgattctgtggagatggagatccggccccgcttccccctgtttggaggctggaagacccactacatcgtgggctacaacctgcccagctatgagtacctgtacaacctgggggaccagtatgccctgaagatgagatttgtggaccacgtgtttgatgagcaggtgattgacagcctgactgtgaagatcatcctgcctgagggcgccaagaacattgaaattgacagcccctatgagatcagccgggccccagatgagctgcactacacctacctggacaccttcggccggcctgtgattgtggcctacaagaagaacctggtggagcagcacatccaggacatcgtggtgcactacaccttcaacaaggtgctgatgctgcaggagcccctgctggtggtggccgccttctacatcctcttcttcaccgtcatcatctacgtgcggctggacttcagcatcaccaaggaccctgctgctgaggccaggatgaaggtggcctgcatcacagagcaggtgctgaccctggtgaacaagagaattggcctgtaccgccactttgatgaaacagtgaaccgctacaagcagagccgggacatcagcaccctgaacagcggcaagaagagcctggagacagagcacaaggccctgaccagcgagatcgccctgctgcagagccggctgaagacagagggcagtgacctgtgtgacagagtgtctgagatgcagaagctggatgcccaggtgaaggagctggtgctgaagtctgctgtggaggccgagcggctggtggccggcaagctgaagaaggacacctacattgaaaatgagaagctgatcagcggcaagaggcaggagctggtgaccaagattgaccacatcctggatgccctgtag

SEQ ID NO: 168141 - DNA, 1137 bp, Artificial Sequence
  Description of Artificial Sequence: Synthetic coding sequence
atgaccagggtgattgaggtgagccactggggcaacattgctgtggaggagaatgtggacctgaagcacactggagctgtgctgaagggccccttcagccgctatgactaccagaggcagccagattctggcatcagcagcatccgctccttcaagaccatcctgcctgctgctgcccaggatgtgtactacagagatgaaattggaaatgtgtccaccagccacctgctgatcctggatgacagcgtggagatggagatccggccccgcttccccctgtttggaggctggaagacccactacatcgtgggctacaacctgcccagctatgagtacctgtacaacctgggggaccagtatgccctgaagatgagatttgtggaccacgtgtttgatgagcaggtgattgacagcctgactgtgaagatcatcctgcctgagggcgccaagaacatcgagattgacagcccctatgagatcagccgggccccagatgagctgcactacacctacctggacaccttcggccggcctgtgattgtggcctacaagaagaacctggtggagcagcacatccaggacatcgtggtgcactacaccttcaacaaggtgctgatgctgcaggagcccctgctggtggtggccgccttctacatcctcttcttcaccgtcatcatctacgtgcggctggacttcagcatcaccaaggaccctgctgctgaggccaggatgaaggtggcctgcatcacagagcaggtgctgaccctggtgaacaagagaattggcctgtaccgccactttgatgagaccgtgaaccgctacaagcagagccgggacatcagcaccctgaacagcggcaagaagagcctggagacagagcacaaggccctgaccagcgagatcgccctgctgcagagccggctgaagacagagggcagtgacctgtgtgacagagtgtctgagatgcagaagctggatgcccaggtgaaggagctggtgctgaagtctgctgtggaggccgagcggctggtggccggcaagctgaagaaggacacctacattgaaaatgagaagctgatcagcggcaagaggcaggagctggtgaccaagattgaccacatcctggatgccctgtag

SEQ ID NO: 168142 - DNA, 1746 bp, Artificial Sequence
  Description of Artificial Sequence: Synthetic coding sequence
atggaggccccagctgctggcctcttcctgctgctgctgctgggcacctgggccccagcccctggcagcgccagcagcgaggcccctcctctcatcaatgaagatgtgaagaggacagtggacctgagcagccacctggccaaggtgacagctgaggtggtgctggcccacctgggcgtgcaggtgaagggagaagatgaggaggagaacaacctggaggtgcgggagaccaagatcaagggcaagagcggccgcttcttcaccgtgaagctgcctgtggccctggaccccggggccaagatcagcgtcatcgtggagaccgtgtacacccacgtgctgcacccctaccccacccagatcacccagagcgagaagcagtttgtggtgtttgagggcaaccactacttctacagcccctaccccaccaagacccagaccatgagggtgaagctggccagcagaaatgtggagagctacaccaagctgggcaaccccaccaggtctgaggacctgctggactatggccccttcagagatgtgcctgcctacagccaggacaccttcaaggtgcactatgagaacaacagccccttcctgaccatcacctccatgaccagggtcatcgaggtgagccactggggcaacattgctgtggaggagaatgtggacctgaagcacactggagctgtgctgaagggccccttcagccgctatgactaccagaggcagcctgacagcggcatcagcagcatccgctccttcaagaccatcctgcctgctgctgcccaggatgtgtactacagagatgaaattggaaatgtgtccaccagccacctgctgatcctggatgattctgtggagatggagatccggccccgcttccccctgtttggaggctggaagacccactacatcgtgggctacaacctgcccagctatgagtacctgtacaacctgggggaccagtatgccctgaagatgagatttgtggaccacgtgtttgatgagcaggtgattgacagcctgactgtgaagatcatcctgcctgagggcgccaagaacattgaaattgacagcccctatgagatcagccgggccccagatgagctgcactacacctacctggacaccttcggccggcctgtgattgtggcctacaagaagaacctggtggagcagcacatccaggacatcgtggtgcactacaccttcaacaaggtgctgatgctgcaggagcccctgctggtggtggccgccttctacatcctcttcttcaccgtcatcatctacgtgcggctggacttcagcatcaccaaggaccctgctgctgaggccaggatgaaggtggcctgcatcacagagcaggtgctgaccctggtgaacaagagaattggcctgtaccgccactttgatgaaacagtgaaccgctacaagcagagccgggacatcagcaccctgaacagcggcaagaagagcctggagacagagcacaaggccctgaccagcgagatcgccctgctgcagagccggctgaagacagagggcagtgacctgtgtgacagagtgtctgagatgcagaagctggatgcccaggtgaaggagctggtgctgaagtctgctgtggaggccgagcggctggtggccggcaagctgaagaaggacacctacattgaaaatgagaagctgatcagcggcaagaggcaggagctggtgaccaagattgaccacatcctggatgccctgtag

SEQ ID NO: 168143 - DNA, 1896 bp, Artificial Sequence
  Description of Artificial Sequence: Synthetic coding sequence
atggcccctcctggcagcagcaccgtcttcctgctggccctgaccatcatcgccagcacctgggccctgacccccacccactacctgaccaagcatgatgtggagcggctgaaggccagcctggaccggcccttcaccaacctggagagcgccttctacagcatcgtgggcctgagcagcctgggcgcccaggtgcctgatgccaagaaggcctgcacctacatccgcagcaacctggaccccagcaatgtggacagcctcttctacgccgcccaggccagccaggccctgagcggctgtgagatcagcatcagcaatgagaccaaggacctgctgctggccgctgtgtctgaggacagctctgtgacccagatctaccacgctgtggccgccctgagcggcttcggcctgcccctggccagccaggaggccctgagcgccctgacagcccggctgagcaaggaggagaccgtgctggccaccgtgcaggccctgcagacagccagccacctgagccagcaggccgacctgcggagcatcgtggaggagattgaggacctggtggcccggctggatgagctgggcggcgtgtacctgcagtttgaggagggcctggagaccacagccctgtttgtggccgccacctacaagctgatggaccacgtgggcacagagcccagcatcaaggaggaccaggtgatccagctgatgaatgccatcttcagcaagaagaactttgagagcctgtctgaggccttctctgtggccagcgctgctgctgtgctgagccacaaccgctaccacgtgcctgtggtggtggtgcctgagggcagcgccagtgacacccatgagcaggccatcctgcggctgcaggtgaccaacgtgctgagccagcccctgacccaggccaccgtgaagctggagcacgccaagtctgtggccagccgggccaccgtgctgcagaagaccagcttcacccctgtgggagatgtgtttgagctgaacttcatgaatgtgaagttcagcagcggctactatgacttcctggtggaggtggagggggacaaccgctacatcgccaacacagtggagctgcgggtgaagatcagcacagaggtgggcatcaccaacgtggacctgagcacagtggacaaggaccagagcatcgcccccaagaccaccagggtgacctacccagccaaggccaagggcaccttcatcgctgacagccaccagaactttgccctcttcttccagctggtggatgtgaacacaggagctgagctgaccccccaccagacctttgtgcggctgcacaaccagaagacaggccaggaggtggtgtttgtggccgagccagacaacaagaatgtgtacaagtttgagctggacaccagcgagaggaagattgaatttgacagcgccagcggcacctacaccctgtacctgatcattggagatgccaccctgaagaaccccatcctgtggaatgtggctgatgtggtgatcaagtttcctgaggaggaggcccccagcacagtgctgagccagaacctcttcacccccaagcaggagatccagcacctgttccgggagcctgagaagaggcccccaacagtggtgagcaacaccttcaccgccctgatcctgagccccctgctgctgctgtttgccctgtggatcagaattggagccaacgtgagcaacttcacctttgcccccagcaccatcatcttccacctgggccacgccgccatgctgggcctgatgtatgtgtactggacccagctgaacatgttccagaccctgaagtacctggccatcctgggctctgtgaccttcctggccggcaacaggatgctggcccagcaggccgtgaagaggacagcccactag

SEQ ID NO: 168144 - DNA, 1038 bp, Artificial Sequence
  Description of Artificial Sequence: Synthetic coding sequence
gtgagcccccagggcagcagcaccgtcttcctgctggccctgaccatcatcgccagcacctgggccctgacccccacccactacctgaccaagcatgatgtggagcggctgaaggccagcctggaccggcccttcaccaacctggagagcgccttctacagcatcgtgggcctgagcagcctgggcgcccaggtgcctgatgccaagaaggcctgcacctacatccgcagcaacctggaccccagcaatgtggacagcctcttctacgccgcccaggccagccaggccctgagcggctgtgagatcagcatcagcaatgagaccaaggacctgctgctggccgctgtgtctgaggacagctctgtgacccagatctaccacgctgtggccgccctgagcggcttcggcctgcccctggccagccaggaggccctgagcgccctgacagcccggctgagcaaggaggagaccgtgctggcccgggtgtggagcacagtgctggagagccgcagcctcttcagcaagaggacagtgcaggccctgcagacagccagccacctgagccagcaggccgacctgcggagcatcgtggaggagattgaggacctggtggcccggctggatgagctgggcggcgtgtacctgcagtttgaggagggcctggagaccacagccctgtttgtggccgccacctacaagctgatggaccacgtgggcacagagcccagcatcaaggaggaccaggtgatccagctgatgaatgccatcttcagcaagaagaactttgagagcctgtctgaggccttctctgtggccagcgctgctgctgtgctgagccacaaccgctaccacgtgcctgtggtggtggtgcctgagggcagcgccagtgacacccatgagcaggccatcctgcggctgcaggtgaccaacgtgctgagccagcccctgacccaggccaccgtgaagctggagcacgccaagtctgtggccagccgggccaccgtgctgcagaagaccagcttcacccctgtgggctag

SEQ ID NO: 168145 - DNA, 1848 bp, Artificial Sequence
  Description of Artificial Sequence: Synthetic coding sequence
atggcccctcctggcagcagcaccgtcttcctgctggccctgaccatcatcgccagcacctgggccctgacccccacccactacctgaccaagcatgatgtggagcggctgaaggccagcctggaccggcccttcaccaacctggagagcgccttctacagcatcgtgggcctgagcagcctgggcgcccaggtgcctgatgccaagatcagcatcagcaatgagaccaaggacctgctgctggccgctgtgtctgaggacagctctgtgacccagatctaccacgctgtggccgccctgagcggcttcggcctgcccctggccagccaggaggccctgagcgccctgacagcccggctgagcaaggaggagaccgtgctggccaccgtgcaggccctgcagacagccagccacctgagccagcaggccgacctgcggagcatcgtggaggagattgaggacctggtggcccggctggatgagctgggcggcgtgtacctgcagtttgaggagggcctggagaccacagccctgtttgtggccgccacctacaagctgatggaccacgtgggcacagagcccagcatcaaggaggaccaggtgatccagctgatgaatgccatcttcagcaagaagaactttgagagcctgtctgaggccttctctgtggccagcgctgctgctgtgctgagccacaaccgctaccacgtgcctgtggtggtggtgcctgagggcagcgccagtgacacccatgagcaggccatcctgcggctgcaggtgaccaacgtgctgagccagcccctgacccaggccaccgtgaagctggagcacgccaagtctgtggccagccgggccaccgtgctgcagaagaccagcttcacccctgtgggagatgtgtttgagctgaacttcatgaatgtgaagttcagcagcggctactatgacttcctggtggaggtggagggggacaaccgctacatcgccaacacagtggagctgcgggtgaagatcagcacagaggtgggcatcaccaacgtggacctgagcacagtggacaaggaccagagcatcgcccccaagaccaccagggtgacctacccagccaaggccaagggcaccttcatcgctgacagccaccagaactttgccctcttcttccagctggtggatgtgaacacaggagctgagctgaccccccaccagacctttgtgcggctgcacaaccagaagacaggccaggaggtggtgtttgtggccgagccagacaacaagaatgtgtacaagtttgagctggacaccagcgagaggaagattgaatttgacagcgccagcggcacctacaccctgtacctgatcattggagatgccaccctgaagaaccccatcctgtggaatgtggctgatgtggtgatcaagtttcctgaggaggaggcccccagcacagtgctgagccagaacctcttcacccccaagcaggagatccagcacctgttccgggagcctgagaagaggcccccaacagtggtgagcaacaccttcaccgccctgatcctgagccccctgctgctgctgtttgccctgtggatcagaattggagccaacgtgagcaacttcacctttgcccccagcaccatcatcttccacctgggccacgccgccatgctgggcctgatgtatgtgtactggacccagctgaacatgttccagaccctgaagtacctggccatcctgggctctgtgaccttcctggccggcaacaggatgctggcccagcaggccgtgaagagaattgctgctgagcagagcagccggctggccaagtaccgcaccctgaggacagcccactag

SEQ ID NO: 168146 - DNA, 441 bp, Artificial Sequence
  Description of Artificial Sequence: Synthetic coding sequence
ggcacctacaccctgtacctgatcattggagatgccaccctgaagaaccccatcctgtggaatgtggctgatgtggtgatcaagtttcctgaggaggaggcccccagcacagtgctgagccagaacctcttcacccccaagcaggagatccagcacctgttccgggagcctgagaagaggcccccaacagtggtgagcaacaccttcaccgccctgatcctgagccccctgctgctgctgtttgccctgtggatcagaattggagccaacgtgagcaacttcacctttgcccccagcaccatcatcttccacctgggccacgccgagcagcacatcagcagcaggaggaagatggagatcctgaagacagagtgccaggagaaggagagcaggaccatccacagcatgaggaggaagatggagaagaagaacttcatctag

SEQ ID NO: 168147 - DNA, 1038 bp, Artificial Sequence
  Description of Artificial Sequence: Synthetic coding sequence
atggcccctcctggcagcagcaccgtcttcctgctggccctgaccatcatcgccagcacctgggccctgacccccacccactacctgaccaagcatgatgtggagcggctgaaggccagcctggaccggcccttcaccaacctggagagcgccttctacagcatcgtgggcctgagcagcctgggcgcccaggtgcctgatgccaagaaggcctgcacctacatccgcagcaacctggaccccagcaatgtggacagcctcttctacgccgcccaggccagccaggccctgagcggctgtgagatcagcatcagcaatgagaccaaggacctgctgctggccgctgtgtctgaggacagctctgtgacccagatctaccacgctgtggccgccctgagcggcttcggcctgcccctggccagccaggaggccctgagcgccctgacagcccggctgagcaaggaggagaccgtgctggcccgggtgtggagcacagtgctggagagccgcagcctcttcagcaagaggacagtgcaggccctgcagacagccagccacctgagccagcaggccgacctgcggagcatcgtggaggagattgaggacctggtggcccggctggatgagctgggcggcgtgtacctgcagtttgaggagggcctggagaccacagccctgtttgtggccgccacctacaagctgatggaccacgtgggcacagagcccagcatcaaggaggaccaggtgatccagctgatgaatgccatcttcagcaagaagaactttgagagcctgtctgaggccttctctgtggccagcgctgctgctgtgctgagccacaaccgctaccacgtgcctgtggtggtggtgcctgagggcagcgccagtgacacccatgagcaggccatcctgcggctgcaggtgaccaacgtgctgagccagcccctgacccaggccaccgtgaagctggagcacgccaagtctgtggccagccgggccaccgtgctgcagaagaccagcttcacccctgtgggctag

SEQ ID NO: 168148 - DNA, 417 bp, Artificial Sequence
  Description of Artificial Sequence: Synthetic coding sequence
gagctggacaccagcgagaggaagattgaatttgattctgccagcggcacctacaccctgtacctgatcattggagatgccaccctgaagaaccccatcctgtggaatgtggctgatgtggtgatcaagtttcctgaggaggaggcccccagcacagtgctgagccagaacctcttcacccccaagcaggagatccagtggatccgcatcggggccaacgtgagcaacttcacctttgcccccagcaccatcatcttccacctgggccatgctgccatgctgggcctgatgtatgtgtactggacccagctgaacatgttccagaccctgaagtacctggccatcctgggctctgtgaccttcctggccggcaacaggatgctggcccagcaggccgtgaagaggacagctgagtag

SEQ ID NO: 168149 - DNA, 417 bp, Artificial Sequence
  Description of Artificial Sequence: Synthetic coding sequence
gagctggacaccagcgagaggaagattgaatttgattctgccagcggcacctacaccctgtacctgatcattggagatgccaccctgaagaaccccatcctgtggaatgtggctgatgtggtgatcaagtttcctgaggaggaggcccccagcacagtgctgagccagaacctcttcacccccaagcaggagatccagtggatccgcatcggggccaacgtgagcaacttcacctttgcccccagcaccatcatcttccacctgggccatgctgccatgctgggcctgatgtatgtgtactggacccagctgaacatgttccagaccctgaagtacctggccatcctgggctctgtgaccttcctggccggcaacaggatgctggcccagcaggccgtgaagaggacagcccactag

SEQ ID NO: 168150 - DNA, 504 bp, Artificial Sequence
  Description of Artificial Sequence: Synthetic coding sequence
atgcagaggacagtgcaggccctgcagacagccagccacctgagccagcaggccgacctgcggagcatcgtggaggagattgaggacctggtggcccggctggatgagctgggcggcgtgtacctgcagtttgaggagggcctggagaccacagccctgtttgtggccgccacctacaagctgatggaccacgtgggcacagagcccagcatcaaggaggaccaggtgatccagctgatgaatgccatcttcagcaagaagaactttgagagcctgtctgaggccttctctgtggccagcgctgctgctgtgctgagccacaaccgctaccacgtgcctgtggtggtggtgcctgagggcagcgccagtgacacccatgagcaggccatcctgcggctgcaggtgaccaacgtgctgagccagcccctgacccaggccaccgtgaagctggagcacgccaagtctgtggccagccgggccaccgtgctgcagaagaccagctag

SEQ ID NO: 168151 - DNA, 444 bp, Artificial Sequence
  Description of Artificial Sequence: Synthetic coding sequence
tgaggaacctacaccctgtacctgatcattggagatgccaccctgaagaaccccatcctgtggaatgtggctgatgtggtgatcaagtttcctgaggaggaggcccccagcacagtgctgagccagaacctcttcacccccaagcaggagatccagcacctgttccgggagcctgagaagaggcctcccaccgtggtgagcaacaccttcaccgccctgatcctgagccccctgctgctgctgtttgccctgtggatccgcatcggggccaacgtgagcaacttcacctttgcccccagcaccatcatcttccacctgggccatgctgagcagcacatcagcagcaggaggaagatggagatcctgaagacagagtgccaggagaaggagagcaggaccatccacagcatgaggaggaagatggagaagaagaacttcatctag

SEQ ID NO: 168152 - DNA, 936 bp, Artificial Sequence
  Description of Artificial Sequence: Synthetic coding sequence
atgcagaggcctggccccttcagcaccctgtatggccgggtgctggcccccctgcccggccgggccggcggggccgccagcggcggcggcggcaacagctgggacctgcccggcagccacgtgcggctgcccggccgggcccagagcggcacccggggcggggccggcaacaccagcaccagctgtggggacagcaacagcatctgcccagcccccagcaccatgagcaaggccgaggaggccaagaagctggccggccgggctgctgtggagaaccacgtgaggaacaaccaggtgctgggcatcggcagcggcagcaccatcgtgcatgctgtgcagagaattgctgagcgggtgaagcaggagaacctgaacctggtgtgcatccccaccagcttccaggcccggcagctgatcctgcagtatggcctgaccctgagtgacctggacagacaccctgagattgacctggccattgatggagcagatgaggtggatgctgacctgaacctgatcaagggcggcggcggctgcctgacccaggagaagatcgtggccggctacgccagccgcttcatcgtgattgctgacttcaggaaggacagcaagaacctgggggaccagtggcacaagggcatccccattgaagtcatccccatggcctacgtgcctgtgtccagagctgtgtcccagaagtttggaggagtggtggagctgaggatggctgtgaacaaggccggccctgtggtgacagacaatggaaacttcatcctggactggaagtttgacagagtgcacaagtggagcgaggtgaacacagccatcaagatgatccctggggtggtggacaccggcctcttcatcaacatggccgagcgggtgtacttcggcatgcaggacggctctgtgaacatgagggagaagcccttctgctag

SEQ ID NO: 168153 - DNA, 534 bp, Artificial Sequence
  Description of Artificial Sequence: Synthetic coding sequence
gcccggcagctgatcctgcagtatggcctgaccctgagtgacctggacagacaccctgagattgacctggccattgatggagcagatgaggtggatgctgacctgaacctgatcaagggcggcggcggctgcctgacccaggagaagatcgtggccggctacgccagccgcttcatcgtgattgctgacttcaggaaggacagcaagaacctgggggaccagtggcacaagggcatccccattgaagtcatccccatggcctacgtgcctgtgtccagagctgtgtcccagaagtttggaggagtggtggagctgaggatggctgtgaacaaggccggccctgtggtgacagacaatggaaacttcatcctggactggaagtttgacagagtgcacaagtggagcgaggtgaacacagccatcaagatgatccctggggtggtggacaccggcctcttcatcaacatggccgagcgggtgtacttcggcatgcaggacggctctgtgaacatgagggagaagcccttctgctag

SEQ ID NO: 168154 - DNA, 492 bp, Artificial Sequence
  Description of Artificial Sequence: Synthetic coding sequence
atgagaattgagaagtgctacttctgcagcggccccatctacccaggccacggcatgatgtttgtgagaaatgactgcaaggtgttccgcttctgcaagagcaagtgccacaagaacttcaagaagaagaggaaccccaggaaggtgcgctggaccaaggccttcaggaaggctgctgggaaggagctgactgtggacaacagctttgaatttgagaagagaagaaatgagcccatcaagtaccagcgggagctgtggaacaagaccattgatgccatgaagagggtggaggagatcaagcagaagaggcaggccaagttcatcatgaaccggctgaagaagaacaaggagctgcagaaggtgcaggacatcaaggaggtgaagcagaacatccacctgatccgggcccccctggccggcaagggcaagcagctggaggagaagatggtgcagcagctgcaggaggatgtggacatggaggatgccccctag

SEQ ID NO: 168155 - DNA, 1161 bp, Artificial Sequence
  Description of Artificial Sequence: Synthetic coding sequence
atgtgcagctctgtggccgccaagctgtggttcctgacagaccggcgcatccgggaggactacccccagaaggagatcctgcgggccctgaaggccaagtgctgtgaggaggagctggacttccgggctgtggtgatggatgaggtggtgctgaccatcgagcagggcaacctgggcctgcgcatcaatggagagctgatcacagcctacccccaggtggtggtggtgcgggtgcccaccccctgggtgcagagcgacagcgacatcaccgtgctgcggcacctggagaagatgggctgccgcctgatgaaccggccccaggccatcctgaactgtgtgaacaagttctggaccttccaggagctggccggccatggagtgcccctgcctgacaccttctcctatggaggccatgaaaattttgccaagatgattgatgaggccgaggtgctggagttccccatggtggtgaagaacacccggggccaccggggcaaggctgtgttcctggcccgggacaagcaccacctggccgacctgagccacctgatcagacatgaggccccctacctgttccagaagtatgtgaaggagagccacggcagagatgtgcgggtgattgtggtgggcggccgggtggtgggcaccatgctgcgctgcagcacagatggccgcatgcagagcaactgcagcctgggcggcgtgggcatgatgtgcagcctgtctgagcagggcaagcagctggccatccaggtgagcaacatcctgggcatggatgtgtgtggcatcgacctgctgatgaaggatgatggcagcttctgtgtgtgtgaggccaatgccaacgtgggcttcatcgcctttgacaaggcctgcaacctggatgtggccggcatcatcgctgactatgctgccagcctgctgcccagcggccgcctgaccaggaggatgagcctgctgtctgtggtgtccacagccagcgagaccagcgagcctgagctgggccccccagccagcacagctgtggacaacatgtctgccagcagcagctctgtggacagcgaccctgagagcacagagcgggagctgctgaccaagctgcccggcggcctcttcaacatgaaccagctgctggccaatgagatcaagctgctggtggactag

SEQ ID NO: 168156 - DNA, 1161 bp, Artificial Sequence; identical to SEQ ID NO: 168155
  Description of Artificial Sequence: Synthetic coding sequence

SEQ ID NO: 168157 - DNA, 1161 bp, Artificial Sequence; identical to SEQ ID NO: 168155
  Description of Artificial Sequence: Synthetic coding sequence

SEQ ID NO: 168158 - DNA, 288 bp, Artificial Sequence
  Description of Artificial Sequence: Synthetic coding sequence
atgtgcagctctgtggccgccaagctgtggttcctgacagaccggcgcatccgggaggactacccccagaaggagatcctgcgggccctgaaggccaagtgctgtgaggaggagctggacttccgggctgtggtgatggatgaggtggtgctgaccatcgagcagggcaacctgggcctgcgcatcaatggagagctgatcacagcctacccccaggtggtggtggtgcgggtgcccaccccctgggtgcagagcgacagcgacatcaccgtgctgcggcacctgtag

SEQ ID NO: 168159 - DNA, 345 bp, Artificial Sequence
  Description of Artificial Sequence: Synthetic coding sequence
atgtgcagctctgtggccgccaagctgtggttcctgacagaccggcgcatccgggaggactacccccagaaggagatcctgcgggccctgaaggccaagtgctgtgaggaggagctggacttccgggctgtggtgatggatgaggtggtgctgaccatcgagcagggcaacctgggcctgcgcatcaatggagagctgatcacagcctacccccaggtggtggtggtgcgggtgcccaccccctgggtgcagagcgacagcgacatcaccgtgctgcggcacctggagaagatgggctgccgcctgatgaaccggccccaggccatcctgaactgtgtgaactag

SEQ ID NO: 168160 - DNA, 645 bp, Artificial Sequence
  Description of Artificial Sequence: Synthetic coding sequence
atgggcagaagacctgcccgctgctaccgctactgcaagaacaagccctaccccaagagccgcttctgccggggcgtgcctgatgccaagatccgcatctttgacctgggcaggaagaaggccaaggtggatgagttccccctgtgtggccacatggtgtctgatgaatatgagcagctgagcagcgaggccctggaggccgcccgcatctgtgccaacaagtacatggtgaagagctgtgggaaggatggcttccacatccgggtgcggctgcaccccttccacgtgatccgcatcaacaagatgctgagctgtgccggggctgaccggctgcagacaggcatgagaggagccttcggcaagccccagggcaccgtggcccgggtgcacatcggccaggtgatcatgagcatccgcaccaagctgcagaacaaggagcacgtgattgaggccctgcggcgggccaagttcaagtttcctggccggcagaagatccacatcagcaagaagtggggcttcaccaagttcaatgctgatgaatttgaggacatggtggccgagaagaggctcatcccagatggctgcggcgtgaagtacatccccaacagaggccccctggacaagtggagggccctgcacagctag

SEQ ID NO: 168161 - DNA, 645 bp, Artificial Sequence; identical to SEQ ID NO: 168160
  Description of Artificial Sequence: Synthetic coding sequence

SEQ ID NO: 168162 - DNA, 645 bp, Artificial Sequence; identical to SEQ ID NO: 168160
  Description of Artificial Sequence: Synthetic coding sequence

SEQ ID NO: 168163 - DNA, 606 bp, Artificial Sequence
  Description of Artificial Sequence: Synthetic coding sequence
atgggcagaagacctgcccgctgctaccgctactgcaagaacaagccctaccccaagagccgcttctgccggggcgtgcctgatgccaagatccgcatctttgacctgggcaggaagaaggccaaggtggatgagttccccctgtgtggccacatggtgtctgatgaatatgagcagctgagcagcgaggccctggaggccgcccgcatctgtgccaacaagtacatggtgaagagctgtgggaaggatggcttccacatccgggtgcggctgcaccccttccacgtgatccgcatcaacaagatgctgagctgtgccggggctgaccggctgcagacaggcatgagaggagccttcggcaagccccagggcaccgtggcccgggtgcacatcggccaggtgatcatgagcatccgcaccaagctgcagaacaaggagcacgtgattgaggccctgcggcgggccaagttcaagtttcctggccggcagaagatccacatcagcaagaagtggggcttcaccaagttcaatgctgatgaatttgaggacatggtggccgagaagaggctcatcccagatggctgcggcgtgaagtacatcccctag

SEQ ID NO: 168164 - DNA, 327 bp, Artificial Sequence
  Description of Artificial Sequence: Synthetic coding sequence
cccaagagccgcttctgccggggcgtgcctgatgccaagatccgcatctttgacctgggcaggaagaaggccaaggtggatgagttccccctgtgtggccacatggtgtctgatgaatatgagcagctgagcagcgaggccctggaggccgcccgcatctgtgccaacaagtacatggtgaagagctgtgggaaggatggcttccacatccgggtgcggctgcaccccttccacgtgatccgcatcaacaagatgctgagctgtgccggggctgaccggcccaccctgctgtgccagtgctgggagaccagcaggaacaccagctag

SEQ ID NO: 168165 - DNA, 546 bp, Artificial Sequence
  Description of Artificial Sequence: Synthetic coding sequence
atgggcagaagacctgcccgctgctaccgctactgcaagaacaagccctaccccaagagccgcttctgccggggcgtgcctgatgccaagatccgcatctttgacctgggcaggaagaaggccaaggtggatgagttccccctgtgtggccacatggtgtctgatgaatatgagcagctgagcagcgaggccctggaggccgcccgcatctgtgccaacaagtacatggtgaagagctgtgggaaggatggcttccacatccgggtgcggctgcaccccttccacgtgatccgcatcaacaagatgctgagctgtgccggggctgacaggagcaccagccagaggtctggggccagccccagctccatgctgatgaacctgaagacctggtggctgaagagcggcagcagccagatggctgtgggcagcagcaccagccccatcgtggccctgtggaccagcggcggcccctgcacccatgagggcttccagtgtgccgcccccctgctgatcctgaccaacaagttctacttcctgagcacctag

SEQ ID NO: 168166 - DNA, 537 bp, Artificial Sequence
  Description of Artificial Sequence: Synthetic coding sequence
atggcccaggaccagggcgagaaggagaaccccatgagggagctgcgcatcaggaagctgtgcctgaacatctgtgtgggggagagcggggaccggctgacccgggccgccaaggtgctggagcagctgaccggccagacccctgtgttcagcaaggcccgctacacagtgcgcagctttggcatcagaagaaatgagaagattgctgtgcactgcaccgtgcggggggccaaggccgaggagatcctggagaagggcctgaaggtgcgggagtatgagctgaggaagaacaacttcagtgacaccggcaactttggatttggcatccaggagcacatcgacctgggcatcaagtatgaccccagcatcggcatctacggcctggacttctacgtggtgctgggccggcccggcttcagcattgctgacaagaagagaagaacaggctgcattggagccaagcaccgcatcagcaaggaggaggccatgcgctggttccagcagaagtatgatggcatcatcctgcccgggaagtag

SEQ ID NO: 168167 - DNA, 396 bp, Artificial Sequence
  Description of Artificial Sequence: Synthetic coding sequence
caggaccagggcgagaaggagaaccccatgagggagctgcgcatcaggaagctgtgcctgaacatctgtgtgggggagagcggggaccggctgacccgggccgccaaggtgctggagcagctgaccggccagacccctgtgttcagcaaggcccgctacacagtgcgcagctttggcatcagaagaaatgagaagattgctgtgcactgcaccgtgcggggggccaaggccgaggagatcctggagaagggcctgaaggtgcgggagtatgagctgaggaagaacaacttcagtgacaccggcaactttggatttggcatccaggagcacatcgacctgggcatcaagtatgaccccagcatcggcatctacggcctggacttctacgtggtgtag

SEQ ID NO: 168168 - DNA, 525 bp, Artificial Sequence
  Description of Artificial Sequence: Synthetic coding sequence
caggaccagggcgagaaggagaaccccatgagggagctgcgcatcaggaagctgtgcctgaacatctgtgtgggggagagcggggaccggctgacccgggccgccaaggtgctggagcagctgaccggccagacccctgtgttcagcaaggcccgctacacagtgcgcagctttggcatcagaagaaatgagaagattgctgtgcactgcaccgtgcggggggccaaggccgaggagatcctggagaagggcctgaaggtgcgggagtatgagctgaggaagaacaacttcagtgacaccggcaactttggatttggcatccaggagcacatcgacctgggcatcaagtatgaccccagcatcggcatctacggcctggacttctacgtggtgctgggccggcccggcttcagcattgctgacaagaagagaagaacaggctgcattggagccaagcaccgcatcagcaaggaggaggccatgcgctggttccagcagaaggtgaagctgatctacctgaagtag

SEQ ID NO: 168169 - DNA, 498 bp, Artificial Sequence
  Description of Artificial Sequence: Synthetic coding sequence
atgccacccaagtttgaccccaatgagatcaaggtggtgtacctgcgctgcaccggcggggaggtgggcgccaccagcgccctggcccccaagattggccccctgggcctgagccccaagaaggtgggagatgacatcgccaaggccaccggggactggaagggcctgcgcatcaccgtgaagctgaccatccagaaccggcaggcccagatcgaggtggtgcccagcgccagcgccctgatcatcaaggccctgaaggagcccccccgggacaggaagaagcagaagaacatcaagcacagcggcaacatcacctttgatgaaattgtgaacatcgcccggcagatgaggcacaggagcctggcccgggagctgagcggcaccatcaaggagatcctgggcacagcccagagcgtgggctgcaatgtggatggccgccacccccatgacatcattgatgacatcaacagcggggctgtggagtgcccagccagctag

SEQ ID NO: 168170 - DNA, 399 bp, Artificial Sequence
  Description of Artificial Sequence: Synthetic coding sequence
atgccacccaagtttgaccccaatgagatcaaggtggtgtacctgcgctgcaccggcggggaggtgggcgccaccagcgccctggcccccaagattggccccctgggcctcatcgaggtggtgcccagcgccagcgccctgatcatcaaggccctgaaggagcccccccgggacaggaagaagcagaagaacatcaagcacagcggcaacatcacctttgatgagatcgtgaacatcgcccggcagatgaggcacaggagcctggcccgggagctgagcggcaccatcaaggagatcctgggcacagcccagagcgtgggctgcaatgtggatggccgccacccccatgacatcattgatgacatcaacagcggggctgtggagtgcccagccagctag

SEQ ID NO: 168171 - DNA, 636 bp, Artificial Sequence
  Description of Artificial Sequence: Synthetic coding sequence
atggcccccagcagaaatggcatggtgctgaagccccacttccacaaggactggcagaggagagtggccacctggttcaaccagcctgccaggaagatcagaagaaggaaggcccggcaggccaaggcccggcgcatcgcccccaggcctgccagcggccccatccggcccatcgtgcgctgccccaccgtgcgctaccacaccaaggtgcgggccggccggggcttcagcctggaggagctgcgggtggccggcatccacaagaaggtggcccggaccatcggcatctctgtggaccccaggagaagaaacaagagcacagagagcctgcaggccaacgtgcagaggctgaaggagtaccgcagcaagctgatcctcttccccaggaagcccagcgcccccaagaagggggacagcagcgctgaggagctgaagctggccacccagctgactggacctgtgatgcctgtgagaaatgtgtacaagaaggagaaggcccgggtcatcacagaggaggagaagaacttcaaggcctttgccagcctgaggatggcccgggccaatgcccggctgtttggcatccgggccaagagggccaaggaggccgctgagcaggatgtggagaagaagaagtag

SEQ ID NO: 168172 - DNA, 636 bp, Artificial Sequence; identical to SEQ ID NO: 168171
  Description of Artificial Sequence: Synthetic coding sequence

SEQ ID NO: 168173 - DNA, 495 bp, Artificial Sequence
  Description of Artificial Sequence: Synthetic coding sequence
atggcccccagcagaaatggcatggtgctgaagccccacttccacaaggactggcagaggagagtggccacctggttcaaccagcctgccaggaagatcagaagaaggaaggcccggcaggccaaggcccggcgcatcgcccccaggcctgccagcggccccatccggcccatcgtgcgctgccccaccgtgcgctaccacaccaaggtgcgggccggccggggcttcagcctggaggagctgcgggtggccggcatccacaagaagggggacagcagcgctgaggagctgaagctggccacccagctgaccggccctgtgatgcctgtgagaaatgtgtacaagaaggagaaggcccgggtcatcacagaggaggagaagaacttcaaggcctttgccagcctgaggatggcccgggccaatgcccggctgtttggcatccgggccaagagggccaaggaggccgctgagcaggatgtggagaagaagaagtag

SEQ ID NO: 168174 - DNA, 615 bp, Artificial Sequence
  Description of Artificial Sequence: Synthetic coding sequence
atgggcgcctacaagtacatccaggagctgtggaggaagaagcagagtgatgtgatgaggttcctgctgcgggtgcgctgctggcagtaccggcagctgagcgccctgcaccgggccccccggcccaccaggccagacaaggcccggcggctgggctacaaggccaagcagggctacgtgatctaccgcatccgggtgagaagaggaggcaggaagaggcctgtgcccaagggggccacctacggcaagcctgtgcaccacggcgtgaaccagctgaagtttgcccggagcctgcagagcgtggccgaggagcgggccggccgccactgtggggccctgcgggtgctgaacagctactgggtgggggaggacagcacctacaagttctttgaggtgatcctgattgaccccttccacaaggccatcagaagaaatccagacacccagtggatcaccaagcctgtgcacaagcaccgggagatgaggggcctgaccagcgctggcaggaagagccggggcctgggcaagggccacaagttccaccacaccatcggcggcagccggcgggccgcctggaggagaagaaacaccctgcagctgcaccgctacagatag

SEQ ID NO: 168175 - DNA, 615 bp, Artificial Sequence; identical to SEQ ID NO: 168174
  Description of Artificial Sequence: Synthetic coding sequence

SEQ ID NO: 168176 - DNA, 528 bp, Artificial Sequence
  Description of Artificial Sequence: Synthetic coding sequence
atgggcgcctacaagtacatccaggagctgtggaggaagaagcagagtgatgtgatgaggttcctgctgcgggtgcgctgctggcagtaccggcagctgagcgccctgcaccgggccccccggcccaccaggccagacaaggcccggcggctgggctacaaggccaagcagggctacgtgatctaccgcatccgggtgagaagaggaggcaggaagaggcctgtgcccaagggggccacctacggcaagcctgtgcaccacggcgtgaaccagctgaagtttgcccggagcctgcagagcgtggccgaggtgaatgccggccgccactgtggggccctgcgggtgctgaacagctactgggtgggggaggacagcacctacaagttctttgaggtgatcctgattgaccccttccacaaggccatcagaagaaatccagacacccagtggatcaccaagcctgtgcacaagcaccgggagatgaggggcctgaccagcgctggcaggaagagccggggcctgggctag

SEQ ID NO: 168177 - DNA, 615 bp, Artificial Sequence; identical to SEQ ID NO: 168174
  Description of Artificial Sequence: Synthetic coding sequence

SEQ ID NO: 168178 - DNA, 615 bp, Artificial Sequence; identical to SEQ ID NO: 168174
  Description of Artificial Sequence: Synthetic coding sequence

SEQ ID NO: 168179 - DNA, 402 bp, Artificial Sequence
  Description of Artificial Sequence: Synthetic coding sequence
atgggcgcctacaagtacatccaggagctgtggaggaagaagcagagtgatgtgatgaggttcctgctgcgggtgcgctgctggcagtaccggcagctgagcgccctgcaccgggccccccggcccaccaggccagacaaggcccggcggctgggctacaaggccaagcagggctacgtgatctaccgcatccgggtgagaagaggaggcaggaagaggcctgtgcccaagggggccacctacggcaagcctgtgcaccacggcgtgaaccagctgaagtttgcccggagcctgcagagcgtggccgaggagcgggccggccgccactgtggggccctgcgggtgctgaacagctactgggtgggggaggacagcacctacaagttctttgaggtgatctag

SEQ ID NO: 168180 - DNA, 525 bp, Artificial Sequence
  Description of Artificial Sequence: Synthetic coding sequence
atgggcgcctacaagtacatccaggagctgtggaggaagaagcagagtgatgtgatgaggttcctgctgcgggtgcgctgctggcagtaccggcagctgagcgccctgcaccgggccccccggcccaccaggccagacaaggcccggcggctgggctacaaggccaagcagggctacgtgatctaccgcatccgggtgagaagaggaggcaggaagaggcctgtgcccaagggggccacctacggcaagcctgtgcaccacggcgtgaaccagctgaagtttgcccggagcctgcagagcgtggccgaggagcgggccggccgccactgtggggccctgcgggtgctgaacagctactgggtgggggaggacagcacctacaagttctttgaggtgatcctgattgaccccttccacaaggccatcagaagaaatccagacacccagtggatcaccaagcctgtgcacaagcaccgggagatgaggggcctgaccagcgctggcaggaagagccggggcctgtag

SEQ ID NO: 168181 - DNA, 615 bp, Artificial Sequence; identical to SEQ ID NO: 168174
  Description of Artificial Sequence: Synthetic coding sequence

SEQ ID NO: 168182 - DNA, 180 bp, Artificial Sequence
  Description of Artificial Sequence: Synthetic coding sequence
atgggcgcctacaagtacatccaggagctgtggaggaagaagcagagtgatgtgatgaggttcctgctgcgggtgcgctgctggcagtaccggcagctgagcgccctgcaccgggccccccggcccaccaggccagacaaggcccggcggctgggctacaaggccaagcagggcacctag

SEQ ID NO: 168183 - DNA, 438 bp, Artificial Sequence
  Description of Artificial Sequence: Synthetic coding sequence
atgggcgcctacaagtacatccaggagctgtggaggaagaagcagagtgatgtgatgaggttcctgctgcgggtgcgctgctggcagtaccggcagctgagcgccctgcaccgggccccccggcccaccaggccagacaaggcccggcggctgggctacaaggccaagcagggctacgtgatctaccgcatccgggtgagaagaggaggcaggaagaggcctgtgcccaagggggccacctacggcaagcctgtgcaccacggcgtgaaccagctgaagtttgcccggagcctgcagagcgtggccgaggagcgggccggccgccactgtggggccctgcgggtgctgaacagctactggatggagagccacagccacagcggcggcagcgctgtgggccagagccggctgacagccacctctgtgtcccgggtgtag

SEQ ID NO: 168184 - DNA, 495 bp, Artificial Sequence
  Description of Artificial Sequence: Synthetic coding sequence
atgggcgcctacaagtacatccaggagctgtggaggaagaagcagagtgatgtgatgaggttcctgctgcgggtgcgctgctggcagtaccggcagctgagcgccctgcaccgggccccccggcccaccaggccagacaaggcccggcggctgggctacaaggccaagcagggctacgtgatctaccgcatccgggtgagaagaggaggcaggaagaggcctgtgcccaagggggccacctacggcaagcctgtgcaccacggcgtgaaccagctgaagtttgcccggagcctgcagagcgtggccgaggagcgggccggccgccactgtggggccctgcgggtgcacaagcaccgggagatgaggggcctgaccagcgctggcaggaagagccggggcctgggcaagggccacaagttccaccacaccatcggcggcagccggcgggccgcctggaggagaagaaacaccctgcagctgcaccgctacagatag

SEQ ID NO: 168185 - DNA, 441 bp, Artificial Sequence
  Description of Artificial Sequence: Synthetic coding sequence
atgcacatcaggaaggccaccaagtacctgaaggatgtgaccctgcagaagcagtgtgtgcccttccgccgctacaacggcggcgtgggccgctgtgcccaggccaagcagtggggctggacccagggccgctggcccaagaagtctgctgagttcctgctgcacatgctgaagaatgctgagagcaatgctgagctgaagggcctggatgtggacagcctggtgattgagcacatccaggtgaacaaggcccccaagatgagaagaaggacctaccgggcccacggccgcatcaacccctacatgagcagcccctgccacatcgagatgatcctgacagagaaggagcagatcgtgcccaagccagaggaggaggtggcccagaagaagaagatcagccagaagaagctgaagaagcagaagctgatggcccgggagtag

SEQ ID NO: 168186 - DNA, 555 bp, Artificial Sequence
  Description of Artificial Sequence: Synthetic coding sequence
atggtgcgctacagcctggaccctgagaaccccaccaagagctgcaagagccggggcagcaacctgcgggtgcacttcaagaacacccgggagacagcccaggccatcaagggcatgcacatcaggaaggccaccaagtacctgaaggatgtgaccctgcagaagcagtgtgtgcccttccgccgctacaacggcggcgtgggccgctgtgcccaggccaagcagtggggctggacccagggccgctggcccaagaagtctgctgagttcctgctgcacatgctgaagaatgctgagagcaatgctgagctgaagggcctggatgtggacagcctggtgattgagcacatccaggtgaacaaggcccccaagatgagaagaaggacctaccgggcccacggccgcatcaacccctacatgagcagcccctgccacatcgagatgatcctgacagagaaggagcagatcgtgcccaagccagaggaggaggtggcccagaagaagaagatcagccagaagaagctgaagaagcagaagctgatggcccgggagtag

SEQ ID NO: 168187 - DNA, 555 bp, Artificial Sequence; identical to SEQ ID NO: 168186
  Description of Artificial Sequence: Synthetic coding sequence

SEQ ID NO: 168188 - DNA, 573 bp, Artificial Sequence
  Description of Artificial Sequence: Synthetic coding sequence
tgaccccagggcgtggacatccgccacaacaaggacaggaaggtgcggaggaaggagcccaagagccaggacatctacctgcggctgctggtgaagctgtaccgcttcctggcccggaggaccaacagcaccttcaaccaggtggtgctgaagaggctcttcatgagcaggaccaacagaccacccctgagcctgagcaggatgatcaggaagatgaagctgcccggccgggagaacaagacagctgtggtggtgggcaccatcacagatgatgtgcgggtgcaggaggtgcccaagctgaaggtgtgtgccctgcgggtgaccagccgggcccggagccgcatcctgcgggccggcggcaagatcctgacctttgaccagctggccctggacagccccaagggctgcggcaccgtgctgctgagcggccccaggaagggccgggaggtgtaccgccactttgggaaggcccctggcaccccccacagccacaccaagccctacgtgcgcagcaagggcaggaagtttgagcgggcccggggccggcgggccagccggggctacaagaactag

SEQ ID NO: 168189 - DNA, 408 bp, Artificial Sequence
  Description of Artificial Sequence: Synthetic coding sequence
atgggcgtggacatccgccacaacaaggacaggaaggtgcggaggaaggagcccaagagccaggacatctacctgcggctgctggtgaagctgtaccgcttcctggcccggaggaccaacagcaccttcaaccaggtggtgctgaagaggctcttcatgagcaggaccaacagaccacccctgagcctgagcaggatgatcaggaagatgaagctgcccggccgggagaacaagacagctgtggtggtgggcaccatcacagatgatgtgcgggtgcaggaggtgcccaagctgaaggtgtcctggaggggcctgggccggcccatccggcccctgctgtactgtgctgtgctgtgctgtgctgtgctgtgctgcctggtgcacccccagagctgccaccgctggtag

SEQ ID NO: 168190 - DNA, 567 bp, Artificial Sequence
  Description of Artificial Sequence: Synthetic coding sequence
atgggcgtggacatccgccacaacaaggacaggaaggtgcggaggaaggagcccaagagccaggacatctacctgcggctgctggtgaagctgtaccgcttcctggcccggaggaccaacagcaccttcaaccaggtggtgctgaagaggctcttcatgagcaggaccaacagaccacccctgagcctgagcaggatgatcaggaagatgaagctgcccggccgggagaacaagacagctgtggtggtgggcaccatcacagatgatgtgcgggtgcaggaggtgcccaagctgaaggtgtgtgccctgcgggtgaccagccgggcccggagccgcatcctgcgggccggcggcaagatcctgacctttgaccagctggccctggacagccccaagggctgcggcaccgtgctgctgagcggccccaggaagggccgggaggtgtaccgccactttgggaaggcccctggcaccccccacagccacaccaagccctacgtgcgcagcaagggcaggaagtttgagcgggcccggggccggcgggccagccggggctacaagaactag

SEQ ID NO: 168191 - DNA, 480 bp, Artificial Sequence
  Description of Artificial Sequence: Synthetic coding sequence
atgctgtaccgcttcctggcccggaggaccaacagcaccttcaaccaggtggtgctgaagaggctcttcatgagcaggaccaaccggccccccctgagcctgagcaggatgatcaggaagatgaagctgcccggccgggagaacaagacagctgtggtggtgggcaccatcacagatgatgtgcgggtgcaggaggtgcccaagctgaaggtgtgtgccctgcgggtgaccagccgggcccggagccgcatcctgcgggccggcggcaagatcctgacctttgaccagctggccctggacagccccaagggctgcggcaccgtgctgctgagcggccccaggaagggccgggaggtgtaccgccactttgggaaggcccctggcaccccccacagccacaccaagccctacgtgcgcagcaaaggaaggaagtttgagcgggcccggggcagaagagccagccggggctacaagaactag

SEQ ID NO: 168192 - DNA, 795 bp, Artificial Sequence
  Description of Artificial Sequence: Synthetic coding sequence
atgaacatcctgcccaagaagtcctggcacgtgaggaacaaggacaacgtggcccgggtgagaagagatgaggcccaggcccgggaggaggagaaggagcgggagcggcgggtgctgctggcccagcaggaggccaggacagagttcctgaggaagaaggcccggcaccagaacagcctgcctgagctggaggccgctgaggccggggcccctggcagcggccctgtggacctcttccgggagctgctggaggagggcaaaggagtcatccggggcaacaaggagtatgaggaggagaagaggcaggagaaggagcggcaggagaaggccctgggcatcctgacctacctgggccagagcgctgctgaggcccagacccagcccccctggtaccagctgcccccaggccggggcggccccccacctggccctgccccagatgagaagatcaagagccggctggaccccctgcgggagatgcagaagcacctgggcaagaagaggcagcacggcggagatgagggcagccgcagcaggaaggagaaggagggcagcgagaagcagaggcccaaggagccccccagcctggaccagctgcgggcagagcggctgcggcgggaggccgctgagaggagcagagctgaggccctgctggcccgggtgcagggccgggccctgcaggagggccagccagaagaagatgaaacagatgacagaagaagacgctacaacagccagttcaacccccagctggcccggcggccccggcagcaggacccccacctgacccactag

SEQ ID NO: 168193 - DNA, 465 bp, Artificial Sequence
  Description of Artificial Sequence: Synthetic coding sequence
atgaaggccagcggcaccctgcgggagtacaaggtggtgggccgctgcctgcccacccccaagtgccacaccccacccctgtacaggatgaggatctttgcccccaaccacgtggtggccaagagccgcttctggtactttgtgtcccagctgaagaagatgaagaagagcagcggggagatcgtgtactgcggccaggtgtttgagaagagccccctgcgggtgaagaactttggcatctggctgcgctatgacagccgcagcggcacccacaacatgtaccgggagtacagagacctgaccacagctggagctgtgacccagtgctacagagacatgggcgcccggcaccgggcccgggcccacagcatccagatcatgaaggtggaggagattgctgccagcaagtgccggcggcagcacaagccccgcttcaccaccaagaggcccaacaccttcttctag

SEQ ID NO: 168194 - DNA, 1278 bp, Artificial Sequence
  Description of Artificial Sequence: Synthetic coding sequence
atgggcggcggggacctgaacctgaagaagtcctggcacccccagaccctgagaaatgtggagaaggtgtggaaggccgagcagaagcatgaggccgagaggaagaagattgaggagctgcagcgggagctgcgggaggagcgggcccgggaggagatgcagagatatgcagaagatgtgggcgctgtgaagaagaaggaggagaagctggactggatgtaccagggccctgggggcatggtgaacagagatgagtacctgctgggccggcccatcgacaagtatgtgtttgagaagatggaggagaaggaggccggctgcagcagcgagaccggcctgctgcccggcagcatctttgcccccagcggggccaacagcctgctggacatggccagcaagatccgggaggaccccctcttcatcatcaggaagaaggaggaggagaagaagcgggaggtgctgaacaaccctgtgaagatgaagaagatcaaggagctgctgcagatgagcctggagaagaaggagaagaagaagaagaaggagaagaagaagaagcacaagaagcacaagcacaggagcagcagcagtgacaggagcagcagtgaagatgagcacagcgctggccgcagccagaagaagatggccaacagcagccctgtgctgagcaaggtgcccggctacggcctgcaggtgaggaacagcgacaggaaccagggcctgcagggccccctgacagctgagcagaagaggggccacggcatgaagaaccacagccgcagccgcagcagcagccacagccccccaagacatgccagcaagaagagcacccgggaggccggcagccgggaccggcgcagccgcagcctgggcagaagaagccgcagcccccggcccagcaagctgcacaacagcaaggtgaacagaagagaaacaggccagaccaggagccccagccccaagaaggaggtgtaccagaggagacatgcccctggctacaccaggaagctgtctgctgaggagctggagaggaagaggcaggagatgatggagaatgccaagtggagggaggaggagcggctgaacatcctgaagagacatgccaaggatgaggagcgggagcagaggctggagaagctggacagcagagatggcaagttcatccacaggatgaagctggagagcgccagcaccagcagcctggaggacagagtgaagaggaacatctacagcctgcagaggacctctgtggccctggagaagaacttcatgaagaggtag

SEQ ID NO: 168195 - DNA, 483 bp, Artificial Sequence
  Description of Artificial Sequence: Synthetic coding sequence
atgaccaacaccaagggcaagaggcggggcacccgctacatgttcagccggcccttcaggaagcacggcgtggtgcccctggccacctacatgaggatctacaagaagggggacatcgtggacatcaagggcatgggcaccgtgcagaagggcatgccccacaagtgctaccacggcaagacaggccgggtgtacaacgtgacccagcacgctgtgggcatcgtggtgaacaagcaggtgaagggcaagatcctggccaagaggatcaacgtgagaattgagcacatcaagcacagcaagagccgggacagcttcctgaagagggtgaaggaaaatgaccagaagaagaaggaggccaaggagaagggcacctgggtgcagctgaagaggcagcctgccccaccccgggaggcccactttgtgaggaccaacgggaaggagcctgagctgctggagcccatcccctatgagttcatggcctag

SEQ ID NO: 168196 - DNA, 483 bp, Artificial Sequence; identical to SEQ ID NO: 168195
  Description of Artificial Sequence: Synthetic coding sequence

SEQ ID NO: 168197 - DNA, 483 bp, Artificial Sequence; identical to SEQ ID NO: 168195
  Description of Artificial Sequence: Synthetic coding sequence

SEQ ID NO: 168198 - DNA, 483 bp, Artificial Sequence; identical to SEQ ID NO: 168195
  Description of Artificial Sequence: Synthetic coding sequence

SEQ ID NO: 168199 - DNA, 972 bp, Artificial Sequence
  Description of Artificial Sequence: Synthetic coding sequence
atggccgcccccaagggcagcctgtgggtgaggacccagctgggcctgccccccctgctgctgctgaccatggccctggccggcggcagcggcacagccagcgctgaggcctttgacagcgtgctgggggacacagccagctgccaccgggcctgccagctgacctaccccctgcacacctaccccaaggaggaggagctgtatgcctgccagaggggctgccgcctcttcagcatctgccagtttgtggatgatggcatcgacctgaacagaaccaagctggagtgtgagagcgcctgcacagaggcctacagccagagtgatgagcagtatgcctgccacctgggctgccagaaccagctgccctttgctgagctgcggcaggagcagctgatgagcctgatgcccaagatgcacctgctcttccccctgaccctggtgcgctccttctggagcgacatgatggattctgcccagagcttcatcaccagctcctggaccttctacctgcaggctgatgatggcaagatcgtcatcttccagagcaagccagagatccagtatgccccccacctggagcaggagcccaccaacctgcgggagagcagcctgagcaagatgagctacctgcagatgaggaacagccaggcccacaggaacttcctggaggatggagagagtgatggcttcctgcgctgcctgagcctgaacagcggctggatcctgaccaccaccctggtgctgtctgtgatggtgctgctgtggatctgctgtgccaccgtggccacagctgtggagcagtatgtgcccagcgagaagctgagcatctatggagacctggagttcatgaatgagcagaagctgaaccgctacccagccagcagcctggtggtggtgcgcagcaagacagaggaccacgaggaggccggccccctgcccaccaaggtgaacctggcccacagcgagatctag

SEQ ID NO: 168200 - DNA, 276 bp, Artificial Sequence
  Description of Artificial Sequence: Synthetic coding sequence
atggccggcagcagaagagaatgtagaagaggaggcagcagcggggccaagttccgcatcagcctgggcctgcctgtgggcgccgtcatcaactgtgccgacaacacaggagccaagaacctgtacatcatctctgtgaagggcatcaagggccgcctgaaccggctgcctgctgctggggtgggggacatggtgatggccaccgtgaagaagggcaagccagagctgaggaagaaggtgcaccctgctgtggtgatccggcagaggaagagctag

SEQ ID NO: 168201 - DNA, 423 bp, Artificial Sequence
  Description of Artificial Sequence: Synthetic coding sequence
atgagcaagaggggccggggcggcagcagcggggccaagttccgcatcagcctgggcctgcctgtgggcgccgtcatcaactgtgccgacaacacaggagccaagaacctgtacatcatctctgtgaagggcatcaagggccgcctgaaccggctgcctgctgctggggtgggggacatggtgatggccaccgtgaagaagggcaagccagagctgaggaagaaggtgcaccctgctgtggtgatccggcagaggaagagctacagaaggaaggatggagtcttcctgtactttgaagataatgctggggtgattgtgaacaacaagggggagatgaagggcagcgccatcaccggccctgtggccaaggaatgtgccgacctgtggccccgcatcgccagcaatgccggcagcatcgcctag

SEQ ID NO: 168202 - DNA, 345 bp, Artificial Sequence
  Description of Artificial Sequence: Synthetic coding sequence
atgagcaagaggggccggggcggcagcagcggggccaagttccgcatcagcctgggcctgcctgtgggcgccgtcatcaactgtgccgacaacacaggagccaagaacctgtacatcatctctgtgaagggcatcaagggccgcctgaaccggctgcctgctgctggggtgggggacatggtgatggccaccgtgaagaagggcaagccagagctgaggaagaaggtgctgctgtgccacacaggctggagcgctgtgacccccctgaagctgactgtgaccctgaactgctggacctggaaccccccagctgtggccttcaagggcctgcagctgcaggtgtag

SEQ ID NO: 168203 - DNA, 423 bp, Artificial Sequence; identical to SEQ ID NO: 168201
  Description of Artificial Sequence: Synthetic coding sequence

SEQ ID NO: 168204 - DNA, 477 bp, Artificial Sequence
  Description of Artificial Sequence: Synthetic coding sequence
tgactggtgggcgccccctgcccccgggccagccctgccccacccaaggccgaggccaaggccaaggccctgaaggccaagaaggctgtgctgaagggcgtgcacagccacaagaagaagaagatccgcaccagccccaccttcagaagacccaagaccctgcggctgcggcggcagcccaagtaccccaggaagagcgcccccaggaggaacaagctggaccactacgccatcatcaagttccccctgaccacagaaagtgccatgaagaagattgaggacaacaacaccctggtgttcatcgtggatgtgaaggccaacaagcaccagatcaagcaggccgtgaagaagctgtatgacattgatgtggccaaggtgaacaccctcatccggccagatggagagaagaaggcctacgtgcggctggccccagactatgatgccctggatgtggccaacaagattggcatcatctag

SEQ ID NO: 168205 - DNA, 477 bp, Artificial Sequence
  Description of Artificial Sequence: Synthetic coding sequence
atgagccctggcctggtggtgctgcgctgggccccagccccacccaaggccgaggccaaggccaaggccctgaaggccaagaaggctgtgctgaagggcgtgcacagccacaagaagaagaagatccgcaccagccccaccttcagaagacccaagaccctgcggctgcggcggcagcccaagtaccccaggaagagcgcccccaggaggaacaagctggaccactacgccatcatcaagttccccctgaccacagaaagtgccatgaagaagattgaggacaacaacaccctggtgttcatcgtggatgtgaaggccaacaagcaccagatcaagcaggccgtgaagaagctgtatgacattgatgtggccaaggtgaacaccctcatccggccagatggagagaagaaggcctacgtgcggctggccccagactatgatgccctggatgtggccaacaagattggcatcatctag

SEQ ID NO: 168206 - DNA, 585 bp, Artificial Sequence
  Description of Artificial Sequence: Synthetic coding sequence
atgcaccccctggtgggcgccccctgcccccgggcctgcaaggagctggtgcccagcgccctgaccatcttcctgctggtgcacgtgcagcccggctacatcacccggcccagcctgcggtctgtggtgctgcgctgggccccagccccacccaaggccgaggccaaggccaaggccctgaaggccaagaaggctgtgctgaagggcgtgcacagccacaagaagaagaagatccgcaccagccccaccttcagaagacccaagaccctgcggctgcggcggcagcccaagtaccccaggaagagcgcccccaggaggaacaagctggaccactacgccatcatcaagttccccctgaccacagaaagtgccatgaagaagattgaggacaacaacaccctggtgttcatcgtggatgtgaaggccaacaagcaccagatcaagcaggccgtgaagaagctgtatgacattgatgtggccaaggtgaacaccctcatccggccagatggagagaagaaggcctacgtgcggctggccccagactatgatgccctggatgtggccaacaagattggcatcatctag

SEQ ID NO: 168207 - DNA, 471 bp, Artificial Sequence
  Description of Artificial Sequence: Synthetic coding sequence
atggcccccaaggccaagaaggaggccccagccccacccaaggccgaggccaaggccaaggccctgaaggccaagaaggctgtgctgaagggcgtgcacagccacaagaagaagaagatccgcaccagccccaccttcagaagacccaagaccctgcggctgcggcggcagcccaagtaccccaggaagagcgcccccaggaggaacaagctggaccactacgccatcatcaagttccccctgaccacagaaagtgccatgaagaagattgaggacaacaacaccctggtgttcatcgtggatgtgaaggccaacaagcaccagatcaagcaggccgtgaagaagctgtatgacattgatgtggccaaggtgaacaccctcatccggccagatggagagaagaaggcctacgtgcggctggccccagactatgatgccctggatgtggccaacaagattggcatcatctag

SEQ ID NO: 168208 - DNA, 474 bp, Artificial Sequence
  Description of Artificial Sequence: Synthetic coding sequence
atgaaggtggagctgtgcagcttcagcggctacaagatctacccaggccatggaagaagatatgccaggacagatggcaaggtgttccagttcctgaatgccaagtgtgagagcgccttcctgagcaagaggaacccccggcagatcaactggacagtgctgtacagaaggaagcacaagaagggccagagcgaggagatccagaagaagaggaccaggagagctgtgaagttccagagggccatcactggagccagcctggccgacatcatggccaagaggaaccagaagccagaggtgaggaaggcccagcgggagcaggccatccgggccgccaaggaggccaagaaggccaagcaggccagcaagaagacagccatggctgctgccaaggcccccaccaaggccgcccccaagcagaagatcgtgaagcctgtgaaggtgtctgccccccgggtgggcggcaagaggtag

SEQ ID NO: 168209 - DNA, 453 bp, Artificial Sequence
  Description of Artificial Sequence: Synthetic coding sequence
atgaaggtggagctgtgcagcttcagcggctacaagatctacccaggccatggaagaagatatgccaggacagatggcaaggtgttccagttcctgaatgccaagtgtgagagcgccttcctgagcaagaggaacccccggcagatcaactggacagtgctgtacagaaggaagcacaagaagggccagagcgaggagatccagaagaagaggaccaggagagctgtgaagttccagagggccatcactggagccagcctggccgacatcatggccaagaggaaccagaagccagaggtgaggaaggcccagcgggagcaggccatccgggccgccaaggaggccaagaaggccaagcaggccagcaagaagacagccatggctgctgccaaggtgatcatgggcttcctgtacttcctggagcagtacaacaggaagatcttcttcttctag

SEQ ID NO: 168210 - DNA, 438 bp, Artificial Sequence
  Description of Artificial Sequence: Synthetic coding sequence
atgaagttcaacccctttgtgaccagtgacaggagcaagaacaggaagaggcacttcaatgcccccagccacatccggaggaagatcatgagcagccccctgagcaaggagctgcggcagaagtacaacgtgcgctccatgcccatcaggaaggatgatgaggtgcaggtggtgcggggccactacaagggccagcagatcggcaaggtggtgcaggtgtacaggaagaagtatgtgatctacatcgagcgggtgcagcgggagaaggccaacggcaccaccgtgcacgtgggcatccaccccagcaaggtggtgatcacccggctgaagctggacaaggacaggaagaagatcctggagaggaaggccaagagccggcaggtgggcaaggagaagggcaagtacaaggaggagaccatcgagaagatgcaggagtag

SEQ ID NO: 168211 - DNA, 411 bp, Artificial Sequence
  Description of Artificial Sequence: Synthetic coding sequence
atgggcaagttcatgaagccaggcaaggtggtgctggtgctggccggccgctacagcggcaggaaggctgtgattgtgaagaacattgatgatggcaccagtgaccggccctacagccacgccctggtggccggcatcgaccgctaccccaggaaggtgacagctgccatgggcaagaagaagatcgccaagaggagcaagatcaagagctttgtgaaggtgtacaactacaaccacctgatgcccacccgctacagcgtggacatccccctggacaagacagtggtgaacaaggatgtgttccgggaccctgccctgaagaggaaggcccggcgggaggccaaggtgaagtttgaggagcgctacaagacaggcaagaacaagtggttcttccagaagctgcgcttctag

SEQ ID NO: 168212 - DNA, 447 bp, Artificial Sequence
  Description of Artificial Sequence: Synthetic coding sequence
atgcccagccggctgaggaagaccaggaagctgcggggccacgtgagccacggccacggccgcatcggcaagcacaggaagcaccctgggggcagaggaaatgccggcggcctgcaccaccaccgcatcaactttgacaagtaccaccctggctactttgggaaggtgggcatgaagcactaccacctgaagaggaaccagagcttctgccccaccgtgaacctggacaagctgtggaccctggtgtctgagcagaccagggtgaatgctgccaagaacaagacaggagctgcccccatcattgatgtggtgcgcagcggctactacaaggtgctgggcaagggcaagctgcccaagcagcctgtgattgtgaaggccaagttcttcagcagaagagctgaggagaagatcaagtctgtgggcggggcctgtgtgctggtggcctag

SEQ ID NO: 168213 - DNA, 327 bp, Artificial Sequence
  Description of Artificial Sequence: Synthetic coding sequence
atgcccagccggctgaggaagaccaggaagctgcggggccacgtgagccacggccacggccgcatcggcaagcacaggaagcaccctgggggcagaggaaatgccggcggcctgcaccaccaccgcatcaactttgacaagtaccaccctggctactttgggaaggtgggcatgaagcactaccacctgaagaggaaccagagcttctgccccaccgtgaacctggacaagctgtggaccctggtgtctgagcagaccagggtgaatgctgccaagaacaagacaggagctgcccccatcattgatgtggtgcgctctgtgtcctag

SEQ ID NO: 168214 - DNA, 414 bp, Artificial Sequence
  Description of Artificial Sequence: Synthetic coding sequence
atgtctgcccacctgcagtggatggtggtgaggaactgcagcagcttcctgatcaagaggaacaagcagacctacagcacagagcccaacaacctgaaggccagaaattccttccgctacaacggcctcatccacaggaagacagtgggcgtggagcctgctgctgatggcaagggcgtggtggtggtgatcaagaggaggagcggccagaggaagccagccaccagctatgtgaggaccaccatcaacaagaatgcccgggccaccctgagcagcatccgccacatgatcaggaagaacaagtacagaccagacctgaggatggccgccatccggcgggccagcgccatcctgcggagccagaagcctgtgatggtgaagaggaagaggacccggcccaccaagagcagctag

SEQ ID NO: 168215 - DNA, 210 bp, Artificial Sequence
  Description of Artificial Sequence: Synthetic coding sequence
atgtctgcccacctgcagtggatggtggtgaggaactgcagcagcttcctgatcaagaggaacaagcagacctacagcacagagcccaacaacctgaaggccagaaattccttccgctacaacggcctcatccacaggaagacagtgggcgtggagcctgctgctgatggcaagggcgtggtggtggtgatcaagagaagaagtgaatag

SEQ ID NO: 168216 - DNA, 264 bp, Artificial Sequence
  Description of Artificial Sequence: Synthetic coding sequence
atgtctgcccacctgcagtggatggtggtgaggaactgcagcagcttcctgatcaagaggaacaagcagacctacagcacagagcccaacaacctgaaggccagaaattccttccgctacaacggcctcatccacaggaagacagtgggcgtggagcctgctgctgatggcaagggcgtggtggtggtgatcaagagaagaagtggagagttctgcctggtgtgggcccgggagcggcccctgagccgggtgtgggagctgtag

SEQ ID NO: 168217 - DNA, 510 bp, Artificial Sequence
  Description of Artificial Sequence: Synthetic coding sequence
atgtctgcccacctgcagtggatggtggtgaggaactgcagcagcttcctgatcaagaggaacaagcagacctacagcacagagcccaacaacctgaaggccagaaattccttccgctacaacggcctcatccacaggaagacagtgggcgtggagcctgctgctgatggcaagggcgtggtggtggtgatcaagaggaggagcggccagaggaagccagccaccagctatgtgaggaccaccatcaacaagaatgcccgggccaccctgagcagcatccgccacatgatcaggaagaacaagtacagaccagacctgaggatggacatgctggccagcacaggcagcggcctgtgctgcagcgtggccgtgcagccctgggccagcagcagcaccagcctgtgcctgcggaccctcatctgcaacatgagggtggaccggccctactacagcggcctgatgaggcggctgaatgtgcagaacctgctggactgtgcccacaagagctag

SEQ ID NO: 168218 - DNA, 510 bp, Artificial Sequence; identical to SEQ ID NO: 168217
  Description of Artificial Sequence: Synthetic coding sequence

SEQ ID NO: 168219 - DNA, 414 bp, Artificial Sequence; identical to SEQ ID NO: 168214
  Description of Artificial Sequence: Synthetic coding sequence

SEQ ID NO: 168220 - DNA, 492 bp, Artificial Sequence
  Description of Artificial Sequence: Synthetic coding sequence
atgtctgcccacctgcagtggatggtggtgaggaactgcagcagcttcctgatcaagaggaacaagcagacctacagcacagagcccaacaacctgaaggccagaaattccttccgctacaacggcctcatccacaggaagacagtgggcgtggagcctgctgctgatggcaagggcgtggtggtggtgatcaagaggaggagcggccagaggaagccagccaccagctatgtgaggaccaccatcaacaagaatgcccgggccaccctgagcagcatccgccacatgatcaggaagaacaagtacagaccagacctgaggatggtgtcctggggcctgggcatccggctgggggagaccggccagtgctgcggggagggcccccccaccaccggctgcaacatgggctggaggggcatggacagctgcttccagcccaccccccacacccagcactggccccggggccgcctggtggagtgcatgggctag

SEQ ID NO: 168221 - DNA, 480 bp, Artificial Sequence
  Description of Artificial Sequence: Synthetic coding sequence
atggccaagagcaagaaccacaccacccacaaccagagcaggaagtggcacagaaatggcatcaagaagcccaggagccagagatatgagagcctgaagggcgtggaccccaagttcctgaggaacatgagatttgccaagaagcacaacaagaagggcctgaagaagatgcaggccaacaatgccaaggccatgtctgcccgggcagaggccatcaaggccctggtgaagcccaaggaggtgaagcccaagatccccaagggcgtgtccaggaagctggaccggctggcctacatcgcccaccccaagctgggcaagagggcccgggcccgcatcgccaagggcctgcggctgtgccggcccaaggccaaggccaaggccaaggccaaggaccagaccaaggcccaggccgccgccccagcctctgtgcctgcccaggcccccaagaggacccaggcccccaccaaggccagcgagtag

SEQ ID NO: 168222 - DNA, 480 bp, Artificial Sequence; identical to SEQ ID NO: 168221
  Description of Artificial Sequence: Synthetic coding sequence

SEQ ID NO: 168223 - DNA, 480 bp, Artificial Sequence; identical to SEQ ID NO: 168221
  Description of Artificial Sequence: Synthetic coding sequence

SEQ ID NO: 168224 - DNA, 480 bp, Artificial Sequence; identical to SEQ ID NO: 168221
  Description of Artificial Sequence: Synthetic coding sequence

SEQ ID NO: 168225 - DNA, 480 bp, Artificial Sequence; identical to SEQ ID NO: 168221
  Description of Artificial Sequence: Synthetic coding sequence

SEQ ID NO: 168226 - DNA, 480 bp, Artificial Sequence; identical to SEQ ID NO: 168221
  Description of Artificial Sequence: Synthetic coding sequence

SEQ ID NO: 168227 - DNA, 648 bp, Artificial Sequence
  Description of Artificial Sequence: Synthetic coding sequence
atgcccttccaccctgtgacagctgccctgatgtaccggggcatctacacagtgcccaacctgctgtctgagcagaggcctgtggacatcccagaagatgagctggaggagatccgggaggccttcaaggtgtttgacagagatggaaatggcttcatcagcaagcaggagctgggcacagccatgaggagcctgggctacatgcccaatgaggtggagctggaggtgatcatccagaggctggacatggatggagatggccaggtggactttgaggagtttgtgaccctgctgggccccaagctgagcaccagcggcatccctgagaagttccacggcacagactttgacaccgtcttctggaagtgtgacatgcagaagctgactgtggatgagctgaagaggctgctgtatgacaccttctgtgagcacctgtccatgaaggacatcgagaacatcatcatgacagaggaggagagccacctgggcacagcagaagaatgtcctgtggatgtggagacctgcagcaaccagcagatccggcagacctgtgtgaggaagagcctcatctgtgcctttgccatcgccttcatcatctctgtgatgctgattgctgccaaccaggtgctgcggagcggcatgaagtag

SEQ ID NO: 168228 - DNA, 1056 bp, Artificial Sequence
  Description of Artificial Sequence: Synthetic coding sequence
atgacccacatcgtgcgggaggtggacaggcctggcagcaaggtgaacaagaaggaggtggtggaggccgtgaccatcgtggagaccccacccatggtggtggtgggcatcgtgggctacgtggagaccccccggggcctgcggaccttcaagacagtgtttgctgagcacatcagtgatgagtgcaagaggcgcttctacaagaactggcacaagagcaagaagaaggccttcaccaagtactgcaagaagtggcaggatgaagatggcaagaagcagctggagaaggacttcagctccatgaagaagtactgccaggtgatccgggtgattgcccacacccagatgaggctgctgcccctgcggcagaagaaggcccacctgatggagatccaggtgaatggaggcaccgtggccgagaagctggactgggcccgggagcggctggagcagcaggtgcctgtgaaccaggtgtttggccaggatgagatgattgatgtgattggagtgaccaagggcaagggctacaagggcgtgaccagccgctggcacaccaagaagctgcccaggaagacccaccggggcctgaggaaggtggcctgcatcggggcctggcacccagcccgggtggccttctctgtggcccgggccggccagaagggctaccaccacaggacagagatcaacaagaagatctacaagattggccagggctacctgatcaaggatggcaagctgatcaagaacaatgccagcacagattatgacctgagtgacaagagcatcaaccccctgggcggctttgtgcactatggagaggtgaccaatgactttgtgatgctgaagggctgtgtggtgggcaccaagaagagggtgctgaccctgaggaagagcctgctggtgcagaccaagagaagagccctggagaagattgacctgaagttcatcgacaccaccagcaagtttggccacggccgcttccagaccatggaggagaagaaggccttcatgggccccctgaagaaggacagaattgccaaggaggagggcgcctag

SEQ ID NO: 168229 - DNA, 348 bp, Artificial Sequence
  Description of Artificial Sequence: Synthetic coding sequence
atggtggccgccaagaagaccaagaagagcctggagagcatcaacagccggctgcagctggtgatgaagagcggcaagtatgtgctgggctacaagcagaccctgaagatgatccggcagggcaaggccaagctggtgatcctggccaacaactgcccagccctgaggaagtcagaaattgagtactatgccatgctggccaagacaggagtgcaccactacagcggcaacaacatcgagctgggcacagcctgtgggaagtactacagagtgtgcaccctggccatcattgatcctggggacagcgacatcatccgctccatgcctgagcagacaggagagaagtag

SEQ ID NO: 168230 - DNA, 348 bp, Artificial Sequence; identical to SEQ ID NO: 168229
  Description of Artificial Sequence: Synthetic coding sequence

SEQ ID NO: 168231 - DNA, 345 bp, Artificial Sequence
  Description of Artificial Sequence: Synthetic coding sequence
atggtggccgccaagaagaccaagaagagcctggagagcatcaacagccggctgcagctggtgatgaagagcggcaagtatgtgctgggctacaagcagaccctgaagatgatccggcagggcaaggccaagctggtgatcctggccaacaactgcccagccctgaggaagtcagaaattgagtactatgccatgctggccaagacaggagtgcaccactacagcggcaacaacatcgagctgggcacagcctgtgggaagtactacagagtgtgcaccctggccatcattgatcctggggacagcgacatcatccgctccatgcctgagcagacaggagagtag

SEQ ID NO: 168232 - DNA, 285 bp, Artificial Sequence
  Description of Artificial Sequence: Synthetic coding sequence
atgagcggccgcctgtggagcaaggccatctttgctggctacaagaggggcctgaggaaccagcgggagcacacagccctgctgaagattgagggcgtgtatgccagagatgaaacagagttctacctgggcaagagatgtgcctacgtgtacaaggccaagaacaacacagtgacccctgggggcaagcccaacaagaccagggtcatctggggcaaggtgacccgggcccacggcaacagcggcatggtgcgggccaagttccgcagcaacctgcctgcctag

SEQ ID NO: 168233 - DNA, 333 bp, Artificial Sequence
  Description of Artificial Sequence: Synthetic coding sequence
atgagcggccgcctgtggagcaaggccatctttgctggctacaagaggggcctgaggaaccagcgggagcacacagccctgctgaagattgagggcgtgtatgccagagatgaaacagagttctacctgggcaagagatgtgcctacgtgtacaaggccaagaacaacacagtgacccctgggggcaagcccaacaagaccagggtcatctggggcaaggtgacccgggcccacggcaacagcggcatggtgcgggccaagttccgcagcaacctgcctgccaaggccatcggccaccgcatccgggtgatgctgtaccccagccgcatctag

SEQ ID NO: 168234 - DNA, 333 bp, Artificial Sequence; identical to SEQ ID NO: 168233
  Description of Artificial Sequence: Synthetic coding sequence

SEQ ID NO: 168235 - DNA, 396 bp, Artificial Sequence
  Description of Artificial Sequence: Synthetic coding sequence
tgactgccctttgccagccgcttcctgtccttccgggctgacagcgcccacgcctccatggtgaatgtgcccaagaccaggaggaccttctgcaagaagtgtgggaagcaccagccccacaaggtgacccagtacaagaagggcaaggacagcctgtatgcccagggcaagagaagatatgacaggaagcagagcggctatggaggccagaccaagcccatcttcaggaagaaggccaagaccaccaagaagatcgtgctgcggctggagtgtgtggagcccaactgccgcagcaagaggatgctggccatcaagcgctgcaagcactttgagctgggcggggacaagaagaggaaggtgtacaactacggctggaaggtgcagagcttctcctag

SEQ ID NO: 168236 - DNA, 429 bp, Artificial Sequence
  Description of Artificial Sequence: Synthetic coding sequence
atgattgcccccacagacagccatgaggaggtgcgcagcggcaccagctacatcctgccctttgccagccgcttcctgtccttccgggctgacagcgcccacgcctccatggtgaatgtgcccaagaccaggaggaccttctgcaagaagtgtgggaagcaccagccccacaaggtgacccagtacaagaagggcaaggacagcctgtatgcccagggcaagagaagatatgacaggaagcagagcggctacggcggccagaccaagcccatcttcaggaagaaggccaagaccaccaagaagatcgtgctgcggctggagtgtgtggagcccaactgccgcagcaagaggatgctggccatcaagcgctgcaagcactttgagctgggcggggacaagaagaggaagggccaggtgatccagttctag

SEQ ID NO: 168237 - DNA, 321 bp, Artificial Sequence
  Description of Artificial Sequence: Synthetic coding sequence
atggtgaatgtgcccaagaccaggaggaccttctgcaagaagtgtgggaagcaccagccccacaaggtgacccagtacaagaagggcaaggacagcctgtatgcccagggcaagagaagatatgacaggaagcagagcggctacggcggccagaccaagcccatcttcaggaagaaggccaagaccaccaagaagatcgtgctgcggctggagtgtgtggagcccaactgccgcagcaagaggatgctggccatcaagcgctgcaagcactttgagctgggcggggacaagaagaggaagggccaggtgatccagttctag

SEQ ID NO: 168238 - DNA, 321 bp, Artificial Sequence
  Description of Artificial Sequence: Synthetic coding sequence
atggtgaatgtgcccaagaccaggaggaccttctgcaagaagtgtgggaagcaccagccccacaaggtgacccagtacaagaagggcaaggacagcctgtatgcccagggcagaagaagatatgacaggaagcagagcggctacggcggccagaccaagcccatcttcaggaagaaggccaagaccaccaagaagatcgtgctgcggctggagtgtgtggagcccaactgccgcagcaagaggatgctggccatcaagcgctgcaagcactttgagctgggcggggacaagaagaggaagggccaggtgatccagttctag

SEQ ID NO: 168239 - DNA, 294 bp, Artificial Sequence
  Description of Artificial Sequence: Synthetic coding sequence
atgaccaagggcaccagcagctttgggaagagaagaaacaagacccacaccctgtgccgccgctgtggcagcaaggcctaccacctgcagaagagcacctgtgggaaatgtggctacccagccaagaggaagaggaagtacaactggagcgccaaggccaagagaagaaacaccactggaactggaaggatgaggcacctgaagatcgtgtaccgccgcttccgccacggcttccgggagggcaccacccccaagcccaagagagctgctgtggccgccagcagcagcagctag

SEQ ID NO: 168240 - DNA, 207 bp, Artificial Sequence
  Description of Artificial Sequence: Synthetic coding sequence
atggtgaagaagattgagatcagccagcacgccaagtacacctgcagcttctgtgggaagaccaagatgaagagaagagctgtgggcatctggcactgcggcagctgcatgaagacagtggccggcggggcctggacctacaacaccaccagcgctgtgacagtgaagagcgccatccggcggctgaaggagctgaaggaccagtag

SEQ ID NO: 168241 - DNA, 279 bp, Artificial Sequence
  Description of Artificial Sequence: Synthetic coding sequence
atggccaagaggaccaagaaggtgggcatcgtgggcaagtatggcacccgctacggggccagcctgaggaagatggtgaagaagattgagatcagccagcacgccaagtacacctgcagcttctgtgggaagaccaagatgaagagaagagctgtgggcatctggcactgcggcagctgcatgaagacagtggccggcggggcctggacctacaacaccaccagcgctgtgacagtgaagagcgccatccggcggctgaaggagctgaaggaccagtag

SEQ ID NO: 168242 - DNA, 213 bp, Artificial Sequence
  Description of Artificial Sequence: Synthetic coding sequence
atgcccaggaagattgaggagatcaaggacttcctgctgacagcccggaggaaggatgccaagtctgtgaagatcaagaagaacaaggacaacgtgaagttcaaggtgcgctgcagccgctacctgtacaccctggtgatcacagacaaggagaaggccgagaagctgaagcagagcctgcccccaggcctggccgtgaaggagctgaagtag

SEQ ID NO: 168243 - DNA, 213 bp, Artificial Sequence; identical to SEQ ID NO: 168242
  Description of Artificial Sequence: Synthetic coding sequence

SEQ ID NO: 168244 - DNA, 213 bp, Artificial Sequence; identical to SEQ ID NO: 168242
  Description of Artificial Sequence: Synthetic coding sequence

SEQ ID NO: 168245 - DNA, 156 bp, Artificial Sequence
  Description of Artificial Sequence: Synthetic coding sequence
atgagcagccacaagaccttcaccatcaagcgcttcctggccaagaagcagaagcagaaccggcccatcccccagtggatccagatgaagccaggcagcaagatccgctacaacagcaagagaagacactggaggaggaccaagctgggcctgtag

SEQ ID NO: 168246 - DNA, 156 bp, Artificial Sequence; identical to SEQ ID NO: 168245
  Description of Artificial Sequence: Synthetic coding sequence

SEQ ID NO: 168247 - DNA, 156 bp, Artificial Sequence; identical to SEQ ID NO: 168245
  Description of Artificial Sequence: Synthetic coding sequence

SEQ ID NO: 168248 - DNA, 1284 bp, Artificial Sequence
  Description of Artificial Sequence: Synthetic coding sequence
atggcctgtgcccggcccctcatctctgtgtacagcgagaagggggagagcagcggcaagaatgtgaccctgcctgctgtgttcaaggcccccatccggccagacatcgtgaactttgtgcacaccaacctgaggaagaacaaccggcagccctatgctgtgtctgagctggccggccaccagaccagcgctgagagctggggcaccggccgggctgtggcccgcatcccccgggtgcggggcggcggcacccacaggagcggccagggcgccttcggcaacatgtgccggggcggccgcatgtttgcccccaccaagacctggaggcgctggcacagaagagtgaacaccacccagaagagatatgccatctgcagcgccctggccgccagcgccctgcctgccctggtgatgagcaagggccaccgcatcgaggaggtgcctgagctgcccctggtggtggaggacaaggtggagggctacaagaagaccaaggaggccgtgctgctgctgaagaagctgaaggcctggaatgacatcaagaaggtgtatgccagccagaggatgagagctgggaagggcaagatgaggaacagaagacgcatccagaggcggggcccctgcatcatctacaatgaagataatggcatcatcaaggccttcaggaacatccctggcatcaccctgctgaatgtgtccaagctgaacatcctgaagctggcccctgggggccacgtgggccgcttctgcatctggacagaaagtgccttcaggaagctggatgagctgtatggcacctggaggaaggccgccagcctgaagagcaactacaacctgcccatgcacaagatgatcaacacagacctgagccgcatcctgaagagccctgagatccagagggccctgcgggcccccaggaagaagatccacagaagagtgctgaagaagaaccccctgaagaacctgcgcatcatgctgaagctgaacccctatgccaagaccatgagaagaaacaccatcctgcggcaggccaggaaccacaagctgcgggtggacaaggctgctgctgctgctgctgccctgcaggccaagagtgatgagaaggctgctgtggccggcaagaagcctgtggtgggcaagaagggcaagaaggctgctgtgggcgtgaagaagcagaagaagcccctggtgggcaagaaggccgccgccaccaagaagccagcccctgagaagaagccagctgagaagaagcccaccacagaggagaagaagccagctgcctag

SEQ ID NO: 168249 - DNA, 1221 bp, Artificial Sequence
  Description of Artificial Sequence: Synthetic coding sequence
atggcctgtgcccggcccctcatctctgtgtacagcgagaagggggagagcagcggcaagaatgtgaccctgcctgctgtgttcaaggcccccatccggccagacatcgtgaactttgtgcacaccaacctgaggaagaacaaccggcagccctatgctgtgtctgagctggccggccaccagaccagcgctgagagctggggcaccggccgggctgtggcccgcatcccccgggtgcggggcggcggcacccacaggagcggccagggcgccttcggcaacatgtgccggggcggccgcatgtttgcccccaccaagacctggaggcgctggcacagaagagtgaacaccacccagaagagatatgccatctgcagcgccctggccgccagcgccctgcctgccctggtgatgagcaagggccaccgcatcgaggaggtgcctgagctgcccctggtggtggaggacaaggtggagggctacaagaagaccaaggaggccgtgctgctgctgaagaagctgaaggcctggaatgacatcaagaaggtgtatgccagccagaggatgagagctgggaagggcaagatgaggaacagaagacgcatccagaggcggggcccctgcatcatctacaatgaagataatggcatcatcaaggccttcaggaacatccctggcatcaccctgctgaatgtgtccaagctgaacatcctgaagctggcccctgggggccacgtgggccgcttctgcatctggacagaaagtgccttcaggaagctggatgagctgtatggcacctggaggaaggccgccagcctgaagagcaactacaacctgcccatgcacaagatgatcaacacagacctgagccgcatcctgaagagccctgagatccagagggccctgcgggcccccaggaagaagatccacagaagagtgctgaagaagaaccccctgaagaacctgcgcatcatgctgaagctgaacccctatgccaagaccatgagaagaaacaccatcctgcggcaggccaggaaccacaagctgcgggtggacaaggctgctgctgctgctgctgccctgcaggccaagagtgatgagaaggctgctgtggccggcaagaagcctgtggtgggcaagaagggcaagaaggctgctgtgggggagaagaagccagctgagaagaagcccaccacagaggagaagaagccagctgcctag

SEQ ID NO: 168250 - DNA, 456 bp, Artificial Sequence
  Description of Artificial Sequence: Synthetic coding sequence
atggcctgtgcccggcccctcatctctgtgtacagcgagaagggggagagcagcggcaagaatgtgaccctgcctgctgtgttcaaggcccccatccggccagacatcgtgaactttgtgcacaccaacctgaggaagaacaaccggcagccctatgctgtgtctgagctggccggccaccagaccagcgctgagagctggggcaccggccgggctgtggcccgcatcccccgggtgcggggcggcggcacccacaggagcggccagggcgccttcggcaacatgtgccggggcggccgcatgtttgcccccaccaagacctggaggcgctggcacagaagagtgaacaccacccagaagctggagaaccacgtggaggccaagcccatctgcaaggaccacgcccctgagcaccacagcagccctggccaggagagccaggcccctgggggctag

SEQ ID NO: 168251 - DNA, 78 bp, Artificial Sequence
  Description of Artificial Sequence: Synthetic coding sequence
atgagggccaagtggaggaagaagaggatgaggcggctgaagaggaagaggaggaagatgaggcagaggagcaagtag

SEQ ID NO: 168252 - DNA, 78 bp, Artificial Sequence; identical to SEQ ID NO: 168251
  Description of Artificial Sequence: Synthetic coding sequence

SEQ ID NO: 168253 - DNA, 381 bp, Artificial Sequence
  Description of Artificial Sequence: Synthetic coding sequence
atgattgtgcgggtgaccaacagagacatcatctgccagatcgcctatgccagaattgaaggagacatgattgtgtgtgccgcctatgcccacgagctgcccaagtatggagtgaaggtgggcctgaccaactatgctgctgcctactgcaccggcctgctgctggcccggcggctgctgaacagatttggcatggacaagatctatgagggccaggtggaggtgactggagatgagtacaacgtggagagcattgatggccagcccggggccttcacctgctacctggatgctggcctggcccggaccaccactggaaacaaggtgtttggagccctgaagggagctgtggatggcggcctgagcatcccccacaggtag

SEQ ID NO: 168254 - DNA, 894 bp, Artificial Sequence
  Description of Artificial Sequence: Synthetic coding sequence
atgggctttgtgaaggtggtgaagaacaaggcctacttcaagcgctaccaggtgaagttcagaagaagaagagagggcaagacagactactatgccaggaagaggctggtgatccaggacaagaacaagtacaacacccccaagtacaggatgattgtgcgggtgaccaacagagacatcatctgccagatcgcctatgccagaattgaaggagacatgattgtgtgtgccgcctatgcccacgagctgcccaagtatggagtgaaggtgggcctgaccaactatgctgctgcctactgcaccggcctgctgctggcccggcggctgctgaacagatttggcatggacaagatctatgagggccaggtggaggtgactggagatgagtacaacgtggagagcattgatggccagcccggggccttcacctgctacctggatgctggcctggcccggaccaccactggaaacaaggtgtttggagccctgaagggagctgtggatggcggcctgagcatcccccacagcaccaagcgcttccctggctatgattctgagagcaaggagttcaatgctgaggtgcacaggaagcacatcatgggccagaatgtggccgactacatgagatacctgatggaggaggatgaagatgcctacaagaagcagttcagccagtacatcaagaacagcgtgaccccagacatgatggaggagatgtacaagaaggcccatgctgccatcagagaaaatcctgtgtatgagaagaagcccaagaaggaggtgaagaagaagcgctggaaccggcccaagatgagcctggcccagaagaaggacagagtggcccagaagaaggccagcttcctgcgggcccaggagagagctgctgagagctag

SEQ ID NO: 168255 - DNA, 744 bp, Artificial Sequence
  Description of Artificial Sequence: Synthetic coding sequence
atgattgtgcgggtgaccaacagagacatcatctgccagatcgcctatgccagaattgaaggagacatgattgtgtgtgccgcctatgcccacgagctgcccaagtatggagtgaaggtgggcctgaccaactatgctgctgcctactgcaccggcctgctgctggcccggcggctgctgaacagatttggcatggacaagatctatgagggccaggtggaggtgactggagatgagtacaacgtggagagcattgatggccagcccggggccttcacctgctacctggatgctggcctggcccggaccaccactggaaacaaggtgtttggagccctgaagggagctgtggatggcggcctgagcatcccccacagcaccaagcgcttccctggctatgattctgagagcaaggagttcaatgctgaggtgcacaggaagcacatcatgggccagaatgtggccgactacatgagatacctgatggaggaggatgaagatgcctacaagaagcagttcagccagtacatcaagaacagcgtgaccccagacatgatggaggagatgtacaagaaggcccatgctgccatcagagaaaatcctgtgtatgagaagaagcccaagaaggaggtgaagaagaagcgctggaaccggcccaagatgagcctggcccagaagaaggacagagtggcccagaagaaggccagcttcctgcgggcccaggagagagctgctgagagctag

SEQ ID NO: 168256 - DNA, 867 bp, Artificial Sequence
  Description of Artificial Sequence: Synthetic coding sequence
atggccggggagaaggtggagaagccagacaccaaggagaagaagccagaggccaagaaggtggatgctgggggcaaggtgaagaagggcaacctgaaggccaagaagcccaagaagggcaagccccactgcagcaggaaccctgtgctggtgcggggcatcggccgctacagccgcagcgccatgtacagcaggaaggccatgtacaagaggaagtacagcgctgccaagagcaaggtggagaagaagaagaaggagaaggtgctggccaccgtgaccaagcctgtgggcggggacaagaatggaggcaccagggtggtgaagctgaggaagatgccccgctactaccccacagaagatgtgcccaggaagctgctgagccacggcaagaagcccttcagccagcacgtgaggaagctgcgggccagcatcaccccaggcaccatcctgatcatcctgaccggccgccaccggggcaagagggtggtgttcctgaagcagctggccagcggcctgctgctggtgacaggccccctggtgctgaacagagtgcccctgcggaggacccaccagaagtttgtgattgccaccagcaccaagattgacatcagcaatgtgaagatccccaagcacctgacagatgcctacttcaagaagaagaagctgaggaagcccaggcaccaggagggggagatctttgacacagagaaggagaagtatgagatcacagagcagaggaagattgaccagaaggctgtggacagccagatcctgcccaagatcaaggccatcccccagctgcagggctacctgcggtctgtgtttgccctgaccaacggcatctacccccacaagctggtgttctag

SEQ ID NO: 168257 - DNA, 867 bp, Artificial Sequence; identical to SEQ ID NO: 168256
  Description of Artificial Sequence: Synthetic coding sequence

SEQ ID NO: 168258 - DNA, 318 bp, Artificial Sequence
  Description of Artificial Sequence: Synthetic coding sequence
atggccggggagaaggtggagaagccagacaccaaggagaagaagccagaggccaagaaggtggatgctgggggcaaggtgaagaagggcaacctgaaggccaagaagcccaagaagggcaagccccactgcagcaggaaccctgtgctggtgcggggcatcggccgctacagccgcagcgccatgtacagcaggaaggccatgtacaagaggaagtacagcgctgccaagagcaaggtggagaagaagaagaaggagaaggtgctggccaccgtgaccaagcctgtgggcggggacaagaatggaggcaccaggtag

SEQ ID NO: 168259 - DNA, 219 bp, Artificial Sequence
  Description of Artificial Sequence: Synthetic coding sequence
atggccggggagaaggtggagaagccagacaccaaggagaagaagccagaggccaagaaggtggatgctgggggcaaggtgaagaagggcaacctgaaggccaagaagcccaagaagggcaagccccactgcagcaggaaccctgtgctggtgcggggcatcggccgctacagccgcagcgccatgtacagcaggaaggccatgtacaagaggaagtag

SEQ ID NO: 168260 - DNA, 480 bp, Artificial Sequence
  Description of Artificial Sequence: Synthetic coding sequence
atggccggggagaaggtggagaagccagacaccaaggagaagaagccagaggccaagaaggtggatgctgggggcaaggtgaagaagggcaacctgaaggccaagaagcccaagaagggcaagccccactgcagcaggaaccctgtgctggtgcggggcatcggccgctacagccgcagcgccatgtacagcaggaaggccatgtacaagaggaagtacagcgctgccaagagcaaggtggagaagaagaagaaggagaaggtgctggccaccgtgaccaagcctgtgggcggggacaagaatggaggcaccagggtggtgaagctgaggaagatgccccgctactaccccacagaagatgtgcccaggaagctgctgagccacggcaagaagcccttcagccagcacgtgaggaagctgcgggccagcatcaccccaggcaccatcctgatcatcctgaccggccgccaccggggctag

SEQ ID NO: 168261 - DNA, 345 bp, Artificial Sequence
  Description of Artificial Sequence: Synthetic coding sequence
atggccggggagaaggtggagaagccagacaccaaggagaagaagccagaggccaagaaggtggatgctgggggcaaggtgaagaagggcaacctgaaggccaagaagcccaagaagggcaagccccactgcagcaggaaccctgtgctggtgcggggcatcggccgctacagccgcagcgccatgtacagcaggaaggccatgtacaagaggaagtacagcgctgccaagagcaaggtggagaagaagaagaaggagaaggtgctggccaccgtgaccaagcctgtgggcggggacaagaatggaggcaccagggtggtgaagctgaggaagatggtgaggtag

SEQ ID NO: 168262 - DNA, 345 bp, Artificial Sequence; identical to SEQ ID NO: 168261
  Description of Artificial Sequence: Synthetic coding sequence

SEQ ID NO: 168263 - DNA, 747 bp, Artificial Sequence
  Description of Artificial Sequence: Synthetic coding sequence
atggagggcgtggaggagaagaagaaggaggtgcctgctgtgcctgagaccctgaagaagaagagaagaaactttgctgagctgaagatcaagaggctgaggaagaagtttgcccagaagatgctgaggaaggcccggaggaagctgatctatgagaaggccaagcactaccacaaggagtaccggcagatgtacagaacagagatccgcatggccaggatggccaggaaggccggcaacttctacgtgcctgctgagcccaagctggcctttgtgatccgcatccggggcatcaatggagtgagccccaaggtgaggaaggtgctgcagctgctgcggctgcggcagatcttcaacggcacctttgtgaagctgaacaaggccagcatcaacatgctgagaattgtggagccctacatcgcctggggctaccccaacctgaagtctgtgaatgaactcatctacaagaggggctacggcaagatcaacaagaagagaattgccctgacagacaatgccctgattgcccggagcctgggcaagtatggcatcatctgcatggaggacctgatccacgagatctacacagtgggcaagcgcttcaaggaggccaacaacttcctgtggcccttcaagctgagcagcccccggggcggcatgaagaagaagaccacccactttgtggagggcggagatgctggcaaccgggaggaccagatcaacagactcatccggaggatgaactag

SEQ ID NO: 168264 - DNA, 456 bp, Artificial Sequence
  Description of Artificial Sequence: Synthetic coding sequence
atggcccccctgtaccaggccgccgggaaaggagatgtgcccaccaagaggcctcctgtgctgcgggccggcgtgaacacagtgaccaccctggtggagaacaagaaggcccagctggtggtgattgcccatgatgtggaccccatcgagctggtggtgttcctgcctgccctgtgcaggaagatgggcgtgccctactgcatcatcaagggcaaggcccggctgggccgcctggtgcacaggaagacctgcaccaccgtggccttcacccaggtgaacagtgaagataaaggagccctggccaagctggtggaggccatccgcaccaactacaatgacagatatgatgagatcagaagacactggggcggcaatgtgctgggccccaagtctgtggccagaattgccaagctggagaaggccaaggccaaggagctggccaccaagctgggctag

SEQ ID NO: 168265 - DNA, 801 bp, Artificial Sequence
  Description of Artificial Sequence: Synthetic coding sequence
atgcccaagggcaagaaggccaagggcaagaaggtggccccagccccagctgtggtgaagaagcaggaggccaagaaggtggtgaaccccctgtttgagaagaggcccaagaactttggaattggccaggacatccagcccaagagggacctgaccaggtttgtgaagtggccccgctacatccggctgcagaggcagagggccatcctgtacaagaggctgaaggtgcccccagccatcaaccagttcacccaggccctggaccggcagacagccacccagctgctgaagctggcccacaagtacagacctgagaccaagcaggagaagaagcagaggctgctggcccgggcagagaagaaggctgctggaaaaggagatgtgcccaccaagaggcctcctgtgctgcgggccggcgtgaacacagtgaccaccctggtggagaacaagaaggcccagctggtggtgattgcccatgatgtggaccccatcgagctggtggtgttcctgcctgccctgtgcaggaagatgggcgtgccctactgcatcatcaagggcaaggcccggctgggccgcctggtgcacaggaagacctgcaccaccgtggccttcacccaggtgaacagcgaggacaagggggccctggccaagctggtggaggccatccgcaccaactacaatgacagatatgatgagatccgccgccactggggcggcaatgtgctgggccccaagtctgtggcccgcatcgccaagctggagaaggccaaggccaaggagctggccaccaagctgggctag

SEQ ID NO: 168266 - DNA, 576 bp, Artificial Sequence
  Description of Artificial Sequence: Synthetic coding sequence
atgctggtgcggctgaatgtgcgctgcagctgccggggcgtggtgctgggcggctgcaggaagctgctggccagcctggtgcagcccaagggcaagaaggccaagggcaagaaggtggccccagccccagctgtggtgaagaagcaggaggccaagaaggtggtgaaccccctgtttgagaagaggcccaagaactttggcatcggccaggacatccagcccaagagggacctgaccaggtttgtgaagtggccccgctacatccggctgcagaggcagagggccatcctgtacaagaggctgaaggtgcccccagccatcaaccagttcacccaggccctggaccggcagacagccacccagctgctgaagctggcccacaagtacagacctgagaccaagcaggagaagaagcagaggctgctggcccgggcagagaagaaggccgccgggaaaggagatgtgcccaccaagaggcctcctgtgctgcgggccggcgtgaacacagtgaccaccctggtggagaacaagaaggcccagctggtggtgattgcccatgatgtggaccccatctag

SEQ ID NO: 168267 - DNA, 774 bp, Artificial Sequence
  Description of Artificial Sequence: Synthetic coding sequence
atgggccgggtcatccggggccagaggaagggggccggcagcgtcttccgggcccacgtgaagcacaggaagggggccgcccggctgcgggctgtggactttgctgagcggcacggctacatcaagggcatcgtgaaggacatcatccatgaccccggccgcggggcccccctggccaaggtggtgttccgggacccctaccgcttcaagaagaggacagagctgttcatcgctgctgagggcatccacacaggccagtttgtgtactgtgggaagaaggcccagctgaacattggaaatgtgctgcctgtgggcaccatgcctgagggcaccatcgtgtgctgcctggaggagaagccaggggaccggggcaagctggcccgggccagcggcaactatgccaccgtcatcagccacaaccctgagaccaagaagaccagggtgaagctgcccagcggcagcaagaaggtgatcagcagcgccaacagagctgtggtgggcgtggtggccggcggcggcagaattgacaagcccatcctgaaggccggccgggcctaccacaagtacaaggccaagaggaactgctggccccgggtgcggggcgtggccatgaaccctgtggagcacccctttggaggcggcaaccaccagcacatcggcaagcccagcaccatcagaagagatgccccagctggcaggaaggtgggcctgattgctgccaggagaacaggccgcctgcggggcaccaagacagtgcaggagaaggagaactag

SEQ ID NO: 168268 - DNA, 774 bp, Artificial Sequence; identical to SEQ ID NO: 168267
  Description of Artificial Sequence: Synthetic coding sequence

SEQ ID NO: 168269 - DNA, 579 bp, Artificial Sequence
  Description of Artificial Sequence: Synthetic coding sequence
atgaagaccatcctgagcaaccagacagtggacatcccagaaaatgtggacatcaccctgaagggccgcaccgtcatcgtgaagggcccccggggcaccctgcggcgggacttcaaccacatcaacgtggagctgagcctgctgggcaagaagaagaagaggctgcgggtggacaagtggtggggcaacaggaaggagctggccaccgtgaggaccatctgcagccacgtgcagaacatgatcaagggcgtgaccctgggcttccgctacaagatgaggtctgtgtatgcccacttccccatcaacgtggtgatccaggagaatggcagcctggtggagatccggaacttcctgggggagaagtacatccggcgggtgaggatgaggcctggggtggcctgcagcgtgtcccaggcccagaaggatgagctgatcctggagggcaatgacatcgagctggtgagcaacagcgctgccctgatccagcaggccaccaccgtgaagaacaaggacatcaggaagttcctggatggcatctacgtgtctgagaagggcaccgtgcagcaggctgatgaatag

SEQ ID NO: 168270 - DNA, 444 bp, Artificial Sequence
  Description of Artificial Sequence: Synthetic coding sequence
atgaagaccatcctgagcaaccagacagtggacatcccagaaaatgtggacatcaccctgaagggccgcaccgtcatcgtgaagggcccccggggcaccctgcggcgggacttcaaccacatcaacgtggagctgagcctgctgggcaagaagaagaagaggctgcgggtggacaagtggtggggcaacaggaaggagctggccaccgtgaggaccatctgcagccacgtgcagaacatgatcaagggcgtgaccctgggcttccgctacaagatgaggtctgtgtatgcccacttccccatcaacgtggtgatccaggagaatggcagcctggtggagatccggaacttcctgggggagaagtacatccggcgggtgaggatgaggcctggggtggcctgcttcaagttcagcggctttgacagcgccagccacaacagctag

SEQ ID NO: 168271 - DNA, 579 bp, Artificial Sequence; identical to SEQ ID NO: 168269
  Description of Artificial Sequence: Synthetic coding sequence

SEQ ID NO: 168272 - DNA, 501 bp, Artificial Sequence
  Description of Artificial Sequence: Synthetic coding sequence
atgaagaccatcctgagcaaccagacagtggacatcccagaaaatgtggacatcaccctgaagggccgcaccgtcatcgtgaagggcccccggggcaccctgcggcgggacttcaaccacatcaacgtggagctgagcctgctgggcaagaagaagaagaggctgcgggtggacaagtggtggggcaacaggaaggagctggccaccgtgaggaccatctgcagccacgtgcagaacatgatcaagggcgtgaccctgggcttccgctacaagatgaggtctgtgtatgcccacttccccatcaacgtggtgatccaggagaatggcagcctggtggagatccggaacttcctgggggagaagtacatccggcgggtgaggatgaggcctggggtggcctgcagcgtgtcccaggcccagaaggatgagctgatcctggagggcaatgacatcgagctggtgagcaacagcgctgccctgatccagcaggccaccacctag

SEQ ID NO: 168273 - DNA, 498 bp, Artificial Sequence
  Description of Artificial Sequence: Synthetic coding sequence
atgctgatgcccaagaagaacagaattgccatctatgagctgctcttcaaggagggcgtgatggtggccaagaaggatgtgcacatgcccaagcaccctgagctggccgacaagaatgtgcccaacctgcacgtgatgaaggccatgcagagcctgaagagccggggctacgtgaaggagcagtttgcctggaggcacttctactggtacctgaccaatgaaggcatccagtacctgcgggactacctgcacctgcccccagaaattgtgcctgccaccctgcggcgcagcaggcctgagaccggccggccccggcccaagggcctggagggggagaggcctgcccggctgaccagaggagaggccgaccgggacacctaccgccgctctgctgtgcccccaggagctgacaagaaggccgaggccggggccggcagcgccacagagttccagttccggggcggcttcggccggggccggggccagcccccccagtag

SEQ ID NO: 168274 - DNA, 477 bp, Artificial Sequence
  Description of Artificial Sequence: Synthetic coding sequence
atggctgacatccagacagagcgggcctaccagaagcagcccaccatcttccagaacaagaagagggtgctgctgggggagaccgggaaggagaagctgccccgctactacaagaacatcggcctgggcttcaagacccccaaggaggccatcgagggcacctacatcgacaagaagtgccccttcaccggaaatgtgtccatccggggccgcatcctgagcggcgtggtgaccaagatgaagatgcagaggaccatcgtcatcagaagagactacctgcactacatcaggaagtacaacagatttgagaagaggcacaagaacatgtctgtgcacctgagcccctgcttcagagatgtgcagatcggggacatcgtgacagtgggggagtgccggcccctgagcaagacagtgcgcttcaacgtgctgaaggtgaccaaggctgctggcaccaagaagcagttccagaagttctag

SEQ ID NO: 168275 - DNA, 423 bp, Artificial Sequence
  Description of Artificial Sequence: Synthetic coding sequence
atgacctccatgacccagagcctgcgggaggtgatcaaggccatgaccaaggccaggaactttgagcgggtgctgggcaagatcaccctggtgtctgctgcccctgggaaggtgatctgtgagatgaaggtggaggaggagcacaccaatgccatcggcaccctgcacggcggcctgacagccaccctggtggacaacatcagcaccatggccctgctgtgcacagagcggggggcccctggggtgtctgtggacatgaacatcacctacatgagccctgccaagctgggggaggacatcgtcatcacagcccacgtgctgaagcagggcaagaccctggccttcacctctgtggacctgaccaacaaggccaccgggaagctgattgcccagggccgccacaccaagcacctgggcaactag

SEQ ID NO: 168276 - DNA, 456 bp, Artificial Sequence
  Description of Artificial Sequence: Synthetic coding sequence
atgggccgcatgcacgcccctgggaagggcctgagccagagcgccctgccctacagaagatctgtgcccacctggctgaagctgaccagtgatgatgtgaaggagcagatctacaagctggccaagaagggcctgacccccagccagatcggggtcatcctgcgggacagccacggcgtggcccaggtgcgctttgtgactggaaacaagatcctgcgcatcctgaagagcaagggcctggccccagacctgcctgaggacctgtaccacctgatcaagaaggctgtggccgtgaggaagcacctggagaggaacaggaaggacaaggatgccaagttccgcctcatcctgattgagagccgcatccaccggctggcccgctactacaagaccaagagggtgctgccccccaactggaagtatgagagcagcacagccagcgccctggtggcctag

SEQ ID NO: 168277 - DNA, 456 bp, Artificial Sequence
  Description of Artificial Sequence: Synthetic coding sequence
atggcccccaggaagggcaaggagaagaaggaggagcaggtgatcagcctgggcccccaggtggccgagggagaaaatgtgtttggagtgtgccacatctttgccagcttcaatgacacctttgtgcacgtgacagacctgagcggcaaggagaccatctgccgggtgactggaggcatgaaggtgaaggctgacagagatgagagcagcccctatgctgccatgctggccgcccaggatgtggcccagcgctgcaaggagctgggcatcacagccctgcacatcaagctgcgggccaccggcggcaacagaaccaagaccccaggccctggggcccagagcgccctgcgggccctggcccggagcggcatgaagattggaagaattgaagatgtgacccccatccccagcgacagcaccaggaggaaaggaggccggcggggccgccgcctgtag

SEQ ID NO: 168278 - DNA, 456 bp, Artificial Sequence; identical to SEQ ID NO: 168277
  Description of Artificial Sequence: Synthetic coding sequence

SEQ ID NO: 168279 - DNA, 456 bp, Artificial Sequence; identical to SEQ ID NO: 168277
  Description of Artificial Sequence: Synthetic coding sequence

SEQ ID NO: 168280 - DNA, 456 bp, Artificial Sequence; identical to SEQ ID NO: 168277
  Description of Artificial Sequence: Synthetic coding sequence

SEQ ID NO: 168281 - DNA, 6912 bp, Artificial Sequence; identical to SEQ ID NO: 142804
  Description of Artificial Sequence: Synthetic coding sequence

SEQ ID NO: 168282 - DNA, 438 bp, Artificial Sequence
  Description of Artificial Sequence: Synthetic coding sequence
atggccgaggtggagcagaagaagaagaggaccttcaggaagttcacctacagaggagtggacctggaccagctgctggacatgtcctatgagcagctgatgcagctgtacagcgcccggcagaggcggcggctgaacagaggcctgcggaggaagcagcacagcctgctgaagaggctgaggaaggccaagaaggaggccccacccatggagaagccagaggtggtgaagacccacctgcgggacatgatcatcctgcctgagatggtgggctccatggtgggcgtgtacaacgggaagaccttcaaccaggtggagatcaagccagagatgattggccactacctgggggagttcagcatcacctacaagcctgtgaagcacggccggcccggcattggagccacccacagcagccgcttcatccccctgaagtag

SEQ ID NO: 168283 - DNA, 393 bp, Artificial Sequence
  Description of Artificial Sequence: Synthetic coding sequence
atggtgaggatgaatgtgctggctgatgccctgaagagcatcaacaatgctgagaagaggggcaagaggcaggtgctgatccggccctgcagcaaggtgattgtgcgcttcctgactgtgatgatgaagcacggctacatcggggagtttgagatcattgatgaccaccgggccggcaagatcgtggtgaacctgaccggccgcctgaacaagtgtggggtcatcagccccaggtttgatgtgcagctgaaggacctggagaagtggcagaacaacctgctgcccagccggcagtttggcttcatcgtgctgaccaccagcgctggcatcatggaccacgaggaggcccggaggaagcacactggaggcaagatcctgggcttcttcttctag

SEQ ID NO: 168284 - DNA, 393 bp, Artificial Sequence; identical to SEQ ID NO: 168283
  Description of Artificial Sequence: Synthetic coding sequence

SEQ ID NO: 168285 - DNA, 441 bp, Artificial Sequence
  Description of Artificial Sequence: Synthetic coding sequence
atgcccagcaagggccccctgcagagcgtgcaggtgtttggaaggaagaagacagccacagctgtggcccactgcaagagaggaaatggcctcatcaaggtgaatggccggcccctggagatgattgagcccaggaccctgcagtacaagctgctggagcctgtgctgctgctgggcaaggagagatttgctggggtggacatccgggtgcgggtgaagggcggcggccacgtggcccagatctatgccatccggcagagcatcagcaaggccctggtggcctactaccagaagtatgtggatgaggccagcaagaaggagatcaaggacatcctgatccagtatgacaggaccctgctggtggccgacccccggcgctgtgagagcaagaagtttggaggccctggggcccgggcccgctaccagaagagctacagatag

SEQ ID NO: 168286 - DNA, 459 bp, Artificial Sequence
  Description of Artificial Sequence: Synthetic coding sequence
atgcccagcaagggccccctgcagagcgtgcaggtgtttggaaggaagaagacagccacagctgtggcccactgcaagagaggaaatggcctcatcaaggtgaatggccggcccctggagatgattgagcccaggaccctgcagtacaagctgctggagcctgtgctgctgctgggcaaggagagatttgctggggtggacatccgggtgcgggtgaagggcggcggccacgtggcccagatctacggggagagccaggagctgggcgcctggaggcgctggctgtgggagggcggcctgcacagcgcccctgtgcccttcaactgtgtgtccttcagccagctgtctgtgagccccagccccaagccctggtggcccatcaccaggaacatgtggatgaggctgccccggcggcgcagcaagaccagcagcagctccatgacaggcccctgctggtag

SEQ ID NO: 168287 - DNA, 408 bp, Artificial Sequence
  Description of Artificial Sequence: Synthetic coding sequence
atgggccgggtgaggaccaagacagtgaagaaggccgcccgggtcatcatcgagaagtactacacccggctgggcaatgacttccacaccaacaagagggtgtgtgaggagatcgccatcatccccagcaagaagctgaggaacaagattgctggctacgtgacccacctgatgaagaggatccagaggggccctgtgcggggcatcagcatcaagctgcaggaggaggagcgggagcggcgggacaactacgtgcctgaggtgtctgccctggaccaggagatcatcgaggtggaccctgacaccaaggagatgctgaagctgctggactttggcagcctgagcaacctgcaggtgacccagcccaccgtgggcatgaacttcaagaccccccggggccctgtgtag

SEQ ID NO: 168288 - DNA, 300 bp, Artificial Sequence
  Description of Artificial Sequence: Synthetic coding sequence
atggacctgattggcttcggctatgctgccctggtgaccttcggcagcatcttcggctacaagaggcggggcggcgtgcccagcctgattgctggcctgtttgtgggctgcctggccggctatggagcctacagagtgtccaatgacaagagagatgtgaaggtgtccctcttcaccgccttcttcctggccaccatcatgggcgtgcgcttcaagaggagcaagaagatcatgcctgctggcctggtggccggcctgagcctgatgatgatcctgcggctggtgctgctgctgctgtag

SEQ ID NO: 168289 - DNA, 459 bp, Artificial Sequence; identical to SEQ ID NO: 153061
  Description of Artificial Sequence: Synthetic coding sequence

SEQ ID NO: 168290 - DNA, 459 bp, Artificial Sequence; identical to SEQ ID NO: 153061
  Description of Artificial Sequence: Synthetic coding sequence

SEQ ID NO: 168291 - DNA, 105 bp, Artificial Sequence
  Description of Artificial Sequence: Synthetic coding sequence
atgagcctggtgattcctgagaagttccagcacatcctgcgggtgctgaacaccaacattgatggaagaaggaagatcgcctttgccatcacagccatcaagtag

SEQ ID NO: 168292 - DNA, 459 bp, Artificial Sequence; identical to SEQ ID NO: 153061
  Description of Artificial Sequence: Synthetic coding sequence

SEQ ID NO: 168293 - DNA, 459 bp, Artificial Sequence; identical to SEQ ID NO: 153061
  Description of Artificial Sequence: Synthetic coding sequence

SEQ ID NO: 168294 - DNA, 249 bp, Artificial Sequence
  Description of Artificial Sequence: Synthetic coding sequence
atgcagaacccccggcagtacaagatcccagactggttcctgaaccggcagaaggatgtgaaggatggcaagtacagccaggtgctggccaacggcctggacaacaagctgcgggaggacctggagcggctgaagaagatccgggcccaccggggcctgcggcacttctggggcctgcgggtgcggggccagcacaccaagaccactggaagaagaggccgcacagtgggcgtgtccaagaagaagtag

SEQ ID NO: 168295 - DNA, 249 bp, Artificial Sequence; identical to SEQ ID NO: 168294
  Description of Artificial Sequence: Synthetic coding sequence

SEQ ID NO: 168296 - DNA, 249 bp, Artificial Sequence; identical to SEQ ID NO: 168294
  Description of Artificial Sequence: Synthetic coding sequence

SEQ ID NO: 168297 - DNA, 249 bp, Artificial Sequence; identical to SEQ ID NO: 168294
  Description of Artificial Sequence: Synthetic coding sequence

SEQ ID NO: 168298 - DNA, 249 bp, Artificial Sequence; identical to SEQ ID NO: 168294
  Description of Artificial Sequence: Synthetic coding sequence

SEQ ID NO: 168299 - DNA, 648 bp, Artificial Sequence
  Description of Artificial Sequence: Synthetic coding sequence
atgtacagcttcatgggcggcggcctcttctgtgcctgggtgggcaccatcctgctggtggtggccatggccacagaccactggatgcagtaccgcctgagcggcagctttgcccaccagggcctgtggagatactgcctgggcaacaagtgctacctgcagacagacagcatcggggagcccccaggccagggccctggccgggcctggggcaagagcagagctgacctgggcgcccagggccacctgtacagccgctggaggaccctgcggctgaaggagggcaagggggccacccaggcctactggaatgccacccgggccttcatgatcctgagcgccctgtgtgccatcagcggcatcatcatgggcatcatggcctttgcccaccagcccaccttcagccgcatcagccggcccttctctgctggcatcatgttcttcagcagcaccctgtttgtggtgctggccctggccatctacacaggagtgacagtgtccttcctgggcagaagatttggagactggaggttctcctggagctacatcctgggctgggtggccgtgctgatgaccttctttgctggcatcttctacatgtgtgcctacagagtgcatgaatgtagaaggctgagcaccccaagatag

SEQ ID NO: 168300 - DNA, 438 bp, Artificial Sequence
  Description of Artificial Sequence: Synthetic coding sequence
atgcctggggtgacagtgaaggatgtgaaccagcaggagtttgtgcgggccctggccgccttcctgaagaagagcggcaagctgaaggtgcctgagtgggtggacacagtgaagctggccaagcacaaggagctggccccctatgatgagaactggttctacaccagggctgccagcacagcccggcacctgtacctgcggggcggggccggcgtgggctccatgaccaagatctatggaggccggcagagaaatggagtgatgcccagccacttcagccggggcagcaagtctgtggccaggagagtgctgcaggccctggagggcctgaagatggtggagaaggaccaggacggcggcaggaagctgaccccccagggccagagggacctggacagaattgctggccaggtggccgccgccaacaagaagcactag

SEQ ID NO: 168301 - DNA, 411 bp, Artificial Sequence
  Description of Artificial Sequence: Synthetic coding sequence
atgtctgctgccctgctgcggcggggcctggagctgctggccgccagcgaggccccccgggaccccccaggccaggccaagcccaggggggcccctgtgaagaggcccaggaagaccaaggccatccaggcccagaagctgaggaacagcgccaagggcaaggtgcccaagagcgccctggatgagtacaggaagagagaatgtcgggaccacctgcgggtgaacctgaagttcctgaccaggaccaggagcacagtggccgagagcgtgtcccagcagatcctgcggcagaacagaggaaggaaggcctgtgacaggcctgtggccaagaccaagaagaagaaggccgagggcaccgtcttcacagaggaggacttccagaagttccagcaggagtacttcggcagctag

SEQ ID NO: 168302 - DNA, 882 bp, Artificial Sequence
  Description of Artificial Sequence: Synthetic coding sequence
atggctgatgatgctggagctgctgggggccctgggggccctgggggccctggcatgggcaacagaggaggcttccggggcggctttggaagtggcatccggggccggggccggggccggggccggggccggggccggggccgcggggcccggggcggcaaggccgaggacaaggagtggatgcctgtgaccaagctgggccgcctggtgaaggacatgaagatcaagagcctggaggagatctacctgttcagcctgcccatcaaggagagcgagatcatcgacttcttcctgggcgccagcctgaaggatgaggtgctgaagatcatgcctgtgcagaagcagacccgggccggccagaggacccgcttcaaggcctttgtggccatcggggactacaacggccacgtgggcctgggcgtgaagtgcagcaaggaggtggccacagccatccggggggccatcatcctggccaagctgagcatcgtgcctgtgcggcggggctactggggcaacaagattggcaagccccacacagtgccctgcaaggtgacaggccgctgtggctctgtgctggtgcggctcatcccagccccccggggcaccggcatcgtgtctgcccctgtgcccaagaagctgctgatgatggccggcattgatgactgctacaccagcgcccggggctgcacagccaccctgggcaactttgccaaggccacctttgatgccatcagcaagacctacagctacctgaccccagacctgtggaaggagaccgtcttcaccaagagcccctaccaggagttcacagaccacctggtgaagacccacaccagggtgtctgtgcagaggacccaggccccagctgtggccaccacctag

SEQ ID NO: 168303 - DNA, 708 bp, Artificial Sequence
  Description of Artificial Sequence: Synthetic coding sequence
atggctgatgatgctggagctgctgggggccctgggggccctgggggccctggcatgggcaacagaggaggcttccggggcggctttggaagtggcatccggggccggggccggggccggggccggggccggggccggggccgcggggcccggggcggcaaggccgaggacaaggagtggatgcctgtgaccaagctgggccgcctggtgaaggacatgaagatcaagagcctggaggagatctacctgttcagcctgcccatcaaggagagcgagatcatcgacttcttcctgggcgccagcctgaaggatgaggtgctgaagatcatgcctgtgcagaagcagacccgggccggccagaggacccgcttcaaggtgacaggccgctgtggctctgtgctggtgcggctcatcccagccccccggggcaccggcatcgtgtctgcccctgtgcccaagaagctgctgatgatggccggcattgatgactgctacaccagcgcccggggctgcacagccaccctgggcaactttgccaaggccacctttgatgccatcagcaagacctacagctacctgaccccagacctgtggaaggagaccgtcttcaccaagagcccctaccaggagttcacagaccacctggtgaagacccacaccagggtgtctgtgcagaggacccaggccccagctgtggccaccacctag

SEQ ID NO: 168304 - DNA, 537 bp, Artificial Sequence
  Description of Artificial Sequence: Synthetic coding sequence
atggctgatgatgctggagctgctgggggccctgggggccctgggggccctggcatgggcaacagaggaggcttccggggcggctttggaagtggcatccggggccggggccggggccggggccggggccggggccggggccgcggggcccggggcggcaaggccgaggacaaggagtggatgcctgtgaccaagctgggccgcctggtgaaggacatgaagatcaagagcctggaggagatctacctgttcagcctgcccatcaaggagagcgagatcatcgacttcttcctgggcgccagcctgaaggatgaggtgctgaagatcatgcctgtgcagaagcagacccgggccggccagaggacccgcttcaaggtgcccggctgccctgggggcggctgtgccggcctggccggcaccctgagcgccctgcacagctgcacctggctgcacccctgtgacttcagaaatggagagcgggagaagaggagcccccaggacctgggctgggccctgctgtggcccctcttcccctag

SEQ ID NO: 168305 - DNA, 588 bp, Artificial Sequence
  Description of Artificial Sequence: Synthetic coding sequence
gtcaccaagctgggccgcctggtgaaggacatgaagatcaagagcctggaggagatctacctgttcagcctgcccatcaaggcctttgtggccatcggggactacaacggccacgtgggcctgggcgtgaagtgcagcaaggaggtggccacagccatccggggggccatcatcctggccaagctgagcatcgtgcctgtgcggcggggctactggggcaacaagattggcaagccccacacagtgccctgcaaggtgacaggccgctgtggctctgtgctggtgcggctcatcccagccccccggggcaccggcatcgtgtctgcccctgtgcccaagaagctgctgatgatggccggcattgatgactgctacaccagcgcccggggctgcacagccaccctgggcaactttgccaaggccacctttgatgccatcagcaagacctacagctacctgaccccagacctgtggaaggagaccgtcttcaccaagagcccctaccaggagttcacagaccacctggtgaagacccacaccagggtgtctgtgcagaggacccaggccccagctgtggccaccacctag

SEQ ID NO: 168306 - DNA, 360 bp, Artificial Sequence
  Description of Artificial Sequence: Synthetic coding sequence
atggccttcaaggacaccgggaagacccctgtggagcctgaggtggccatccaccgcatccgcatcaccctgaccagcagaaatgtgaagagcctggagaaggtgtgtgccgacctgatccggggggccaaggagaagaacctgaaggtgaagggccctgtgaggatgcccaccaagaccctgcgcatcaccaccaggaagaccccctgtggggagggcagcaagacctgggaccgcttccagatgaggatccacaagaggctgattgacctgcacagccccagcgagatcgtgaagcagatcaccagcatcagcattgagcccggggtggaggtggaggtgaccatcgcagatgcctag

SEQ ID NO: 168307 - DNA, 429 bp, Artificial Sequence
  Description of Artificial Sequence: Synthetic coding sequence
atggccttcaaggacaccgggaagacccctgtggagcctgaggtggccatccaccgcatccgcatcaccctgaccagcagaaatgtgaagagcctggagaaggtgtgtgccgacctgatccggggggccaaggagaagaacctgaaggtgaagggccctgtgaggatgcccaccaagaccctgcgcatcaccaccaggaagaccccctgtggggagggcagcaagacctgggaccgcttccagatgaggatccacaagaggctgattgacctgcacagccccagcgagatcgtgaagcagatcaccagcatcagcattgagcccggggtggagctgattgagagcacagatgctgagcccatggacacagagggccagcagtacaccctgcggtctgtgtttgagagccctggcacctgccccttctag

SEQ ID NO: 168308 - DNA, 360 bp, Artificial Sequence; identical to SEQ ID NO: 168306
  Description of Artificial Sequence: Synthetic coding sequence

SEQ ID NO: 168309 - DNA, 252 bp, Artificial Sequence
  Description of Artificial Sequence: Synthetic coding sequence
atgcagaatgatgctggggagtttgtggacctgtatgtgcccaggaagtgcagcgccagcaaccgcatcatcggggccaaggaccacgccagcatccagatgaatgtggccgaggtggacaaggtgacaggccgcttcaacggccagttcaagacctacgccatctgtggggccatccggaggatgggagagagtgatgacagcatcctgcggctggccaaggcagatggcatcgtgtccaagaacttctag

SEQ ID NO: 168310 - DNA, 294 bp, Artificial Sequence
  Description of Artificial Sequence: Synthetic coding sequence
atgcagaatgatgctggggagtttgtggacctgtatgtgcccaggaagtgcagcgccagcaaccgcatcatcggggccaaggaccacgccagcatccagatgaatgtggcccggctgaccaggagccaggccggcctgatggccagcctgaagctgatgctgtctgctggcccctttgtgggctgggtgtcccagatgatccccttcagtgactggccccggcgctggcaccggctgaaggagctgctgaccggggagaaccaccgctgtggcatctttgtgatcaacaagtag

SEQ ID NO: 168311 - DNA, 252 bp, Artificial Sequence; identical to SEQ ID NO: 168309
  Description of Artificial Sequence: Synthetic coding sequence

SEQ ID NO: 168312 - DNA, 201 bp, Artificial Sequence
  Description of Artificial Sequence: Synthetic coding sequence
atgcagaatgatgctggggagtttgtggacctgtatgtgcccaggaagtgcagcgccagcaaccgcatcatcggggccaaggaccacgccagcatccagatgaatgtggccgaggtgtcctgggagcctggaagaagagagggctgtgacatctgtgccggcaaggccggctgccccatcgtggaggagcccctgggctag

SEQ ID NO: 168313 - DNA, 273 bp, Artificial Sequence
  Description of Artificial Sequence: Synthetic coding sequence
atgcagaatgatgctggggagtttgtggacctgtatgtgcccaggaagtgcagcgccagcaaccgcatcatcggggccaaggaccacgccagcatccagatgaatgtggccgaggtggacaaggtgacaggccgcttcaacggccagttcaagacctacgccatctgtggggccatccggaggatggtgtctgtgtccctgggctttgcccaccacttcggcacctcctggaccctgccctgtgccctggagtgtgtgatggtgcctgagtag

SEQ ID NO: 168314 - DNA, 246 bp, Artificial Sequence
  Description of Artificial Sequence: Synthetic coding sequence
atgcagaatgatgctggggagtttgtggacctgtatgtgcccaggaagtgcagcgccagcaaccgcatcatcggggccaaggaccacgccagcatccagatgaatgtggccgaggtggacaaggtgacaggccgcttcaacggccagttcaagacctacgccatctgtggggccatccggaggatgggagagagtgatgacagcatcctgcggctggccaaggcagatggcatcgtgtccaagtag

SEQ ID NO: 168315 - DNA, 432 bp, Artificial Sequence
  Description of Artificial Sequence: Synthetic coding sequence
atgggcaaatgtcggggcctgaggacagccaggaagctgcggagccacagaagagaccagaagtggcatgacaagcagtacaagaaggcccacctgggcacagccctgaaggccaacccctttggaggagccagccacgccaagggcatcgtgctggagaaggtgggcgtggaggccaagcagcccaacagcgccatcagaaaatgtgtgcgggtgcagctgatcaagaatggcaagaagatcacagcctttgtgcccaatgatggctgcctgaacttcatcgaggagaatgatgaggtgctggtggccggctttggaaggaagggccatgctgtgggggacatccctggggtgcgcttcaaggtggtgaaggtggccaacgtgtccctgctggccctgtacaagggcaagaaggagcggcccaggagctag

SEQ ID NO: 168316 - DNA, 393 bp, Artificial Sequence
  Description of Artificial Sequence: Synthetic coding sequence
atgaatgacacagtgaccatccgcaccaggaagttcatgaccaaccggctgctgcagaggaagcagatggtgattgatgtgctgcaccctgggaaggccaccgtgcccaagacagagatccgggagaagctggccaagatgtacaagaccaccccagatgtgatctttgtgtttggcttccgcacccactttggaggcggcaagaccaccggcttcggcatgatctatgacagcctggactatgccaagaagaatgagcccaagcaccggctggcccggcacggcctgtatgagaagaagaagaccagcaggaagcagaggaaggagaggaagaacaggatgaagaaggtgcggggcacagccaaggccaacgtgggcgccggcaagaagtag

SEQ ID NO: 168317 - DNA, 402 bp, Artificial Sequence
  Description of Artificial Sequence: Synthetic coding sequence
atgaatgacacagtgaccatccgcaccaggaagttcatgaccaaccggctgctgcagaggaagcagatggtgattgatgtgctgcaccctgggaaggccaccgtgcccaagacagagatccgggagaagctggccaagatgtacaagaccaccccagatgtgatctttgtgtttggcttccgcacccactttggaggcggcaagaccaccggcttcggcatgatctatgacagcctggactatgccaagaagaatgagcccaagcaccggctggcccggcacggcctgtatgagaagaagaagaccagcaggaagcagaggaaggagaggaagaacaggatgaagaaggtgcggggcacagccaaggccaacgtgggcgccggcaagaagcccaaggagtag

SEQ ID NO: 168318 - DNA, 399 bp, Artificial Sequence
  Description of Artificial Sequence: Synthetic coding sequence
atgaatgacacagtgaccatccgcaccaggaagttcatgaccaaccggctgctgcagaggaagcagatggtgattgatgtgctgcaccctgggaaggccaccgtgcccaagacagagatccgggagaagctggccaagatgtacaagaccaccccagatgtgatctttgtgtttggcttccgcacccactttggaggcggcaagaccaccggcttcggcatgatctatgacagcctggactatgccaagaagaatgagcccaagcaccggctggcccggcacggcctgtatgagaagaagaagaccagcaggaagcagaggaaggagaggaagaacaggatgaagaaggtgcggggcacagccaaggccaacgtgggcgccggcaagaagcagaagtag

SEQ ID NO: 168319 - DNA, 396 bp, Artificial Sequence
  Description of Artificial Sequence: Synthetic coding sequence
atgaatgacacagtgaccatccgcaccaggaagttcatgaccaaccggctgctgcagaggaagcagatggtgattgatgtgctgcaccctgggaaggccaccgtgcccaagacagagatccgggagaagctggccaagatgtacaagaccaccccagatgtgatctttgtgtttggcttccgcacccactttggaggcggcaagaccaccggcttcggcatgatctatgacagcctggactatgccaagaagaatgagcccaagcaccggctggcccggcacggcctgtatgagaagaagaagaccagcaggaagcagaggaaggagaggaagaacaggatgaagaaggtgcggggcacagccaaggccaacgtgggcgccggcaagaagcagtag

SEQ ID NO: 168320 - DNA, 870 bp, Artificial Sequence
  Description of Artificial Sequence: Synthetic coding sequence
atgaatgacacagtgaccatccgcaccaggaagttcatgaccaaccggctgctgcagaggaagcagatggtgattgatgtgctgcaccctgggaaggccaccgtgcccaagacagagatccgggagaagctggccaagatgtacaagaccaccccagatgtgatctttgtgtttggcttccgcacccactttggaggcggcaagaccaccggcttcggcatgatctatgacagcctggactatgccaagaagaatgagcccaagcaccggctggcccggcacggcctgtatgagaagaagaagaccagcaggaagcagaggaaggagaggaagaacaggatgaagaaggtgcggggcacagccaaggccaacgtgggcgccggcaagaagatgagggagctgggcctgggcgtgcaggccctgggccgcatcagccaggaggagcgctgcacagatgtgaagaacagcaaggcccgggagagcagaggagtggtgtggcaggtggaggtgcccggcccctggagcgtgtggacctgtggccgcctgcggcggggctgtgggaagtacctgcaggtggccgtgacctggaggaagacagagaaccgggagcagtgctgccaggcctgcctgctggagcgggccctggtgagaaatggagccttcatgagccctgccagccctgccccagctggcagcccccaccctgtggatggagacctggtgctgcacctgcctgaggccctgagcgccaccctgaccctgagcccccacatccaggccatcaacaagagctttggccccttctttgagatccaccaggagagcagctgcttcagcccccccagctgcctgagcggcctgggccactag

SEQ ID NO: 168321 - DNA, 378 bp, Artificial Sequence
  Description of Artificial Sequence: Synthetic coding sequence
atgccacccaaggatgacaagaagaagaaggatgctgggaagagcgccaagaaggacaaggaccctgtgaacaagagcggcggcaaggccaagaagaagaagtggagcaagggcaaggtgcgggacaagctgaacaacctggtgctgtttgacaaggccacctatgacaagctgtgcaaggaggtgcccaactacaagctgatcaccccagctgtggtgtctgagcggctgaagatccggggcagcctggcccgggccgccctgcaggagctgctgagcaagggcctcatcaagctggtgtccaagcaccgggcccaggtgatctacaccaggaacaccaagggaggagatgccccagctgctggagaagatgcctag

SEQ ID NO: 168322 - DNA, 348 bp, Artificial Sequence
  Description of Artificial Sequence: Synthetic coding sequence
atgaccaagaagagaagaaacaacggccgggccaagaagggccggggccacgtgcagcccatccgctgcaccaactgtgcccgctgtgtgcccaaggacaaggccatcaagaagtttgtgatccggaacatcgtggaggccgctgctgtgcgggacatcagcgaggcctctgtgtttgatgcctacgtgctgcccaagctgtatgtgaagctgcactactgtgtgtcctgtgccatccacagcaaggtggtgaggaacagaagccgggaggccaggaaggacaggaccccaccaccccgcttccggcctgctggggccgccccccggcccccacccaagcccatgtag

SEQ ID NO: 168323 - DNA, 348 bp, Artificial Sequence; identical to SEQ ID NO: 168322
  Description of Artificial Sequence: Synthetic coding sequence

SEQ ID NO: 168324 - DNA, 255 bp, Artificial Sequence
  Description of Artificial Sequence: Synthetic coding sequence
atgcccctggccaaggacctgctgcaccccagccctgaggaggagaagaggaagcacaagaagaagaggctggtgcagagccccaacagctacttcatggatgtgaagtgccccggctgctacaagatcaccaccgtcttcagccacgcccagacagtggtgctgtgtgtgggctgcagcacagtgctgtgccagcccactggaggcaaggcccggctgacagagggctgcagcttccggaggaagcagcactag

SEQ ID NO: 168325 - DNA, 201 bp, Artificial Sequence
  Description of Artificial Sequence: Synthetic coding sequence
atgcccctggccaaggacctgctgcaccccagccctgaggaggagaagaggaagcacaagaagaagaggctggtgcagagccccaacagctacttcatggatgtgaagtgccctggagaggagacagcctgctgcagcggggagagcacaggcccccagcagctggagaatgtggtggtgctggccgtgtcctacccctag

SEQ ID NO: 168326 - DNA, 255 bp, Artificial Sequence
  Description of Artificial Sequence: Synthetic coding sequence
atgcccctggcccgggacctgctgcaccccagcctggaggaggagaagaagaagcacaagaagaagaggctggtgcagagccccaacagctacttcatggatgtgaagtgccccggctgctacaagatcaccaccgtcttcagccacgcccagacagtggtgctgtgtgtgggctgcagcacagtgctgtgccagcccactggaggcaaggcccggctgacagagggctgcagcttccggaggaagcagcactag

SEQ ID NO: 168327 - DNA, 159 bp, Artificial Sequence
  Description of Artificial Sequence: Synthetic coding sequence
atggatgtgaagtgccccggctgctacaagatcaccaccgtcttcagccacgcccagacagtggtgctgtgtgtgggctgcagcacagtgctgtgccagcccactggaggcaaggcccggctgacagagggctgcagcttccggaggaagcagcactag

SEQ ID NO: 168328 - DNA, 159 bp, Artificial Sequence; identical to SEQ ID NO: 168327
  Description of Artificial Sequence: Synthetic coding sequence

SEQ ID NO: 168329 - DNA, 303 bp, Artificial Sequence
  Description of Artificial Sequence: Synthetic coding sequence
atgtgccagagatgtggcctgaagctgattgtcatcatctgcttctttgtgcagctggcccgggacctgctgcaccccagcctggaggaggagaagaagaagcacaagaagaagaggctggtgcagagccccaacagctacttcatggatgtgaagtgccccggctgctacaagatcaccaccgtcttcagccacgcccagacagtggtgctgtgtgtgggctgcagcacagtgctgtgccagcccactggaggcaaggcccggctgacagagggctgcagcttccggaggaagcagcactag

SEQ ID NO: 168330 - DNA, 210 bp, Artificial Sequence
  Description of Artificial Sequence: Synthetic coding sequence
atggacaccagccgggtgcagcccatcaagctggcccgggtgaccaaggtgctgggccgcacaggcagccagggccagtgcacccaggtgcgggtggagttcatggatgacaccagccgcagcatcatcagaaatgtgaagggccctgtgcgggagggagatgtgctgaccctgctggagagcgagcgggaggcccggcggctgaggtag

SEQ ID NO: 168331 - DNA, 366 bp, Artificial Sequence
  Description of Artificial Sequence: Synthetic coding sequence
atggtgcccttcaatgacctgtacagcggccctgacaccttcagcgagttcatcagcgccagccacagcgctgtgcccttccggggcccccccctgctgctgccccccctgcgctggggccctgtgggcgcccggggcatccacggcagacatgagcccatccaccacccccagtgcaagaggccccgggcccggggcagaagagcccaccccttcggcgtgcgggcccggagccctgaggtggccctgagcctggccgcccgctgggtgctggatgtgggctttgaccacctggctgatggaaatggcctgagccagagcgcccccttcttctgcccccctcatgtgacagagatgctgctgtag

SEQ ID NO: 168332 - DNA, 210 bp, Artificial Sequence; identical to SEQ ID NO: 168330
  Description of Artificial Sequence: Synthetic coding sequence

SEQ ID NO: 168333 - DNA, 171 bp, Artificial Sequence
  Description of Artificial Sequence: Synthetic coding sequence
atgggccaccagcagctgtactggagccaccccaggaagtttggccagggcagccgcagctgccgggtgtgcagcaacagacatggcctcatcagaaaatatggcctgaacatgtgccggcagtgcttccggcagtatgccaaggacatcggcttcatcaagctggactag

SEQ ID NO: 168334 - DNA, 204 bp, Artificial Sequence
  Description of Artificial Sequence: Synthetic coding sequence
atgggccaccagcagctgtactggagccaccccaggaagtttggccagggcagccgcagctgccgggtgtgcagcaacagacatggcctcatcagaaaatatggcctgaacatgtgccggcagtgcttccggcagtatgccaaggacatcggcttcatcaagaaggacctgagctgcctgccctggcactgcctgtggaggtag

SEQ ID NO: 168335 - DNA, 780 bp, Artificial Sequence
  Description of Artificial Sequence: Synthetic coding sequence
atggctgtgcagatcagcaagaagaggaagtttgtggctgatggcatcttcaaggccgagctgaatgagttcctgacccgggagctggctgaagatggctacagcggcgtggaggtgcgggtgacccccaccaggacagagatcatcatcctggccaccaggacccagaatgtgctgggggagaagggccgccgcatccgggagctgacagctgtggtgcagaagagatttggcttccctgagggctctgtggagctgaagatcatggtgatggtgacaggctaccccctgctgcccctgaagctgtatgcagagaaggtggccacccggggcctgtgtgccatcgcccaggccgagagcctgcgctacaagctgctgggcggcctggccgtgcggcgggcctgctacggcgtgctgcgcttcatcatggagagcggggccaagggctgtgaggtggtggtgtctgggaagctgcggggccagagggccaagtccatgaagtttgtggatggcctgatgatccacagcggggaccctgtgaactactacgtggacacagctgtgcgccacgtgctgctgcggcagggcgtgctgggcatcaaggtgaagatcatgctgccctgggaccccaccgggaagattggccccaagaagcccctgcctgaccacgtgtccatcgtggagcccaaggatgagatcctgcccaccacccccatcagcgagcagaagggcggcaagccagagcccccagccatgccccagcctgtgcccacagcctag

SEQ ID NO: 168336 - DNA, 732 bp, Artificial Sequence
  Description of Artificial Sequence: Synthetic coding sequence
atggctgtgcagatcagcaagaagaggaagtttgtggctgatggcatcttcaaggccgagctgaatgagttcctgacccgggagctggctgaagatggctacagcggcgtggaggtgcgggtgacccccaccaggacagagatcatcatcctggccaccaggacccagaatgtgctgggggagaagggccgccgcatccgggagctgacagctgtggtgcagaagagatttggcttccctgagggctctgtggagctgtatgcagagaaggtggccacccggggcctgtgtgccatcgcccaggccgagagcctgcgctacaagctgctgggcggcctggccgtgcggcgggcctgctacggcgtgctgcgcttcatcatggagagcggggccaagggctgtgaggtggtggtgtctgggaagctgcggggccagagggccaagtccatgaagtttgtggatggcctgatgatccacagcggggaccctgtgaactactacgtggacacagctgtgcgccacgtgctgctgcggcagggcgtgctgggcatcaaggtgaagatcatgctgccctgggaccccaccgggaagattggccccaagaagcccctgcctgaccacgtgtccatcgtggagcccaaggatgagatcctgcccaccacccccatcagcgagcagaagggcggcaagccagagcccccagccatgccccagcctgtgcccacagcctag

SEQ ID NO: 168337 - DNA, 732 bp, Artificial Sequence; identical to SEQ ID NO: 168336
  Description of Artificial Sequence: Synthetic coding sequence

SEQ ID NO: 168338 - DNA, 732 bp, Artificial Sequence; identical to SEQ ID NO: 168336
  Description of Artificial Sequence: Synthetic coding sequence

SEQ ID NO: 168339 - DNA, 795 bp, Artificial Sequence
  Description of Artificial Sequence: Synthetic coding sequence
atggctgtgggcaagaacaagaggctgaccaagggcggcaagaagggggccaagaagaaggtggtggaccccttcagcaagaaggactggtatgatgtgaaggccccagccatgttcaacatccggaacatcggcaagaccctggtgaccaggacccagggcaccaagatcgccagtgatggcctgaagggccgggtgtttgaggtgtccctggccgacctgcagaatgatgaggtggccttcaggaagttcaagctgatcacagaagatgtgcagggcaagaactgcctgaccaacttccacggcatggacctgacccgggacaagatgtgcagcatggtgaagaagtggcagaccatgattgaggcccacgtggatgtgaagaccacagatggctacctgctgcggctcttctgtgtgggcttcaccaagaagaggaacaaccagatcaggaagaccagctatgcccagcaccagcaggtgcggcagatcaggaagaagatgatggagatcatgacccgggaggtgcagaccaatgacctgaaggaggtggtgaacaagctgatcccagacagcatcggcaaggacatcgagaaggcctgccagagcatctaccccctgcatgatgtgtttgtgaggaaggtgaagatgctgaagaagcccaagtttgagctgggcaagctgatggagctgcacggggagggcagcagcagcggcaaggccactggagatgagaccggggccaaggtggagcgggcagatggctatgagccccctgtgcaggagagcgtgtag

SEQ ID NO: 168340 - DNA, 528 bp, Artificial Sequence
  Description of Artificial Sequence: Synthetic coding sequence
atggctgtggccaagaagaaggtggtggaccccttcagcaagaaggactggtatgatgtgaaggccccagccatgttcaacatcagaaatattggcaagaccctggtgaccaggacccagggcaccaagatcgccagtgatggcctgaagggccgggtgtttgaggtgtccctggccgacctgcagaatgatgaggtggccttcaggaagttcaagctgatcacagaagatgtgcagggcaagaactgcctgaccaacttccacggcatggacctgacccgggacaagatgtgcagcatggtgaagaagtggcagaccatgattgaggcccacgtggatgtgaagaccacagatggctacctgctgcggctcttctgtgtgggcttcaccaagaagaggaacaaccagatcaggaagaccagctatgcccagcaccagcaggtgcggcagatcaggaagaagatgatggagatcatgacccgggaggtgcagaccaatgacctgaaggaggtggtgaacaagctgtag

SEQ ID NO: 168341 - DNA, 684 bp, Artificial Sequence
  Description of Artificial Sequence: Synthetic coding sequence
atgttcaacatcagaaatattggcaagaccctggtgaccaggacccagggcaccaagatcgccagtgatggcctgaagggccgggtgtttgaggtgtccctggccgacctgcagaatgatgaggtggccttcaggaagttcaagctgatcacagaagatgtgcagggcaagaactgcctgaccaacttccacggcatggacctgacccgggacaagatgtgcagcatggtgaagaagtggcagaccatgattgaggcccacgtggatgtgaagaccacagatggctacctgctgcggctcttctgtgtgggcttcaccaagaagaggaacaaccagatcaggaagaccagctatgcccagcaccagcaggtgcggcagatcaggaagaagatgatggagatcatgacccgggaggtgcagaccaatgacctgaaggaggtggtgaacaagctgatcccagacagcatcggcaaggacatcgagaaggcctgccagagcatctaccccctgcatgatgtgtttgtgaggaaggtgaagatgctgaagaagcccaagtttgagctgggcaagctgatggagctgcatggagagggcagcagcagcggcaaggccactggagatgaaacaggagccaaggtggagcgggcagatggctatgagccccctgtgcaggagagcgtgtag

SEQ ID NO: 168342 - DNA, 438 bp, Artificial Sequence
  Description of Artificial Sequence: Synthetic coding sequence
atgattgaggcccacgtggatgtgaagaccacagatggctacctgctgcggctcttctgtgtgggcttcaccaagaagaggaacaaccagatcaggaagaccagctatgcccagcaccagcaggtgcggcagatcaggaagaagatgatggagatcatgacccgggaggtgcagaccaatgacctgaaggaggtggtgaacaagctgatcccagacagcatcggcaaggacatcgagaaggcctgccagagcatctaccccctgcatgatgtgtttgtgaggaaggtgaagatgctgaagaagcccaagtttgagctgggcaagctgatggagctgcatggagagggcagcagcagcggcaaggccactggagatgaaacaggagccaaggtggagcgggcagatggctatgagccccctgtgcaggagagcgtgtag

SEQ ID NO: 168343 - DNA, 684 bp, Artificial Sequence; identical to SEQ ID NO: 168341
  Description of Artificial Sequence: Synthetic coding sequence

SEQ ID NO: 168344 - DNA, 627 bp, Artificial Sequence
  Description of Artificial Sequence: Synthetic coding sequence
aagaggctgaccaagggcggcaagaagggggccaagaagaaggtggtggaccccttcagcaagaaggactggtatgatgtgaaggccccagccatgttcaacatccggaacatcggcaagaccctggtgaccaggacccagggcaccaagatcgccagtgatggcctgaagggccgggtgtttgagaccatgattgaggcccacgtggatgtgaagaccacagatggctacctgctgcggctcttctgtgtgggcttcaccaagaagaggaacaaccagatcaggaagaccagctatgcccagcaccagcaggtgcggcagatcaggaagaagatgatggagatcatgacccgggaggtgcagaccaatgacctgaaggaggtggtgaacaagctgatcccagacagcatcggcaaggacatcgagaaggcctgccagagcatctaccccctgcatgatgtgtttgtgaggaaggtgaagatgctgaagaagcccaagtttgagctgggcaagctgatggagctgcacggggagggcagcagcagcggcaaggccactggagatgagaccggggccaaggtggagcgggcagatggctatgagccccctgtgcaggagagcgtgtag

SEQ ID NO: 168345 - DNA, 792 bp, Artificial Sequence
  Description of Artificial Sequence: Synthetic coding sequence
atggcccggggccccaagaagcacctgaagagggtggccgcccccaagcactggatgctggacaagctgactggagtgtttgccccccggcccagcacaggcccccacaagctgcgggagtgcctgcccctcatcatcttcctgaggaaccggctgaagtatgccctgactggagatgaggtgaagaagatctgcatgcagcgcttcatcaagattgatggcaaggtgaggacagacatcacctacccagctggcttcatggatgtgatcagcattgacaagacaggagagaacttccgcctcatctatgacaccaagggccgctttgctgtgcaccgcatcaccccagaggaggccaagtacaagctgtgcaaggtgaggaagatctttgtgggcaccaagggcatcccccacctggtgacccatgatgcccggaccatccgctacccagaccccctcatcaaggtgaatgacaccatccagattgacctggagaccgggaagatcacagacttcatcaagtttgacaccggcaacctgtgcatggtgactggaggagccaacctgggccgcatcggggtcatcaccaaccgggagcggcaccctggcagctttgatgtggtgcacgtgaaggatgccaacggcaacagctttgccacccggctgagcaacatcttcgtcatcggcaagggcaacaagccctggatcagcctgccccggggcaagggcatccggctgaccatcgccgaggagcgggacaagaggctggccgccaagcagagcagcggctag

SEQ ID NO: 168346 - DNA, 369 bp, Artificial Sequence
  Description of Artificial Sequence: Synthetic coding sequence
atggcccggggccccaagaagcacctgaagagggtggccgcccccaagcactggatgctggacaagctgactggagtgtttgccccccggcccagcacaggcccccacaagctgcgggagtgcctgcccctcatcatcttcctgaggaaccggctgaagtatgccctgactggagatgaggtgaagaagatctgcatgcagcgcttcatcaagattgatggcaaggtgaggacagacatcacctacccagctggcttcatggatgtgatcagcattgacaagacaggagagaacttccgcctcatctatgacaccaagggccgctttgctgtgcaccgcatcaccccagaggaggccaagccctgctag

SEQ ID NO: 168347 - DNA, 792 bp, Artificial Sequence
  Description of Artificial Sequence: Synthetic coding sequence
atggcccggggccccaagaagcacctgaagagggtggccgcccccaagcactggatgctggacaagctgactggagtgtttgccccccggcccagcacaggcccccacaagctgcgggagtgcctgcccctgattgtgttcctgaggaaccggctgaagtatgccctgactggagatgaggtgaagaagatctgcatgcagcgcttcatcaagattgatggcaaggtgcgggtggatgtgacctacccagctggcttcatggatgtgatcagcattgagaagacaggagagcacttccggctggtgtatgacaccaagggccgctttgctgtgcaccgcatcaccgtggaggaggccaagtacaagctgtgcaaggtgaggaagatcaccgtgggcgtgaagggcatcccccacctggtgacccatgatgcccggaccatccgctacccagaccccgtcatcaaggtgaatgacacagtgcagattgacctgggcaccgggaagatcatcaacttcatcaagtttgacaccggcaacctgtgcatggtgattggaggagccaacctgggccgggtgggcgtcatcaccaaccgggagcggcaccctggcagctttgatgtggtgcacgtgaaggatgccaacggcaacagctttgccacccggctgagcaacatctttgtgattggaaatggaaacaagccctggatcagcctgccccggggcaagggcatccggctgactgtggccgaggagcgggacaagaggctggccaccaagcagagcagcggctag

SEQ ID NO: 168348 - DNA, 789 bp, Artificial Sequence
  Description of Artificial Sequence: Synthetic coding sequence
atgctgggccgcccagccaagttcagcaaggcccggggccccaagaagcacctgaagagggtggccgcccccaagcactggatgctggacaagctgactggagtgtttgccccccggcccagcacaggcccccacaagctgagagaatgtctgcccctcatcgtgttcctgaggaaccggctgaagtatgccctgactggagatgaggtgaagaagatctgcatgcagcgcttcatcaagattgatggcaaggtgcgggtggatgtgacctacccagctggcttcatggatgtgatcagcattgagaagacaggagagcacttccggctggtgtatgacaccaagggccgctttgctgtgcaccgcatcaccgtggaggaggccaagtacaagctgtgcaaggtgaggaagatcaccgtgggcgtgaagggcatcccccacctggtgacccatgatgcccggaccatccgctacccagaccctgtgatcaaggtgaatgacacagtgcagattgacctgggcaccgggaagatcatcaacttcatcaagtttgacaccggcaacctgtgcatggtgattggaggagccaacctgggccgggtgggcgtcatcaccaaccgggagcggcaccctggcagctttgatgtggtgcacgtgaaggatgccaatggaaacagctttgccacccggctgagcaacatctttgtgattggaaatggaaacaagccctggatcagcctgccccggggcaagggcatccggctgactgtggccgaggagcgggactag

SEQ ID NO: 168349 - DNA, 792 bp, Artificial Sequence
  Description of Artificial Sequence: Synthetic coding sequence
atggcccggggccccaagaagcacctgaagagggtggccgcccccaagcactggatgctggacaagctgactggagtgtttgccccccggcccagcacaggcccccacaagctgcgggagtgcctgcccctgattgtgttcctgaggaaccggctgaagtatgccctgactggagatgaggtgaagaagatctgcatgcagcacttcctgaagattgatggcaaggtgcgggtggacatcacctacccagctggcttcattgatgtgatcagcattgagaagacaggagagcacttccggctggtgtacaacaccaagggctgctttgctgtgcaccgcatcaccgtggaggaggccaagtacaagctgtgcaaggtgaggaagatcaccgtgggcaccaagggcatcccccacctggtgacccatgatgcccggaccatccgctacccagaccccctcatcaaggtgaatgacacagtgcagattgacctgggcaccgggaagatcaccagcttcatcaagtttgacacaggaaatgtgtgcatggtgattgctggggccaacctgggccgggtgggcgtcatcaccaaccgggagcggcaccctggcagctgtgatgtggtgcacgtgaaggatgccaacggcaacagctttgccacccgcatcagcaacatctttgtgattggaaatggaaacaagccctggatcagcctgccccggggcaagggcatccggctgaccatcgccgaggagcgggacaagaggctggccgccaagcagagcagcggctag

SEQ ID NO: 168350 - DNA, 615 bp, Artificial Sequence
  Description of Artificial Sequence: Synthetic coding sequence
atgacagagtgggagacagctgccccagctgtggccgagaccccagacatcaagctgtttgggaagtggagcacagatgatgtgcagatcaatgacatcagcctgcaggactacatcgctgtgaaggagaagtatgccaagtacctgccccacagcgctggccgctatgctgccaagcgcttcaggaaggcccagtgccccatcgtggagcggctgaccaacagcatgatgatgcatggaagaaataatggcaagaagctgatgacagtgcgcatcgtgaagcacgcctttgagatcatccacctgctgaccggggagaaccccctgcaggtgctggtgaatgccatcatcaacagcggcccccgggaggacagcacccgcatcggccgggccggcaccgtgcggcggcaggccgtggatgtgagccccctgcggcgggtgaaccaggccatctggctgctgtgcaccggggcccgggaggccgccttcaggaacatcaagaccatcgcagaatgtctggctgatgagctgatcaatgctgccaagggcagcagcaacagctatgccatcaagaagaaggatgagctggagcgggtggccaagagcaacagatag

SEQ ID NO: 168351 - DNA, 615 bp, Artificial Sequence; identical to SEQ ID NO: 168350
  Description of Artificial Sequence: Synthetic coding sequence

SEQ ID NO: 168352 - DNA, 657 bp, Artificial Sequence
  Description of Artificial Sequence: Synthetic coding sequence
atggccacagaggtggccgcagatgccctgggggaggagtggaagggctacgtggtgcgcatcagcggcggcaatgacaagcagggcttccccatgaagcagggcgtgctgacccacggccgggtgcggctgctgctgagcaagggccacagctgctaccggcccaggagaactggagagaggaagaggaagtctgtgcggggctgcatcgtggatgccaacctgtctgtgctgaacctggtgattgtgaagaagggggagaaggacatccctggcctgacagacaccaccgtgccccggcggctgggccccaagagggccagccgcatcaggaagctgttcaacctgagcaaagaagatgatgtgcggcagtatgtggtgaggaagcccctgaacaaggagggcaagaagcccaggaccaaggcccccaagatccagaggctggtgaccccccgggtgctgcagcacaagagaagaagaattgccctgaagaagcagaggaccaagaagaacaaggaggaggccgcagaatatgccaagctgctggccaagaggatgaaggaggccaaggagaagaggcaggagcagatcgccaagagaagaaggctgagcagcctgcgggccagcaccagcaagtctgagagcagccagaagtag

SEQ ID NO: 168353 - DNA, 276 bp, Artificial Sequence
  Description of Artificial Sequence: Synthetic coding sequence
atgaagctgaacatctccttccctgccaccggctgccagaagctgattgaggtggatgatgagaggaagctgcggaccttctatgagaagaggatggccacagaggtggccgcagatgccctgggggaggagtggaaggtgaaggtggacaagctgctgcaggtgttcaagtctgagaccgtgaatgccatcggcaactggtacctggagtggggcagtgacagcggcttctggctgctgaccttcggcaagctgctgcccaatgccaccctgtag

SEQ ID NO: 168354 - DNA, 657 bp, Artificial Sequence; identical to SEQ ID NO: 168352
  Description of Artificial Sequence: Synthetic coding sequence

SEQ ID NO: 168355 - DNA, 750 bp, Artificial Sequence
  Description of Artificial Sequence: Synthetic coding sequence
atgaagctgaacatctccttccctgccaccggctgccagaagctgattgaggtggatgatgagaggaagctgcggaccttctatgagaagaggatggccacagaggtggccgcagatgccctgggggaggagtggaagggctacgtggtgcgcatcagcggcggcaatgacaagcagggcttccccatgaagcagggcgtgctgacccacggccgggtgcggctgctgctgagcaagggccacagctgctaccggcccaggagaactggagagaggaagaggaagtctgtgcggggctgcatcgtggatgccaacctgtctgtgctgaacctggtgattgtgaagaagggggagaaggacatccctggcctgacagacaccaccgtgccccggcggctgggccccaagagggccagccgcatcaggaagctgttcaacctgagcaaggaggatgatgtgcggcagtatgtggtgaggaagcccctgaacaaggagggcaagaagcccaggaccaaggcccccaagatccagaggctggtgaccccccgggtgctgcagcacaagagaagacgcatcgccctgaagaagcagaggaccaagaagaacaaggaggaggccgcagaatatgccaagctgctggccaagaggatgaaggaggccaaggagaagaggcaggagcagatcgccaagagaagaaggctgagcagcctgcgggccagcaccagcaagtctgagagcagccagaagtag

SEQ ID NO: 168356 - DNA, 585 bp, Artificial Sequence
  Description of Artificial Sequence: Synthetic coding sequence
atgttcagcagcagcgccaagatcgtgaagcccaacggggagaagccagatgaatttgaaagtggcatcagccaggccctgctggagctggagatgaacagcgacctgaaggcccagctgcgggagctgaacatcacagctgccaaggagattgaggtgggcggcggcaggaaggccatcatcatctttgtgcctgtgccccagctgaagagcttccagaagatccaggtgcggctggtgcgggagctggagaagaagttcagcggcaagcacgtggtgttcatcgcccagaggcgcatcctgcccaagcccaccaggaagagcaggaccaagaacaagcagaagaggcccaggagcaggaccctgacagctgtgcatgatgccatcctggaggacctggtgttccccagcgagatcgtgggcaagaggatccgggtgaagctggatggcagccgcctcatcaaggtgcacctggacaaggcccagcagaacaacgtggagcacaaggtggagaccttcagcggcgtgtacaagaagctgaccgggaaggatgtgaactttgagttccctgagttccagctgtag

SEQ ID NO: 168357 - DNA, 585 bp, Artificial Sequence; identical to SEQ ID NO: 168356
  Description of Artificial Sequence: Synthetic coding sequence

SEQ ID NO: 168358 - DNA, 585 bp, Artificial Sequence; identical to SEQ ID NO: 168356
  Description of Artificial Sequence: Synthetic coding sequence

SEQ ID NO: 168359 - DNA, 567 bp, Artificial Sequence
  Description of Artificial Sequence: Synthetic coding sequence
atgggcatcagccgggacaactggcacaagaggaggaagacaggaggcaagaggaagccctaccacaagaagaggaaatatgagctgggccggcctgctgccaacaccaagattggcccccggcgcatccacacagtgcgggtgcggggcggctgcaccaggaagacccgcatcattgatgtggtgtacaatgccagcaacaatgagctggtgaggaccaagaccctggtgaagaactgcatcgtgctgattgacagcaccccctaccggcagtggtatgagagccactacgccctgcccctgggcaggaagaagggggccaagctgaccccagaggaggaggagatcctgaacaagaagaggagcaagaagatccagaagaagtatgatgagaggaagaagaatgccaagatcagcagcctgctggaggagcagttccagcagggcaagctgctggcctgcatcgccagcaggcctggccagtgtggccgggcagatggctacgtgctggagggcaaggagctggagttctacctgaggaagatcaaggccaggaagggcaagtag

SEQ ID NO: 168360 - DNA, 627 bp, Artificial Sequence
  Description of Artificial Sequence: Synthetic coding sequence
atgggcatcagccgggacaactggcacaagaggaggaagacaggaggcaagaggaagccctaccacaagaagaggaaatatgagctgggccggcctgctgccaacaccaagattggcccccggcgcatccacacagtgcgggtgcggggcggcaacaagaagtaccgggccctgcggctggatgtgggcaacttctcctggggcagcgagtgctgcaccaggaagacccgcatcattgatgtggtgtacaatgccagcaacaatgagctggtgaggaccaagaccctggtgaagaactgcatcgtgctgattgacagcaccccctaccggcagtggtatgagagccactacgccctgcccctgggcaggaagaagggggccaagctgaccccagaggaggaggagatcctgaacaagaagaggagcaagaagatccagaagaagtatgatgagaggaagaagaatgccaagatcagcagcctgctggaggagcagttccagcagggcaagctgctggcctgcatcgccagcaggcctggccagtgtggccgggcagatggctacgtgctggagggcaaggagctggagttctacctgaggaagatcaaggccaggaagggcaagtag

SEQ ID NO: 168361 - DNA, 585 bp, Artificial Sequence
  Description of Artificial Sequence: Synthetic coding sequence
atgcctgtggcccgctcctgggtgtgcaggaagacctacgtgaccccaagaagaccatttgagaagagccggctggaccaggagctgaagctgattggagaatatggcctgaggaacaagcgggaggtgtggagggtgaagttcaccctggccaagatcaggaaggccgcccgggagctgctgaccctggatgagaaggacccccggcggctgtttgagggcaatgccctgctgcggcggctggtgcgcatcggcgtgctggatgagggcaagatgaagctggactacatcctgggcctgaagattgaggacttcctggagcggcggctgcagacccaggtgttcaagctgggcctggccaagagcatccaccacgcccgggtgctgatccggcagaggcacatccgggtgaggaagcaggtggtgaacatccccagcttcatcgtgcggctggacagccagaagcacatcgacttcagcctgcggagcccctatggaggcggccggcccggccgggtgaagaggaagaatgccaagaagggccagggcggggccggggctggagatgatgaggaggaggactag

SEQ ID NO: 168362 - DNA, 585 bp, Artificial Sequence; identical to SEQ ID NO: 168361
  Description of Artificial Sequence: Synthetic coding sequence

SEQ ID NO: 168363 - DNA, 585 bp, Artificial Sequence; identical to SEQ ID NO: 168361
  Description of Artificial Sequence: Synthetic coding sequence

SEQ ID NO: 168364 - DNA, 420 bp, Artificial Sequence
  Description of Artificial Sequence: Synthetic coding sequence
atgcctgtggcccgctcctgggtgtgcaggaagacctacgtgaccccaagaagaccatttgagaagagccggctggaccaggagctgaagctgattggagaatatggcctgaggaacaagcgggaggtgtggagggtgaagttcaccctggccaagatcaggaaggccgcccgggagctgctgaccctggatgagaaggacccccggcggctgtttgagggcaatgccctgctgcggcggctggtgcgcatcggcgtgctggatgagggcaagatgaagctggactacatcctgggcctgaagattgaggacttcctggagcggcggctgcagacccaggtgttcaagctgggcctggccaagagcatccaccacgcccgggtgctgatccggcagaggcacatcagccccaggaggtag

SEQ ID NO: 168365 - DNA, 420 bp, Artificial Sequence; identical to SEQ ID NO: 168364
  Description of Artificial Sequence: Synthetic coding sequence

SEQ ID NO: 168366 - DNA, 471 bp, Artificial Sequence
  Description of Artificial Sequence: Synthetic coding sequence
atgcctgtggcccgctcctgggtgtgcaggaagacctacgtgaccccaagaagaccatttgagaagagccggctggaccaggagctgaagctgattggagaatatggcctgaggaacaagcgggaggtgtggagggtgaagttcaccctggccaagatcaggaaggccgcccgggagctgctgaccctggatgagaaggacccccggcggctgtttgagggcaatgccctgctgcggcggctggtgcgcatcggcgtgctggatgagggcaagatgaagctggactacatcctgggcctgaagattgaggacttcctggagcggcggctgcagacccaggtgttcaagctgggcctggccaagagcatccaccacgcccgggtgctgatccggcagaggcacatccgctaccacctgggctgggcccctgagagcagcagcacctgccccagtgatggctgcccccactag

SEQ ID NO: 168367 - DNA, 420 bp, Artificial Sequence; identical to SEQ ID NO: 168364
  Description of Artificial Sequence: Synthetic coding sequence

SEQ ID NO: 168368 - DNA, 2844 bp, Artificial Sequence
  Description of Artificial Sequence: Synthetic coding sequence
atggccaccagggtgaggacagccagcatctgggtgccccccctgcaggagaggaacagctcctgggaccgcatcaggaagctgcagggccaggagagcatcctgggccagggcaccccaggcctgcagcccctgcccggcaccccccggcagaagcagaagagccgccgcatcgagaaggtgctggagtggctgttcatcagccaggagcagcccaagatcaccaagtcctggggccccctgtccttcatggatgtgtttgtggacttcacctgggaggagtggcagctgctggaccctgcccagaagtgcctgtacagatctgtgatgctggagaactacagcaacctggtgtccctgggctaccagcacaccaagccagacatcatcttcaagctggagcagggcgaggagctgtgcatggtgcaggcccaggtgcccaaccagacctgccccaacacagtgtggaagattgatgacctgatggactggcaccaggagaacaaggacaagctgggcagcacagccaagagctttgagtgcaccaccttcggcaagctgtgcctgctgagcaccaagtacctgagccggcagaagccccacaagtgtggcacccacggcaagagcctgaagtacatcgacttcaccagtgactatgccaggaacaaccccaacggcttccaggtgcacggcaagagcttcttccacagcaagcatgagcagaccgtcatcggcatcaagtactgtgagagcattgagagcggcaagacagtgaacaagaagagccagctgatgtgccagcagatgtacatgggagagaagcccttcggctgcagctgctgtgagaaggccttcagcagcaagagctacctgctggtgcaccagcagacccatgctgaggagaagccctacggctgcaatgaatgtgggaaggacttcagcagcaagagctacctgattgtgcaccagaggatccacactggagagaagctgcatgaatgttctgagtgcaggaagaccttctccttccacagccagctggtgatccaccagaggatccacactggagagaacccctatgagtgctgtgaatgtgggaaggtgttcagcaggaaggaccagctggtgagccaccagaagacccacagcggccagaagccctacgtgtgcaatgaatgtgggaaggccttcggcctgaagagccagctgatcatccacgagcgcatccacactggagagaagccctatgaatgtaatgaatgccagaaggccttcaacaccaagagcaacctgatggtgcaccagaggacccacactggagagaagccctacgtgtgcagcgactgtgggaaggccttcaccttcaagagccagctgattgtgcaccagggcatccacactggagtgaagccctacggctgcatccagtgtgggaagggcttcagcctgaagagccagctgattgtgcaccagaggagccacacaggcatgaagccctacgtgtgcaatgaatgtgggaaggccttccgcagcaagagctacctgatcatccacaccaggacccacactggagagaagctgcacgagtgcaacaactgtgggaaggccttctccttcaagagccagctgatcatccaccagaggatccacactggagagaacccctatgaatgtcatgaatgtgggaaggccttcagcaggaagtaccagctgatcagccaccagaggacccatgctggggagaagccctatgaatgtacagactgtgggaaggccttcggcctgaagagccagctgatcatccaccagaggacccacactggagagaagccctttgaatgttctgagtgccagaaggccttcaacaccaagagcaacctgattgtgcaccagaggacccacactggagagaagccctacagctgcaatgaatgtgggaaggccttcaccttcaagagccagctgattgtgcacaagggcgtgcacactggagtgaagccctacggctgcagccagtgtgccaagaccttcagcctgaagagccagctgattgtgcaccagaggagccacactggagtgaagccctacggctgcagtgaatgtgggaaggccttccgcagcaagagctacctgatcatccacatgaggacccacactggagagaagccccatgaatgtcgggagtgtgggaagagcttctccttcaacagccagctgattgtgcaccagaggatccacactggagagaacccctatgaatgttctgaatgtgggaaggccttcaacaggaaggaccagctgatcagccaccagaggacccatgctggggagaagccctacggctgcagtgaatgtgggaaggccttcagcagcaagagctacctgatcatccacatgaggacccacagcggggagaagccctatgaatgtaatgaatgtgggaaggccttcatctggaagagcctgctgattgtgcatgagaggacccatgctggggtgaacccctacaagtgcagccagtgtgagaagagcttcagcggcaagctgcggctgctggtgcaccagaggatgcacacccgggagaagccctatgaatgttctgaatgtgggaaggccttcatccggaacagccagctgattgtgcaccagaggacccacagcggggagaagccctacggctgcaatgaatgtgggaagaccttcagccagaagagcatcctgagcgcccaccagaggacccacactggagagaagccctgcaagtgcacagaatgtgggaaggccttctgctggaagagccagctgatcatgcaccagaggacccacgtggatgacaagcactag

SEQ ID NO: 168369 - DNA, 768 bp, Artificial Sequence
  Description of Artificial Sequence: Synthetic coding sequence
atgccccgggaggaccgggccacctggaagagcaactacttcctgaagatcatccagctgctggatgactaccccaagtgcttcatcgtgggcgctgacaacgtgggcagcaagcagatgcagcagatccgcatgagcctgcggggcaaggctgtggtgctgatgggcaagaacaccatgatgaggaaggccatccggggccacctggagaacaacccagccctggagaagctgctgccccacatcagaggaaatgtgggctttgtgttcaccaaggaggacctgacagagatccgggacatgctgctggccaacaaggtgcctgctgctgcccgggccggggccatcgccccctgtgaggtgacagtgcctgcccagaacacaggcctgggccctgagaagaccagcttcttccaggccctgggcatcaccaccaagatcagccggggcaccatcgagatcctgggcgtgagaaatgtggcctctgtgtgcctgcagatcggctaccccaccgtggcctctgtgccccacagcatcatcaatggctacaagagggtgctggccctgtctgtggagacagactacaccttccccctggccgagaaggtgaaggccttcctggccgaccccagcgcctttgtggccgccgcccctgtggccgccgccaccacagctgccccagctgctgctgctgccccagccaaggtggaggccaaggaggagagcgaggagagtgatgaggacatgggcttcggcctgtttgattag

SEQ ID NO: 168370 - DNA, 954 bp, Artificial Sequence
  Description of Artificial Sequence: Synthetic coding sequence
atgccccgggaggaccgggccacctggaagagcaactacttcctgaagatcatccagctgctggatgactaccccaagtgcttcatcgtgggcgctgacaacgtgggcagcaagcagatgcagcagatccgcatgagcctgcggggcaaggctgtggtgctgatgggcaagaacaccatgatgaggaaggccatccggggccacctggagaacaacccagccctggagaagctgctgccccacatcagaggaaatgtgggctttgtgttcaccaaggaggacctgacagagatccgggacatgctgctggccaacaaggtgcctgctgctgcccgggccggggccatcgccccctgtgaggtgacagtgcctgcccagaacacaggcctgggccctgagaagaccagcttcttccaggccctgggcatcaccaccaagatcagccggggcaccatcgagatcctgagtgatgtgcagctgatcaagacaggagacaaggtgggcgccagcgaggccaccctgctgaacatgctgaacatcagccccttctcctttggcctggtgatccagcaggtgtttgacaatggcagcatctacaaccctgaggtgctggacatcacagaggagaccctgcacagccgcttcctggagggcgtgagaaatgtggcctctgtgtgcctgcagatcggctaccccaccgtggcctctgtgccccacagcatcatcaatggctacaagagggtgctggccctgtctgtggagacagactacaccttccccctggccgagaaggtgaaggccttcctggccgaccccagcgcctttgtggccgccgcccctgtggccgccgccaccacagctgccccagctgctgctgctgccccagccaaggtggaggccaaggaggagagcgaggagagtgatgaggacatgggcttcggcctgtttgattag

SEQ ID NO: 168371 - DNA, 954 bp, Artificial Sequence; identical to SEQ ID NO: 168370
  Description of Artificial Sequence: Synthetic coding sequence

SEQ ID NO: 168372 - DNA, 345 bp, Artificial Sequence
  Description of Artificial Sequence: Synthetic coding sequence
atggcctctgtgtctgagctggcctgcatctacagcgccctgatcctgcatgatgatgaggtgacagtgacagaggacaagatcaatgccctgatcaaggctgctggggtgaatgtggagcccttctggccaggcctgtttgccaaggccctggccaacgtgaacatcggcagcctcatctgcaatgtgggcgccggcggccctgccccagctgctggggccgccccagctgggggccctgcccccagcacagctgctgccccagctgaggagaagaaggtggaggccaagaaggaggagagcgaggagagtgatgatgacatgggcttcggcctgtttgattag

SEQ ID NO: 168373 - DNA, 270 bp, Artificial Sequence
  Description of Artificial Sequence: Synthetic coding sequence
atggcctctgtgtctgagctggcctgcatctacagcgccctgatcctgcatgatgatgaggtgacagtgacagccctggccaacgtgaacatcggcagcctcatctgcaatgtgggcgctgggggccctgccccagctgctggagctgccccagctgggggccctgcccccagcacagctgctgccccagctgaggagaagaaggtggaggccaagaaggaggagagcgaggagagtgatgatgacatgggcttcggcctgtttgattag

SEQ ID NO: 168374 - DNA, 2277 bp, Artificial Sequence
  Description of Artificial Sequence: Synthetic coding sequence
atggccccagccatgcagcctgctgagatccagtttgcccagaggctggccagcagcgagaagggcatccgggacagagctgtgaagaagctgcggcagtacatctctgtgaagacccagcgggagactggaggcttcagccaggaggagctgctgaagatctggaagggcctcttctactgcatgtgggtgcaggatgagcccctgctgcaggaggagctggccaacaccatcgcccagctggtgcatgctgtgaacaacagcgctgcccagcacctgttcatccagaccttctggcagaccatgaaccgggagtggaagggcatcgaccggctgcggctggacaagtactacatgctgatccggctggtgctgcggcagagctttgaggtgctgaagagaaatggctgggaggagagccgcatcaaggtgttcctggatgtgctgatgaaggaggtgctgtgcccagagagccagagccccaacggggtgcgcttccacttcatcgacatctacctggatgagctgagcaaggtgggcggcaaggagctgctggccgaccagaacctgaagttcatcgaccccttctgcaagattgctgccaagaccaaggaccacaccctggtgcagaccatcgcccggggcgtgtttgaggccatcgtggaccagagcccctttgtgcctgaggagaccatggaggagcagaagaccaaggtgggagatggagacctgtctgctgaggagatcccagaaaatgaggtgtccctgcggcgggctgtgtccaagaagaagacagccctgggcaagaaccacagcaggaaggatggcctgagtgatgagcggggcagagatgactgtggcacctttgaggacaccggccccctgctgcagtttgactacaaggctgtggccgaccggctgctggagatgaccagcaggaagaacaccccccacttcaacaggaagaggctgagcaagctgatcaagaagttccaggacctgtctgagggcagcagcatcagccagctgagctttgctgaggacatctctgcagatgaagatgaccagatcctgagccagggcaagcacaagaagaagggcaacaagctgctggagaagaccaacctggagaaggagaagggcagcagggtcttctgtgtggaggaggaggacagcgagagcagcctgcagaagagaagaaggaagaagaagaagaagcaccacctgcagcctgagaaccctggccctgggggcgccgcccccagcctggagcagaacagaggccgggagcctgaggccagcggcctgaaggccctgaaggcccgggtggccgagcccggggctgaggccaccagcagcactggagaggagagcggcagcgagcaccccccagctgtgcccatgcacaacaagaggaagaggcccaggaagaagagcccccgggcccaccgggagatgctggagagcgctgtgctgcccccagaggacatgagccagagcggccccagcggcagccacccccagggcccccggggcagccccactggaggagcccagctgctgaagaggaagaggaagctgggcgtggtgcctgtgaatggaagtggcctgagcaccccagcctggccacccctgcagcaggagggcccccccaccggccctgctgagggcgccaacagccacaccaccctgccccagaggcggcggctgcagaagaagaaggccggccctggcagcctggagctgtgtggcctgcccagccagaagacagccagcctgaagaagaggaagaagatgagggtgatgagcaacctggtggagcacaatggagtgctggagagcgaggccggccagccccaggccctgggcagcagcggcacctgcagcagcctgaagaagcagaagctgcgggcagagagtgactttgtgaagtttgacacccccttcctgcccaagcccctcttcttcagaagagccaagagcagcacagccacccaccccccaggccctgctgtgcagctgaacaagacccccagcagcagcaagaaggtgaccttcggcctgaacagaaacatgacagctgagttcaagaagacagacaagagcatcctggtgagccccaccggccccagccgggtggcctttgatcctgagcagaagcccctgcatggagtgctgaagacccccaccagcagccctgccagcagccccctggtggccaagaagcccctgaccaccaccccaagaagaagaccccgggccatggacttcttctag

SEQ ID NO: 168375 - DNA, 780 bp, Artificial Sequence
  Description of Artificial Sequence: Synthetic coding sequence
atgcctggggccaactaccgggccggggccggggccggggccggggcccggcggcccaggggggcccgggaccgggaggaggatggcggcggcctggagcctgctgctgtggcccgggacctgctgcggggcaccagcaacatgagctttgaggagctgctggagctgcagagccaggtgggcaccaagacctacaagcagctggtggccggcaacagccccaagaagcaggccagcaggcctcccatccagaatgcctgtgtggccgacaagcaccggcccctggagatgtctgccaagatccgggtgcccttcctgcggcaggtggtgcccatcagcaagaaggtggcccgggaccccaggtttgatgacctgagcggggagtacaaccctgaggtgtttgacaagacctaccagttcctgaatgacatccgggccaaggagaaggagctggtgaagaagcagctgaagaagcacctgtctggagaggagcacgagaagctgcagcagctgctgcagaggatggagcagcaggagatggcccagcaggagaggaagcagcagcaggagctgcacctggccctgaagcaggagcggcgggcccaggcccagcagggccaccggccctacttcctgaagaagtctgagcagaggcagctggccctggccgagaagttcaaggagctgaagaggagcaagaagctggagaacttcctgagcaggaagagaagaagaaatgccggcaaggacagaagacacctgcccctgagcaaggagtag

SEQ ID NO: 168376 - DNA, 4233 bp, Artificial Sequence
  Description of Artificial Sequence: Synthetic coding sequence
atggacatctatgacacccagaccctgggcgtggtggtgtttggaggcttcatggtggtgtctgccatcggcatcttcctggtgtccaccttctccatgaaggagaccagctatgaggaggccctggccaaccagaggaaggagatggccaagacccaccaccagaaggtggagaagaagaagaaggagaagacagtggagaagaagggcaagaccaagaagaaggaggagaagcccaacgggaagatcccagaccatgaccctgccccaaatgtgacagtgctgctgcgggagcctgtgcgggccccagctgtggccgtggcccccacccctgtgcagccccccatcatcgtggcccctgtggccaccgtgcctgccatgccccaggagaagctggccagcagccccaaggacaagaagaagaaggagaagaaggtggccaaggtggagcctgctgtgtcctctgtggtgaacagcatccaggtgctgaccagcaaggccgccatcctggagacagcccccaaggaggtgcccatggtggtggtgccccctgtgggcgccaagggcaacaccccagccaccggcaccacccagggcaagaaggccgagggcacccagaaccagagcaagaaggccgagggcgcccccaaccagggcaggaaggccgagggcacccccaaccagggcaagaagacagagggcacccccaaccagggcaagaaggccgagggcacccccaaccagggcaagaaggccgagggcacccccaaccagggcaagaaggccgagggcgcccagaaccagggcaagaaggtggacaccacccccaaccagggcaagaaggtggagggcgcccccacccagggcaggaaggccgagggcgcccagaaccaggccaagaaggtggagggcgcccagaaccagggcaagaaggccgagggcgcccagaaccagggcaagaagggggagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaagtctgagggcgcccagaaccagggcaagaaggtggagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggccgagggcgcccagaaccagggcaagaaggtggagggcgcccagaaccagggcaagaaggccgagggcgcccagaaccagggcaagaaggccgagggcgcccagaaccagggcaagaaggccgagggcgcccagaaccagggccagaagggggagggcgcccagaaccagggcaagaagacagagggcgcccagggcaagaaggccgagaggagccccaaccagggcaagaagggggagggcgcccccatccagggcaagaaggctgacagcgtggccaaccagggcaccaaggtggagggcatcaccaaccagggcaagaaggccgagggcagccccagcgagggcaagaaggccgagggcagccccaaccagggcaagaaggcagatgctgctgccaaccagggcaagaagacagagagcgcctctgtgcagggcaggaacacagatgtggcccagagccctgaggcccccaagcaggaggccccagccaagaagaagagcggcagcaagaagaagggggagcccggccccccagatgctgatggccccctgtacctgccctacaagaccctggtgtccacagtgggctccatggtgttcaatgaaggagaggcccagaggctgattgagatcctgtctgagaaggccggcatcatccaggacacctggcacaaggccacccagaagggggaccctgtggccatcctgaagaggcagctggaggagaaggagaagctgctggccacagagcaggaggatgctgctgtggccaagagcaagctgcgggagctgaacaaggagatggctgctgagaaggccaaggctgctgctggggaggccaaggtgaagaagcagctggtggcccgggagcaggagatcacagctgtgcaggccaggatgcaggccagctaccgggagcacgtgaaggaggtgcagcagctgcagggcaagatccgcaccctgcaggagcagctggagaatggccccaacacccagctggcccggctgcagcaggagaacagcatcctgagagatgccctgaaccaggccaccagccaggtggagagcaagcagaatgctgagctggccaagctgcggcaggagctgagcaaggtgtccaaggagctggtggagaagtctgaggccgtgcggcaggatgagcagcagaggaaggccctggaggccaaggccgccgcctttgagaagcaggtgctgcagctgcaggccagccaccgggagagcgaggaggccctgcagaagaggctggatgaggtgtcccgggagctgtgccacacccagagcagccacgccagcctgcgggcagatgctgagaaggcccaggagcagcagcagcagatggccgagctgcacagcaagctgcagagcagcgaggccgaggtgcgcagcaaatgtgaggagctgagcggcctgcacggccagctgcaggaggcccgggcagagaacagccagctgacagagcgcatccgcagcattgaggccctgctggaggccggccaggccagagatgcccaggatgtgcaggccagccaggccgaggccgaccagcagcagacccggctgaaggagctggagagccaggtgtctggcctggagaaggaggccatcgagctgcgggaggccgtggagcagcagaaggtgaagaacaatgacctgcgggagaagaactggaaggccatggaggccctggccacagctgagcaggcctgcaaggagaagctgctgagcctgacccaggccaaggaggagagcgagaagcagctgtgcctgattgaggcccagaccatggaggccctgctggccctgctgcctgagctgtctgtgctggcccagcagaactacacagagtggctgcaggacctgaaggagaagggccccaccctgctgaagcaccccccagccccagctgagcccagcagtgacctggccagcaagctgcgggaggccgaggagacccagagcaccctgcaggctgaatgtgaccagtaccgcagcatcctggccgagacagagggcatgctgcgggacctgcagaagtctgtggaggaggaggagcaggtgtggagggccaaggtgggcgctgctgaggaggagctgcagaagagccgggtgacagtgaagcacctggaggagatcgtggagaagctgaagggggagctggagagcagtgaccaggtgcgggagcacaccagccacctggaggccgagctggagaagcacatggctgctgccagcgctgagtgccagaactatgccaaggaggtggccggcctgcggcagctgctgctggagagccagagccagctggatgctgccaagtctgaggcccagaagcagagtgatgagctggccctggtgcggcagcagctgtctgagatgaagagccacgtggaggatggagacattgctggggccccagccagcagccctgaggcccctcctgctgagcaggaccctgtgcagctgaagacccagctggagtggacagaggccatcctggaggatgagcagacccagaggcagaagctgacagctgagtttgaggaggcccagaccagcgcctgccgcctgcaggaggagctggagaagctgaggacagctggccccctggagagcagcgagacagaggaggccagccagctgaaggagcggctggagaaggagaagaagctgaccagtgacctgggccgggccgccacccggctgcaggagctgctgaagaccacccaggagcagctggcccgggagaaggacacagtgaagaagctgcaggagcagctggagaaggcagaagatggcagcagcagcaaggagggcacctctgtgtag

SEQ ID NO: 168377 - DNA, 2934 bp, Artificial Sequence
  Description of Artificial Sequence: Synthetic coding sequence
atggacatctatgacacccagaccctgggcgtggtggtgtttggaggcttcatggtggtgtctgccatcggcatcttcctggtgtccaccttctccatgaaggagaccagctatgaggaggccctggccaaccagaggaaggagatggccaagacccaccaccagaaggtggagaagaagaagaaggagaagacagtggagaagaagggcaagaccaagaagaaggaggagaagcccaacgggaagatcccagaccatgaccctgccccaaatgtgacagtgctgctgcgggagcctgtgcgggccccagctgtggccgtggcccccacccctgtgcagccccccatcatcgtggcccctgtggccaccgtgcctgccatgccccaggagaagctggccagcagccccaaggacaagaagaagaaggagaagaaggtggccaaggtggagcctgctgtgtcctctgtggtgaacagcatccaggtgctgaccagcaaggccgccatcctggagacagcccccaaggagggcaggaacacagatgtggcccagagccctgaggcccccaagcaggaggccccagccaagaagaagagcggcagcaagaagaagggccccccagatgctgatggccccctgtacctgccctacaagaccctggtgtccacagtgggctccatggtgttcaatgaaggagaggcccagaggctcatcgagatcctgtctgagaaggccggcatcatccaggacacctggcacaaggccacccagaagggggaccctgtggccatcctgaagaggcagctggaggagaaggagaagctgctggccacagagcaggaggatgctgctgtggccaagagcaagctgcgggagctgaacaaggagatggctgctgagaaggccaaggctgctgctggggaggccaaggtgaagaagcagctggtggcccgggagcaggagatcacagctgtgcaggccaggatgcaggccagctaccgggagcacgtgaaggaggtgcagcagctgcagggcaagatccgcaccctgcaggagcagctggagaatggccccaacacccagctggcccggctgcagcaggagaacagcatcctgagagatgccctgaaccaggccaccagccaggtggagagcaagcagaatgctgagctggccaagctgcggcaggagctgagcaaggtgtccaaggagctggtggagaagtctgaggccgtgcggcaggatgagcagcagaggaaggccctggaggccaaggctgctgcctttgagaagcaggtgctgcagctgcaggccagccaccgggagagcgaggaggccctgcagaagaggctggatgaggtgtcccgggagctgtgccacacccagagcagccacgccagcctgcgggcagatgctgagaaggcccaggagcagcagcagcagatggccgagctgcacagcaagctgcagagcagcgaggccgaggtgcgcagcaaatgtgaggagctgagcggcctgcacggccagctgcaggaggcccgggcagagaacagccagctgacagagcgcatccgcagcattgaggccctgctggaggccggccaggccagagatgcccaggatgtgcaggccagccaggccgaggccgaccagcagcagacccggctgaaggagctggagagccaggtgtctggcctggagaaggaggccatcgagctgcgggaggccgtggagcagcagaaggtgaagaacaatgacctgcgggagaagaactggaaggccatggaggccctggccacagctgagcaggcctgcaaggagaagctgctgagcctgacccaggccaaggaggagagcgagaagcagctgtgcctgattgaggcccagaccatggaggccctgctggccctgctgcctgagctgtctgtgctggcccagcagaactacacagagtggctgcaggacctgaaggagaagggccccaccctgctgaagcaccccccagccccagctgagcccagcagtgacctggccagcaagctgcgggaggccgaggagacccagagcaccctgcaggccgagtgtgaccagtaccgcagcatcctggccgagacagagggcatgctgcgggacctgcagaagtctgtggaggaggaggagcaggtgtggagggccaaggtgggcgctgctgaggaggagctgcagaagagccgggtgacagtgaagcacctggaggagatcgtggagaagctgaagggggagctggagagcagtgaccaggtgcgggagcacaccagccacctggaggccgagctggagaagcacatggccgccgccagcgctgagtgccagaactatgccaaggaggtggccggcctgcggcagctgctgctggagagccagagccagctggatgctgccaagtctgaggcccagaagcagagtgatgagctggccctggtgcggcagcagctgtctgagatgaagagccacgtggaggatggagacattgctggggccccagccagcagccctgaggcccccccagctgagcaggaccctgtgcagctgaagacccagctggagtggacagaggccatcctggaggatgagcagacccagaggcagaagctgacagctgagtttgaggaggcccagaccagcgcctgccgcctgcaggaggagctggagaagctgaggacagctggccccctggagagcagcgagacagaggaggccagccagctgaaggagcggctggagaaggagaagaagctgaccagtgacctgggccgggccgccacccggctgcaggagctgctgaagaccacccaggagcagctggcccgggagaaggacacagtgaagaagctgcaggagcagctggagaaggccgaggatggcagcagcagcaaggagggcacctctgtgtag

SEQ ID NO: 168378 - DNA, 2934 bp, Artificial Sequence; identical to SEQ ID NO: 168377
  Description of Artificial Sequence: Synthetic coding sequence

SEQ ID NO: 168379 - DNA, 4233 bp, Artificial Sequence; identical to SEQ ID NO: 168376
  Description of Artificial Sequence: Synthetic coding sequence

SEQ ID NO: 168380 - DNA, 903 bp, Artificial Sequence
  Description of Artificial Sequence: Synthetic coding sequence
atggacatctatgacacccagaccctgggcgtggtggtgtttggaggcttcatggtggtgtctgccatcggcatcttcctggtgtccaccttctccatgaaggagaccagctatgaggaggccctggccaaccagaggaaggagatggccaagacccaccaccagaaggtggagaagaagaagaaggagaagacagtggagaagaagggcaagaccaagaagaaggaggagaagcccaacgggaagatcccagaccatgaccctgccccaaatgtgacagtgctgctgcgggagcctgtgcgggccccagctgtggccgtggcccccacccctgtgcagccccccatcatcgtggcccctgtggccaccgtgcctgccatgccccaggagaagctggccagcagccccaaggacaagaagaagaaggagaagaaggtggccaaggtggagcctgctgtgtcctctgtggtgaacagcatccaggtgctgaccagcaaggccgccatcctggagacagcccccaaggaggtgcccatggtggtggtgccccctgtgggcgccaagggcaacaccccagccaccggcaccacccagggcaagaaggccgagggcacccagaaccagagcaagaaggccgagggcgcccccaaccagggcaggaaggccgagggcacccccaaccagggcaagaagacagagggcacccccaaccagggcaagaaggccgagggcacccccaaccagggcaagaaggccgagggcacccccaaccagggcaagaaggccgagggcgcccagaaccagggcaagaaggtggacaccacccccaaccagggcaagaaggtggagggcgcccccacccagggcaggaaggccgagggcgcccagaaccaggccaagtag

SEQ ID NO: 168381 - DNA, 2256 bp, Artificial Sequence
  Description of Artificial Sequence: Synthetic coding sequence
atggtgttcaatgaaggagaggcccagaggctcatcgagatcctgtctgagaaggccggcatcatccaggacacctggcacaaggccacccagaagggggaccctgtggccatcctgaagaggcagctggaggagaaggagaagctgctggccacagagcaggaggatgctgctgtggccaagagcaagctgcgggagctgaacaaggagatggctgctgagaaggccaaggctgctgctggggaggccaaggtgaagaagcagctggtggcccgggagcaggagatcacagctgtgcaggccaggatgcaggccagctaccgggagcacgtgaaggaggtgcagcagctgcagggcaagatccgcaccctgcaggagcagctggagaatggccccaacacccagctggcccggctgcagcaggagaacagcatcctgagagatgccctgaaccaggccaccagccaggtggagagcaagcagaatgctgagctggccaagctgcggcaggagctgagcaaggtgtccaaggagctggtggagaagtctgaggccgtgcggcaggatgagcagcagaggaaggccctggaggccaaggctgctgcctttgagaagcaggtgctgcagctgcaggccagccaccgggagagcgaggaggccctgcagaagaggctggatgaggtgtcccgggagctgtgccacacccagagcagccacgccagcctgcgggcagatgctgagaaggcccaggagcagcagcagcagatggccgagctgcacagcaagctgcagagcagcgaggccgaggtgcgcagcaaatgtgaggagctgagcggcctgcacggccagctgcaggaggcccgggcagagaacagccagctgacagagcgcatccgcagcattgaggccctgctggaggccggccaggccagagatgcccaggatgtgcaggccagccaggccgaggccgaccagcagcagacccggctgaaggagctggagagccaggtgtctggcctggagaaggaggccatcgagctgcgggaggccgtggagcagcagaaggtgaagaacaatgacctgcgggagaagaactggaaggccatggaggccctggccacagctgagcaggcctgcaaggagaagctgctgagcctgacccaggccaaggaggagagcgagaagcagctgtgcctgattgaggcccagaccatggaggccctgctggccctgctgcctgagctgtctgtgctggcccagcagaactacacagagtggctgcaggacctgaaggagaagggccccaccctgctgaagcaccccccagccccagctgagcccagcagtgacctggccagcaagctgcgggaggccgaggagacccagagcaccctgcaggccgagtgtgaccagtaccgcagcatcctggccgagacagagggcatgctgcgggacctgcagaagtctgtggaggaggaggagcaggtgtggagggccaaggtgggcgctgctgaggaggagctgcagaagagccgggtgacagtgaagcacctggaggagatcgtggagaagctgaagggggagctggagagcagtgaccaggtgcgggagcacaccagccacctggaggccgagctggagaagcacatggccgccgccagcgctgagtgccagaactatgccaaggaggtggccggcctgcggcagctgctgctggagagccagagccagctggatgctgccaagtctgaggcccagaagcagagtgatgagctggccctggtgcggcagcagctgtctgagatgaagagccacgtggaggatggagacattgctggggccccagccagcagccctgaggcccccccagctgagcaggaccctgtgcagctgaagacccagctggagtggacagaggccatcctggaggatgagcagacccagaggcagaagctgacagctgagtttgaggaggcccagaccagcgcctgccgcctgcaggaggagctggagaagctgaggacagctggccccctggagagcagcgagacagaggaggccagccagctgaaggagcggctggagaaggagaagaagctgaccagtgacctgggccgggccgccacccggctgcaggagctgctgaagaccacccaggagcagctggcccgggagaaggacacagtgaagaagctgcaggagcagctggagaaggccgaggatggcagcagcagcaaggagggcacctctgtgtag

SEQ ID NO: 168382 - DNA, 663 bp, Artificial Sequence
  Description of Artificial Sequence: Synthetic coding sequence
atggccagcggctgcaagattggccccagcatcctgaacagcgacctggccaacctgggcgctgagtgcctgaggatgctggacagcggggctgactacctgcacctggatgtgatggatggctacatgcacatgatggtgtccaagccagagcagtgggtgaagcccatggctgtggccggggccaaccagtacaccttccacctggaggccacagaaaatcctggggccctgatcaaggacatccgggagaatggcatgaagagctgcagcgtgacccaggccgaggtgcagtggcacagccagggccccctgcaggtgggcctggccatcaagccaggcacctctgtggagtacctggccccctgggccaaccagattgacatggccctggtgatgacagtggagcccggctttggaggccagaagttcatggaggacatgatgcccaaggtgcactggctgcggacccagttccccagcctggacatcgaggtggatggaggagtgggccctgacacagtgcacaagtgtgccgaggccggggccaacatgattgtgtctggcagcgccatcatgaggtctgaggaccccaggagcgtcatcaacctgctgagaaatgtgtgcagcgaggccgcccagaagaggagcctggacagatag

SEQ ID NO: 168383 - DNA, 687 bp, Artificial Sequence
  Description of Artificial Sequence: Synthetic coding sequence
atggccagcggctgcaagattggccccagcatcctgaacagcgacctggccaacctgggcgctgagtgcctgaggatgctggacagcggggctgactacctgcacctggatgtgatggatggccactttgtgcccaacatcaccttcggccaccctgtggtggagagcctgaggaagcagctgggccaggaccccttctttgacatgcacatgatggtgtccaagccagagcagtgggtgaagcccatggctgtggccggggccaaccagtacaccttccacctggaggccacagaaaatcctggggccctgatcaaggacatccgggagaatggcatgaaggtgggcctggccatcaagccaggcacctctgtggagtacctggccccctgggccaaccagattgacatggccctggtgatgacagtggagcccggctttggaggccagaagttcatggaggacatgatgcccaaggtgcactggctgcggacccagttccccagcctggacatcgaggtggatggaggagtgggccctgacacagtgcacaagtgtgccgaggccggggccaacatgattgtgtctggcagcgccatcatgaggtctgaggaccccaggagcgtcatcaacctgctgagaaatgtgtgcagcgaggccgcccagaagaggagcctggacagatag

SEQ ID NO: 168384 - DNA, 537 bp, Artificial Sequence
  Description of Artificial Sequence: Synthetic coding sequence
atgcacatgatggtgtccaagccagagcagtgggtgaagcccatggctgtggccggggccaaccagtacaccttccacctggaggccacagaaaatcctggggccctgatcaaggacatccgggagaatggcatgaagagctgcagcgtgacccaggccgaggtgcagtggcacagccagggccccctgcaggtgggcctggccatcaagccaggcacctctgtggagtacctggccccctgggccaaccagattgacatggccctggtgatgacagtggagcccggctttggaggccagaagttcatggaggacatgatgcccaaggtgcactggctgcggacccagttccccagcctggacatcgaggtggatggaggagtgggccctgacacagtgcacaagtgtgccgaggccggggccaacatgattgtgtctggcagcgccatcatgaggtctgaggaccccaggagcgtcatcaacctgctgagaaatgtgtgcagcgaggccgcccagaagaggagcctggacagatag

SEQ ID NO: 168385 - DNA, 537 bp, Artificial Sequence; identical to SEQ ID NO: 168384
  Description of Artificial Sequence: Synthetic coding sequence

SEQ ID NO: 168386 - DNA, 285 bp, Artificial Sequence
  Description of Artificial Sequence: Synthetic coding sequence
atgcacatgatggtgtccaagccagagcagtgggtgaagcccatggctgtggccggggccaaccagtacaccttccacctggaggccacagaaaatcctggggccctgatcaaggacatccgggagaatggcatgaagagctgcagcgtgacccaggccgaggtgcagtggcacagccagggccccctgcaggtgggcctggccatcaagccaggcacctctgtggagtacctggccccctgggccaaccagattgacatggccctggtgatgacagtggagtag

SEQ ID NO: 168387 - DNA, 537 bp, Artificial Sequence; identical to SEQ ID NO: 168384
  Description of Artificial Sequence: Synthetic coding sequence

SEQ ID NO: 168388 - DNA, 600 bp, Artificial Sequence
  Description of Artificial Sequence: Synthetic coding sequence
atggccagcggctgcaagattggccccagcatcctgaacagcgacctggccaacctgggcgctgagtgcctgaggatgctggacagcggggctgactacctgcacctggatgtgatggatggccactttgtgcccaacatcaccttcggccaccctgtggtggagagcctgaggaagcagctgggccaggaccccttctttgacatgcacatgatggtgtccaagccagagcagtgggtgaagcccatggctgtggccggggccaaccagtacaccttccacctggaggccacagaaaatcctggggccctgatcaaggacatccgggagaatggcatgaaggtgggcctggccatcaagccaggcacctctgtggagtacctggccccctgggccaaccagattgacatggccctggtgatgacagtggagcccggctttggaggccagaagttcatggaggacatgatgcccaaggccggggccaacatgattgtgtctggcagcgccatcatgagaagtgaggaccccaggagcgtcatcaacctgctgagaaatgtgtgcagcgaggccgcccagaagaggagcctggacagatag

SEQ ID NO: 168389 - DNA, 3159 bp, Artificial Sequence
  Description of Artificial Sequence: Synthetic coding sequence
atgagggaggccgctgagcggcggcagcagctgcagctggagcatgaccaggccctggccgtgctgagcgccaagcagcaggagattgacctgctgcagaagagcaaggtgcgggagctggaggagaagtgcaggacccagagcgagcagttcaacctgctgagccgggacctggagaagttccggcagcacgccggcaagattgacctgctgggcggcagcgctgtggcccccctggacatcagcacagcccccagcaagcccttcccccagttcatgaatggcctggccaccagcctgggcaagggccaggagagcgccatcggcggcagcagcgccatcggggagtacatccggcccctgccccagcccggggacaggcctgagcccctgagcgccaagcccaccttcctgagccgcagcggcagcgcccgctgccgctctgagagtgacatggagaatgaaagaaacagcaacaccagcaagcagcgctacagcggcaaggtgcacctgtgtgtggcccgctacagctacaacccctttgatggccccaatgaaaatcctgaggccgagctgcccctgacagctgggaagtacctgtatgtgtatggagacatggatgaagatggcttctatgaaggagagctgctggatggccagaggggcctggtgcccagcaactttgtggactttgtgcaggacaatgaaagccggctggccagcaccctgggcaatgagcaggaccagaacttcatcaaccacagcggcatcggcctggagggggagcacatcctggacctgcacagccccacccacattgatgctggcatcacagacaacagcgctggcaccctggatgtgaacattgatgacatcggggaggacatcgtgccctaccccaggaagatcaccctcatcaagcagctggccaagagcgtcatcgtgggctgggagcccccagctgtgcccccaggctggggcaccgtgtcctcctacaacgtgctggtggacaaggagaccaggatgaacctgaccctgggcagcaggaccaaggccctgattgagaagctgaacatggccgcctgcacctaccgcatctctgtgcagtgtgtgaccagccggggcagcagtgatgagctgcagtgcaccctgctggtgggcaaggatgtggtggtggcccccagccacctgcgggtggacaacatcacccagatcagcgcccagctgtcctggctgcccaccaacagcaactacagccacgtgatcttcctgaatgaggaggagtttgatattgtgaaggccgcccgctacaagtaccagttcttcaacctgcggcccaacatggcctacaaggtgaaggtgctggccaagccccaccagatgccctggcagctgcccctggagcagcgggagaagaaggaggcctttgtggagttcagcaccctgcctgctggccccccagccccaccccaggatgtgacagtgcaggccggcgtgaccccagccaccatccgggtgtcctggaggcctcctgtgctgacccccaccggcctgagcaatggagccaacgtgacaggctatggagtgtatgccaagggccagagggtggccgaggtgatcttccccacagctgacagcacagctgtggagctggtgcggctgcggagcctggaggccaagggcgtgacagtgaggaccctgagcgcccagggcgagagcgtggacagcgctgtggccgctgtgcccccagagctgctggtgccccccaccccccaccccaggcctgccccccagagcaagcccctggccagcagtggagtgcctgagaccaaggatgagcacctgggcccccacgccaggatggatgaggcctgggagcagagccgggcccctggccctgtgcacggccacatgctggagccccctgtgggccctggaagaagaagccccagccccagccgcatcctgccccagccccagggcacccctgtgtccaccaccgtggccaaggccatggcccgggaggccgcccagagggtggccgagagcagccggctggagaagaggagcgtcttcctggagaggagcagcgctggccagtatgctgccagtgatgaagaagatgcctatgacagcccagacttcaagagaagaggagcctctgtggatgacttcctgaagggcagcgagctgggcaagcagccccactgctgccacggagatgagtaccacacagagagcagccggggcagtgacctgagtgacatcatggaggaggatgaggaggagctgtacagcgagatgcagctggaggatggcggcagaagaagaccttctggcaccagccacaatgccctgaagatcctgggcaacccagccagcgctggccgggtggaccacatgggccgccgcttcccccggggcagcgctggcccccagaggagcaggcctgtgacagtgcccagcattgatgattatggccgggaccggctgagcccagacttctatgaggagagcgagacagatcctggagctgaggagctgcctgcccgcatctttgtggccctgtttgattatgaccccctgaccatgagccccaacccagatgctgctgaggaggagctgcccttcaaggagggccagatcatcaaggtgtatggagacaaggatgctgatggcttctacagaggagagacctgtgcccggctgggcctcatcccctgcaacatggtgtctgagatccaggctgatgatgaggagatgatggaccagctgctgcggcagggcttcctgcccctgaacacccctgtggagaagattgaaagaagccgccgcagcggccgccgccacagcgtgtccaccaggaggatggtggccctgtatgactatgacccccgggagagcagccccaacgtggatgtggaggccgagctgaccttctgcaccggggacatcatcaccgtgtttggagaaattgatgaagatggcttctactatggagagctgaatggccagaagggcctggtgcccagcaacttcctggaggaggtgcctgatgatgtggaggtgtacctgagtgatgcccccagccactacagccaggacacccccatgaggagcaaggccaagaggaagaagtctgtgcacttcaccccctag

SEQ ID NO: 168390 - DNA, 1938 bp, Artificial Sequence
  Description of Artificial Sequence: Synthetic coding sequence
atgaatggcctggccaccagcctgggcaagggccaggagagcgccatcggcggcagcagcgccatcggggagtacatccggcccctgccccagcccggggacaggcctgagcccctgagcgccaagcccaccttcctgagccgcagcggcagcgcccgctgccgctctgagagtgacatggagaatgaaagaaacagcaacaccagcaagcagcgctacagcggcaaggtgcacctgtgtgtggcccgctacagctacaacccctttgatggccccaatgaaaatcctgaggccgagctgcccctgacagctgggaagtacctgtatgtgtatggagacatggatgaagatggcttctatgaaggagagctgctggatggccagaggggcctggtgcccagcaactttgtggactttgtgcaggacaatgaaagccggctggccagcaccctgggcaatgagcaggaccagaacttcatcaaccacagcggcatcggcctggagggggagcacatcctggacctgcacagccccacccacattgatgctggcatcacagacaacagcgctggcaccctggatgtgaacattgatgacatcggggaggacatcgtgccctaccccaggaagatcaccctcatcaagcagctggccaagagcgtcatcgtgggctgggagcccccagctgtgcccccaggctggggcaccgtgtcctcctacaacgtgctggtggacaaggagaccaggatgaacctgaccctgggcagcaggaccaaggccctgattgagaagctgaacatggccgcctgcacctaccgcatctctgtgcagtgtgtgaccagccggggcagcagtgatgagctgcagtgcaccctgctggtgggcaaggatgtggtggtggcccccagccacctgcgggtggacaacatcacccagatcagcgcccagctgtcctggctgcccaccaacagcaactacagccacgtgatcttcctgaatgaggaggagtttgatattgtgaaggccgcccgctacaagtaccagttcttcaacctgcggcccaacatggcctacaaggtgaaggtgctggccaagccccaccagatgccctggcagctgcccctggagcagcgggagaagaaggaggcctttgtggagttcagcaccctgcctgctggccccccagccccaccccaggatgtgacagtgcaggccggcgtgaccccagccaccatccgggtgtcctggaggcctcctgtgctgacccccaccggcctgagcaatggagccaacgtgacaggctatggagtgtatgccaagggccagagggtggccgaggtgatcttccccacagctgacagcacagctgtggagctggtgcggctgcggagcctggaggccaagggcgtgacagtgaggaccctgagcgcccagggcgagagcgtggacagcgctgtggccgctgtgcccccagagctgctggtgccccccaccccccaccccaggcctgccccccagagcaagcccctggccagcagtggagtgcctgagaccaaggatgagcacctgggcccccacgccaggatggatgaggcctgggagcagagccgggcccctggccctgtgcacggccacatgctggagccccctgtgggccctggaagaagaagccccagccccagccgcatcctgccccagccccagggcacccctgtgtccaccaccgtggccaaggccatggcccgggaggccgcccagagggtggccgagagcagccggctggagaagaggagcgtcttcctggagaggagcagcgctggccagtatgctgccagtgatgaagaagatgcctatgacagcccagacttcaagagaagaggagcctctgtggatgacttcctgaagggcagcgagctgggcaagcagatggccagctag

SEQ ID NO: 168391 - DNA, 1938 bp, Artificial Sequence
  Description of Artificial Sequence: Synthetic coding sequence
atgaatggcctggccaccagcctgggcaagggccaggagagcgccatcggcggcagcagcgccatcggggagtacatccggcccctgccccagcccggggacaggcctgagcccctgagcgccaagcccaccttcctgagccgcagcggcagcgcccgctgccgctctgagagtgacatggagaatgaaagaaacagcaacaccagcaagcagcgctacagcggcaaggtgcacctgtgtgtggcccgctacagctacaacccctttgatggccccaatgaaaatcctgaggccgagctgcccctgacagctgggaagtacctgtatgtgtatggagacatggatgaagatggcttctatgaaggagagctgctggatggccagaggggcctggtgcccagcaactttgtggactttgtgcaggacaatgaaagccggctggccagcaccctgggcaatgagcaggaccagaacttcatcaaccacagcggcatcggcctggagggggagcacatcctggacctgcacagccccacccacattgatgctggcatcacagacaacagcgctggcaccctggatgtgaacattgatgacatcggggaggacatcgtgccctaccccaggaagatcaccctcatcaagcagctggccaagagcgtcatcgtgggctgggagcccccagctgtgcccccaggctggggcaccgtgtcctcctacaacgtgctggtggacaaggagaccaggatgaacctgaccctgggcagcaggaccaaggccctgattgagaagctgaacatggccgcctgcacctaccgcatctctgtgcagtgtgtgaccagccggggcagcagtgatgagctgcagtgcaccctgctggtgggcaaggatgtggtggtggcccccagccacctgcgggtggacaacatcacccagatcagcgcccagctgtcctggctgcccaccaacagcaactacagccacgtgatcttcctgaatgaggaggagtttgatattgtgaaggccgcccgctacaagtaccagttcttcaacctgcggcccaacatggcctacaaggtgaaggtgctggccaagccccaccagatgccctggcagctgcccctggagcagcgggagaagaaggaggcctttgtggagttcagcaccctgcctgctggccccccagccccaccccaggatgtgacagtgcaggccggcgtgaccccagccaccatccgggtgtcctggaggcctcctgtgctgacccccaccggcctgagcaatggagccaacgtgacaggctatggagtgtatgccaagggccagagggtggccgaggtgatcttccccacagctgacagcacagctgtggagctggtgcggctgcggagcctggaggccaagggcgtgacagtgaggaccctgagcgcccagggcgagagcgtggacagcgctgtggccgctgtgcccccagagctgctggtgccccccaccccccaccccaggcctgccccccagagcaagcccctggccagcagtggagtgcctgagaccaaggatgagcacctgggcccccacgccaggatggatgaggcctgggagcagagccgggcccctggccctgtgcacggccacatgctggagccccctgtgggccctggaagaagaagccccagccccagccgcatcctgccccagccccagggcacccctgtgtccaccaccgtggccaaggccatggcccgggaggccgcccagagggtggccgagagcagccggctggagaagaggagcgtcttcctggagaggagcagcgctggccagtatgctgccagtgatgaagaagatgcctatgacagcccagacttcaagagaagaggagcctctgtggatgacttcctgaagggcagcgagctgggcaagcagatggtgtcctag

SEQ ID NO: 168392 - DNA, 4638 bp, Artificial Sequence
  Description of Artificial Sequence: Synthetic coding sequence
atgcagcgggagcgggaggccgagatccggcagctgctgcgctggaaggaggccgagcagaggcagctgcagcagctgctgcaccgggagagagatggagtggtgcggcaggcccgggagctgcagaggcagctggccgaggagctggtgaacagaggccactgcagcaggcctggggccagcgaggtgtctgctgcccagtgccgctgccgcctgcaggaggtgctggcccagctgcgctggcagacagatggagagcaggccgcccgcatccgctacctgcaggccgccctggaggtggagcggcagctgttcctgaagtacatcctggcccacttccggggccacccagccctgagcggcagcccagacccccaggccgtgcacagcctggaggagcccctgccccagaccagcagcggcagctgccacgcccccaagccagcctgccagctgggcagcctggacagcctgtctgctgaggtgggcgtgcgcagccgcagcctgggcctggtgagcagcgcctgcagcagcagcccagatggcctgctgagcacccacgccagcagcctggactgctttgccccagcctgcagccgcagcctggacagcaccaggagcctgcccaaggccagcaagtctgaggagcggcccagcagcccagacaccagcaccccaggcagccggcggctgagccccccacccagccccctgcccccacctcctcctccttctgcccacaggaagctgagcaacccccggggcggggagggcagcgagagccagccctgtgaggtgctgacccccagccccccaggcctgggccaccacgagctgatcaagctgaactggctgctggccaaggccctgtgggtgctggcccggcgctgctacaccctgcaggccgagaacaagcagctgcggcgggccggctgcccctaccaggctgatgagaaggtgaagaggctgaaggtgaagagagctgagctgaccggcctggcccggcggctggccgaccgggccaggaagctgcaggagaccaacctgcgggctgtgtctgcccccatccctggagagagctgtgccggcctggagctgtgccaggtgtttgcccggcagagggcccgggacctgtctgagcaggccagcgcccccctggccaaggacaagcagatcgaggagctgcggcaggagtgccacctgctgcaggcccgggtggccagcggcccctgcagcgacctgcacacaggccggggcggcccctgcacccagtggctgaatgtgcgggacctggaccggctgcagcgggagagccagcgggaggtgctgcggctgcagaggcagctgatgctgcagcagggcaatggaggagcctggccagaggccggcggccagagcgccacctgtgaggaggtgcggcggcagatgctggccctggagcgggagctggaccagaggagaagagagtgccaggagctgggcgcccaggccgccccagcccggcggcggggggaggaggccgagacccagctgcaggccgccctgctgaagaatgcctggctggccgaggagaatggccgcctgcaggccaagacagactgggtgaggaaggtggaggctgaaaattctgaggtgcggggccacctgggccgggcctgccaggagagagatgccagcggcctgattgctgagcagctgctgcagcaggccgcccggggccaggaccggcagcagcagctgcagagggacccccagaaggccctgtgtgacctgcaccccagctggaaggagatccaggccctgcagtgcaggcctggccaccccccagagcagccctgggagaccagccagatgcctgagagccaggtgaagggcagcagaagacccaagttccacgcccggcctgaggactatgctgtgtcccagcccaacagagacatccaggagaagcgggaggccagcctggaggagagccctgtggccctgggggagagcgcctctgtgccccaggtgtctgagaccgtgcctgccagccagcccctgagcaagaagaccagcagccagagcaacagcagcagcgagggctccatgtgggccaccgtgcccagcagccccaccctggaccgggacacagccagcgaggtggatgacctggagccagacagcgtgtccctggccctggagatgggcggcagcgctgccccagctgcccccaagctgaagatcttcatggcccagtacaactacaacccctttgagggccccaatgaccaccctgagggggagctgcccctgacagctggggactacatctacatctttggagacatggatgaagatggcttctatgaaggagagctggaggatggaagaagaggcctggtgcccagcaactttgtggagcagatcccagacagctacatccctggctgcctgcctgccaagagcccagacctgggccccagccagctgcctgctggccaggatgaggccctggaggaggacagcctgctgagcggcaaggcccagggcgtggtggaccggggcctgtgccagatggtgcgggtgggcagcaagacagaggtggccacagagatcctggacaccaagacagaggcctgccagctgggcctgctgcagagcatgggcaagcagggcctgagccggcccctgctgggcaccaagggcgtgctgaggatggcccccatgcagctgcacctgcagaatgtgacagccaccagcgccaacatcacctgggtgtacagcagccaccgccacccccacgtggtgtacctggatgaccgggagcacgccctgaccccagctggggtgtcctgctacaccttccagggcctgtgccccggcacccactaccgggcccgggtggaggtgcggctgccccgggacctgctgcaggtgtactggggcaccatgagcagcacagtgacctttgacaccctgctggccggccccccctacccacccctggatgtgctggtggagagacatgccagccctggggtgctggtggtgtcctggctgcctgtgaccatcgacagcgctggcagcagcaatggagtgcaggtgacaggctatgctgtgtatgcagatggcctgaaggtgtgtgaggtggctgatgccacagctggcagcaccctgctggagttcagccagctgcaggtgcccctgacctggcagaaggtgtctgtgaggaccatgagcctgtgtggggagagcctggacagcgtgcctgcccagatccctgaggacttcttcatgtgccaccgctggccagagaccccacccttctcctacacctgtggggaccccagcacctacagagtgaccttccctgtgtgcccccagaagctgagcctggccccacccagcgccaaggccagcccccacaaccctggcagctgtggggagccccaggccaagttcctggaggccttctttgaggagcccccccggcggcagagccctgtgagcaacctgggctctgaaggagaatgtcccagcagtggagctggcagccaggcccaggagctggccgaggcctgggagggctgcaggaaggacctgctcttccagaagagcccccagaaccaccggccccccagcgtgtctgaccagcctggagagaaggagaactgcagccagcacatgggcaccagcaagagccctgcccctggcttcatccacctgaggacagaatgtggccccaggaaggagccctgccaggagaaggccgccctggagcgggtgctgcggcagaagcaggatgcccagggcttcaccccaccccagctgggcgccagccagcagtatgccagtgacttccacaacgtgctgaaggaggagcaggaggccctgtgcctggacctgtggggcacagaaagaagagaggagcggcgggagcctgagccccacagccggcagggccaggccctgggcgtgaagaggggctgccagctgcacgagcccagcagcgccctgtgcccagcccccagcgccaaggtgatcaagatgccccggggcggcccccagcagctgggcaccggggccaacaccccagcccgggtgtttgtggccctgagtgactacaaccccctggtgatgtctgccaacctgaaggctgctgaggaggagctggtgttccagaagaggcagctgctgcgggtgtggggcagccaggacacccatgacttctacctgtctgagtgcaaccggcaggtgggcaacatccctggccgcctggtggccgagatggaggtgggcacagagcagacagaccggcgctggaggagccctgcccagggcaacctgcccagcgtggcccacctggaggacttccagggcctgaccatcccccagggcagcagcctggtgctgcagggcaacagcaagaggctgcccctgtggacccccaagatcatgattgctgccctggactatgaccctggagatggccagatgggcggccagggcaagggccgcctggccctgcgggctggagatgtggtgatggtgtatggccccatggatgaccagggcttctactacggggagctgggcggccaccggggcctggtgcctgcccacctgctggaccacatgagcctgcacggccactag

SEQ ID NO: 168393 - DNA, 4920 bp, Artificial Sequence
  Description of Artificial Sequence: Synthetic coding sequence
atggccaaggacagccccagccccctgggcgccagccccaagaagccaggctgcagcagccctgctgctgctgtgctggagaaccagaggcgggagctggagaagctgcgggcagagctggaggccgagagagctggctggagggctgagaggagaagatttgctgcccgggagcggcagctgcgggaggaggccgagcgggagcggcggcagctggccgaccggctgcggagcaagtgggaggcccagaggagccgggagctgcggcagctgcaggaggagatgcagcgggagcgggaggccgagatccggcagctgctgcgctggaaggaggccgagcagaggcagctgcagcagctgctgcaccgggagagagatggagtggtgcggcaggcccgggagctgcagaggcagctggccgaggagctggtgaacagaggccactgcagcaggcctggggccagcgaggtgtctgctgcccagtgccgctgccgcctgcaggaggtgctggcccagctgcgctggcagacagatggagagcaggccgcccgcatccgctacctgcaggccgccctggaggtggagcggcagctgttcctgaagtacatcctggcccacttccggggccacccagccctgagcggcagcccagacccccaggccgtgcacagcctggaggagcccctgccccagaccagcagcggcagctgccacgcccccaagccagcctgccagctgggcagcctggacagcctgtctgctgaggtgggcgtgcgcagccgcagcctgggcctggtgagcagcgcctgcagcagcagcccagatggcctgctgagcacccacgccagcagcctggactgctttgccccagcctgcagccgcagcctggacagcaccaggagcctgcccaaggccagcaagtctgaggagcggcccagcagcccagacaccagcaccccaggcagccggcggctgagccccccacccagccccctgcccccacctcctcctccttctgcccacaggaagctgagcaacccccggggcggggagggcagcgagagccagccctgtgaggtgctgacccccagccccccaggcctgggccaccacgagctgatcaagctgaactggctgctggccaaggccctgtgggtgctggcccggcgctgctacaccctgcaggccgagaacaagcagctgcggcgggccggctgcccctaccaggctgatgagaaggtgaagaggctgaaggtgaagagagctgagctgaccggcctggcccggcggctggccgaccgggccaggaagctgcaggagaccaacctgcgggctgtgtctgcccccatccctggagagagctgtgccggcctggagctgtgccaggtgtttgcccggcagagggcccgggacctgtctgagcaggccagcgcccccctggccaaggacaagcagatcgaggagctgcggcaggagtgccacctgctgcaggcccgggtggccagcggcccctgcagcgacctgcacacaggccggggcggcccctgcacccagtggctgaatgtgcgggacctggaccggctgcagcgggagagccagcgggaggtgctgcggctgcagaggcagctgatgctgcagcagggcaatggaggagcctggccagaggccggcggccagagcgccacctgtgaggaggtgcggcggcagatgctggccctggagcgggagctggaccagaggagaagagagtgccaggagctgggcgcccaggccgccccagcccggcggcggggggaggaggccgagacccagctgcaggccgccctgctgaagaatgcctggctggccgaggagaatggccgcctgcaggccaagacagactgggtgaggaaggtggaggctgaaaattctgaggtgcggggccacctgggccgggcctgccaggagagagatgccagcggcctgattgctgagcagctgctgcagcaggccgcccggggccaggaccggcagcagcagctgcagagggacccccagaaggccctgtgtgacctgcaccccagctggaaggagatccaggccctgcagtgcaggcctggccaccccccagagcagccctgggagaccagccagatgcctgagagccaggtgaagggcagcagaagacccaagttccacgcccggcctgaggactatgctgtgtcccagcccaacagagacatccaggagaagcgggaggccagcctggaggagagccctgtggccctgggggagagcgcctctgtgccccaggtgtctgagaccgtgcctgccagccagcccctgagcaagaagaccagcagccagagcaacagcagcagcgagggctccatgtgggccaccgtgcccagcagccccaccctggaccgggacacagccagcgaggtggatgacctggagccagacagcgtgtccctggccctggagatgggcggcagcgctgccccagctgcccccaagctgaagatcttcatggcccagtacaactacaacccctttgagggccccaatgaccaccctgagggggagctgcccctgacagctggggactacatctacatctttggagacatggatgaagatggcttctatgaaggagagctggaggatggaagaagaggcctggtgcccagcaactttgtggagcagatcccagacagctacatccctggctgcctgcctgccaagagcccagacctgggccccagccagctgcctgctggccaggatgaggccctggaggaggacagcctgctgagcggcaaggcccagggcgtggtggaccggggcctgtgccagatggtgcgggtgggcagcaagacagaggtggccacagagatcctggacaccaagacagaggcctgccagctgggcctgctgcagagcatgggcaagcagggcctgagccggcccctgctgggcaccaagggcgtgctgaggatggcccccatgcagctgcacctgcagaatgtgacagccaccagcgccaacatcacctgggtgtacagcagccaccgccacccccacgtggtgtacctggatgaccgggagcacgccctgaccccagctggggtgtcctgctacaccttccagggcctgtgccccggcacccactaccgggcccgggtggaggtgcggctgccccgggacctgctgcaggtgtactggggcaccatgagcagcacagtgacctttgacaccctgctggccggccccccctacccacccctggatgtgctggtggagagacatgccagccctggggtgctggtggtgtcctggctgcctgtgaccatcgacagcgctggcagcagcaatggagtgcaggtgacaggctatgctgtgtatgcagatggcctgaaggtgtgtgaggtggctgatgccacagctggcagcaccctgctggagttcagccagctgcaggtgcccctgacctggcagaaggtgtctgtgaggaccatgagcctgtgtggggagagcctggacagcgtgcctgcccagatccctgaggacttcttcatgtgccaccgctggccagagaccccacccttctcctacacctgtggggaccccagcacctacagagtgaccttccctgtgtgcccccagaagctgagcctggccccacccagcgccaaggccagcccccacaaccctggcagctgtggggagccccaggccaagttcctggaggccttctttgaggagcccccccggcggcagagccctgtgagcaacctgggctctgaaggagaatgtcccagcagtggagctggcagccaggcccaggagctggccgaggcctgggagggctgcaggaaggacctgctcttccagaagagcccccagaaccaccggccccccagcgtgtctgaccagcctggagagaaggagaactgcagccagcacatgggcaccagcaagagccctgcccctggcttcatccacctgaggacagaatgtggccccaggaaggagccctgccaggagaaggccgccctggagcgggtgctgcggcagaagcaggatgcccagggcttcaccccaccccagctgggcgccagccagcagtatgccagtgacttccacaacgtgctgaaggaggagcaggaggccctgtgcctggacctgtggggcacagaaagaagagaggagcggcgggagcctgagccccacagccggcagggccaggccctgggcgtgaagaggggctgccagctgcacgagcccagcagcgccctgtgcccagcccccagcgccaaggtgatcaagatgccccggggcggcccccagcagctgggcaccggggccaacaccccagcccgggtgtttgtggccctgagtgactacaaccccctggtgatgtctgccaacctgaaggctgctgaggaggagctggtgttccagaagaggcagctgctgcgggtgtggggcagccaggacacccatgacttctacctgtctgagtgcaaccggcaggtgggcaacatccctggccgcctggtggccgagatggaggtgggcacagagcagacagaccggcgctggaggagccctgcccagggcaacctgcccagcgtggcccacctggaggacttccagggcctgaccatcccccagggcagcagcctggtgctgcagggcaacagcaagaggctgcccctgtggacccccaagatcatgattgctgccctggactatgaccctggagatggccagatgggcggccagggcaagggccgcctggccctgcgggctggagatgtggtgatggtgtatggccccatggatgaccagggcttctactacggggagctgggcggccaccggggcctggtgcctgcccacctgctggaccacatgagcctgcacggccactag

SEQ ID NO: 168394 - DNA, 4638 bp, Artificial Sequence
  Description of Artificial Sequence: Synthetic coding sequence
atgcagcgggagcgggaggccgagatccggcagctgctgcgctggaaggaggccgagcagaggcagctgcagcagctgctgcaccgggagagagatggagtggtgcggcaggcccgggagctgcagaggcagctggccgaggagctggtgaacagaggccactgcagcaggcctggggccagcgaggtgtctgctgcccagtgccgctgccgcctgcaggaggtgctggcccagctgcgctggcagacagatggagagcaggccgcccgcatccgctacctgcaggccgccctggaggtggagcggcagctgttcctgaagtacatcctggcccacttccggggccacccagccctgagcggcagcccagacccccaggccgtgcacagcctggaggagcccctgccccagaccagcagcggcagctgccacgcccccaagccagcctgccagctgggcagcctggacagcctgtctgctgaggtgggcgtgcgcagccgcagcctgggcctggtgagcagcgcctgcagcagcagcccagatggcctgctgagcacccacgccagcagcctggactgctttgccccagcctgcagccgcagcctggacagcaccaggagcctgcccaaggccagcaagtctgaggagcggcccagcagcccagacaccagcaccccaggcagccggcggctgagccccccacccagccccctgcccccacctcctcctccttctgcccacaggaagctgagcaacccccggggcggggagggcagcgagagccagccctgtgaggtgctgacccccagccccccaggcctgggccaccacgagctgatcaagctgaactggctgctggccaaggccctgtgggtgctggcccggcgctgctacaccctgcaggaggagaacaagcagctgcggcgggccggctgcccctaccaggctgatgagaaggtgaagaggctgaaggtgaagagagctgagctgaccggcctggcccggcggctggccgaccgggcccgggagctgcaggagaccaacctgcgggctgtgtctgcccccatccctggagagagctgtgccggcctggagctgtgccaggtgtttgcccggcagagggcccgggacctgtctgagcaggccagcgcccccctggccaaggacaagcagatcgaggagctgcggcaggagtgccacctgctgcaggcccgggtggccagcggcccctgcagcgacctgcacacaggccggggcggcccctgcacccagtggctgaatgtgcgggacctggaccggctgcagcgggagagccagcgggaggtgctgcggctgcagaggcagctgatgctgcagcagggcaatggaggagcctggccagaggccggcggccagagcgccacctgtgaggaggtgcggcggcagatgctggccctggagcgggagctggaccagaggagaagagagtgccaggagctgggcacccaggccgccccagcccggcggcggggggaggaggccgagacccagctgcaggccgccctgctgaagaatgcctggctggccgaggagaatggccgcctgcaggccaagacagactgggtgaggaaggtggaggctgaaaattctgaggtgcggggccacctgggccgggcctgccaggagagagatgccagcggcctgattgctgagcagctgctgcagcaggccgcccggggccaggaccggcagcagcagctgcagagggacccccagaaggccctgtgtgacctgcaccccagctggaaggagatccaggccctgcagtgcaggcctggccaccccccagagcagccctgggagaccagccagatgcctgagagccaggtgaagggcagcagaagacccaagttccacgcccggcctgaggactatgctgtgtcccagcccaacagagacatccaggagaagcgggaggccagcctggaggagagccctgtggccctgggggagagcgcctctgtgccccaggtgtctgagaccgtgcctgccagccagcccctgagcaagaagaccagcagccagagcaacagcagcagcgagggctccatgtgggccaccgtgcccagcagccccaccctggaccgggacacagccagcgaggtggatgacctggagccagacagcgtgtccctggccctggagatgggcggcagcgctgccccagctgcccccaagctgaagatcttcatggcccagtacaactacaacccctttgagggccccaatgaccaccctgagggggagctgcccctgacagctggggactacatctacatctttggagacatggatgaagatggcttctatgaaggagagctggatgatggaagaagaggcctggtgcccagcaactttgtggagcagatcccagacagctacatccctggctgcctgcctgccaagagcccagacctgggccccagccagctgcctgctggccaggatgaggccctggaggaggacagcctgctgagcggcaaggcccagggcatggtggaccggggcctgtgccagatggtgcgggtgggcagcaagacagaggtggccacagagatcctggacaccaagacagaggcctgccagctgggcctgctgcagagcatgggcaagcagggcctgagccggcccctgctgggcaccaagggcgtgctgaggatggcccccatgcagctgcacctgcagaatgtgacagccaccagcgccaacatcacctgggtgtacagcagccaccgccacccccacgtggtgtacctggatgaccgggagcacgccctgaccccagctggggtgtcctgctacaccttccagggcctgtgccccggcacccactacagagtgcgggtggaggtgcggctgccctgggacctgctgcaggtgtactggggcaccatgagcagcacagtgacctttgacaccctgctggccggccccccctacccacccctggaggtgctggtggagagacatgccagccctggggtgctggtggtgtcctggctgcctgtgaccatcgacagcgctggcagcagcaatggagtgcaggtgacaggctatgctgtgtatgcagatggcctgaaggtgtgtgaggtggctgatgccacagctggcagcacagtgctggagttcagccagctgcaggtgcccctgacctggcagaaggtgtctgtgaggaccatgagcctgtgtggggagagcctggacagcgtgcctgcccagatccctgaggacttcttcatgtgccaccgctggccagagaccccacccttctcctacacctgtggggaccccagcacctacagagtgaccttccctgtgtgcccccagaagctgagcctggccccacccagcgccaaggccagcccccacaaccctggcagctgtggggagccccaggccaagttcctggaggccttctttgaggagcccccccggcggcagagccctgtgagcaacctgggctctgaaggagaatgtcccagcagtggagctggcagccaggcccaggagctggccgaggcctgggagggctgcaggaaggacctgctcttccagaagagcccccagaaccaccggccccccagcgtgtctgaccagcctggagagaaggagaactgctaccagcacatgggcaccagcaagagccctgcccctggcttcatccacctgaggacagaatgtggccccaggaaggagccctgccaggagaaggccgccctggagcgggtgctgcggcagaagcaggatgcccagggcttcaccccaccccagctgggcgccagccagcagtatgccagtgacttccacaacgtgctgaaggaggagcaggaggccctgtgcctggacctgcggggcacagaaagaagagaggagcggcgggagcctgagccccacagccggcagggccaggccctgggcgtgaagaggggctgccagctgcacgagcccagcagcgccctgtgcccagcccccagcgccaaggtgatcaagatgccccggggcggcccccagcagctgggcaccggggccaacaccccagcccgggtgtttgtggccctgagtgactacaaccccctggtgatgtctgccaacctgaaggctgctgaggaggagctggtgttccagaagaggcagctgctgcgggtgtggggcagccaggacacccatgacttctacctgtctgagtgcaaccggcaggtgggcaacatccctggccgcctggtggccgagatggaggtgggcacagagcagacagaccggcgctggaggagccctgcccagggccacctgcccagcgtggcccacctggaggacttccagggcctgaccatcccccagggcagcagcctggtgctgcagggcaacagcaagaggctgcccctgtggacccccaagatcatgattgctgccctggactatgaccctggagatggccagatgggcggccagggcaagggccgcctggccctgcgggctggagatgtggtgatggtgtatggccccatggatgaccagggcttctactacggggagctgggcggccaccggggcctggtgcctgcccacctgctggaccacatgagcctgcacggccactag

SEQ ID NO: 168395 - DNA, 4920 bp, Artificial Sequence
  Description of Artificial Sequence: Synthetic coding sequence
atggccaaggacagccccagccccctgggcgccagccccaagaagccaggctgcagcagccctgctgctgctgtgctggagaaccagaggcgggagctggagaagctgcgggcagagctggaggccgagagagctggctggagggctgagaggagaagatttgctgcccgggagcggcagctgcgggaggaggccgagcgggagcggcggcagctggccgaccggctgcggagcaagtgggaggcccagaggagccgggagctgcggcagctgcaggaggagatgcagcgggagcgggaggccgagatccggcagctgctgcgctggaaggaggccgagcagaggcagctgcagcagctgctgcaccgggagagagatggagtggtgcggcaggcccgggagctgcagaggcagctggccgaggagctggtgaacagaggccactgcagcaggcctggggccagcgaggtgtctgctgcccagtgccgctgccgcctgcaggaggtgctggcccagctgcgctggcagacagatggagagcaggccgcccgcatccgctacctgcaggccgccctggaggtggagcggcagctgttcctgaagtacatcctggcccacttccggggccacccagccctgagcggcagcccagacccccaggccgtgcacagcctggaggagcccctgccccagaccagcagcggcagctgccacgcccccaagccagcctgccagctgggcagcctggacagcctgtctgctgaggtgggcgtgcgcagccgcagcctgggcctggtgagcagcgcctgcagcagcagcccagatggcctgctgagcacccacgccagcagcctggactgctttgccccagcctgcagccgcagcctggacagcaccaggagcctgcccaaggccagcaagtctgaggagcggcccagcagcccagacaccagcaccccaggcagccggcggctgagccccccacccagccccctgcccccacctcctcctccttctgcccacaggaagctgagcaacccccggggcggggagggcagcgagagccagccctgtgaggtgctgacccccagccccccaggcctgggccaccacgagctgatcaagctgaactggctgctggccaaggccctgtgggtgctggcccggcgctgctacaccctgcaggaggagaacaagcagctgcggcgggccggctgcccctaccaggctgatgagaaggtgaagaggctgaaggtgaagagagctgagctgaccggcctggcccggcggctggccgaccgggcccgggagctgcaggagaccaacctgcgggctgtgtctgcccccatccctggagagagctgtgccggcctggagctgtgccaggtgtttgcccggcagagggcccgggacctgtctgagcaggccagcgcccccctggccaaggacaagcagatcgaggagctgcggcaggagtgccacctgctgcaggcccgggtggccagcggcccctgcagcgacctgcacacaggccggggcggcccctgcacccagtggctgaatgtgcgggacctggaccggctgcagcgggagagccagcgggaggtgctgcggctgcagaggcagctgatgctgcagcagggcaatggaggagcctggccagaggccggcggccagagcgccacctgtgaggaggtgcggcggcagatgctggccctggagcgggagctggaccagaggagaagagagtgccaggagctgggcacccaggccgccccagcccggcggcggggggaggaggccgagacccagctgcaggccgccctgctgaagaatgcctggctggccgaggagaatggccgcctgcaggccaagacagactgggtgaggaaggtggaggctgaaaattctgaggtgcggggccacctgggccgggcctgccaggagagagatgccagcggcctgattgctgagcagctgctgcagcaggccgcccggggccaggaccggcagcagcagctgcagagggacccccagaaggccctgtgtgacctgcaccccagctggaaggagatccaggccctgcagtgcaggcctggccaccccccagagcagccctgggagaccagccagatgcctgagagccaggtgaagggcagcagaagacccaagttccacgcccggcctgaggactatgctgtgtcccagcccaacagagacatccaggagaagcgggaggccagcctggaggagagccctgtggccctgggggagagcgcctctgtgccccaggtgtctgagaccgtgcctgccagccagcccctgagcaagaagaccagcagccagagcaacagcagcagcgagggctccatgtgggccaccgtgcccagcagccccaccctggaccgggacacagccagcgaggtggatgacctggagccagacagcgtgtccctggccctggagatgggcggcagcgctgccccagctgcccccaagctgaagatcttcatggcccagtacaactacaacccctttgagggccccaatgaccaccctgagggggagctgcccctgacagctggggactacatctacatctttggagacatggatgaagatggcttctatgaaggagagctggatgatggaagaagaggcctggtgcccagcaactttgtggagcagatcccagacagctacatccctggctgcctgcctgccaagagcccagacctgggccccagccagctgcctgctggccaggatgaggccctggaggaggacagcctgctgagcggcaaggcccagggcatggtggaccggggcctgtgccagatggtgcgggtgggcagcaagacagaggtggccacagagatcctggacaccaagacagaggcctgccagctgggcctgctgcagagcatgggcaagcagggcctgagccggcccctgctgggcaccaagggcgtgctgaggatggcccccatgcagctgcacctgcagaatgtgacagccaccagcgccaacatcacctgggtgtacagcagccaccgccacccccacgtggtgtacctggatgaccgggagcacgccctgaccccagctggggtgtcctgctacaccttccagggcctgtgccccggcacccactacagagtgcgggtggaggtgcggctgccctgggacctgctgcaggtgtactggggcaccatgagcagcacagtgacctttgacaccctgctggccggccccccctacccacccctggaggtgctggtggagagacatgccagccctggggtgctggtggtgtcctggctgcctgtgaccatcgacagcgctggcagcagcaatggagtgcaggtgacaggctatgctgtgtatgcagatggcctgaaggtgtgtgaggtggctgatgccacagctggcagcacagtgctggagttcagccagctgcaggtgcccctgacctggcagaaggtgtctgtgaggaccatgagcctgtgtggggagagcctggacagcgtgcctgcccagatccctgaggacttcttcatgtgccaccgctggccagagaccccacccttctcctacacctgtggggaccccagcacctacagagtgaccttccctgtgtgcccccagaagctgagcctggccccacccagcgccaaggccagcccccacaaccctggcagctgtggggagccccaggccaagttcctggaggccttctttgaggagcccccccggcggcagagccctgtgagcaacctgggctctgaaggagaatgtcccagcagtggagctggcagccaggcccaggagctggccgaggcctgggagggctgcaggaaggacctgctcttccagaagagcccccagaaccaccggccccccagcgtgtctgaccagcctggagagaaggagaactgctaccagcacatgggcaccagcaagagccctgcccctggcttcatccacctgaggacagaatgtggccccaggaaggagccctgccaggagaaggccgccctggagcgggtgctgcggcagaagcaggatgcccagggcttcaccccaccccagctgggcgccagccagcagtatgccagtgacttccacaacgtgctgaaggaggagcaggaggccctgtgcctggacctgcggggcacagaaagaagagaggagcggcgggagcctgagccccacagccggcagggccaggccctgggcgtgaagaggggctgccagctgcacgagcccagcagcgccctgtgcccagcccccagcgccaaggtgatcaagatgccccggggcggcccccagcagctgggcaccggggccaacaccccagcccgggtgtttgtggccctgagtgactacaaccccctggtgatgtctgccaacctgaaggctgctgaggaggagctggtgttccagaagaggcagctgctgcgggtgtggggcagccaggacacccatgacttctacctgtctgagtgcaaccggcaggtgggcaacatccctggccgcctggtggccgagatggaggtgggcacagagcagacagaccggcgctggaggagccctgcccagggccacctgcccagcgtggcccacctggaggacttccagggcctgaccatcccccagggcagcagcctggtgctgcagggcaacagcaagaggctgcccctgtggacccccaagatcatgattgctgccctggactatgaccctggagatggccagatgggcggccagggcaagggccgcctggccctgcgggctggagatgtggtgatggtgtatggccccatggatgaccagggcttctactacggggagctgggcggccaccggggcctggtgcctgcccacctgctggaccacatgagcctgcacggccactag

SEQ ID NO: 168396 - DNA, 4638 bp, Artificial Sequence
  Description of Artificial Sequence: Synthetic coding sequence
atgcagcgggagcgggaggccgagatccggcagctgctgcgctggaaggaggccgagcagaggcagctgcagcagctgctgcaccgggagagagatggagtggtgcggcaggcccgggagctgcagaggcagctggccgaggagctggtgaacagaggccactgcagcaggcctggggccagcgaggtgtctgctgcccagtgccgctgccgcctgcaggaggtgctggcccagctgcgctggcagacagatggagagcaggccgcccgcatccgctacctgcaggccgccctggaggtggagcggcagctgttcctgaagtacatcctggcccacttccggggccacccagccctgagcggcagcccagacccccaggccgtgcacagcctggaggagcccctgccccagaccagcagcggcagctgccacgcccccaagccagcctgccagctgggcagcctggacagcctgtctgctgaggtgggcgtgcgcagccgcagcctgggcctggtgagcagcgcctgcagcagcagcccagatggcctgctgagcacccacgccagcagcctggactgctttgccccagcctgcagccgcagcctggacagcaccaggagcctgcccaaggccagcaagtctgaggagcggcccagcagcccagacaccagcaccccaggcagccggcggctgagccccccacccagccccctgcccccacctcctcctccttctgcccacaggaagctgagcaacccccggggcggggagggcagcgagagccagccctgtgaggtgctgacccccagccccccaggcctgggccaccacgagctgatcaagctgaactggctgctggccaaggccctgtgggtgctggcccggcgctgctacaccctgcaggaggagaacaagcagctgcggcgggccggctgcccctaccaggctgatgagaaggtgaagaggctgaaggtgaagagagctgagctgaccggcctggcccggcggctggccgaccgggcccgggagctgcaggagaccaacctgcgggctgtgtctgcccccatccctggagagagctgtgccggcctggagctgtgccaggtgtttgcccggcagagggcccgggacctgtctgagcaggccagcgcccccctggccaaggacaagcagatcgaggagctgcggcaggagtgccacctgctgcaggcccgggtggccagcggcccctgcagcgacctgcacacaggccggggcggcccctgcacccagtggctgaatgtgcgggacctggaccggctgcagcgggagagccagcgggaggtgctgcggctgcagaggcagctgatgctgcagcagggcaatggaggagcctggccagaggccggcggccagagcgccacctgtgaggaggtgcggcggcagatgctggccctggagcgggagctggaccagaggagaagagagtgccaggagctgggcacccaggccgccccagcccggcggcggggggaggaggccgagacccagctgcaggccgccctgctgaagaatgcctggctggccgaggagaatggccgcctgcaggccaagacagactgggtgaggaaggtggaggctgaaaattctgaggtgcggggccacctgggccgggcctgccaggagagagatgccagcggcctgattgctgagcagctgctgcagcaggccgcccggggccaggaccggcagcagcagctgcagagggacccccagaaggccctgtgtgacctgcaccccagctggaaggagatccaggccctgcagtgcaggcctggccaccccccagagcagccctgggagaccagccagatgcctgagagccaggtgaagggcagcagaagacccaagttccacgcccggcctgaggactatgctgtgtcccagcccaacagagacatccaggagaagcgggaggccagcctggaggagagccctgtggccctgggggagagcgcctctgtgccccaggtgtctgagaccgtgcctgccagccagcccctgagcaagaagaccagcagccagagcaacagcagcagcgagggctccatgtgggccaccgtgcccagcagccccaccctggaccgggacacagccagcgaggtggatgacctggagccagacagcgtgtccctggccctggagatgggcggcagcgctgccccagctgcccccaagctgaagatcttcatggcccagtacaactacaacccctttgagggccccaatgaccaccctgagggggagctgcccctgacagctggggactacatctacatctttggagacatggatgaagatggcttctatgaaggagagctggatgatggaagaagaggcctggtgcccagcaactttgtggagcagatcccagacagctacatccctggctgcctgcctgccaagagcccagacctgggccccagccagctgcctgctggccaggatgaggccctggaggaggacagcctgctgagcggcaaggcccagggcatggtggaccggggcctgtgccagatggtgcgggtgggcagcaagacagaggtggccacagagatcctggacaccaagacagaggcctgccagctgggcctgctgcagagcatgggcaagcagggcctgagccggcccctgctgggcaccaagggcgtgctgaggatggcccccatgcagctgcacctgcagaatgtgacagccaccagcgccaacatcacctgggtgtacagcagccaccgccacccccacgtggtgtacctggatgaccgggagcacgccctgaccccagctggggtgtcctgctacaccttccagggcctgtgccccggcacccactacagagtgcgggtggaggtgcggctgccctgggacctgctgcaggtgtactggggcaccatgagcagcacagtgacctttgacaccctgctggccggccccccctacccacccctggatgtgctggtggagagacatgccagccctggggtgctggtggtgtcctggctgcctgtgaccatcgacagcgctggcagcagcaatggagtgcaggtgacaggctatgctgtgtatgcagatggcctgaaggtgtgtgaggtggctgatgccacagctggcagcacagtgctggagttcagccagctgcaggtgcccctgacctggcagaaggtgtctgtgaggaccatgagcctgtgtggggagagcctggacagcgtgcctgcccagatccctgaggacttcttcatgtgccaccgctggccagagaccccacccttctcctacacctgtggggaccccagcacctacagagtgaccttccctgtgtgcccccagaagctgagcctggccccacccagcgccaaggccagcccccacaaccctggcagctgtggggagccccaggccaagttcctggaggccttctttgaggagcccccccggcggcagagccctgtgagcaacctgggctctgaaggagaatgtcccagcagtggagctggcagccaggcccaggagctggccgaggcctgggagggctgcaggaaggacctgctcttccagaagagcccccagaaccaccggccccccagcgtgtctgaccagcctggagagaaggagaactgctaccagcacatgggcaccagcaagagccctgcccctggcttcatccacctgaggacagaatgtggccccaggaaggagccctgccaggagaaggccgccctggagcgggtgctgcggcagaagcaggatgcccagggcttcaccccaccccagctgggcgccagccagcagtatgccagtgacttccacaacgtgctgaaggaggagcaggaggccctgtgcctggacctgcggggcacagaaagaagagaggagcggcgggagcctgagccccacagccggcagggccaggccctgggcgtgaagaggggctgccagctgcacgagcccagcagcgccctgtgcccagcccccagcgccaaggtgatcaagatgccccggggcggcccccagcagctgggcaccggggccaacaccccagcccgggtgtttgtggccctgagtgactacaaccccctggtgatgtctgccaacctgaaggctgctgaggaggagctggtgttccagaagaggcagctgctgcgggtgtggggcagccaggacacccatgacttctacctgtctgagtgcaaccggcaggtgggcaacatccctggccgcctggtggccgagatggaggtgggcacagagcagacagaccggcgctggaggagccctgcccagggccacctgcccagcgtggcccacctggaggacttccagggcctcatcatcccccagggcagcagcctggtgctgcagggcaacagcaagaggctgcccctgtggacccccaagatcatgattgctgccctggactatgaccctggagatggccagatgggcggccagggcaagggccgcctggccctgcgggctggagatgtggtgatggtgtatggccccatggatgaccagggcttctactacggggagctgggcggccaccggggcctggtgcctgcccacctgctggaccacatgagcctgcacggccactag

SEQ ID NO: 168397 - DNA, 4920 bp, Artificial Sequence
  Description of Artificial Sequence: Synthetic coding sequence
atggccaaggacagccccagccccctgggcgccagccccaagaagccaggctgcagcagccctgctgctgctgtgctggagaaccagaggcgggagctggagaagctgcgggcagagctggaggccgagagagctggctggagggctgagaggagaagatttgctgcccgggagcggcagctgcgggaggaggccgagcgggagcggcggcagctggccgaccggctgcggagcaagtgggaggcccagaggagccgggagctgcggcagctgcaggaggagatgcagcgggagcgggaggccgagatccggcagctgctgcgctggaaggaggccgagcagaggcagctgcagcagctgctgcaccgggagagagatggagtggtgcggcaggcccgggagctgcagaggcagctggccgaggagctggtgaacagaggccactgcagcaggcctggggccagcgaggtgtctgctgcccagtgccgctgccgcctgcaggaggtgctggcccagctgcgctggcagacagatggagagcaggccgcccgcatccgctacctgcaggccgccctggaggtggagcggcagctgttcctgaagtacatcctggcccacttccggggccacccagccctgagcggcagcccagacccccaggccgtgcacagcctggaggagcccctgccccagaccagcagcggcagctgccacgcccccaagccagcctgccagctgggcagcctggacagcctgtctgctgaggtgggcgtgcgcagccgcagcctgggcctggtgagcagcgcctgcagcagcagcccagatggcctgctgagcacccacgccagcagcctggactgctttgccccagcctgcagccgcagcctggacagcaccaggagcctgcccaaggccagcaagtctgaggagcggcccagcagcccagacaccagcaccccaggcagccggcggctgagccccccacccagccccctgcccccacctcctcctccttctgcccacaggaagctgagcaacccccggggcggggagggcagcgagagccagccctgtgaggtgctgacccccagccccccaggcctgggccaccacgagctgatcaagctgaactggctgctggccaaggccctgtgggtgctggcccggcgctgctacaccctgcaggaggagaacaagcagctgcggcgggccggctgcccctaccaggctgatgagaaggtgaagaggctgaaggtgaagagagctgagctgaccggcctggcccggcggctggccgaccgggcccgggagctgcaggagaccaacctgcgggctgtgtctgcccccatccctggagagagctgtgccggcctggagctgtgccaggtgtttgcccggcagagggcccgggacctgtctgagcaggccagcgcccccctggccaaggacaagcagatcgaggagctgcggcaggagtgccacctgctgcaggcccgggtggccagcggcccctgcagcgacctgcacacaggccggggcggcccctgcacccagtggctgaatgtgcgggacctggaccggctgcagcgggagagccagcgggaggtgctgcggctgcagaggcagctgatgctgcagcagggcaatggaggagcctggccagaggccggcggccagagcgccacctgtgaggaggtgcggcggcagatgctggccctggagcgggagctggaccagaggagaagagagtgccaggagctgggcacccaggccgccccagcccggcggcggggggaggaggccgagacccagctgcaggccgccctgctgaagaatgcctggctggccgaggagaatggccgcctgcaggccaagacagactgggtgaggaaggtggaggctgaaaattctgaggtgcggggccacctgggccgggcctgccaggagagagatgccagcggcctgattgctgagcagctgctgcagcaggccgcccggggccaggaccggcagcagcagctgcagagggacccccagaaggccctgtgtgacctgcaccccagctggaaggagatccaggccctgcagtgcaggcctggccaccccccagagcagccctgggagaccagccagatgcctgagagccaggtgaagggcagcagaagacccaagttccacgcccggcctgaggactatgctgtgtcccagcccaacagagacatccaggagaagcgggaggccagcctggaggagagccctgtggccctgggggagagcgcctctgtgccccaggtgtctgagaccgtgcctgccagccagcccctgagcaagaagaccagcagccagagcaacagcagcagcgagggctccatgtgggccaccgtgcccagcagccccaccctggaccgggacacagccagcgaggtggatgacctggagccagacagcgtgtccctggccctggagatgggcggcagcgctgccccagctgcccccaagctgaagatcttcatggcccagtacaactacaacccctttgagggccccaatgaccaccctgagggggagctgcccctgacagctggggactacatctacatctttggagacatggatgaagatggcttctatgaaggagagctggatgatggaagaagaggcctggtgcccagcaactttgtggagcagatcccagacagctacatccctggctgcctgcctgccaagagcccagacctgggccccagccagctgcctgctggccaggatgaggccctggaggaggacagcctgctgagcggcaaggcccagggcatggtggaccggggcctgtgccagatggtgcgggtgggcagcaagacagaggtggccacagagatcctggacaccaagacagaggcctgccagctgggcctgctgcagagcatgggcaagcagggcctgagccggcccctgctgggcaccaagggcgtgctgaggatggcccccatgcagctgcacctgcagaatgtgacagccaccagcgccaacatcacctgggtgtacagcagccaccgccacccccacgtggtgtacctggatgaccgggagcacgccctgaccccagctggggtgtcctgctacaccttccagggcctgtgccccggcacccactacagagtgcgggtggaggtgcggctgccctgggacctgctgcaggtgtactggggcaccatgagcagcacagtgacctttgacaccctgctggccggccccccctacccacccctggatgtgctggtggagagacatgccagccctggggtgctggtggtgtcctggctgcctgtgaccatcgacagcgctggcagcagcaatggagtgcaggtgacaggctatgctgtgtatgcagatggcctgaaggtgtgtgaggtggctgatgccacagctggcagcacagtgctggagttcagccagctgcaggtgcccctgacctggcagaaggtgtctgtgaggaccatgagcctgtgtggggagagcctggacagcgtgcctgcccagatccctgaggacttcttcatgtgccaccgctggccagagaccccacccttctcctacacctgtggggaccccagcacctacagagtgaccttccctgtgtgcccccagaagctgagcctggccccacccagcgccaaggccagcccccacaaccctggcagctgtggggagccccaggccaagttcctggaggccttctttgaggagcccccccggcggcagagccctgtgagcaacctgggctctgaaggagaatgtcccagcagtggagctggcagccaggcccaggagctggccgaggcctgggagggctgcaggaaggacctgctcttccagaagagcccccagaaccaccggccccccagcgtgtctgaccagcctggagagaaggagaactgctaccagcacatgggcaccagcaagagccctgcccctggcttcatccacctgaggacagaatgtggccccaggaaggagccctgccaggagaaggccgccctggagcgggtgctgcggcagaagcaggatgcccagggcttcaccccaccccagctgggcgccagccagcagtatgccagtgacttccacaacgtgctgaaggaggagcaggaggccctgtgcctggacctgcggggcacagaaagaagagaggagcggcgggagcctgagccccacagccggcagggccaggccctgggcgtgaagaggggctgccagctgcacgagcccagcagcgccctgtgcccagcccccagcgccaaggtgatcaagatgccccggggcggcccccagcagctgggcaccggggccaacaccccagcccgggtgtttgtggccctgagtgactacaaccccctggtgatgtctgccaacctgaaggctgctgaggaggagctggtgttccagaagaggcagctgctgcgggtgtggggcagccaggacacccatgacttctacctgtctgagtgcaaccggcaggtgggcaacatccctggccgcctggtggccgagatggaggtgggcacagagcagacagaccggcgctggaggagccctgcccagggccacctgcccagcgtggcccacctggaggacttccagggcctcatcatcccccagggcagcagcctggtgctgcagggcaacagcaagaggctgcccctgtggacccccaagatcatgattgctgccctggactatgaccctggagatggccagatgggcggccagggcaagggccgcctggccctgcgggctggagatgtggtgatggtgtatggccccatggatgaccagggcttctactacggggagctgggcggccaccggggcctggtgcctgcccacctgctggaccacatgagcctgcacggccactag

SEQ ID NO: 168398 - DNA, 3402 bp, Artificial Sequence
  Description of Artificial Sequence: Synthetic coding sequence
atgcctgtgcaggccccccagtggacagacttcctgagctgccccatctgcacccagacctttgatgagaccatcaggaagcccatcagcctgggctgcggccacacagtgtgcaagatgtgcctgaacaagctgcacaggaaggcctgcccctttgaccagaccaccatcaacacagacatcgagctgctgcctgtgaacagcgccctgctgcagctggtgggcgcccaggtgcctgagcagcagcccatcaccctgtgcagcggcgtggaggacaccaagcactatgaggaggccaagaagtgtgtggaggagctggccctgtacctgaagcccctgagcagcgcccggggcgtgggcctgaacagcaccacccagagcgtgctgagccggcccatgcagaggaagctggtgaccctggtgcactgccagctggtggaggaggagggccgcatccgggccatgagagctgcccggagcctgggggagaggacagtgacagagctgatcctgcagcaccagaacccccagcagctgagcagcaacctgtgggccgctgtgcgggcccggggctgccagttcctgggccctgccatgcaggaggaggccctgaagctggtgctgctggccctggaggatggcagcgccctgagcaggaaggtgctggtgctgtttgtggtgcagaggctggagccccgcttcccccaggccagcaagaccagcatcggccacgtggtgcagctgctgtaccgggccagctgcttcaaggtgaccaagagagatgaggacagcagcctgatgcagctgaaggaggagttccgcacctatgaggccctgcggcgggagcatgacagccagatcgtgcagatcgccatggaggccggcctgcgcatcgccccagaccagtggagcagcctgctgtatggagaccagagccacaagagccacatgcagagcatcatcgacaagctgcagaccccagccagctttgcccagagcgtgcaggagctgaccatcgccctgcagaggactggagaccctgccaacctgaaccggctgcggccccacctggagctgctggccaacatcgaccccagcccagatgcccccccacccacctgggagcagctggagaatggcctggtggccgtgaggacagtggtgcacggcctggtggactacatccagaaccacagcaagaagggagctgaccagcagcagcccccccagcacagcaagtacaagacctacatgtgccgggacatgaagcagaggggcggctgccccaggggggccagctgcacctttgcccacagccaggaggagctggagaagttcaggaagatgaacaagaggctggtgccccggcggcccctgagcgccagcctgggccagctgaatgaggtgggcctgcccagcgctgccatcctgcctgatgaaggagctgtggacctgcccagcaggaagcccccagccctgcccaatggaattgtgtccacaggcaacacagtgacccagctgatcccccggggcacagaccccagctatgacagcagcctgaagccaggcaagattgaccacctgagcagcagcgcccctggcagccccccagacctgctggagagcgtgcccaagagcatcagcgccctgcctgtgaacccccacagcatccccccccggggccctgctgacctgccccccatgcctgtgaccaagcccctgcagatggtgccccggggcagccagctgtacccagcccagcagacagatgtgtactaccaggaccccagaggagctgcccccccatttgagcccgccccctaccagcagggcatgtactacaccccaccaccccagtgtgtgtccagatttgtgcggcccccacccagcgcccctgagcccgccccaccctacctggaccactacccaccctacctgcaggagcgggtggtgaacagccagtatggcacccagccccagcagtacccacccatctaccccagccactatgatggaagaagagtgtacccagcccccagctacacccgggaggagatcttccgggagagccccatccccatcgagatccccccagctgctgtgcccagctatgtgcctgagagccgggagcgctaccagcagatcgagagctactaccctgtggccccccaccccacccagatccggcccagctacctgcgggagcccccctacagccggctgcccccaccaccccagccccaccccagcctggatgagctgcacagaagaaggaaggagatcatggcccagctggaggagaggaaggtgatcagccccccaccatttgcccccagccccaccctgccccccaccttccaccctgaggagttcctggatgaggacctgaaggtggccggcaagtacaagggaaatgactacagccagtacagcccctggagctgtgacaccatcggcagctacatcggcaccaaggatgccaagcccaaggatgtggtggccgccggctctgtggagatgatgaatgtggagagcaagggcatgagggaccagaggctggacctgcagaggagagctgctgagaccagtgatgatgacctgatcccctttggagaccggcccaccgtgtccagatttggagccatcagcaggaccagcaagaccatctaccagggcgccggccccatgcaggccatggccccccagggcgcccccaccaagagcatcaacatcagtgactacagcccctacggcacccacggcggctggggcgccagcccctacagcccccaccagaacatccccagccagggccacttcagcgagcgggagcgcatctccatgtctgaggtggccagccacggcaagcccctgcccagcgctgagcgggagcagctgcggctggagctgcagcagctgaaccaccagatcagccagcagacccagctgcggggcctggaggccgtgagcaaccggctggtgctgcagcgggaggccaacaccctggccggccagagccagcccccacctcctcctccacccaagtggccaggcatgatcagcagcgagcagctgagcctggagctgcaccaggtggagcgggagatcggcaagaggacccgggagctgtccatggagaaccagtgcagcctggacatgaagagcaagctgaacaccagcaagcaggccgagaatggccagcctgagccccagaacaaggtgcctgctgaggacctgaccctgaccttcagtgatgtgcccaacggcagcgccctgacccaggagaacatcagcctgctgagcaacaagaccagcagcctgaacctgtctgaagatcctgagggcggcggggacaacaatgacagccagaggtctggagtgacccccagcagcgccccctag

SEQ ID NO: 168399 - DNA, 3378 bp, Artificial Sequence
  Description of Artificial Sequence: Synthetic coding sequence
atgcctgtgcaggccccccagtggacagacttcctgagctgccccatctgcacccagacctttgatgagaccatcaggaagcccatcagcctgggctgcggccacacagtgtgcaagatgtgcctgaacaagctgcacaggaaggcctgcccctttgaccagaccaccatcaacacagacatcgagctgctgcctgtgaacagcgccctgctgcagctggtgggcgcccaggtgcctgagcagcagcccatcaccctgtgcagcggcgtggaggacaccaagcactatgaggaggccaagaagtgtgtggaggagctggccctgtacctgaagcccctgagcagcgcccggggcgtgggcctgaacagcaccacccagagcgtgctgagccggcccatgcagaggaagctggtgaccctggtgcactgccagctggtggaggaggagggccgcatccgggccatgagagctgcccggagcctgggggagaggacagtgacagagctgatcctgcagcaccagaacccccagcagctgagcagcaacctgtgggccgctgtgcgggcccggggctgccagttcctgggccctgccatgcaggaggaggccctgaagctggtgctgctggccctggaggatggcagcgccctgagcaggaaggtgctggtgctgtttgtggtgcagaggctggagccccgcttcccccaggccagcaagaccagcatcggccacgtggtgcagctgctgtaccgggccagctgcttcaaggtgaccaagagagatgaggacagcagcctgatgcagctgaaggaggagttccgcacctatgaggccctgcggcgggagcatgacagccagatcgtgcagatcgccatggaggccggcctgcgcatcgccccagaccagtggagcagcctgctgtatggagaccagagccacaagagccacatgcagagcatcatcgacaagctgcagaccccagccagctttgcccagagcgtgcaggagctgaccatcgccctgcagaggactggagaccctgccaacctgaaccggctgcggccccacctggagctgctggccaacatcgaccccagcccagatgcccccccacccacctgggagcagctggagaatggcctggtggccgtgaggacagtggtgcacggcctggtggactacatccagaaccacagcaagaagggagctgaccagcagcagcccccccagcacagcaagtacaagacctacatgtgccgggacatgaagcagaggggcggctgccccaggggggccagctgcacctttgcccacagccaggaggagctggagaagttcaggaagatgaacaagaggctggtgccccggcggcccctgagcgccagcctgggccagctgaatgaggtgggcctgcccagcgctgccatcctgcctgatgaaggagctgtggacctgcccagcaggaagcccccagccctgcccaatggaattgtgtccacaggcaacacagtgacccagctgatcccccggggcacagaccccagctatgacagcagcctgaagccaggcaagattgaccacctgagcagcagcgcccctggcagccccccagacctgctggagagcgtgcccaagagcatcagcgccctgcctgtgaacccccacagcatccccccccggggccctgctgacctgccccccatgcctgtgaccaagcccctgcagatggtgccccggggcagccagctgtacccagcccagcagacagatgtgtactaccaggaccccagaggagctgcccccccatttgagcccgccccctaccagcagggcatgtactacaccccaccaccccagtgtgtgtccagatttgtgcggcccccacccagcgcccctgagcccgccccaccctacctggaccactacccaccctacctgcaggagcgggtggtgaacagccagtatggcacccagccccagcagtacccacccatctaccccagccactatgatggaagaagagtgtacccagcccccagctacacccgggaggagatcttccgggagagccccatccccatcgagatccccccagctgctgtgcccagctatgtgcctgagagccgggagcgctaccagcagatcgagagctactaccctgtggccccccaccccacccagatccggcccagctacctgcgggagcccccctacagccggctgcccccaccaccccagccccaccccagcctggatgagctgcacagaagaaggaaggagatcatggcccagctggaggagaggaaggtgatcagccccccaccatttgcccccagccccaccctgccccccaccttccaccctgaggagttcctggatgaggacctgaaggtggccggcaagtacaagggaaatgactacagccagtacagcccctggagctgtgacaccatcggcagctacatcggcaccaaggatgccaagcccaaggatgtggtggccgccggctctgtggagatgatgaatgtggagagcaagggcatgagggaccagaggctggacctgcagaggagagctgctgagaccagtgatgatgacctgatcccctttggagaccggcccaccgtgtccagatttggagccatcagcaggaccagcaagaccatctaccagggcgccggccccatgcaggccatggccccccagggcgcccccaccaagagcatcaacatcagtgactacagcccctacggcacccacggcggctggggcgccagcccctacagcccccaccagaacatccccagccagggccacttcagcgagcgggagcgcatctccatgtctgaggtggccagccacggcaagcccctgcccagcgctgagcgggagcagctgcggctggagctgcagcagctgaaccaccagatcagccagcagacccagctgcggggcctggagcgggaggccaacaccctggccggccagagccagcccccacctcctcctccacccaagtggccaggcatgatcagcagcgagcagctgagcctggagctgcaccaggtggagcgggagatcggcaagaggacccgggagctgtccatggagaaccagtgcagcctggacatgaagagcaagctgaacaccagcaagcaggctgaaaatggccagcctgagccccagaacaaggtgcctgctgaggacctgaccctgaccttcagcagtgatgtgcccaacggcagcgccctgacccaggagaacatcagcctgctgagcaacaagaccagcagcctgaacctgtctgaagatcctgagggcggcggggacaacaatgacagccagaggtctggagtgacccccagcagcgccccctag

SEQ ID NO: 168400 - DNA, 3402 bp, Artificial Sequence; identical to SEQ ID NO: 168398
  Description of Artificial Sequence: Synthetic coding sequence

SEQ ID NO: 168401 - DNA, 984 bp, Artificial Sequence
  Description of Artificial Sequence: Synthetic coding sequence
atgtgggccacctgctgcaactggttctgcctggatggccagcctgaggaggtgcccccaccccagggcgccaggatgcaggcctacagcaaccctggctacagcagcttccccagccccaccggcctggagcccagctgcaagagctgtggggcccactttgccaacacagccaggaagcagacctgcctggactgcaagaagaacttctgcatgacctgcagcagccaggtgggcaatggcccccggctgtgcctgctgtgccagcgcttccgggccacagccttccagcgggaggagctgatgaagatgaaggtgaaggacctgcgggactacctgagcctgcatgacatcagcacagagatgtgccgggagaaggaggagctggtgctgctggtgctgggccagcagcccgtcatcagccaggaggacaggacccgggccagcaccctgagcccagacttccctgagcagcaggccttcctgacccagccccacagctccatggtgccccccaccagccccaacctgcccagcagcagcgcccaggccacctctgtgcccccagcccaggtgcaggagaaccagcagagcattgattctgaggacagctttgtgcctggaagaagagccagcctgagtgacctgacagacctggaggacatcgagggcctgactgtgcggcagctgaaggagatcctggccaggaactttgtgaactacaagggctgctgtgagaagtgggagctgatggagcgggtgacccggctgtacaaggaccagaagggcctgcagcacctgggcggcgctgtgcccagcggcctggaggagaacctgtgcaagatctgcatggacagccccatcgactgtgtgctgctggagtgtggccacatggtgacctgcaccaagtgtgggaagaggatgaatgaatgtcccatctgccggcagtatgtgatccgggctgtgcacgtgttccgctcctag

SEQ ID NO: 168402 - DNA, 1092 bp, Artificial Sequence
  Description of Artificial Sequence: Synthetic coding sequence
atgtgggccacctgctgcaactggttctgcctggatggccagcctgaggaggtgcccccaccccagggcgccaggatgcaggcctacagcaaccctggctacagcagcttccccagccccaccggcctggagcccagctgcaagagctgtggggcccactttgccaacacagccaggaagcagacctgcctggactgcaagaagaacttctgcatgacctgcagcagccaggtgggcaatggcccccggctgtgcctgctgtgccagcgcttccgggccacagccttccagcgggaggagctgatgaagatgaaggtgaaggacctgcgggactacctgagcctgcatgacatcagcacagagatgtgccgggagaaggaggagctggtgctgctggtgctgggccagcagcccgtcatcagccaggaggacaggacccgggccagcaccctgagcccagacttccctgagcagcaggccttcctgacccagccccacagctccatggtgccccccaccagccccaacctgcccagcagcagcgcccaggccacctctgtgcccccagcccaggtgcaggagaaccagcaggccaatggacatgtgtcccaggaccaggaggagcctgtgtacctggagagcgtggcccgggtgcctgcagaagatgagacccagagcattgattctgaggacagctttgtgcctggaagaagagccagcctgagtgacctgacagacctggaggacatcgagggcctgactgtgcggcagctgaaggagatcctggccaggaactttgtgaactacaagggctgctgtgagaagtgggagctgatggagcgggtgacccggctgtacaaggaccagaagggcctgcagcacctggtgtctggagctgaggaccagaatggaggagctgtgcccagcggcctggaggagaacctgtgcaagatctgcatggacagccccatcgactgtgtgctgctggagtgtggccacatggtgacctgcaccaagtgtgggaagaggatgaatgaatgtcccatctgccggcagtatgtgatccgggctgtgcacgtgttccgctcctag

SEQ ID NO: 168403 - DNA, 1068 bp, Artificial Sequence
  Description of Artificial Sequence: Synthetic coding sequence
atgtgggccacctgctgcaactggttctgcctggatggccagcctgaggaggtgcccccaccccagggcgccaggatgcaggcctacagcaaccctggctacagcagcttccccagccccaccggcctggagcccagctgcaagagctgtggggcccactttgccaacacagccaggaagcagacctgcctggactgcaagaagaacttctgcatgacctgcagcagccaggtgggcaatggcccccggctgtgcctgctgtgccagcgcttccgggccacagccttccagcgggaggagctgatgaagatgaaggtgaaggacctgcgggactacctgagcctgcatgacatcagcacagagatgtgccgggagaaggaggagctggtgctgctggtgctgggccagcagcccgtcatcagccaggaggacaggacccgggccagcaccctgagcccagacttccctgagcagcaggccttcctgacccagccccacagctccatggtgccccccaccagccccaacctgcccagcagcagcgcccaggccacctctgtgcccccagcccaggtgcaggagaaccagcaggccaatggacatgtgtcccaggaccaggaggagcctgtgtacctggagagcgtggcccgggtgcctgcagaagatgagacccagagcattgattctgaggacagctttgtgcctggaagaagagccagcctgagtgacctgacagacctggaggacatcgagggcctgactgtgcggcagctgaaggagatcctggccaggaactttgtgaactacaagggctgctgtgagaagtgggagctgatggagcgggtgacccggctgtacaaggaccagaagggcctgcagcacctgggcggcgctgtgcccagcggcctggaggagaacctgtgcaagatctgcatggacagccccatcgactgtgtgctgctggagtgtggccacatggtgacctgcaccaagtgtgggaagaggatgaatgaatgtcccatctgccggcagtatgtgatccgggctgtgcacgtgttccgctcctag

SEQ ID NO: 168404 - DNA, 1092 bp, Artificial Sequence; identical to SEQ ID NO: 168402
  Description of Artificial Sequence: Synthetic coding sequence

SEQ ID NO: 168405 - DNA, 816 bp, Artificial Sequence
  Description of Artificial Sequence: Synthetic coding sequence
atgtgggccacctgctgcaactggttctgcctggatggccagcctgaggaggtgcccccaccccagggcgccaggatgcaggcctacagcaaccctggctacagcagcttccccagccccaccggcctggagcccagctgcaagagctgtggggcccactttgccaacacagccaggaagcagacctgcctggactgcaagaagaacttctgcatgacctgcagcagccaggtgggcaatggcccccggctgtgcctgctgtgccagcgcttccgggccacagccttccagcgggaggagctgatgaagatgaaggtgaaggacctgcgggactacctgagcctgcatgacatcagcacagagatgtgccgggagaaggaggagctggtgctgctggtgctgggccagcagcccgtcatcagccaggaggacaggacccgggccagcaccctgagcccagacttccctgagcagcaggccttcctgacccagccccacagctccatggtgccccccaccagccccaacctgcccagcagcagcgcccaggccacctctgtgcccccagcccaggtgcaggagaaccagcaggccaatggacatgtgtcccaggaccaggaggagcctgtgtacctggagagcgtggcccgggtgcctgcagaagatgagacccagagcattgattctgaggacagctttgtgcctggaagaagagccagcctgagtgacctgacagacctggaggacatcgagggcctgactgtgcggcagctgaaggagatcctggccaggaactttgtgaactacaagggctag

SEQ ID NO: 168406 - DNA, 402 bp, Artificial Sequence
  Description of Artificial Sequence: Synthetic coding sequence
atgtgggccacctgctgcaactggttctgcctggatggccagcctgaggaggtgcccccaccccagggcgccaggatgcaggcctacagcaaccctggctacagcagcttccccagccccaccggcctggagcccagctgcaagagctgtggggcccactttgccaacacagccaggaagcagacctgcctggactgcaagaagaacttctgcatgacctgcagcagccaggtgggcaatggcccccggctgtgcctgctgtgccagcgcttccgggccacagccttccagcgggaggagctgatgaagatgaaggtgaaggacctgcgggactacctgagcctgcatgacatcagcacagagatgtgccgggagaaggaggagctggtgctgctggtgtag

SEQ ID NO: 168407 - DNA, 570 bp, Artificial Sequence
  Description of Artificial Sequence: Synthetic coding sequence
atgtgggccacctgctgcaactggttctgcctggatggccagcctgaggaggtgcccccaccccagggcgccaggatgcaggcctacagcaaccctggctacagcagcttccccagccccaccggcctggagcccagctgcaagagctgtggggcccactttgccaacacagccaggaagcagacctgcctggactgcaagaagaacttctgcatgacctgcagcagccaggtgggcaatggcccccggctgtgcctgctgtgccagcgcttccgggccacagccttccagcgggaggagctgatgaagatgaaggtgaaggacctgcgggactacctgagcctgcatgacatcagcacagagatgtgccgggagaaggaggagctggtgctgctggtgctgggccagcagcccgtcatcagccaggaggacaggacccgggccagcaccctgagcccagacttccctgagcagcaggccttcctgacccagccccacagctccatggtgccccccaccagccccaacctgcccagcagcagcgcccaggccacctctgtgcccccatag

SEQ ID NO: 168408 - DNA, 138 bp, Artificial Sequence
  Description of Artificial Sequence: Synthetic coding sequence
atgtgggccacctgctgcaactggttctgcctggatggccagcctgaggaggtgcccccaccccagggcgccaggatgcaggcctacagcaaccctggctacagcagcttccccagccccaccggcctggagccctag

SEQ ID NO: 168409 - DNA, 2124 bp, Artificial Sequence
  Description of Artificial Sequence: Synthetic coding sequence
atgagcggcagccggcaggccggcagcggcagcgctggcaccagccctggcagcagcgctgccagctctgtgaccagcgccagcagcagcctgagcagcagccccagccccccatctgtggccgtgtctgctgctgccctggtgtctggaggagtggcccaggccgccggcagcggcggcctgggcggccctgtgcggcctgtgctggtggccccagctgtgtctggcagcggcggcggcgctgtgtccacaggcctgagccgccacagctgtgccgcccggcccagcgctggggtgggcggcagcagcagcagcctgggcagcggcagcaggaagaggcccctgctggcccccctgtgcaatggcctcatcaacagctatgaggacaagagcaatgactttgtgtgccccatctgctttgacatgattgaggaggcctacatgaccaagtgtggccacagcttctgctacaagtgcatccaccagagcctggaggacaacaaccgctgccccaagtgcaactacgtggtggacaacatcgaccacctgtaccccaacttcctggtgaatgagctgatcctgaagcagaagcagagatttgaggagaagcgcttcaagctggaccacagcaatggccaccgctggcagatcttccaggactggctgggcacagaccaggacaacctggacctggccaacgtgaacctgatgctggagctgctggtgcagaagaagaagcagctggaggccgagagccacgccgcccagctgcagatcctgatggagttcctgaaggtggcccggaggaacaagcgggaggagatgagcggcctgtacagccctgtgtctgaggacagcacagtgccccagtttgaggcccccagccccagccacagcagcatcatcgacagcacagagtacagccagcccccaggcttcagcggcagcagccagaccaagaagcagccctggtacaacagcaccctggccagcaggaggaagaggctgacagcccactttgaggacctggagcagtgctacttcagcaccaggatgagccgcatcagtgatgacagcaggacagccagccagctggatgagttccaggagtgcctgagcaagttcacccgctacaacagcgtgcggcccctggccaccctgtcctatgccagtgacctgtacaacggcagcagcatcgtgagcagcattgaatttgaccgggactgtgactactttgccatcgccggcgtgaccaagaagatcaaggtgtatgaatatgacaccgtcatccaggatgctgtggacatccactacccagaaaatgagatgacctgcaacagcaagatcagctgcatctcctggagcagctaccacaagaacctgctggccagcagtgactatgagggcaccgtcatcctgtgggatggcttcaccggccagaggagcaaggtgtaccaggagcacgagaagcgctgctggagcgtggacttcaacctgatggaccccaagctgctggccagcggcagtgatgatgccaaggtgaagctgtggagcaccaacctggacaacagcgtggccagcattgaggccaaggccaacgtgtgctgcgtgaagttcagccccagcagccgctaccacctggccttcggctgtgccgaccactgtgtgcactactatgacctgaggaacaccaagcagcccatcatggtgttcaagggccacaggaaggctgtgtcctatgccaagtttgtgtctggagaggagatcgtgtctgccagcacagacagccagctgaagctgtggaatgtgggcaagccctactgcctgcgctccttcaagggccacatcaatgagaagaactttgtgggcctggccagcaatggagactacatcgcctgtggcagcgagaacaacagcctgtacctgtactacaagggcctgagcaagaccctgctgaccttcaagtttgacacagtgaagtctgtgctggacaaggacagaaaagaagatgacaccaatgaatttgtgtctgctgtgtgctggagggccctgcctgatggagagagcaatgtgctgattgctgccaacagccagggcaccatcaaggtgctggagctggtgtag

SEQ ID NO: 168410 - DNA, 1521 bp, Artificial Sequence
  Description of Artificial Sequence: Synthetic coding sequence
atggagttcctgaaggtggcccggaggaacaagcgggagcagctggagcagatccagaaggagctgtctgtgctggaggaggacatcaagagggtggaggagatgagcggcctgtacagccctgtgtctgaggacagcacagtgccccagtttgaggcccccagccccagccacagcagcatcatcgacagcacagagtacagccagcccccaggcttcagcggcagcagccaggccggcgtgcagtggagatacctgggcagcctgcagcccccaccaccccgctacaagcgcttcagctgcctgaccctgcccagctcctgggactacagaaggctgcccccccacctgaccaagaagcagccctggtacaacagcaccctggccagcaggaggaagaggctgacagcccactttgaggacctggagcagtgctacttcagcaccaggatgagccgcatcagtgatgacagcaggacagccagccagctggatgagttccaggagtgcctgagcaagttcacccgctacaacagcgtgcggcccctggccaccctgtcctatgccagtgacctgtacaacggcagcagcatcgtgagcagcattgaatttgaccgggactgtgactactttgccatcgccggcgtgaccaagaagatcaaggtgtatgaatatgacaccgtcatccaggatgctgtggacatccactacccagaaaatgagatgacctgcaacagcaagatcagctgcatctcctggagcagctaccacaagaacctgctggccagcagtgactatgagggcaccgtcatcctgtgggatggcttcaccggccagaggagcaaggtgtaccaggagcacgagaagcgctgctggagcgtggacttcaacctgatggaccccaagctgctggccagcggcagtgatgatgccaaggtgaagctgtggagcaccaacctggacaacagcgtggccagcattgaggccaaggccaacgtgtgctgcgtgaagttcagccccagcagccgctaccacctggccttcggctgtgccgaccactgtgtgcactactatgacctgaggaacaccaagcagcccatcatggtgttcaagggccacaggaaggctgtgtcctatgccaagtttgtgtctggagaggagatcgtgtctgccagcacagacagccagctgaagctgtggaatgtgggcaagccctactgcctgcggagcttcaagggccacatcaatgagaagaactttgtgggcctggccagcaatggagactacatcgcctgtggcagcgagaacaacagcctgtacctgtactacaagggcctgagcaagaccctgctgaccttcaagtttgacacagtgaagtctgtgctggacaaggacaggaaggaggatgacaccaatgaatttgtgtctgctgtgtgctggagggccctgcctgatggagagagcaatgtgctgattgctgccaacagccagggcaccatcaaggtgctggccctgctgtag

SEQ ID NO: 168411 - DNA, 2196 bp, Artificial Sequence
  Description of Artificial Sequence: Synthetic coding sequence
atgagcggcagccggcaggccggcagcggcagcgctggcaccagccctggcagcagcgctgccagctctgtgaccagcgccagcagcagcctgagcagcagccccagccccccatctgtggccgtgtctgctgctgccctggtgtctggaggagtggcccaggccgccggcagcggcggcctgggcggccctgtgcggcctgtgctggtggccccagctgtgtctggcagcggcggcggcgctgtgtccacaggcctgagccgccacagctgtgccgcccggcccagcgctggggtgggcggcagcagcagcagcctgggcagcggcagcaggaagaggcccctgctggcccccctgtgcaatggcctcatcaacagctatgaggacaagagcaatgactttgtgtgccccatctgctttgacatgattgaggaggcctacatgaccaagtgtggccacagcttctgctacaagtgcatccaccagagcctggaggacaacaaccgctgccccaagtgcaactacgtggtggacaacatcgaccacctgtaccccaacttcctggtgaatgagctgatcctgaagcagaagcagagatttgaggagaagcgcttcaagctggaccacagcgtgagcagcaccaacggccaccgctggcagatcttccaggactggctgggcacagaccaggacaacctggacctggccaacgtgaacctgatgctggagctgctggtgcagaagaagaagcagctggaggccgagagccacgccgcccagctgcagatcctgatggagttcctgaaggtggcccggaggaacaagcgggagcagctggagcagatccagaaggagctgtctgtgctggaggaggacatcaagagggtggaggagatgagcggcctgtacagccctgtgtctgaggacagcacagtgccccagtttgaggcccccagccccagccacagcagcatcatcgacagcacagagtacagccagcccccaggcttcagcggcagcagccagaccaagaagcagccctggtacaacagcaccctggccagcaggaggaagaggctgacagcccactttgaggacctggagcagtgctacttcagcaccaggatgagccgcatcagtgatgacagcaggacagccagccagctggatgagttccaggagtgcctgagcaagttcacccgctacaacagcgtgcggcccctggccaccctgtcctatgccagtgacctgtacaacggcagcagcatcgtgagcagcattgaatttgaccgggactgtgactactttgccatcgccggcgtgaccaagaagatcaaggtgtatgaatatgacaccgtcatccaggatgctgtggacatccactacccagaaaatgagatgacctgcaacagcaagatcagctgcatctcctggagcagctaccacaagaacctgctggccagcagtgactatgagggcaccgtcatcctgtgggatggcttcaccggccagaggagcaaggtgtaccaggagcacgagaagcgctgctggagcgtggacttcaacctgatggaccccaagctgctggccagcggcagtgatgatgccaaggtgaagctgtggagcaccaacctggacaacagcgtggccagcattgaggccaaggccaacgtgtgctgcgtgaagttcagccccagcagccgctaccacctggccttcggctgtgccgaccactgtgtgcactactatgacctgaggaacaccaagcagcccatcatggtgttcaagggccacaggaaggctgtgtcctatgccaagtttgtgtctggagaggagatcgtgtctgccagcacagacagccagctgaagctgtggaatgtgggcaagccctactgcctgcgctccttcaagggccacatcaatgagaagaactttgtgggcctggccagcaatggagactacatcgcctgtggcagcgagaacaacagcctgtacctgtactacaagggcctgagcaagaccctgctgaccttcaagtttgacacagtgaagtctgtgctggacaaggacagaaaagaagatgacaccaatgaatttgtgtctgctgtgtgctggagggccctgcctgatggagagagcaatgtgctgattgctgccaacagccagggcaccatcaaggtgctggagctggtgtag

SEQ ID NO: 168412 - DNA, 774 bp, Artificial Sequence
  Description of Artificial Sequence: Synthetic coding sequence
atgagcggcagccggcaggccggcagcggcagcgctggcaccagccctggcagcagcgctgccagctctgtgaccagcgccagcagcagcctgagcagcagccccagccccccatctgtggccgtgtctgctgctgccctggtgtctggaggagtggcccaggccgccggcagcggcggcctgggcggccctgtgcggcctgtgctggtggccccagctgtgtctggcagcggcggcggcgctgtgtccacaggcctgagccgccacagctgtgccgcccggcccagcgctggggtgggcggcagcagcagcagcctgggcagcggcagcaggaagaggcccctgctggcccccctgtgcaatggcctcatcaacagctatgaggacaagagcaatgactttgtgtgccccatctgctttgacatgattgaggaggcctacatgaccaagtgtggccacagcttctgctacaagtgcatccaccagagcctggaggacaacaaccgctgccccaagtgcaactacgtggtggacaacatcgaccacctgtaccccaacttcctggtgaatgagctgatcctgaagcagaagcagagatttgaggagaagcgcttcaagctggaccacagcgtgagcagcaccaacggccaccgctggcagatcttccaggactggctgggcacagaccaggacaacctggacctggccaacgtgaacctgatgctggagctgctggtgcagaagaacaagaagaagaagaagaagaagaagtag

SEQ ID NO: 168413 - DNA, 2325 bp, Artificial Sequence
  Description of Artificial Sequence: Synthetic coding sequence
atggcccacgaggccatggagtatgatgtgcaggtgcagctgaaccacgccgagcagcagcctgccccagctggcatggccagcagccagggcggccctgccctgctgcagcctgtgcctgcagatgtggtgagcagccagggcgtgcccagcatcctgcagcctgccccagctgaggtgatcagcagccaggccaccccacccctgctgcagcctgccccccagctgtctgtggacctgacagaggtggaggtgctgggggaggacacagtggagaacatcaaccccaggaccagcgagcagcaccggcagggcagtgatggcaaccacaccatcccagccagcagcctgcacagcatgaccaacttcatcagcggcctgcagaggctgcacggcatgctggagttcctgcggcccagcagcagcaaccacagcgtgggccccatgaggaccaggagaagagtgtctgccagcagaagagcccgggccggcggcagccagaggacagattctgcccggctgcgggcccccctggatgcctacttccaggtgtccaggacccagcctgacctgcctgccaccacctatgacagcgagaccagaaatcctgtgtctgaggagctgcaggtgagcagcagcagtgacagcgacagcgacagcagcgcagaatatggaggagtggtggaccaggccgaggagagcggggccgtcatcctggaggagcagctggccggcgtgtctgctgagcaggaggtgacctgcattgatggcggcaagaccctgcccaagcagcccagcccccagaagtctgagcccctgctgcccagcgcctccatggatgaggaggagggggacacctgcaccatctgcctggagcagtggaccaatgctggggaccaccggctgagcgccctgcgctgtggccacctgtttggctaccgctgcatcagcacctggctgaagggccaggtgaggaagtgcccccagtgcaacaagaaggcccggcacagcgacatcgtggtgctgtatgcccggaccctgcgggccctggacaccagcgagcaggagaggatgaagagcagcctgctgaaggagcagatgctgaggaagcaggccgagctggagagcgcccagtgccgcctgcagctgcaggtgctgacagacaagtgcacccggctgcagaggagagtgcaggacctgcagaagctgaccagccaccagagccagaacctgcagcagccccggggcagccaggcctgggtgctgagctgcagccccagcagccagggccagcacaagcacaagtaccacttccagaagaccttcaccgtgtcccaggccggcaactgccgcatcatggcctactgtgatgccctgagctgcctggtgatcagccagcccagcccccaggccagcttcctgcccggctttggagtgaagatgctgagcacagccaacatgaagagcagccagtacatccccatgcacggcaagcagatccggggcctggccttcagcagctacctgcggggcctgctgctgagcgccagcctggacaacaccatcaagctgaccagcctggagaccaacacagtggtgcagacctacaatgccggccggcctgtgtggagctgctgctggtgcctggatgaggccaactacatctatgccggcctggccaacggcagcatcctggtgtatgatgtgaggaacaccagcagccacgtgcaggagctggtggcccagaaggcccgctgccccctggtgtccctgagctacatgcccagggctgccagcgctgccttcccctacggcggcgtgctggccggcaccctggaggatgccagcttctgggagcagaagatggacttcagccactggccccacgtgctgcccctggagcccggcggctgcatcgacttccagacagagaacagcagccgccactgcctggtgacctacagaccagacaagaaccacaccaccatccgctctgtgctgatggagatgagctaccgcctggatgacaccggcaaccccatctgcagctgccagcctgtgcacaccttctttggaggccccacctgcaagctgctgaccaagaatgccatcttccagagcccagaaaatgatggcaacatcctggtgtgcacaggagatgaggccgccaacagcgccctgctgtgggatgctgccagcggcagcctgctgcaggacctgcagacagaccagcctgtgctggacatctgcccctttgaggtgaacagaaacagctacctggccaccctgacagagaagatggtgcacatctacaagtgggagtag

SEQ ID NO: 168414 - DNA, 792 bp, Artificial Sequence
  Description of Artificial Sequence: Synthetic coding sequence
atggcccacgaggccatggagtatgatgtgcaggtgcagctgaaccacgccgagcagcagcctgccccagctggcatggccagcagccagggcggccctgccctgctgcagcctgtgcctgcagatgtggtgagcagccagggcgtgcccagcatcctgcagcctgccccagctgaggtgatcagcagccaggccaccccacccctgctgcagcctgccccccagctgtctgtggacctgacagaggtggaggtgctgggggaggacacagtggagaacatcaaccccaggaccagcgagcagcaccggcagggcagtgatggcaaccacaccatcccagccagcagcctgcacagcatgcccctggagcccggcggctgcatcgacttccagacagagaacagcagccgccactgcctggtgacctacagaccagacaagaaccacaccaccatccgctctgtgctgatggagatgagctaccgcctggatgacaccggcaaccccatctgcagctgccagcctgtgcacaccttcttcggcggccccacctgcaagctgctgaccaagaatgccatcttccagagcccagaaaatgatggcaacatcctggtgtgcacaggagatgaagctgccaacagcgccctgctgtgggatgctgccagcggcagcctgctgcaggacctgcagacagaccagcctgtgctggacatctgcccctttgaggtgaacagaaattcctacctggccaccctgacagagaagatggtgcacatctacaagtgggagtag

SEQ ID NO: 168415 - DNA, 2058 bp, Artificial Sequence
  Description of Artificial Sequence: Synthetic coding sequence
atgaaccagagccgcagcagaagtgatggcggcagcgaggagaccctgccccaggaccacaaccaccatgaaaatgaaagacgctggcagcaggagcggctgcaccgggaggaggcctactaccagttcatcaatgagctgaatgatgaggactaccgcctgatgagggaccacaacctgctgggcaccccaggagagatcaccagcgaggagctgcagcagaggctggatggagtgaaggagcagctggccagccagcctgacctgagagatggcaccaactacagagacagcgaggtgccccgggagagcagccatgaggacagcctgctggagtggctgaacaccttccggaggactggaaatgccaccaggagcggccagaatggaaaccagacctggagggctgtgtccaggaccaaccccaacaacggggagttccgcttcagcctggagatccacgtgaaccacgagaacagaggatttgagatccatggagaggactacacagacatccccctgagtgacagcaacagagaccacacagccaaccggcagcagaggagcaccagccctgtggcccggaggaccaggagccagacctctgtgaacttcaacggcagcagcagcaacatccccaggacccggctggccagccggggccagaacccagctgagggcagcttcagcaccctgggccgcctgagaaatggaattggaggagctgctggcatcccccgggccaatgccagcaggaccaacttcagcagccacaccaaccagagcggcggcagcgagctgcggcagcgggagggccagagatttggagctgcccacgtgtgggagaatggagcccggagcaatgtgacagtgaggaacaccaaccagaggctggagcccatccggctgcggagcaccagcaacagccgcagccgcagccccatccagaggcagagcggcaccgtgtaccacaacagccagcgggagagcaggcctgtgcagcagaccacccggcgctctgtgagaagaagaggccgcaccagggtcttcctggagcaggaccgggagcgggagcggcggggcacagcctacacccccttcagcaacagccggctggtgagccgcatcaccgtggaggagggggaggagagcagccgcagcagcacagctgtgcggcggcaccccaccatcaccctggacctgcaggtgcggcgcatccggcctggagagaacagagaccgggacagcatcgccaacagaaccaggagccgggtgggcctggctgaaaatacagtgaccatcgagagcaacagcggcggcttccggaggaccatcagccggctggagaggagcggcatccgcacctacgtgtccaccatcaccgtgcccctgcggcgcatcagtgaaaatgagctggtggagcccagctctgtggccctgcggagcatcctgcggcagatcatgactggatttggagagctgagcagcctgatggaggccgacagcgagagcgagctgcagagaaatggccagcacctgcctgacatgcacagcgagctgagcaacctgggcacagacaacaacagaagccagcaccgggagggcagcagccaggaccggcaggcccagggcgacagcacagagatgcacggggagaatgagaccacccagccccacaccaggaacagcgacagcagaggaggccggcagctgaggaaccccaacaacctggtggagaccggcaccctgcccatcctgcggctggcccacttcttcctgctgaatgaaagtgatgatgatgaccgcatccggggcctgaccaaggagcagattgacaacctgagcaccaggcactatgagcacaacagcattgacagcgagctgggcaagatctgcagcgtgtgcatcagtgactatgtgactggaaacaagctgcggcagctgccctgcatgcatgagttccacatccactgcatcgaccgctggctgtctgagaactgcacctgccccatctgccggcagcctgtgctgggcagcaacatcgccaacaacggctag

SEQ ID NO: 168416 - DNA, 2058 bp, Artificial Sequence; identical to SEQ ID NO: 168415
  Description of Artificial Sequence: Synthetic coding sequence

SEQ ID NO: 168417 - DNA, 2058 bp, Artificial Sequence; identical to SEQ ID NO: 168415
  Description of Artificial Sequence: Synthetic coding sequence

SEQ ID NO: 168418 - DNA, 990 bp, Artificial Sequence
  Description of Artificial Sequence: Synthetic coding sequence
atgcagctggaggtggacaagatgggcaccaagctgggggagctgctggtgagccgcatcaccgtggaggagggggaggagagcagccgcagcagcacagctgtgcggcggcaccccaccatcaccctggacctgcaggtgcggcgcatccggcctggagagaacagagaccgggacagcatcgccaacagaaccaggagccgggtgggcctggctgaaaatacagtgaccatcgagagcaacagcggcggcttccggaggaccatcagccggctggagaggagcggcatccgcacctacgtgtccaccatcaccgtgcccctgcggcgcatcagtgaaaatgagctggtggagcccagctctgtggccctgcggagcatcctgcggcagatcatgactggatttggagagctgagcagcctgatggaggccgacagcgagagcgagctgcagagaaatggccagcacctgcctgacatgcacagcgagctgagcaacctgggcacagacaacaacagaagccagcaccgggagggcagcagccaggaccggcaggcccagggcgacagcacagagatgcacggggagaatgagaccacccagccccacaccaggaacagcgacagcagaggaggccggcagctgaggaaccccaacaacctggtggagaccggcaccctgcccatcctgcggctggcccacttcttcctgctgaatgaaagtgatgatgatgaccgcatccggggcctgaccaaggagcagattgacaacctgagcaccaggcactatgagcacaacagcattgacagcgagctgggcaagatctgcagcgtgtgcatcagtgactatgtgactggaaacaagctgcggcagctgccctgcatgcatgagttccacatccactgcatcgaccgctggctgtctgagaactgcacctgccccatctgccggcagcctgtgctgggcagcaacatcgccaacaacggctag

SEQ ID NO: 168419 - DNA, 1221 bp, Artificial Sequence
  Description of Artificial Sequence: Synthetic coding sequence
atgaccaccccagccaatgcccagaatgccagcaagacctgggagctgagcctgtatgagctgcacaggaccccccaggaggccatcatggatggaacagaaattgctgtgagccccaggagcctgcacagcgagctgatgtgccccatctgcctggacatgctgaagaacaccatgaccaccaaggaatgtctgcaccgcttctgcagcgactgcatcgtgacagccctgcggagcggcaacaaggaatgtcccacctgcaggaagaagctggtgtccaagaggagcctgcggccagaccccaactttgatgccctgatcagcaagatctaccccagccgggaggagtatgaggcccaccaggacagagtgctgatccggctgagccggctgcacaaccagcaggccctgagcagcagcattgaggagggcctgaggatgcaggccatgcaccgggcccagagggtgagaagacccatccctggcagtgaccagaccaccaccatgtctggaggagagggggagcccggggagggggagggagatggagaagatgtgtccagtgacagcgccccagacagcgcccctggccctgcccccaagaggccccggggcggcggggccggcggcagctctgtgggcactggaggcggcggcaccggcggcgtgggcggcggggccggcagcgaggacagcggggaccggggcggcaccctgggcggcggcaccctgggcccccccagccccccaggggcccccagccccccagagcccggcggggagattgagctggtgttccggccccaccccctgctggtggagaagggggagtactgccagaccaggtatgtgaagaccactggaaatgccaccgtggaccacctgagcaagtacctggccctgagaattgccctggagcggcggcagcagcaggaggccggggagcccggcggccctgggggcggggccagtgacaccggcggcccagatggctgcggcggggagggcggcggggccggcggcggagatggccctgaggagcccgccctgcccagcctggagggcgtgtctgagaagcagtacaccatctacatcgcccctgggggcggggccttcaccaccctgaatggcagcctgaccctggagctggtgaatgagaagttctggaaggtgtcccggcccctggagctgtgctacgcccccaccaaggaccccaagtag

SEQ ID NO: 168420 - DNA, 1221 bp, Artificial Sequence; identical to SEQ ID NO: 168419
  Description of Artificial Sequence: Synthetic coding sequence

SEQ ID NO: 168421 - DNA, 1221 bp, Artificial Sequence; identical to SEQ ID NO: 168419
  Description of Artificial Sequence: Synthetic coding sequence

SEQ ID NO: 168422 - DNA, 1221 bp, Artificial Sequence; identical to SEQ ID NO: 168419
  Description of Artificial Sequence: Synthetic coding sequence

SEQ ID NO: 168423 - DNA, 1221 bp, Artificial Sequence; identical to SEQ ID NO: 168419
  Description of Artificial Sequence: Synthetic coding sequence

SEQ ID NO: 168424 - DNA, 1221 bp, Artificial Sequence; identical to SEQ ID NO: 168419
  Description of Artificial Sequence: Synthetic coding sequence

SEQ ID NO: 168425 - DNA, 465 bp, Artificial Sequence
  Description of Artificial Sequence: Synthetic coding sequence
atgggcaactgcctgaagagccccaccagtgatgacatcagcctgctgcacgagagccagagcgaccgggccagctttggagagggcacagagccagaccaggagcccccaccaccctaccaggagcaggtgcctgtgcctgtgtaccaccccacccccagccagacccggctggccacccagctgacagaggaggagcagatccgcatcgcccagagaattggcctcatccagcacctgcccaagggcgtgtatgaccccggcagagatggcagcgagaagaagatccgggagtgtgtgatctgcatgatggactttgtgtatggagaccccatccgcttcctgccctgcatgcacatctaccacctggactgcattgatgactggctgatgaggagcttcacctgccccagctgcatggagcctgtggatgctgccctgctgagcagctatgagaccaactag

SEQ ID NO: 168426 - DNA, 1896 bp, Artificial Sequence
  Description of Artificial Sequence: Synthetic coding sequence
atgcccaggcctgccctgtctgtgaccagcttctgccaccggctgggcaagcgggagaggaagcagagcttcatgggcaacagcggcaacagctggagccacacccccttccccaagctggagctgggcctgggcccccagcccatggccccccgggagctgcccacctgcagcatctgcctggagcggctgcgggaccccatcagcctggactgtggccatgacttctgcatccgctgcttcagcacccaccggctgcccggctgtgagcccccctgctgcccagagtgcaggaagatctgcaagcagaagaggggcctgcggagcctgggggagaagatgaagctgctgccccagaggcccctgcccccagccctgcaggagacctgccctgtgcgggcagagcccctgctgctggtgcgcatcaatgccagcggcggcctcatcctgaggatgggcgccatcaaccgctgcctgaagcaccccctggcccgggacacccctgtgtgcctgctggccgtgctgggggagcagcacagcggcaagagcttcctgctgaaccacctgctgcagggcctgcccggcctggagagcggggagggcggccggccccggggcggggaggccagcctgcagggctgccgctggggcgccaacggcctggcccggggcatctggatgtggagccaccccttcctgctgggcaaggagggcaagaaggtggccgtgttcctggtggacacaggagatgccatgagccctgagctgagccgggagacccgcatcaagctgtgtgccctgaccaccatgctgagcagctaccagatcctgagcaccagccaggagctgaaggacacagacctggactacctggagatgtttgtgcacgtggccgaggtgatgggcaagcactacggcatggtgcccatccagcacctggacctgctggtgcgggacagcagccaccccaacaaggccggccagggccacgtgggcaacatcttccagaggctgagcggccgctaccccaaggtgcaggagctgctgcagggcaagagggcccgctgctgcctgctgcctgcccctggaagaagaaggatgaaccagggccacgccagccctggggacacagatgatgacttccgccacctgctgggcgcctacgtgtctgatgtgctgtctgctgccccccagcacgccaagagccgctgccagggctactggaatgaaggccgggctgtggcccggggggaccggcggctgctgaccggccagcagctggcccaggagatcaagaacctgagcggctggatgggccgcactggacctggcttcaccagcccagatgagatggccgcccagctgcatgacctgaggaaggtggaggccgccaagcgggagtttgaggagtatgtgcggcagcaggatgtggccaccaagaggatcttcagcgccctgcgggtgctgcctgacaccatgaggaacctgctgagcacccagaaggatgccatcctggcccggcatggagtggccctgctgtgcaagggccgggaccagaccctggaggccctggaggccgagctgcaggccacagccaaggccttcatggacagctacaccatgaggttctgtggccacctggccgctgtgggcggcgctgtgggcgccggcctgatgggcctggccggcggcgtggtgggcgccggcatggctgctgctgccctggccgctgaggccggcatggtggccgccggggctgctgtgggcgccactggagctgctgtggtgggcggcggcgtgggcgccggcctggccgccaccgtgggctgcatggagaaggaggaggatgagcggctgctggagggggaccgggagcccctgctgcaggaggagtag

SEQ ID NO: 168427 - DNA, 687 bp, Artificial Sequence
  Description of Artificial Sequence: Synthetic coding sequence
atggccgcccagcagagggactgtggcggggccgcccagctggccggccctgctgctgaggccgaccccctgggccgcttcacctgccctgtgtgcctggaggtgtatgagaagcctgtgcaggtgccctgtggccacgtgttctgcagcgcctgcctgcaggagtgcctgaagcccaagaagcctgtgtgtggggtgtgccgcagcgccctggcccctggggtgcgggctgtggagctggagcggcagatcgagagcacagagaccagctgccacggctgcaggaagaacttcttcctgagcaagatccgcagccacgtggccacctgcagcaagtaccagaactacatcatggagggcgtgaaggccaccatcaaggatgccagcctgcagcccagaaatgtgcccaaccgctacaccttcccctgcccctactgcccagagaagaactttgaccaggagggcctggtggagcactgcaagctgttccacagcacagacaccaagtctgtggtgtgccccatctgtgcctccatgccctggggagaccccaactaccgcagcgccaacttccgggagcacatccagaggaggcaccgcttctcctatgacacctttgtggactatgatgtggatgaggaggacatgatgaaccaggtgctgcagaggagcatcatcgaccagtag

SEQ ID NO: 168428 - DNA, 576 bp, Artificial Sequence
  Description of Artificial Sequence: Synthetic coding sequence
atggccgcccagcagagggactgtggcggggccgcccagctggccggccctgctgctgaggccgaccccctgggccgcttcacctgccctgtgtgcctggaggtgtatgagaagcctgtgcaggtgccctgtggccacgtgttctgcagcgcctgcctgcaggagtgcctgaagcccaagaagcctgtgtgtggggtgtgccgcagcgccctggcccctggggtgcgggctgtggagctggagcggcagatcgagagcacagagaccagctgccacggctgcaggaagaacttcttcctgagcaagatccgcagccacgtggccacctgcagcaagtaccagaactacatcatggagggcgtgaaggccaccatcaaggatgccagcctgcagcccagaaatgtgcccaaccgctacaccttcccctgcccctactgcccagagaagaactttgaccaggagggcctggtggagcactgcaagctgttccacagcacagacaccaagtctgtgaccagcgagcagagcccctgcctgctgtctgtgtcctgctaccgggccagcatcacctactag

SEQ ID NO: 168429 - DNA, 1287 bp, Artificial Sequence
  Description of Artificial Sequence: Synthetic coding sequence
atgggccccccacctggagctggggtgtcctgccggggcggctgcggcttcagccggctgctggcctggtgcttcctgctggccctgagcccccaggcccctggcagcagaggagctgaggccgtgtggacagcctacctgaatgtgtcctggagggtgccccacactggagtgaacagaacagtgtgggagctgtctgaggagggcgtgtatggccaggacagccccctggagcctgtggccggcgtgctggtgcccccagatggccctggggccctgaatgcctgcaacccccacaccaacttcaccgtgcccaccgtgtggggcagcacagtgcaggtgtcctggctggccctgatccagagaggaggcggctgcacctttgctgacaagatccacctggcctatgaaagaggagccagcggggctgtgatcttcaacttccctggcaccagaaatgaagtcatccccatgagccaccctggagctgtggacatcgtggccatcatgattggcaacctgaagggcaccaagatcctgcagagcatccagaggggcatccaggtgaccatggtgattgaggtgggcaagaagcacggcccctgggtgaaccactacagcatcttctttgtgtctgtgtccttcttcatcatcacagctgccaccgtgggctacttcatcttctacagcgcccggcggctgagaaatgcccgggcccagagcaggaagcagaggcagctgaaggcagatgccaagaaggccatcggccgcctgcagctgcggaccctgaagcagggcgacaaggagatcggcccagatggagacagctgtgctgtgtgcatcgagctgtacaagcccaatgacctggtgcgcatcctgacctgcaaccacatcttccacaagacctgtgtggacccctggctgctggagcacaggacctgccccatgtgcaagtgtgacatcctgaaggccctgggcatcgaggtggatgtggaggatggctctgtgtccctgcaggtgcctgtgtccaatgagatcagcaacagcgccagcagccatgaggaggacaacagaagtgaaacagccagcagcggctacgcctctgtgcagggcacagatgagccccccctggaggagcacgtgcagagcaccaatgaaagcctgcagctggtgaaccacgaggccaacagcgtggccgtggatgtgatcccccacgtggacaaccccacctttgaagaagatgagacccccaaccaggagacagctgtgcgggagatcaagagctag

SEQ ID NO: 168430 - DNA, 1209 bp, Artificial Sequence
  Description of Artificial Sequence: Synthetic coding sequence
atgaaccaggagaacagaagcagcttcttctggctgctggtgatcttcaccttcctgctgaagatcacagccagcttctccatgtctgcctacgtgacagtgacctactacaatgagaccagcaactacacagccatcgagacctgtgaatgtggggtgtatggcctggccagccctgtggccaatgccatgggcgtggtgggcatccccaagaacaacaactaccaggcctgtgaccacaacacagagttcagcaacaccaagaagccctggatcgccctgattgagcggggcaactgcaccttcagcgagaagatccagacagctggaagaagaaatgctgatgctgtggtgatctacaatgcccctgagactggaaaccagaccatccagatggccaactttggagctgtggacatcgtggccatcatgattggcaacctgaagggcaccaagatcctgcagagcatccagaggggcatccaggtgaccatggtgattgaggtgggcaagaagcacggcccctgggtgaaccactacagcatcttctttgtgtctgtgtccttcttcatcatcacagctgccaccgtgggctacttcatcttctacagcgcccggcggctgagaaatgcccgggcccagagcaggaagcagaggcagctgaaggcagatgccaagaaggccatcggccgcctgcagctgcggaccctgaagcagggcgacaaggagatcggcccagatggagacagctgtgctgtgtgcatcgagctgtacaagcccaatgacctggtgcgcatcctgacctgcaaccacatcttccacaagacctgtgtggacccctggctgctggagcacaggacctgccccatgtgcaagtgtgacatcctgaaggccctgggcatcgaggtggatgtggaggatggctctgtgtccctgcaggtgcctgtgtccaatgagatcagcaacagcgccagcagccatgaggaggacaacagaagtgaaacagccagcagcggctacgcctctgtgcagggcacagatgagccccccctggaggagcacgtgcagagcaccaatgaaagcctgcagctggtgaaccacgaggccaacagcgtggccgtggatgtgatcccccacgtggacaaccccacctttgaagaagatgagacccccaaccaggagacagctgtgcgggagatcaagagctag

SEQ ID NO: 168431 - DNA, 750 bp, Artificial Sequence
  Description of Artificial Sequence: Synthetic coding sequence
atgtctgcctacgtgacagtgacctactacaatgagaccagcaactacacagccatcgagacctgtgaatgtggggtgtatggcctggccagccctgtggccaatgccatgggcgtggtgggcatccccaagaacaacaactaccaggcctgtgaccacaacacagagttcagcaacaccaagaagccctggatcgccctgattgaaagaggcaactgcaccttcagcgagaagatccagacagctggaagaagaaatgctgatgctgtggtgatctacaatgcccctgagaccggcaaccagaccatccagatggccaactttggagctgtggacatcgtggccatcatgattggcaacctgaagggcaccaagatcctgcagagcatccagaggggcatccaggtgaccatggtgattgaggtgggcaagaagcacggcccctgggtgaaccactacagcatcttctttgtgtctgtgtccttcttcatcatcacagctgccaccgtgggctacttcatcttctacagcgcccggcggctgagaaatgcccgggcccagagcaggaagcagaggcagctgaaggcagatgccaagaaggccatcggccgcctgcagctgcggaccctgaagcagggcgacaaggagattggaccagatggagacagctgtgctgtgtgcatcgagctgtacaagcccaatgacctggtgcgcatcctgacctgcaaccacatcttccacaagacctag

SEQ ID NO: 168432 - DNA, 633 bp, Artificial Sequence
  Description of Artificial Sequence: Synthetic coding sequence
atggccggcctgggcctgggcagcgctgtgcctgtgtggctggccgaggatgacctgggctgcatcatctgccagggcctgctggactggccagccaccctgccctgtggccacagcttctgccgccactgcctggaggccctgtggggcgccagagatgcccggcgctgggcctgccccacctgccggcagggcgccgcccagcagccccacctgaggaagaacaccctgctgcaggacctggccgacaagtaccgccgggccgcccgggagatccaggccggcagtgaccctgcccactgcccctgccccggcagcagcagcctgagcagcgctgctgcccggccccggcggcggcctgagctgcagagggtggccgtggagaagagcatcacagaggtggcccaggagctgacagagctggtggagcacctggtggacatcgtgcgcagcctgcagaaccagaggcccctgtctgagagcggccctgacaatgagctgagcatcctgggcaaggaaaattcctggaagccccggctgccccctcatgcccactgcctgacccgggccaccctgcacagcggggagctgctgggcctgctgagcggccccagcatccagcccctgacctag

SEQ ID NO: 168433 - DNA, 1299 bp, Artificial Sequence
  Description of Artificial Sequence: Synthetic coding sequence
atggccggcctgggcctgggcagcgctgtgcctgtgtggctggccgaggatgacctgggctgcatcatctgccagggcctgctggactggccagccaccctgccctgtggccacagcttctgccgccactgcctggaggccctgtggggcgccagagatgcccggcgctgggcctgccccacctgccggcagggcgccgcccagcagccccacctgaggaagaacaccctgctgcaggacctggccgacaagtaccgccgggccgcccgggagatccaggccggcagtgaccctgcccactgcccctgccccggcagcagcagcctgagcagcgctgctgcccggccccggcggcggcctgagctgcagagggtggccgtggagaagagcatcacagaggtggcccaggagctgacagagctggtggagcacctggtggacatcgtgcgcagcctgcagaaccagaggcccctgtctgagagcggccctgacaatgagctgagcatcctgggcaaggccttcagcagcggcgtggacctgtccatggccagccccaagctggtgaccagtgacacagctgctgggaagatccgggacatcctgcatgacctggaggagatccaggagaagctgcaggagagcgtgacctggaaggaggcccctgaggcccagatgcagggcgagctgctggaggcccccagcagcagcagctgccccctgcctgaccagagccacccagccctgcggcgggccagcagatttgcccagtgggccatccaccccaccttcaacctgaagagcctgagctgcagcctggaggtgtccaaggacagcaggacagtgacagtgagccaccggccccagccctaccgctggagctgtgagcgcttcagcaccagccaggtgctgtgcagccaggccctgagcagcggcaagcactactgggaggtggacaccaggaactgcagccactgggccgtgggcgtggcctcctgggagatgagccgggaccaggtgctgggccgcaccatggacagctgctgcgtggagtggaagggcaccagccagctgagcgcctggcacatggtgaaggagaccgtgctgggcagtgacaggcctggggtggtgggcatctggctgaacctggaggagggcaagctggccttctacagcgtggacaaccaggagaagctgctgtatgaatgtaccatcagcgccagcagccccctgtacccagccttctggctgtatggcctgcaccctggcaactacctgatcatcaagcaggtgaaggtgtag

SEQ ID NO: 168434 - DNA, 255 bp, Artificial Sequence
  Description of Artificial Sequence: Synthetic coding sequence
tgaaaggaggcccctgaggcccagatgcagggcagcctgctgccccggctggagtgcagcggcaccatcacagctgccagcatcagccaggcccaggagaacagctggaagccccggctgccccctcatgcccactgcctgacccgggccaccctgcacagcggggagctgctgggcctgctgtctgtgcccccaagaggagagctgattgccaaggccaagcaggtggagaccctggacccccgggccctgtag

SEQ ID NO: 168435 - DNA, 291 bp, Artificial Sequence
  Description of Artificial Sequence: Synthetic coding sequence
gcccagcagccccacctgaggaagaacaccctgctgcaggacctggccgacaagtaccgccgggccgcccgggagatccaggccggcagtgaccctgcccactgcccctgccccggcagcagcagcctgagcagcgctgctgcccggccccggcggcggcctgagctgcagagagaaaattcctggaagccccggctgccccctcatgcccactgcctgacccgggccaccctgcacagcggggagctgctgggcctgctgagcggccccagcatccagcccctgacctag

SEQ ID NO: 168436 - DNA, 861 bp, Artificial Sequence
  Description of Artificial Sequence: Synthetic coding sequence
atggccggcctgggcctgggcagcgctgtgcctgtgtggctggccgaggatgacctgggctgcatcatctgccagggcctgctggactggccagccaccctgccctgtggccacagcttctgccgccactgcctggaggccctgtggggcgccagagatgcccggcgctgggcctgccccacctgccggcagggcgccgcccagcagccccacctgaggaagaacaccctgctgcaggacctggccgacaagtaccgccgggccgcccgggagatccaggccggcagtgaccctgcccactgcccctgccccggcagcagcagcctgagcagcgctgctgcccggccccggcggcggcctgagctgcagagggtggccgtggagaagagcatcacagaggtggcccaggagctgacagagctggtggagcacctggtggacatcgtgcgcagcctgcagaaccagaggcccctgtctgagagcggccctgacaatgagctgagcatcctgggcaaggccttcagcagcggcgtggacctgtccatggccagccccaagctggtgaccagtgacacagctgctgggaagatccgggacatcctgcatgacctggaggagatccaggagaagctgcaggagagcgtgacctggaaggaggcccctgaggcccagatgcagggcagcctgctgccccggctggagtgcagcggcaccatcacagctgccagcatcagccaggcccaggagaacagctggaagccccggctgccccctcatgcccactgcctgacccgggccaccctgcacagcggggagctgctgggcctgctgagcggccccagcatccagcccctgacctag

SEQ ID NO: 168437 - DNA, 756 bp, Artificial Sequence
  Description of Artificial Sequence: Synthetic coding sequence
atggccagccccaagctggtgaccagtgacacagctgctgggaagatccgggacatcctgcatgacctggaggagatccaggagaagctgcaggagagcgtgacctggaaggaggcccctgaggcccagatgcagggcgagctgctggaggcccccagcagcagcagctgccccctgcctgaccagagccacccagccctgcggcgggccagcagatttgcccagtgggccatccaccccaccttcaacctgaagagcctgagctgcagcctggaggtgtccaaggacagcaggacagtgacagtgagccaccggccccagccctaccgctggagctgtgagcgcttcagcaccagccaggtgctgtgcagccaggccctgagcagcggcaagcactactgggaggtggacaccaggaactgcagccactgggccgtgggcgtggcctcctgggagatgagccgggaccaggtgctgggccgcaccatggacagctgctgcgtggagtggaagggcaccagccagctgagcgcctggcacatggtgaaggagaccgtgctgggcagtgacaggcctggggtggtgggcatctggctgaacctggaggagggcaagctggccttctacagcgtggacaaccaggagaagctgctgtatgagtgcaccatcagcgccagcagccccctgtacccagccttctggctgtatggcctgcaccctggcaactacctgatcatcaagcaggtgaaggtgtag

SEQ ID NO: 168438 - DNA, 1995 bp, Artificial Sequence
  Description of Artificial Sequence: Synthetic coding sequence
atggctgctgtgggccccccccagcagcaggtgaggatggcccaccagcaggtgtgggccgccctggaggtggccctgcgggtgccctgcctgtacatcattgatgccatcttcaacagctacccagacagcagccagagccgcttctgcatcgtgctgcagatcttcctgcggctgtttggagtgtttgccagcagcatcgtgctgatcctgagccagaggagcctcttcaagttctacacctacagcagcgccttcctgctggccgccacctctgtgctggtgaactactatgccagcctgcacatcgacttctacggggcctacaacaccagcgccttcggcatcgagctgctgcccaggaagggccccagcctgtggatggccctgattgtgctgcagctgacctttggaattggctacgtgaccctgctgcagatccacagcatctacagccagctgatcatcctggacctgctggtgcctgtgattggcctcatcacagagctgcccctgcacatccgggagaccctgctcttcaccagcagcctcatcctgaccctgaacacagtgtttgtgctggccgtgaagctgaagtggttctactacagcaccaggtatgtgtacctgctggtgcgccacatgtaccgcatctacggcctgcagctgctgatggaggacacctggaagaggatccgcttcccagacatcctgcgggtcttctggctgaccagggtgacagcccaggccaccgtgctgatgtacatcctgaggatggccaatgaaacagacagcttcttcatctcctgggatgacttctgggacctgatctgcaacctgatcatcagcggctgtgacagcaccctgactgtgctgggcatgtctgctgtgatcagctctgtggcccactacctgggcctgggcatcctggccttcatcggcagcacagaggaggatgaccggcggctgggctttgtggcccctgtgctcttcttcatcctggccctgcagacaggcctgagcggcctgcggcctgaggagcggctcatccggctgagcaggaacatgtgcctgctgctgacagctgtgctgcacttcatccacggcatgacagatcctgtgctgatgagcctgagcgccagccacgtgtcctccttcagaagacacttccctgtgctgtttgtgtctgcctgcctcttcatcctgcctgtgctgctgtcctatgtgctgtggcaccactacgccctgaacacctggctgtttgctgtgacagccttctgtgtggagctgtgcctgaaggtgattgtgtccctgactgtgtacaccctcttcatgattgatggctactacaacgtgctgtgggagaagctggatgattatgtgtactacgtgcgcagcacaggcagcatcatcgagttcatctttggagtggtgatgtttggaaatggagcctacaccatgatgtttgaaagtggcagcaagatccgggccttcatgatgtgcctgcacgcctacttcaacatctacctgcaggccaagaatggctggaagaccttcatgaacagaagaacagctgtgaagaagatcaacagcctgcctgagatcaagggcagccggctgcaggagatcaatgatgtgtgtgccatctgctaccacgagttcaccaccagcgcccgcatcaccccctgcaaccactacttccacgccctgtgcctgaggaagtggctgtacatccaggacacctgccccatgtgccaccagaaggtgtacattgaagatgacatcaaggacaacagcaatgtgagcaacaacaacggcttcatccccccaaatgagaccccagaggaggccgtgcgggaggccgctgctgagagtgaccgggagctgaatgaagatgacagcacagactgtgatgatgatgtgcagcgggagagaaatggagtcatccagcacactggagctgctgctgaggagttcaatgatgacacagactag

SEQ ID NO: 168439 - DNA, 1425 bp, Artificial Sequence
  Description of Artificial Sequence: Synthetic coding sequence
atgagcagcgaggaccgggaggcccaggaggatgagctgctggccctggccagcatctatgatggagatgagttcaggaaggccgagagcgtgcagggcggggagacccgcatctacctggacctgccccagaacttcaagatctttgtgtctggcaacagcaatgaatgtctgcagaacagcggctttgagtacaccatctgcttcctgccccccctggtgctgaactttgagctgcccccagactaccccagcagcagcccccccagcttcaccctgagcggcaagtggctgagccccacccagctgagcgccctgtgcaagcacctggacaacctgtgggaggagcaccggggctctgtggtgctgtttgcctggatgcagttcctgaaggaggagaccctggcctacctgaacatcgtgagcccctttgagctgaagattggcagccagaagaaggtgcagaggagaacagcccaggccagccccaacacagagctggactttggaggagctgctggcagtgatgtggaccaggaggagatcgtggatgaaagagctgtgcaggatgtggagagcctgagcaacctgatccaggagatcctggactttgaccaggcccagcagatcaagtgcttcaacagcaagctgttcctgtgcagcatctgcttctgtgagaagctgggcagcgagtgcatgtacttcctggagtgccgccacgtgtactgcaaggcctgcctgaaggactactttgagatccagatcagagatggccaggtgcagtgcctgaactgcccagagcccaagtgccccagcgtggccaccccaggccaggtgaaggagctggtggaggccgagctgtttgcccgctatgaccggctgctgctgcagagcagcctggacctgatggctgatgtggtgtactgcccccggccctgctgccagctgcctgtgatgcaggagcccggctgcaccatgggcatctgcagcagctgcaactttgccttctgcaccctgtgccgcctgacctaccatggagtgagcccctgcaaggtgacagctgagaagctgatggacctgagaaatgagtacctgcaggctgatgaggccaacaagaggctgctggaccagagatatggcaagagggtcatccagaaggccctggaggagatggagagcaaggagtggctggagaagaacagcaagagctgcccctgctgcggcacccccatcgagaagctggatggctgcaacaagatgacctgcaccggctgcatgcagtacttctgctggatctgcatgggcagcctgagccgggccaacccctacaagcacttcaatgaccccggcagcccctgcttcaacagactcttctatgctgtggatgtggatgatgacatctgggaggatgaggtggaggactag

SEQ ID NO: 168440 - DNA, 1425 bp, Artificial Sequence; identical to SEQ ID NO: 168439
  Description of Artificial Sequence: Synthetic coding sequence

SEQ ID NO: 168441 - DNA, 1047 bp, Artificial Sequence
  Description of Artificial Sequence: Synthetic coding sequence
atgcagttcctgaaggaggagaccctggcctacctgaacatcgtgagcccctttgagctgaagattggcagccagaagaaggtgcagaggagaacagcccaggccagccccaacacagagctggactttggaggagctgctggcagtgatgtggaccaggaggagatcgtggatgaaagagctgtgcaggatgtggagagcctgagcaacctgatccaggagatcctggactttgaccaggcccagcagatcaagtgcttcaacagcaagctgttcctgtgcagcatctgcttctgtgagaagctgggcagcgagtgcatgtacttcctggagtgccgccacgtgtactgcaaggcctgcctgaaggactactttgagatccagatcagagatggccaggtgcagtgcctgaactgcccagagcccaagtgccccagcgtggccaccccaggccaggtgaaggagctggtggaggccgagctgtttgcccgctatgaccggctgctgctgcagagcagcctggacctgatggctgatgtggtgtactgcccccggccctgctgccagctgcctgtgatgcaggagcccggctgcaccatgggcatctgcagcagctgcaactttgccttctgcaccctgtgccgcctgacctaccatggagtgagcccctgcaaggtgacagctgagaagctgatggacctgagaaatgagtacctgcaggctgatgaggccaacaagaggctgctggaccagagatatggcaagagggtcatccagaaggccctggaggagatggagagcaaggagtggctggagaagaacagcaagagctgcccctgctgcggcacccccatcgagaagctggatggctgcaacaagatgacctgcaccggctgcatgcagtacttctgctggatctgcatgggcagcctgagccgggccaacccctacaagcacttcaatgaccccggcagcccctgcttcaacagactcttctatgctgtggatgtggatgatgacatctgggaggatgaggtggaggactag

SEQ ID NO: 168442 - DNA, 897 bp, Artificial Sequence
  Description of Artificial Sequence: Synthetic coding sequence
atgagcagcgaggaccgggaggcccaggaggatgagctgctggccctggccagcatctatgatggagatgagttcaggaaggccgagagcgtgcagggcggggagacccgcatctacctggacctgccccagaacttcaagatctttgtgtctggcaacagcaatgaatgtctgcagaacagcggctttgagtacaccatctgcttcctgccccccctggtgctgaactttgagctgcccccagactaccccagcagcagcccccccagcttcaccctgagcggcaagtggctgagccccacccaggtgaaggagctggtggaggccgagctgtttgcccgctatgaccggctgctgctgcagagcagcctggacctgatggctgatgtggtgtactgcccccggccctgctgccagctgcctgtgatgcaggagcccggctgcaccatgggcatctgcagcagctgcaactttgccttctgcaccctgtgccgcctgacctaccatggagtgagcccctgcaaggtgacagctgagaagctgatggacctgagaaatgagtacctgcaggctgatgaggccaacaagaggctgctggaccagagatatggcaagagggtcatccagaaggccctggaggagatggagagcaaggagtggctggagaagaacagcaagagctgcccctgctgcggcacccccatcgagaagctggatggctgcaacaagatgacctgcaccggctgcatgcagtacttctgctggatctgcatgggcagcctgagccgggccaacccctacaagcacttcaatgaccccggcagcccctgcttcaacagactcttctatgctgtggatgtggatgatgacatctgggaggatgaggtggaggactag

SEQ ID NO: 168443 - DNA, 1425 bp, Artificial Sequence; identical to SEQ ID NO: 168439
  Description of Artificial Sequence: Synthetic coding sequence

SEQ ID NO: 168444 - DNA, 1425 bp, Artificial Sequence; identical to SEQ ID NO: 168439
  Description of Artificial Sequence: Synthetic coding sequence

SEQ ID NO: 168445 - DNA, 48 bp, Artificial Sequence
  Description of Artificial Sequence: Synthetic coding sequence
atgagcagcgaggaccgggaggcccaggaggatgagctgctggcctag

SEQ ID NO: 168446 - DNA, 399 bp, Artificial Sequence
  Description of Artificial Sequence: Synthetic coding sequence
atgagcagcgaggaccgggaggcccaggaggatgagctgctggccctggccagcatctatgatggagatgagttcaggaaggccgagagcgtgcagggcggggagacccgcatctacctggacctgccccagaacttcaagatctttgtgtctggcaacagcaatgaatgtctgcagaacagcggctttgagtacaccatctgcttcctgccccccctggtgctgaactttgagctgcccccagactaccccagcagcagcccccccagcttcaccctgagcggcaagtggctgagccccacccagctgagcgccctgtgcaagcacctggacaacctgtgggaggagcaccggggctctgtggtgctgtttgcctggatgcagttcctgaaggagtag

SEQ ID NO: 168447 - DNA, 516 bp, Artificial Sequence
  Description of Artificial Sequence: Synthetic coding sequence
atgagcagcgaggaccgggaggcccaggaggatgagctgctggccctggccagcatctatgatggagatgagttcaggaaggccgagagcgtgcagggcggggagacccgcatctacctggacctgccccagaacttcaagatctttgtgtctggcaacagcaatgaatgtctgcagaacagcggctttgagtacaccatctgcttcctgccccccctggtgctgaactttgagctgcccccagactaccccagcagcagcccccccagcttcaccctgagcggcaagtggctgagccccacccagctgagcgccctgtgcaagcacctggacaacctgtgggaggagcaccggggctctgtggtgctgtttgcctggatgcagttcctgaaggaggagaccctggcctacctgaacatcgtgagcccctttgagctgaagattggcagccagaagaaggtgcagaggagaacagcccaggccagccccaacacagagctggactttggaggatag

SEQ ID NO: 168448 - DNA, 558 bp, Artificial Sequence
  Description of Artificial Sequence: Synthetic coding sequence
atgagcagcgaggaccgggaggcccaggaggatgagctgctggccctggccagcatctatgatggagatgagttcaggaaggccgagagcgtgcagggcggggagacccgcatctacctggacctgccccagaacttcaagatctttgtgtctggcaacagcaatgaatgtctgcagaacagcggctttgagtacaccatctgcttcctgccccccctggtgctgaactttgagctgcccccagactaccccagcagcagcccccccagcttcaccctgagcggcaagtggctgagccccacccagctgagcgccctgtgcaagcacctggacaacctgtgggaggagcaccggggctctgtggtgctgtttgcctggatgcagttcctgaaggaggagaccctggcctacctgaacatcgtgagcccctttgagctgaagattggcagccagaagaaggtgcagaggagaacagcccaggccagccccaacacagagctggactttggaggagctgctggcagtgatgtggaccaggaggagatcgtggatgaatag

SEQ ID NO: 168449 - DNA, 186 bp, Artificial Sequence
  Description of Artificial Sequence: Synthetic coding sequence
atgagcagcgaggaccgggaggcccaggaggatgagctgctggccctggccagcatctatgatggagatgagttcaggaaggccgagagcgtgcagggcggggagacccgcatctacctggacctgccccagaacttcaagatctttgtgtctggcaacagcaatgaatgtctgcagaacagctag

SEQ ID NO: 168450 - DNA, 837 bp, Artificial Sequence
  Description of Artificial Sequence: Synthetic coding sequence
atgagcagcgaggaccgggaggcccaggaggatgagctgctggccctggccagcatctatgatggagatgagttcaggaaggccgagagcgtgcagggcggggagacccgcatctacctggacctgccccagaacttcaagatctttgtgtctggcaacagcaatgaatgtctgcagaacagcggctttgagtacaccatctgcttcctgccccccctggtgctgaactttgagctgcccccagactaccccagcagcagcccccccagcttcaccctgagcggcaagtggctgagccccacccagctgagcgccctgtgcaagcacctggacaacctgtgggaggagcaccggggctctgtggtgctgtttgcctggatgcagttcctgaaggaggagaccctggcctacctgaacatcgtgagcccctttgagctgaagattggcagccagaagaaggtgcagaggagaacagcccaggccagccccaacacagagctggactttggaggagctgctggcagtgatgtggaccaggaggagatcgtggatgaaagagctgtgcaggatgtggagagcctgagcaacctgatccaggagatcctggactttgaccaggcccagcagatcaagtgcttcaacagcaagctgttcctgtgcagcatctgcttctgtgagaagctgggcagcgagtgcatgtacttcctggagtgccgccacgtgtactgcaaggcctgcctgaaggactactttgagatccagatcagagatggccaggtgcagtgcctgaactgcccagagcccaagtgccccagcgtggccaccccaggccagtag

SEQ ID NO: 168451 - DNA, 300 bp, Artificial Sequence
  Description of Artificial Sequence: Synthetic coding sequence
atgagcagcgaggaccgggaggcccaggaggatgagctgctggccctggccagcatctatgatggagatgagttcaggaaggccgagagcgtgcagggcggggagacccgcatctacctggacctgccccagaacttcaagatctttgtgtctggcaacagcaatgaatgtctgcagaacagcggctttgagtacaccatctgcttcctgccccccctggtgctgaactttgagctgcccccagactaccccagcagcagcccccccagcttcaccctgagcggcaagtggctgtcctag

SEQ ID NO: 168452 - DNA, 516 bp, Artificial Sequence
  Description of Artificial Sequence: Synthetic coding sequence
atgagcagcgaggaccgggaggcccaggaggatgagctgctggccctggccagcatctatgatggagatgagttcaggaaggccgagagcgtgcagggcggggagacccgcatctacctggacctgccccagaacttcaagatctttgtgtctgagaagctgatggacctgagaaatgagtacctgcaggctgatgaggccaacaagaggctgctggaccagagatatggcaagagggtcatccagaaggccctggaggagatggagagcaaggagtggctggagaagaacagcaagagctgcccctgctgcggcacccccatcgagaagctggatggctgcaacaagatgacctgcaccggctgcatgcagtacttctgctggatctgcatgggcagcctgagccgggccaacccctacaagcacttcaatgaccccggcagcccctgcttcaacagactcttctatgctgtggatgtggatgatgacatctgggaggatgaggtggaggactag

SEQ ID NO: 168453 - DNA, 1077 bp, Artificial Sequence
  Description of Artificial Sequence: Synthetic coding sequence
atggccggctgtggggagattgaccacagcatcaacatgctgcccaccaacaggaaggccaatgaaagctgcagcaacacagcccccagcctgactgtgcctgaatgtgccatctgcctgcagacctgtgtgcaccctgtgtccctgccctgcaagcacgtgttctgctacctgtgtgtgaagggggcctcctggctgggcaagagatgtgccctgtgccggcaggagatccctgaggacttcctggacaagcccaccctgctgagccctgaggagctgaaggccgccagcagaggaaatggagaatatgcctggtactatgagggcagaaatggctggtggcagtatgatgagaggaccagccgggagctggaggatgccttcagcaagggcaagaagaacacagagatgctgattgctggcttcctgtatgtggccgacctggagaacatggtgcagtacagaagaaatgaacatggaagaagaaggaagatcaagagggacatcatcgacatccccaagaagggcgtggccggcctgcggctggactgtgatgccaacacagtgaacctggcccgggagagcagcgcagatggagctgacagcgtgtctgcccagagcggggcctctgtgcagcccctggtgtcctctgtgcggcccctgacctctgtggatggccagctgaccagccctgccacccccagcccagatgccagcaccagcctggaggacagctttgcccacctgcagctgagcggggacaacacagctgagaggagccacagaggagagggggaggaggaccacgagagccccagcagcggccgggtgcctgccccagacaccagcattgaggagacagaaagtgatgccagcagtgacagtgaagatgtgtctgctgtggtggcccagcacagcctgacccagcagaggctgctggtgtccaatgccaaccagacagtgcctgacagaagtgacaggagcggcacagacagatctgtggccggcggcggcaccgtgtctgtgtctgtgcgcagcagaagaccagatggccagtgcaccgtgacagaggtgtag

SEQ ID NO: 168454 - DNA, 1077 bp, Artificial Sequence; identical to SEQ ID NO: 168453
  Description of Artificial Sequence: Synthetic coding sequence

SEQ ID NO: 168455 - DNA, 1080 bp, Artificial Sequence
  Description of Artificial Sequence: Synthetic coding sequence
atgatggccggctgtggggagattgaccacagcatcaacatgctgcccaccaacaggaaggccaatgaaagctgcagcaacacagcccccagcctgactgtgcctgaatgtgccatctgcctgcagacctgtgtgcaccctgtgtccctgccctgcaagcacgtgttctgctacctgtgtgtgaagggggcctcctggctgggcaagagatgtgccctgtgccggcaggagatccctgaggacttcctggacaagcccaccctgctgagccctgaggagctgaaggccgccagcagaggaaatggagaatatgcctggtactatgagggcagaaatggctggtggcagtatgatgagaggaccagccgggagctggaggatgccttcagcaagggcaagaagaacacagagatgctgattgctggcttcctgtatgtggccgacctggagaacatggtgcagtacagaagaaatgagcacggcagaagaaggaagatcaagagggacatcatcgacatccccaagaagggcgtggccggcctgcggctggactgtgatgccaacacagtgaacctggcccgggagagcagcgcagatggagctgacagcgtgtctgcccagagcggggcctctgtgcagcccctggtgtcctctgtgcggcccctgacctctgtggatggccagctgaccagccctgccacccccagcccagatgccagcaccagcctggaggacagctttgcccacctgcagctgagcggggacaacacagctgagaggagccacagaggagagggggaggaggaccacgagagccccagcagcggccgggtgcctgccccagacaccagcattgaggagacagaaagtgatgccagcagtgacagtgaagatgtgtctgctgtggtggcccagcacagcctgacccagcagaggctgctggtgtccaatgccaaccagacagtgcctgacagaagtgacagaagtggcacagacagatctgtggccggcggcggcaccgtgtctgtgtctgtgcgcagccggcggccagatggccagtgcaccgtgacagaggtgtag

SEQ ID NO: 168456 - DNA, 1716 bp, Artificial Sequence
  Description of Artificial Sequence: Synthetic coding sequence
atggccctgcccaaggatgccatccccagcctgtctgagtgccagtgtggcatctgcatggagatcctggtggagcctgtgaccctgccctgcaaccacaccctgtgcaagccctgcttccagagcacagtggagaaggccagcctgtgctgccccttctgcagaagaagagtgtcctcctggacccgctaccacaccaggaggaacagcctggtgaatgtggagctgtggaccatcatccagaagcactacccccgggagtgcaagctgcgggccagcggccaggagagcgaggaggtggctgatgactaccagcctgtgcggctgctgagcaagccaggagagctgcggcgggagtatgaggaggagatcagcaaggtggccgctgagcggcgggccagcgaggaggaggagaacaaggccagcgaggagtacatccagaggctgctggccgaggaggaggaggaggagaagaggcaggccgagaagagaagaagagccatggaggagcagctgaagagtgatgaggagctggccaggaagctgagcattgacatcaacaacttctgtgagggcagcatcagcgccagccccctgaacagcaggaagagtgaccctgtgacccccaagtctgagaagaagagcaagaacaagcagaggaacacaggagacatccagaagtacctgacccccaagagccagtttggaagtgccagccacagcgaggccgtgcaggaggtgaggaaggacagcgtgtccaaggacatcgacagcagtgacaggaagagccccaccggccaggacacagaaattgaggacatgcccaccctgagcccccagatcagcctgggcgtgggggagcagggcgctgacagcagcattgagagccccatgccctggctgtgtgcctgtggggctgagtggtaccacgagggcaatgtgaagacccggcccagcaaccacggcaaggagctgtgtgtgctgagccatgagcggcccaagaccagggtgccctacagcaaggagacagctgtgatgccctgtggccgcacagaaagtggctgtgcccccaccagcggcgtgacccagaccaatggaaacaacacaggagaaacagaaaatgaggagagctgcctgctgatcagcaaggagatcagcaagaggaagaaccaggagagcagctttgaagctgtgaaggacccctgcttcagcgccaagaggaggaaggtgtccccagagagcagcccagaccaggaggagacagagatcaacttcacccagaagctgattgacctggagcacctgctgtttgagcggcacaagcaggaggagcaggaccggctgctggccctgcagctgcagaaggaggtggacaaggagcagatggtgcccaaccggcagaagggcagcccagatgagtaccacctgcgggccaccagcagccccccagacaaggtgctgaatggccagaggaagaaccccaaggatggcaacttcaagaggcagacccacaccaagcaccccaccccagagcggggcagccgggacaagaaccggcaggtgtccctgaagatgcagctgaagcagagcgtgaacagaaggaagatgcccaacagcacccgggaccactgcaaggtgtccaagagcgcccacagcctgcagcccagcatcagccagaagtctgtgttccagatgttccagcgctgcaccaagtag

SEQ ID NO: 168457 - DNA, 1716 bp, Artificial Sequence; identical to SEQ ID NO: 168456
  Description of Artificial Sequence: Synthetic coding sequence

SEQ ID NO: 168458 - DNA, 4872 bp, Artificial Sequence
  Description of Artificial Sequence: Synthetic coding sequence
atggctgctgaggccagcaagacaggccccagccgcagcagctaccagaggatgggcaggaagagccagccctggggcgctgctgagatccagtgcacccgctgtggcagaagagtgagccgcagcagcggccaccactgtgagctgcagtgtggccacgccttctgtgagctgtgcctgctgatgacagaagaatgtaccaccatcatctgcccagactgtgaggtggccacagctgtgaacacccggcagcgctactaccccatggccggctacatcaaggaggacagcatcatggagaagctgcagcccaagaccatcaagaactgcagccaggacttcaagaagacagctgaccagctgaccaccggcctggagaggtctgccagcacagacaagaccctgctgaacagcagcgctgtgatgctggacaccaacacagctgaggagattgatgaggccctgaacacagcccaccacagctttgagcagctgagcattgctgggaaggccctggagcacatgcagaagcagaccatcgaggagcgggagcgggtgattgaggtggtggagaagcagtttgaccagctgctggccttctttgacagcaggaagaagaacctgtgtgaggagtttgcccggaccacagatgactacctgagcaacctgatcaaggccaagagctacatcgaggagaagaagaacaacctgaatgctgccatgaacatcgcccgggccctgcagctgagccccagcctgcggacctactgtgacctgaaccagatcatccgcaccctgcagctgaccagtgacagcgagctggcccaggtgagcagcccccagctgagaaatccaccccggctgtctgtgaactgcagcgagatcatctgcatgttcaacaacatgggcaagattgagttccgggacagcaccaagtgctacccccaggagaatgagatccggcagaatgtgcagaagaagtacaacaacaagaaggagctgagctgctatgacacctacccacccctggagaagaagaaggtggacatgtctgtgctgaccagcgaggcccctcctccacccctgcagcctgagaccaatgatgtgcacctggaggccaagaacttccagccccagaaggatgtggccacagccagccccaagaccatcgctgtgctgccccagatgggcagcagcccagatgtgatcatcgaggagatcattgaagataatgtggagagcagcgctgagctggtgtttgtgagccacgtgattgacccctgccacttctacatcaggaagtacagccagatcaaggatgccaaggtgctggagaagaaggtgaatgagttctgcaacagaagcagccacctggaccccagcgacatcctggagctgggcgcccgcatctttgtgagcagcatcaagaatggcatgtggtgccggggcaccatcacagagctgatccccatcgagggcaggaacaccaggaagccctgcagccccacccggctgtttgtgcatgaggtggccctgatccagatcttcatggtggactttggaaattctgaggtgctgattgtgactggagtggtggacacccacgtgcggcctgagcacagcgccaagcagcacatcgccctgaatgacctgtgcctggtgctgaggaagtctgagccctacacagagggcctgctgaaggacatccagcccctggcccagccctgcagcctgaaggacatcgtgccccagaacagcaatgaaggctgggaggaggaggccaaggtggagttcctgaagatggtgaacaacaaggctgtgtccatgaaggtgttccgggaggaggatggagtgctgattgtggacctgcagaagcccccacccaacaagatcagcagtgacatgcctgtgtccctgagagatgccctggtgttcatggagctggccaagttcaagagccagagcctgcggagccactttgagaagaacaccaccctgcactaccacccccccatcctgcccaaggagatgacagatgtgtctgtgacagtgtgccacatcaacagccctggggacttctacctgcagctgattgagggcctggacatcctcttcctgctgaagaccatcgaggagttctacaagtcagaagatggagagaacctggagatcctgtgccctgtgcaggaccaggcctgtgtggccaagtttgaagatggcatctggtaccgggccaaggtgattggcctgcccggccaccaggaggtggaggtgaagtatgtggactttggaaacacagccaagatcaccatcaaggatgtgaggaagatcaaggatgagttcctgaatgcccctgagaaggccatcaagtgcaagctggcctacatcgagccctacaagaggaccatgcagtggagcaaggaggccaaggagaagtttgaggagaaggcccaggacaagttcatgacctgcagcgtcatcaagatcctggaggacaacgtgctgctggtggagctgtttgacagcctgggcgcccctgagatgaccaccaccagcatcaatgaccagctggtgaaggagggcctggccagctatgaaattggctacatcctgaaggacaacagccagaagcacatcgaggtgtgggaccccagccctgaggagatcatcagcaatgaggtgcacaacctgaaccctgtgtctgccaagagcctgcccaatgaaaacttccagagcctgtacaacaaggagctgcctgtgcacatctgcaacgtcatcagccctgagaagatctacgtgcagtggctgctgacagagaacctgctgaacagcctggaggagaagatgattgctgcctatgagaacagcaagtgggagcctgtgaagtgggagaatgacatgcactgtgctgtgaagatccaggacaagaaccagtggaggcggggccagatcatccgcatggtgacagacaccctggtggaggtgctgctgtatgatgtgggcgtggagctggtggtgaatgtggactgcctgaggaagctggaggagaacctgaagaccatgggccgcctgagcctggagtgcagcctggtggacatccggcctgctgggggcagtgacaagtggacagccacagcctgtgactgcctgagcctgtacctgactggagctgtggccaccatcatcctgcaggtggacagcgaggagaacaacaccacctggcccctgcctgtgaagatcttctgcagagatgagaagggggagcgggtggatgtgtccaagtacctgatcaagaagggcctggccctgcgggagcggcgcatcaacaacctggacaacagccacagcctgtctgagaagagcctggaggtgcccctggagcaggaggacagcgtggtgaccaactgcatcaagaccaactttgatcctgacaagaagacagctgacatcatcagcgagcagaaggtgtctgagttccaggagaagatcctggagcccaggaccacccggggctacaagcccccagccatccccaacatgaatgtgtttgaggccaccgtgtcctgtgtgggagatgatggcaccatctttgtggtgcccaagctgtctgaatttgagctgatcaagatgaccaatgagatccagagcaacctgaagtgcctgggcctgctggagccctacttctggaagaagggggaggcctgtgctgtgcggggcagtgacaccctgtggtaccggggcaaggtgatggaggtggtgggcggcgctgtgcgggtgcagtacctggaccacggcttcacagagaagatcccccagtgccacctgtaccccatcctgctgtacccagacatcccccagttctgcatcccctgccagctgcacaacaccacccctgtgggcaatgtgtggcagccagatgccatcgaggtgctgcagcagctgctgagcaagaggcaggtggacatccacatcatggagctgcccaagaacccctgggagaagctgagcatccacctgtactttgatggcatgagcctgagctacttcatggcctactacaagtactgcaccagcgagcacacagaggagatgctgaaggagaagcccaggagtgaccatgacaagaagtatgaggaggagcagtgggagatccgctttgaggagctgctgtctgctgagacagacacccccctgctgcccccctacctgagcagcagcctgcccagccctggagagctgtatgctgtgcaggtgaagcacgtggtgagccccaatgaggtgtacatctgcctggacagcattgagaccagcaaccagagcaaccagcacagcgacacagatgattctggagtgtctggagagagcgagagcgagagcctggatgaggccctgcagagggtgaacaagaaggtggaggccctgccccccctgacagacttcagaacagagatgccctgcctggccgagtatgatgatggcctgtggtaccgggccaagatcgtggccatcaaggagttcaaccccctgagcatcctggtgcagtttgtggactatggcagcacagccaagctgaccctgaaccggctgtgccagatccccagccacctgatgagatacccagcccgggccatcaaggtgctgctggccggcttcaagccacccctgcgggacctgggggagacccgcatcccctactgccccaagtggagcatggaggccctgtgggccatgattgactgcctgcagggcaagcagctgtatgctgtgtccatggccccagcccctgagcagatcgtgaccctgtatgatgatgagcagcaccctgtgcacatgcccctggtggagatgggcctggccgacaaggatgaatag

SEQ ID NO: 168459 - DNA, 1350 bp, Artificial Sequence
  Description of Artificial Sequence: Synthetic coding sequence
atggctgctgaggccagcaagacaggccccagccgcagcagctaccagaggatgggcaggaagagccagccctggggcgctgctgagatccagtgcacccgctgtggcagaagagtgagccgcagcagcggccaccactgtgagctgcagtgtggccacgccttctgtgagctgtgcctgctgatgacagaagaatgtaccaccatcatctgcccagactgtgaggtggccacagctgtgaacacccggcagcgctactaccccatggccggctacatcaaggaggacagcatcatggagaagctgcagcccaagaccatcaagaactgcagccaggacttcaagaagacagctgaccagctgaccaccggcctggagaggtctgccagcacagacaagaccctgctgaacagcagcgctgtgatgctggacaccaacacagctgaggagattgatgaggccctgaacacagcccaccacagctttgagcagctgagcattgctgggaaggccctggagcacatgcagaagcagaccatcgaggagcgggagcgggtgattgaggtggtggagaagcagtttgaccagctgctggccttctttgacagcaggaagaagaacctgtgtgaggagtttgcccggaccacagatgactacctgagcaacctgatcaaggccaagagctacatcgaggagaagaagaacaacctgaatgctgccatgaacatcgcccgggccctgcagctgagccccagcctgcggacctactgtgacctgaaccagatcatccgcaccctgcagctgaccagtgacagcgagctggcccaggtgagcagcccccagctgagaaatccaccccggctgtctgtgaactgcagcgagatcatctgcatgttcaacaacatgggcaagattgagttccgggacagcaccaagtgctacccccaggagaatgagatccggcagaatgtgcagaagaagtacaacaacaagaaggagctgagctgctatgacacctacccacccctggagaagaagaaggtggacatgtctgtgctgaccagcgaggcccctcctccacccctgcagcctgagaccaatgatgtgcacctggaggccaagaacttccagccccagaaggatgtggccacagccagccccaagaccatcgctgtgctgccccagatgggcagcagcccagatgtgatcatcgaggagatcattgaagataatgtggagacctgtggcacagatgacctgggggagaccccccgctaccccaagaagcccctgcagaagaacagctctgtgcccttcggcagcaaggctgacacagtgaccaccgtgtag

SEQ ID NO: 168460 - DNA, 4746 bp, Artificial Sequence
  Description of Artificial Sequence: Synthetic coding sequence
atggctgctgaggccagcaagacaggccccagccgcagcagctaccagaggatgggcaggaagagccagccctggggcgctgctgagatccagtgcacccgctgtggcagaagagtgagccgcagcagcggccaccactgtgagctgcagtgtggccacgccttctgtgagctgtgcctgctgatgacagaagaatgtaccaccatcatctgcccagactgtgaggtggccacagctgtgaacacccggcagcgctactaccccatggccggctacatcaaggaggacagcatcatggagaagctgcagcccaagaccatcaagaactgcagccaggacttcaagaagacagctgaccagctgaccaccggcctggagaggtctgccagcacagacaagaccctgctgaacagcagcgctgtgatgctggacaccaacacagctgaggagattgatgaggccctgaacacagcccaccacagctttgagcagctgagcattgctgggaaggccctggagcacatgcagaagcagaccatcgaggagcgggagcgggtgattgaggtggtggagaagcagtttgaccagctgctggccttctttgacagcaggaagaagaacctgtgtgaggagtttgcccggaccacagatgactacctgagcaacctgatcaaggccaagagctacatcgaggagaagaagaacaacctgaatgctgccatgaacatcgcccgggccctgcagctgagccccagcctgcggacctactgtgacctgaaccagatcatccgcaccctgcagctgaccagtgacagcgagctggcccaggtgagcagcccccagctgagaaatccaccccggctgtctgtgaactgcagcgagatcatctgcatgttcaacaacatgggcaagattgagttccgggacagcaccaagtgctacccccaggagaatgagatccggcagaatgtgcagaagaagtacaacaacaagaaggagctgagctgctatgacacctacccacccctggagaagaagaaggtggacatgtctgtgctgaccagcgaggcccctcctccacccctgcagcctgagaccaatgatgtgcacctggaggccaagaacttccagccccagaaggatgtggccacagccagccccaagaccatcgctgtgctgccccagatgggcagcagcccagatgtgatcatcgaggagatcattgaagataatgtggagagcagcgctgagctggtgtttgtgagccacgtgattgacccctgccacttctacatcaggaagtacagccagatcaaggatgccaaggtgctggagaagaaggtgaatgagttctgcaacagaagcagccacctggaccccagcgacatcctggagctgggcgcccgcatctttgtgagcagcatcaagaatggcatgtggtgccggggcaccatcacagagctgatccccatcgagggcaggaacaccaggaagccctgcagccccacccggctgtttgtgcatgaggtggccctgatccagatcttcatggtggactttggaaattctgaggtgctgattgtgactggagtggtggacacccacgtgcggcctgagcacagcgccaagcagcacatcgccctgaatgacctgtgcctggtgctgaggaagtctgagccctacacagagggcctgctgaaggacatccagcccctggcccagccctgcagcctgaaggacatcgtgccccagaacagcaatgaaggctgggaggaggaggccaaggtggagttcctgaagatggtgaacaacaaggctgtgtccatgaaggtgttccgggaggaggatggagtgctgattgtggacctgcagaagcccccacccaacaagatcagcagtgacatgcctgtgtccctgagagatgccctggtgttcatggagctggccaagttcaagagccagagcctgcggagccactttgagaagaacaccaccctgcactaccacccccccatcctgcccaaggagatgacagatgtgtctgtgacagtgtgccacatcaacagccctggggacttctacctgcagctgattgagggcctggacatcctcttcctgctgaagaccatcgaggagttctacaagtcagaagatggagagaacctggagatcctgtgccctgtgcaggaccaggcctgtgtggccaagtttgaagatggcatctggtaccgggccaaggtgattggcctgcccggccaccaggaggtggaggtgaagtatgtggactttggaaacacagccaagatcaccatcaaggatgtgaggaagatcaaggatgagttcctgaatgcccctgagaaggccatcaagtgcaagctggcctacatcgagccctacaagaggaccatgcagtggagcaaggaggccaaggagaagtttgaggagaaggcccaggacaagttcatgacctgcagcgtcatcaagatcctggaggacaacgtgctgctggtggagctgtttgacagcctgggcgcccctgagatgaccaccaccagcatcaatgaccagctggtgaaggagggcctggccagctatgaaattggctacatcctgaaggacaacagccagaagcacatcgaggtgtgggaccccagccctgaggagatcatcagcaatgaggtgcacaacctgaaccctgtgtctgccaagagcctgcccaatgaaaacttccagagcctgtacaacaaggagctgcctgtgcacatctgcaacgtcatcagccctgagaagatctacgtgcagtggctgctgacagagaacctgctgaacagcctggaggagaagatgattgctgcctatgagaacagcaagtgggagcctgtgaagtgggagaatgacatgcactgtgctgtgaagatccaggacaagaaccagtggaggcggggccagatcatccgcatggtgacagacaccctggtggaggtgctgctgtatgatgtgggcgtggagctggtggtgaatgtggactgcctgaggaagctggaggagaacctgaagaccatgggccgcctgagcctggagtgcagcctggtggacatccggcctgctgggggcagtgacaagtggacagccacagcctgtgactgcctgagcctgtacctgactggagctgtggccaccatcatcctgcaggtggacagcgaggagaacaacaccacctggcccctgcctgtgaagatcttctgcagagatgagaagggggagcgggtggatgtgtccaagtacctgatcaagaagggcctggccctgcgggagcggcgcatcaacaacctggacaacagccacagcctgtctgagaagagcctggaggtgcccctggagcaggaggacagcgtggtgaccaactgcatcaagaccaactttgatcctgacaagaagacagctgacatcatcagcgagcagaaggtgtctgagttccaggagaagatcctggagcccaggaccacccggggctacaagcccccagccatccccaacatgaatgtgtttgaggccaccgtgtcctgtgtgggagatgatggcaccatctttgtggtgcccaagctgtctgaatttgagctgatcaagatgaccaatgagatccagagcaacctgaagtgcctgggcctgctggagccctacttctggaagaagggggaggcctgtgctgtgcggggcagtgacaccctgtggtaccggggcaaggtgatggaggtggtgggcggcgctgtgcgggtgcagtacctggaccacggcttcacagagaagatcccccagtgccacctgtaccccatcctgctgtacccagacatcccccagttctgcatcccctgccagctgcacaacaccacccctgtgggcaatgtgtggcagccagatgccatcgaggtgctgcagcagctgctgagcaagaggcaggtggacatccacatcatgaagcccaggagtgaccatgacaagaagtatgaggaggagcagtgggagatccgctttgaggagctgctgtctgctgagacagacacccccctgctgcccccctacctgagcagcagcctgcccagccctggagagctgtatgctgtgcaggtgaagcacgtggtgagccccaatgaggtgtacatctgcctggacagcattgagaccagcaaccagagcaaccagcacagcgacacagatgattctggagtgtctggagagagcgagagcgagagcctggatgaggccctgcagagggtgaacaagaaggtggaggccctgccccccctgacagacttcagaacagagatgccctgcctggccgagtatgatgatggcctgtggtaccgggccaagatcgtggccatcaaggagttcaaccccctgagcatcctggtgcagtttgtggactatggcagcacagccaagctgaccctgaaccggctgtgccagatccccagccacctgatgagatacccagcccgggccatcaaggtgctgctggccggcttcaagccacccctgcgggacctgggggagacccgcatcccctactgccccaagtggagcatggaggccctgtgggccatgattgactgcctgcagggcaagcagctgtatgctgtgtccatggccccagcccctgagcagatcgtgaccctgtatgatgatgagcagcaccctgtgcacatgcccctggtggagatgggcctggccgacaaggatgaatag

SEQ ID NO: 168461 - DNA, 3207 bp, Artificial Sequence
  Description of Artificial Sequence: Synthetic coding sequence
atgctggacaccaacacagctgaggagattgatgaggccctgaacacagcccaccacagctttgagcagctgagcattgctgggaaggccctggagcacatgcagaagcagaccatcgaggagcgggagagggtcatcgaggtggtggagaagcagtttgaccagctgctggccttctttgacagcaggaagaagaacctgtgtgaggagtttgcccggaccacagatgactacctgagcaacctgatcaaggccaagagctacatcgaggagaagaagaacaacctgaatgctgccatgaacatcgcccgggccctgcagctgagccccagcctgcggacctactgtgacctgaaccagatcatccgcaccctgcagctgaccagtgacagcgagctggcccaggtgagcagcccccagctgaggaaccccccccggctgtctgtgaactgcagcgagatcatctgcatgttcaacaacatgggcaagattgagttccgggacagcaccaagtgctacccccaggagaatgagatccggcagaatgtgcagaagaagtacaacaacaagaaggagctgagctgctatgacacctacccacccctggagaagaagaaggtggacatgtctgtgctgaccagcgaggcccctcctccacccctgcagcctgagaccaatgatgtgcacctggaggccaagaacttccagccccagaaggatgtggccacagccagccccaagaccatcgctgtgctgccccagatgggcagcagcccagatgtgatcatcgaggagatcatcgaggacaacgtggagagcagcgctgagctggtgtttgtgagccacgtgattgacccctgccacttctacatcaggaagtacagccagatcaaggatgccaaggtgctggagaagaaggtgaatgagttctgcaacagaagcagccacctggaccccagcgacatcctggagctgggcgcccgcatctttgtgagcagcatcaagaatggcatgtggtgccggggcaccatcacagagctgatccccatcgagggcaggaacaccaggaagccctgcagccccacccggctgtttgtgcatgaggtggccctgatccagatcttcatggtggactttggaaacagcgaggtgctgattgtgactggagtggtggacacccacgtgcggcctgagcacagcgccaagcagcacatcgccctgaatgacctgtgcctggtgctgaggaagtctgagccctacacagagggcctgctgaaggacatccagcccctggcccagccctgcagcctgaaggacatcgtgccccagaacagcaatgaaggctgggaggaggaggccaaggtggagttcctgaagatggtgaacaacaaggctgtgtccatgaaggtgttccgggaggaggatggagtgctgattgtggacctgcagaagcccccacccaacaagatcagcagtgacatgcctgtgtccctgagagatgccctggtgttcatggagctggccaagttcaagagccagagcctgcggagccactttgagaagaacaccaccctgcactaccacccccccatcctgcccaaggagatgacagatgtgtctgtgacagtgtgccacatcaacagccctggggacttctacctgcagctgattgagggcctggacatcctcttcctgctgaagaccatcgaggagttctacaagtcagaagatggagagaacctggagatcctgtgccctgtgcaggaccaggcctgtgtggccaagtttgaagatggcatctggtaccgggccaaggtgattggcctgcccggccaccaggaggtggaggtgaagtatgtggactttggaaacacagccaagatcaccatcaaggatgtgaggaagatcaaggatgagttcctgaatgcccctgagaaggccatcaagtgcaagctggcctacatcgagccctacaagaggaccatgcagtggagcaaggaggccaaggagaagtttgaggagaaggcccaggacaagttcatgacctgcagcgtcatcaagatcctggaggacaacgtgctgctggtggagctgtttgacagcctgggcgcccctgagatgaccaccaccagcatcaatgaccagctggtgaaggagggcctggccagctatgagatcggctacatcctgaaggacaacagccagaagcacatcgaggtgtgggaccccagccctgaggagatcatcagcaatgaggtgcacaacctgaaccctgtgtctgccaagagcctgcccaatgaaaacttccagagcctgtacaacaaggagctgcctgtgcacatctgcaacgtcatcagccctgagaagatctacgtgcagtggctgctgacagagaacctgctgaacagcctggaggagaagatgattgctgcctatgagaacagcaagtgggagcctgtgaagtgggagaatgacatgcactgtgctgtgaagatccaggacaagaaccagtggaggcggggccagatcatccgcatggtgacagacaccctggtggaggtgctgctgtatgatgtgggcgtggagctggtggtgaatgtggactgcctgaggaagctggaggagaacctgaagaccatgggccgcctgagcctggagtgcagcctggtggacatccggcctgctgggggcagtgacaagtggacagccacagcctgtgactgcctgagcctgtacctgaccggggctgtggccaccatcatcctgcaggtggacagcgaggagaacaacaccacctggcccctgcctgtgaagatcttctgcagagatgagaagggggagcgggtggatgtgtccaagtacctgatcaagaagggcctggccctgcgggagcggcgcatcaacaacctggacaacagccacagcctgtctgagaagagcctggaggtgcccctggagcaggaggacagcgtggtgaccaactgcatcaagaccaactttgatcctgacaagaagacagctgacatcatcagcgagcagaaggtgtctgagttccaggagaagatcctggagcccaggaccacccggggctacaagcccccagccatccccaacatgaatgtgtttgaggccaccgtgtcctgtgtgggagatgatggcaccatctttgtggtgcccaagctgtctgaatttgagctgatcaagtag

SEQ ID NO: 168462 - DNA, 462 bp, Artificial Sequence
  Description of Artificial Sequence: Synthetic coding sequence
atggccagctactttgatgaacatgactgtgagcccagcgaccctgagcaggagaccaggaccaacatgctgctggagctggcccggagcctcttcaacaggatggactttgaggacctgggcctggtggtggactgggaccaccacctgcccccacctgctgccaagacagtggtggagaacctgcccaggacagtcatccggggcagccaggccgagctgaagtgccctgtgtgcctgctggagtttgaggaggaggagacagccatcgagatgccctgccaccacctgttccacagcagctgcatcctgccctggctgagcaagaccaacagctgccccctgtgccgctatgagctgcccacagatgatgacacctatgaggagcacagaagagacaaggccaggaagcagcagcagcagcaccggctggagaacctgcacggggccatgtacacctag

SEQ ID NO: 168463 - DNA, 684 bp, Artificial Sequence
  Description of Artificial Sequence: Synthetic coding sequence
atggcctgcaccaagaccctgcagcagagccagcccatctctgctggggccaccaccaccaccacagctgtggccccagctgggggccacagcggcagcacagaatgtgacctggagtgcctggtgtgccgggagccctacagctgcccccggctgcccaagctgctggcctgccagcacgccttctgtgccatctgcctgaagctgctgctgtgtgtgcaggacaacacctggagcatcacctgccccctgtgcaggaaggtgacagctgtgcctgggggcctcatctgcagcctgcgggaccacgaggccgtggtgggccagctggcccagccctgcacagaggtgtccctgtgcccccagggcctggtggaccctgctgacctggccgccggccaccccagcctggtgggagaagatggccaggatgaggtgtctgccaaccacgtggccgcccggcggctggccgcccacctgctgctgctggccctgctgatcatcctgattggccccttcatctacccaggagtgctgcgctgggtgctgaccttcatcatcgccctggccctgctgatgagcaccctcttctgctgcctgcccagcacccggggcagctgctggcccagcagcaggaccctcttctgccgggagcagaagcacagccacatcagcagcatcgcctag

SEQ ID NO: 168464 - DNA, 795 bp, Artificial Sequence
  Description of Artificial Sequence: Synthetic coding sequence
atgagccaggccgtgcagaccaacggcacccagcccctgagcaagacctgggagctgagcctgtatgagctgcagaggaccccccaggaggccatcacagatggcctggagatcgtggtgagccccaggagcctgcacagcgagctgatgtgccccatctgcctggacatgctgaagaacaccatgaccaccaaggagtgcctgcaccgcttctgtgccgactgcatcatcacagccctgcggagcggcctgcagaggggcaagaagcagcagattgaaaatggcagcggggctgaagataatggagacagcagccactgcagcaatgccagcacccacagcaaccaggaggccggccccagcaacaagaggaccaagaccagtgatgattctggcctggagctggacaacaacaatgctgccatggccatcgaccctgtgatggatggagccagcgagattgagctggtgttccggccccaccccaccctgatggagaaggatgacagcgcccagacccgctacatcaagaccagcggaaatgccaccgtggaccacctgagcaagtacctggccgtgcggctggccctggaggagctgcggagcaaaggagagagcaaccagatgaacctggacacagccagcgagaagcagtacaccatctacatcgccacagccagcggccagttcaccgtgctgaatggcagcttcagcctggagctggtgtctgagaagtactggaaggtgaacaagcccatggagctgtactatgcccccaccaaggagcacaagtag

SEQ ID NO: 168465 - DNA, 1011 bp, Artificial Sequence
  Description of Artificial Sequence: Synthetic coding sequence
atgagccaggccgtgcagaccaacggcacccagcccctgagcaagacctgggagctgagcctgtatgagctgcagaggaccccccaggaggccatcacagatggcctggagatcgtggtgagccccaggagcctgcacagcgagctgatgtgccccatctgcctggacatgctgaagaacaccatgaccaccaaggagtgcctgcaccgcttctgtgccgactgcatcatcacagccctgcggagcggcaacaaggagtgccccacctgcaggaagaagctggtgtccaagaggagcctgcggccagaccccaactttgatgccctgatcagcaagatctaccccagcagagatgaatatgaggcccaccaggagcgggtgctggcccgcatcaacaagcacaacaaccagcaggccctgagccacagcattgaggagggcctgaagatccaggccatgaaccggctgcagaggggcaagaagcagcagattgaaaatggcagcggggctgaagataatggagacagcagccactgcagcaatgccagcacccacagcaaccaggaggccggccccagcaacaagaggaccaagaccagtgatgattctggcctggagctggacaacaacaatgctgccatggccatcgaccctgtgatggatggagccagcgagattgagctggtgttccggccccaccccaccctgatggagaaggatgacagcgcccagacccgctacatcaagaccagcggaaatgccaccgtggaccacctgagcaagtacctggccgtgcggctggccctggaggagctgcggagcaaaggagagagcaaccagatgaacctggacacagccagcgagaagcagtacaccatctacatcgccacagccagcggccagttcaccgtgctgaatggcagcttcagcctggagctggtgtctgagaagtactggaaggtgaacaagcccatggagctgtactatgcccccaccaaggagcacaagtag

SEQ ID NO: 168466 - DNA, 741 bp, Artificial Sequence
  Description of Artificial Sequence: Synthetic coding sequence
atgagccaggccgtgcagaccaacggcacccagcccctgagcaagacctgggagctgagcctgtatgagctgcagaggaccccccaggaggccatcacagatggcctggagatcgtggtgagccccaggagcctgcacagcgagctgatgtgccccatctgcctggacatgctgaagaacaccatgaccaccaaggagtgcctgcaccgcttctgtgccgactgcatcatcacagccctgcggagcggcaacaaggagtgccccacctgcaggaagaagctggtgtccaagaggagcctgcggccagaccccaactttgatgccctgatcagcaagatctaccccagcagagatgaatatgaggcccaccaggagcgggtgctggcccgcatcaacaagcacaacaaccagcaggccctgagccacagcattgaggagggcctgaagatccaggccatgaaccggctgcagaggggcaagaagcagcagattgaaaatggcagcggggctgaagataatggagacagcagccactgcagcaatgccagcacccacagcaaccaggaggccggccccagcaacaagaggaccaagaccagtgatgattctggcctggagctggacaacaacaatgctgccatggccatcgaccctgtgatggatggagccagcgagattgagctggtgttccggccccaccccaccctgatggagaaggatgacagcgcccagaccaggtag

SEQ ID NO: 168467 - DNA, 822 bp, Artificial Sequence
  Description of Artificial Sequence: Synthetic coding sequence
atggccaactgggtgttctgcaaccgctgcttccagcccccccacaggaccagctgcttcagcctgaccaactgtggccacgtgtactgtgatgcctgcctgggcaagggcaagaagaatgaatgtctcatctgcaaggccccctgcaggacagtgctgctgagcaagcacacagatgctgacatccaggccttcttcatgagcattgacagcctgtgcaagaagtacagccgggagaccagccagtacctgcggctgagccggggctgctgccgcctgaagctgtgcccagccaccagcagcaaggaggtgccccggggcagcacccacggcagccaggccgccgcccgggacccccaggagcactgggtgtccaccacccgggccccccggcccggctgcagaagaagccagagccagcctgaggcccagggcaacaccatccaggatgccccccaccccctgaccctgctgcaccccagcaggaccctcatccacaccaagagcccctggggccagaagctgctggagttcatcaagcacgtgtgctaccaccgccaccagagccaccggccctgtgcccctggctggttctgccaggtgctgcagaggcctggagctgtgtctggagagaagacccagcagaccaggcctgcccccccagccacctgcctgctgtgcctgagctgcctgagcggcttccgccacggcccctggaggagccaggccctgcccagcgacctggtggcccccctgtttgtgtcctacacagtggaggtgtccatcaccaatgccggctggagcttccctgctgctgtgtag

SEQ ID NO: 168468 - DNA, 699 bp, Artificial Sequence
  Description of Artificial Sequence: Synthetic coding sequence
atggccaactgggtgttctgcaaccgctgcttccagcccccccacaggaccagctgcttcagcctgaccaactgtggccacgtgtactgtgatgcctgcctgggcaagggcaagaagaatgaatgtctcatctgcaaggccccctgcaggacagtgctgctgagcaagcacacagatgctgacatccaggccttcttcatgagcattgacagcctgtgcaagaagtacagccgggagaccagccagatcctggagttccaggagaagcacaggaagaggctgctggccttctaccgggagaagatcagccggctggaggagagcctgaggaagtctgtgctgcagatcgagcagctgcagagcatgaggagcagccagcagacagccttcagcaccatcaagagctctgtgtccaccaagccccacggctgcctgctgcccccccacagcagcgccccagaccggctggagagcatggaggtggacctgagccccagccccatcaggaagtcagaaattgctgctggccctgcccgcatctccatgatcagccccccccaggacggccgcatggccccctgtgcccggcgggtgtgccacttccagcgcttcaccatgttcctgcaccggcggctgagcagcctggccgccccacccagcgtgcagttctggaaggcccggggcacccaccagctgtag

SEQ ID NO: 168469 - DNA, 894 bp, Artificial Sequence
  Description of Artificial Sequence: Synthetic coding sequence
atggccaactgggtgttctgcaaccgctgcttccagcccccccacaggaccagctgcttcagcctgaccaactgtggccacgtgtactgtgatgcctgcctgggcaagggcaagaagaatgaatgtctcatctgcaaggccccctgcaggacagtgctgctgagcaagcacacagatgctgacatccaggccttcttcatgagcattgacagcctgtgcaagaagtacagccgggagaccagccagatcctggagttccaggagaagcacaggaagaggctgctggccttctaccgggagaagatcagccggctggaggagagcctgaggaagtctgtgctgcagatcgagcagctgcagagcatgaggagcagccagcagacagccttcagcaccatcaagagctctgtgtccaccaagccccacggctgcctgctgcccccccacagcagcgccccagaccggctggagagcatggaggtggacctgagccccagccccatcaggaagtcagaaattgctgctggccctgcccgcatctccatgatcagccccccccaggacggccgcatgggcccccacctgacagccagcttctgcttcatcccctggctgaccctgagcaagccccctgtgcctggagaatgtgtgatcagccggggcagcccctgcttctgcattgatgtgtgcccccactggctgctgctgctggccttcagcagcggccgccacggggagctgaccaacagcaagaccctgcccatctatgcagaggtgcagagagctgtgctcttccccttccagcaggccgagggcaccctggacaccttccgcaccccagctgtgtctgtggtgttccccctgtgccagtttgagaggaagaagagcttctag

SEQ ID NO: 168470 - DNA, 3192 bp, Artificial Sequence
  Description of Artificial Sequence: Synthetic coding sequence
atggagtgccccagctgccagcacgtgtccaaggaggagacccccaagttctgcagccagtgtggggagcggctgcccccagctgcccccatcgctgacagcgagaacaacaacagcaccatggccagcgccagcgagggggagatggagtgtggccaggagctgaaggaggagggcggcccctgcctcttccctggcagtgacagctggcaggagaaccctgaggagccctgcagcaaggcctcctggacagtgcaggagagcaagaagaagaagaggaagaagaagaagaagggcaacaagagcgccagcagcgagctggccagcctgcccctgagccctgccagcccctgccacctgaccctgctgagcaacccctggccccaggacacagccctgccccacagccaggcccagcagagcggccccaccggccagcccagccagcccccaggcacagccaccacccccctggagggagatggcctgagcgcccccacagaggtgggggacagccccctgcaggcccaggccctgggggaggccggcgtggccaccggcagcgaggcccagagcagcccccagttccaggaccacacagaaggagaggaccaggatgccagcatccccagcggcggccggggcctgagccaggagggcactggaccacccaccagcgctggggagggccacagcaggacagaagatgctgcccaggagctgctgctgcctgagagcaaaggaggcagcagcgagcctggaacagagctgcagaccacagagcagcaggccggggccagcgcctccatggctgtggatgctgtggccgagcccgccaatgctgtgaagggagctgggaaggagatgaaggagaagacccagaggatgaagcagcccccagccaccaccccacccttcaagacccactgccaggaggccgagaccaagaccaaggatgagatggctgctgctgaggagaaggtgggcaagaatgagcagggcgagcctgaggacctgaagaagccagagggcaagaacagatctgctgctgctgtgaagaatgagaaggagcagaagaaccaggaggctgatgtgcaggaggtgaaggccagcaccctgagccctgggggcggcgtgaccgtcttcttccacgccatcatcagcctgcacttccccttcaacccagacctgcacaaggtgttcatccggggcggggaggagtttggagagagcaagtgggacagcaacatctgtgagctgcactacacccgggacctgggccatgacagagtgctggtggagggcatcgtgtgcatcagcaagaagcacctggacaagtacatcccctacaagtatgtgatctacaacggggagagctttgaatatgagttcatctacaagcaccagcagaagaagggggagtatgtgaaccgctgcctcttcatcaagagcagcctgctgggcagcggggactggcaccagtactatgacatcgtgtacatgaagccccacggccgcctgcagaaggtgatgaaccacatcacagatggccccaggaaggacctggtgaagggcaagcagattgctgctgccctgatgctggacagcaccttcagcatcctgcagacctgggacaccatcaacctgaacagcttcttcacccagtttgagcagttctgctttgtgctgcagcagcccatgatctatgagggccaggcccagctgtggacagacctgcagtaccgggagaaggaggtgaagcgctacctgtggcagcacctgaagaagcacgtggtgcccctgcctgatggcaagagcacagacttcctgcctgtggactgccctgtgcgcagcaagctgaagacaggcctgattgtgctgtttgtggtggagaagattgagctgctgctggagggcagcctggactggctgtgccacctgctgaccagtgatgccagcagcccagatgagttccaccgggacctgagccacatcctgggcatcccccagagctggaggctgtacctggtgaacctgtgccagcgctgcatggacaccaggacctacacctggctgggcgccctgcctgtgctgcactgctgcatggagctggcccccaggcacaaggatgcctggaggcagcctgaggacacctgggccgccctggagggcctgtccttcagccccttccgggagcagatgctggacaccagcagcctgctgcagttcatgagggagaagcagcacctgctgagcattgatgagcccctcttccgctcctggttcagcctgctgcccctgagccacctggtgatgtacatggagaacttcatcgagcacctgggccgcttccctgcccacatcctggactgcctgagcggcatctactaccgcctgcccggcctggagcaggtgctgaacacccaggatgtgcaggatgtgcagaatgtgcagaacatcctggagatgctgctgcggctgctggacacctacagagacaagatccctgaggaggccctgagccccagctacctgactgtgtgcctgaagctgcacgaggccatctgcagcagcaccaagctgctgaagttctatgagctgcctgccctgtctgctgagatcgtgtgcaggatgatccggctgctgagcctggtggacagcgctggccagagagatgagaccggcaacaacagcgtgcagacagtgttccagggcaccctggccgccaccaagcgctggctgcgggaggtgttcaccaagaacatgctgaccagcagcggggccagcttcacctacgtgaaggagattgaggtgtggaggcggctggtggagatccagtttcctgctgagcacggctggaaggagagcctgctgggggacatggagtggaggctgaccaaggaggagcccctgagccagatcacagcctactgcaacagctgctgggacaccaagggcctggaggacagcgtggccaagacctttgagaagtgcatcatcgaggccgtgtcctctgcctgccaggtgaacaacctgagctcctgggagacagattctggcagccagctgtgcagcgccatgacccagctgcgggccatgaagcaccccctgggcctgagcagcagcgccaacagcgagatcggcaagtgggcccccagcagcctggccaagggaaatggagctgagatctag

SEQ ID NO: 168471 - DNA, 9843 bp, Artificial Sequence
  Description of Artificial Sequence: Synthetic coding sequence
atggtgtgtgatggagactgggagcactgctacctgcccagcgccttcagccagcacaaggtgtttgtgaccccccaggcccccctggaggccatccaggcctacctggccggccactacagagtgcccaagcagaccctgtctgctgctgctgtgttcaatgaccggctgtgtgtgggcatcgtggccagcgagagagctggggtgggcaagagcctgtatgtgaagaggctgcatgacaagatgaagatgcagctgaatgtgaagaatgtgcccctgaagaccatccggctgattgacccccaggtggatgagagccgggtgctgggcgccctgctgcccttcctggatgcccagtaccagaaggtgcctgtgctcttccacctggatgtgaccagctctgtgcagacaggcatctgggtgttcctgttcaagctgctgatcctgcagtacctgatggacatcaacgggaagatgtggctgaggaacccctgccacctgtacatcgtggagatcctggagaggaggacctctgtgcccagccgcagcagcagcgccctgcggaccagggtgccccagttctccttcctggacatcttccccaaggtgacctgcaggcctcccaaggaggtgattgacatggagctgagcgccctgcggagtgacacagagcccggcatggacctgtgggagttctgcagcgagaccttccagaggccctaccagtacctgcggcgcttcaaccagaaccaggacctggacaccttccagtaccaggagggctctgtggagggcaccccagaagaatgtctgcagcacttcctgttccactgtggggtcatcaaccccagctggagcgagctgaggaactttgcccgcttcctgaactaccagctgcgggactgtgaggccagcctcttctgcaaccccagcttcatcggggacaccctgcggggcttcaagaagtttgtggtgaccttcatgatcttcatggcccgggactttgccacccccagcctgcacaccagtgaccagagccctgggaagcacatggtgaccatggatggagtgcgggaggaggacctggcccccttcagcctgaggaagcgctgggagagcgagccccacccctacgtgttcttcaatgatgaccacaccaccatgaccttcatcggcttccacctgcagcccaacatcaatggatctgtggatgccatcagccacctgaccgggaaggtgatcaagagagatgtgatgacccgggacctgtaccagggcctgctgctgcagagggtgcccttcaacgtggactttgacaagctgcccaggcacaagaagctggagcggctgtgcctgaccctgggcatcccccaggccacagatcctgacaagacctatgagctgaccacagacaacatgctgaagatcctggccatcgagatgaggttccgctgtggcatccctgtgatcatcatgggagaaacaggctgcggcaagaccaggctcatcaagttcctgagtgacctgcggcggggcggcaccaatgctgacaccatcaagctggtgaaggtgcatggaggcaccacagctgacatgatctacagccgggtgcgggaggctgaaaatgtggcctttgccaacaaggaccagcaccagctggacaccatcctcttctttgatgaggccaacaccacagaggccatcagctgcatcaaggaggtgctgtgtgaccacatggtggatggccagcccctggctgaagattctggcctgcacatcatcgccgcctgcaacccctacaggaagcacagcgaggagatgatctgccgcctggagagcgctggcctgggctacagagtgtccatggaggagacagctgaccggctgggcagcatccccctgcggcagctggtgtacagagtgcacgccctgccccccagcctcatccccctggtgtgggactttggccagctgagtgatgtggccgagaagctgtacatccagcagatcgtgcagaggctggtggagagcatcagcctggatgaaaatggcaccagggtcatcacagaggtgctgtgtgccagccagggcttcatgaggaagacagaagatgaatgttcctttgtgtccctgagagatgtggagcgctgtgtgaaggtgttccgctggttccacgagcacagcgccatgctgctggcccagctgaatgccttcctgagcaagagctctgtgtccaagaaccacacagagcgggaccctgtgctgtggagcctgatgctggccatcggcgtgtgctaccacgccagcctggagaagaaggacagctacaggaaggccatcgcccgcttcttccccaagccctatgatgacagccggctgctgctggatgagatcacccgggcccaggacctcttcctggatggagtgcccctgaggaagaccatcgccaagaacctggccctgaaggaaaatgtgttcatgatggtggtgtgcatcgagctgaagatccccctcttcctggtgggcaagccaggcagcagcaagagcctggccaagaccatcgtggctgatgccatgcagggccctgctgcctacagcgacctcttccgcagcctgaagcaggtgcacctggtgtccttccagtgcagcccccacagcaccccccagggcatcatcagcaccttccggcagtgtgcccgcttccagcagggcaaggacctgcagcagtatgtgtctgtggtggtgctggatgaggtgggcctggccgaggacagccccaagatgcccctgaagaccctgcaccccctgctggaggatggctgcattgaagatgatcctgccccccacaagaaggtgggctttgtgggcatcagcaactgggccctggaccctgccaagatgaacagaggcatctttgtgtcccggggcagccccaatgaaacagagctgattgagagcgccaagggcatctgcagcagtgacatcctggtgcaggacagagtgcagggctactttgccagctttgccaaggcctatgagaccgtgtgcaagaggcaggacaaggagttcttcggcctgcgggactactacagcctcatcaagatggtgtttgctgctgccaaggccagcaacaggaagcccagcccccaggacatcgcccaggccgtgctgaggaacttcagcggcaaggatgacatccaggccctggacatcttcctggccaacctgcctgaggccaagtgcagcgaggaggtgagccccatgcagctgatcaagcagaacatcttcggccccagccagaaggtgcctggaggagagcaggaggatgctgagagccgctacctgctggtgctgaccaagaactacgtggccctgcagatcctgcagcagaccttctttgaaggagaccagcagcctgagatcatctttggaagtggcttccccaaggaccaggagtacacccagctgtgcaggaacatcaacagagtgaagatctgcatggagaccgggaagatggtgctgctgctgaacctgcagaacctgtatgagagcctgtatgatgccctgaaccagtactacgtgcacctgggcggccagaagtatgtggacctgggcctgggcacccaccgggtgaagtgccgggtgcaccccaacttccgcctcatcgtcatcgaggagaaggatgtggtgtacaagcacttccccatccccctcatcaaccggctggagaagcactacctggacatcaacacagtgctggagaagtggcagaagagcatcgtggaggagctgtgtgcctgggtggagaagttcatcaacgtgaaggcccaccacttccagaagaggcacaagtacagccccagtgatgtgttcatcggctaccacagtgatgcctgtgcctctgtggtgctgcaggtgattgagcggcagggcccccgggccctgacagaggagctgcaccagaaggtgtctgaggaggccaagagcatcctgctgaactgtgccaccccagatgctgtggtgcggctgagcgcctacagcctgggcggctttgctgctgagtggctgagccaggagtacttccaccggcagaggcacaacagctttgctgacttcctgcaggcccacctgcacacagctgacctggagagacatgccatcttcacagagatcaccaccttcagccggctgctgaccagccatgactgtgagatcctggagagcgaggtgacaggccgggcccccaagcccaccctgctgtggctgcagcagtttgacacagagtacagcttcctgaaggaggtgaggaactgcctgaccaacacagccaagtgcaagatcctgatcttccagacagactttgaagatggcatccgcagcgcccagctgattgccagcgccaagtacagcgtcatcaatgagatcaacaagatccgggagaatgaagatcgcatctttgtgtacttcatcaccaagctgagccgggtgggccggggcacagcctacgtgggcttccacggcggcctgtggcagagcgtgcacattgatgacctgcggcgcagcaccctgatggtgtctgatgtgacccggctgcagcacgtgaccatcagccagctgtttgcccctggggacctgcctgagctgggcctggagcacagagcagaagatggccacgaggaggccatggagacagaggccagcaccagcggggaggtggccgaggtggccgaggaggccatggagacagagagcagcgagaaggtgggcaaggagaccagcgagctgggcggcagtgatgtgtccatcctggacaccacccggctgctgcggagctgtgtgcagagcgctgtgggcatgctgcgggaccagaatgaaagctgcaccaggaacatgagaagagtggtgctgctgctgggcctgctgaatgaagatgatgcctgccacgccagcttcctgcgggtgtccaagatgaggctgagcgtcttcctgaagaagcaggaggagagccagttccaccccctggagtggctggcccgggaggcctgcaaccaggatgccctgcaggaggccggcaccttccgccacaccctgtggaagagggtgcagggcgctgtgacccccctgctggcctccatgatctccttcatcgacagagatggcaacctggagctgctgaccaggccagacaccccaccctgggcccgggacctgtggatgttcatcttcagtgacaccatgctgctgaacatccccctggtgatgaacaatgaaagacacaagggggagatggcctacatcgtggtgcagaaccacatgaacctgtctgaaaatgccagcaacaacgtgcccttctcctggaagatcaaggactacctggaggagctgtgggtgcaggcccagtacatcacagatgctgagggcctgcccaagaagtttgtggacatcttccagcagacccccctgggccgcttcctggcccagctgcatggagagccccagcaggagctgctgcagtgctacctgaaggacttcatcctgctgaccatgagggtgtccacagaggaggagctgaagttcctgcagatggccctgtggagctgcaccaggaagctgaaggccgccagcgaggcccctgaggaggaggtgtccctgccctgggtgcacctggcctaccagcgcttccgcagccggctgcagaacttcagccgcatcctgaccatctacccccaggtgctgcacagcctgatggaggcccgctggaaccacgagctggccggctgtgagatgaccctggatgcctttgctgccatggcctgcacagagatgctgaccaggaacaccctgaagcccagcccccaggcctggctgcagctggtgaagaacctgtccatgcccctggagctgatctgcagtgatgagcacatgcagggcagcggcagcctggcccaggccgtcatccgggaggtgcgggcccagtggagccgcatcttcagcacagccctgtttgtggagcacgtgctgctgggcacagagagccgggtgcctgagctgcagggcctggtgacagagcacgtgttcctgctggacaagtgcctgcgggagaacagtgatgtgaagacccacggcccctttgaggccgtgatgaggaccctgtgtgagtgcaaggagacagccagcaagaccctgagcagatttggcatccagccctgcagcatctgcctgggagatgccaaggaccctgtgtgcctgccctgtgaccacgtgcactgcctgcgctgcctgcgggcctggtttgccagcgagcagatgatctgcccctactgcctgacagccctgcctgatgagttcagccctgctgtgtcccaggcccaccgggaggccatcgagaagcacgcccgcttccggcagatgtgcaacagcttctttgtggacctggtgtccaccatctgcttcaaggacaatgcccctcctgagaaggaggtgattgagagcctgctgagcctgctgtttgtgcagaagggccgcctgagagatgctgcccagaggcactgtgagcacaccaagagcctgagccccttcaatgatgtggtggacaagacccctgtgatccgcagcgtcatcctgaagctgctgctgaagtacagcttccatgatgtgaaggactacatccaggagtacctgaccctgctgaagaagaaggccttcatcacagaggacaagacagagctgtacatgctgttcatcaactgcctggaggacagcatcctggagaagaccagcgcctacagcagaaatgatgagctgaaccacctggaggaggagggccgcttcctgaaggcctacagccctgccagccggggccgggagcccgccaatgaggcctctgtggagtacctgcaggaggtggcccgcatccggctgtgcctggacagagctgctgacttcctgtctgagcctgagggcggccctgagatggccaaggagaagcagtgctacctgcagcaggtgaagcagttctgcatccgggtggagaatgactggcaccgggtgtacctggtgaggaagctgagcagccagaggggcatggagtttgtgcagggcctgagcaagccaggccggccccaccagtgggtgttccccaaggatgtggtgaagcagcagggcctgcggcaggaccaccctggccagatggaccgctacctggtgtatggagatgagtacaaggccctgagagatgctgtggccaaggctgtgctggagtgcaagcccctgggcatcaagacagccctgaaggcctgcaagaccccccagagccagcagagcgcctacttcctgctgaccctcttccgggaggtggccatcctgtaccgcagccacaatgccagcctgcaccccaccccagagcagtgtgaggccgtgtccaagttcatcggggagtgcaagatcctgagccccccagacatcagcagatttgccaccagcctggtggacaacagcgtgcccctgctgcgggccggccccagcgacagcaacctggatggcaccgtgacagagatggccatccatgctgctgctgtgctgctgtgtggccagaatgagctgctggagcccctgaagaacctggccttctccccagccaccatggcccacgccttcctgcccaccatgcctgaggacctgctggcccaggcccggcgctggaagggcctggagcgggtgcactggtacacctgccccaacggccacccctgcagcgtgggggagtgtggccggcccatggagcagagcatctgcatcgactgccacgcccccatcggcggcatcgaccacaagcccagagatggcttccacctggtgaaggacaaggctgacaggacccagacaggccacgtgctgggcaacccccagaggagagatgtggtgacctgtgaccggggcctgccccctgtggtgttcctgctgatccggctgctgacccacctggccctgctgctgggcgccagccagagcagccaggccctgatcaacatcatcaagccccctgtgcgggaccccaagggcttcctgcagcagcacatcctgaaggacctggagcagctggccaagatgctgggccacagcgcagatgagaccatcggcgtggtgcacctggtgctgcggcggctgctgcaggagcagcaccagctgagcagccggcggctgctgaactttgacacagagctgagcaccaaggagatgaggaacaactgggagaaggagattgctgctgtgatcagccctgagctggagcacctggacaagaccctgcccaccatgaacaacctgatcagccaggacaagaggatcagcagcaaccctgtggccaagatcatctacggggaccctgtgaccttcctgccccacctgcccaggaagtctgtggtgcactgcagcaagatctggagctgcaggaagaggatcaccgtggagtacctgcagcacatcgtggagcagaagaatggcaaggagcgggtgcccatcctgtggcacttcctgcagaaggaggccgagctgcggctggtgaagttcctgcctgagatcctggccctgcagagggacctggtgaagcagttccagaatgtgcagcaggtggagtacagcagcatccggggcttcctgagcaagcacagcagtgatggcctgcggcagctgctgcacaaccgcatcaccgtcttcctgagcacctggaacaagctgcggcgcagcctggagaccaatggagagatcaacctgcccaaggactactgcagcacagacctggacctggacacagaatttgagatcctgctgccccggcggcggggcctgggcctgtgtgccacagccctggtgtcctacctgatccggctgcacaatgaaattgtgtatgctgtggagaagctgagcaaagaaaacaacagctacagcgtggatgctgctgaggtgacagagctgcacgtgatctcctatgaggtggagcgggacctgacccccctcatcctgagcaactgccagtaccaggtggaggagggccgggagaccgtgcaggagtttgacctggagaagatccagaggcagatcgtgagccgcttcctgcagggcaagccccggctgagcctgaagggcatccccaccctggtgtacagacatgactggaactatgagcacctgttcatggacatcaagaacaagatggcccaggacagcctgcccagcagcgtcatcagcgccatcagcggccagctgcagagctacagtgatgcctgtgaggtgctgtctgtggtggaggtgaccctgggcttcctgagcacagctggaggagaccccaacatgcagctgaatgtgtacacccaggacatcctgcagatgggagaccagaccatccacgtgctgaaggccctgaaccgctgccagctgaagcacaccatcgccctgtggcagttcctgagcgcccacaagtctgagcagctgctgcggctgcacaaggagccctttggagagatcagcagccgctacaaggctgacctgagcccagaaaatgccaagctgctgagcaccttcctgaaccagacaggcctggatgccttcctgctggagctgcacgagatgatcatcctgaagctgaagaacccccagacccagacagaggagcgcttccggccccagtggagcctgcgggacaccctggtgtcctacatgcagaccaaggagagcgagatcctgcctgagatggccagccagtttcctgaggagatcctgctggccagctgtgtgtctgtgtggaagacagctgctgtgctgaagtggaaccgggagatgaggtag

SEQ ID NO: 168472 - DNA, 4653 bp, Artificial Sequence
  Description of Artificial Sequence: Synthetic coding sequence
atggagtgccccagctgccagcacgtgtccaaggaggagacccccaagttctgcagccagtgtggggagcggctgcccccagctgcccccatcgctgacagcgagaacaacaacagcaccatggccagcgccagcgagggggagatggagtgtggccaggagctgaaggaggagggcggcccctgcctcttccctggcagtgacagctggcaggagaaccctgaggagccctgcagcaaggcctcctggacagtgcaggagagcaagaagaagaagaggaagaagaagaagaagggcaacaagagcgccagcagcgagctggccagcctgcccctgagccctgccagcccctgccacctgaccctgctgagcaacccctggccccaggacacagccctgccccacagccaggcccagcagagcggccccaccggccagcccagccagcccccaggcacagccaccacccccctggagggagatggcctgagcgcccccacagaggtgggggacagccccctgcaggcccaggccctgggggaggccggcgtggccaccggcagcgaggcccagagcagcccccagttccaggaccacacagaaggagaggaccaggatgccagcatccccagcggcggccggggcctgagccaggagggcactggaccacccaccagcgctggggagggccacagcaggacagaagatgctgcccaggagctgctgctgcctgagagcaaaggaggcagcagcgagcctggaacagagctgcagaccacagagcagcaggccggggccagcgcctccatggctgtggatgctgtggccgagcccgccaatgctgtgaagggagctgggaaggagatgaaggagaagacccagaggatgaagcagcccccagccaccaccccacccttcaagacccactgccaggaggccgagaccaagaccaaggatgagatggctgctgctgaggagaaggtgggcaagaatgagcagggcgagcctgaggacctgaagaagccagagggcaagaacagatctgctgctgctgtgaagaatgagaaggagcagaagaaccaggaggctgatgtgcaggaggtgaaggccagcaccctgagccctgggggcggcgtgaccgtcttcttccacgccatcatcagcctgcacttccccttcaacccagacctgcacaaggtgttcatccggggcggggaggagtttggagagagcaagtgggacagcaacatctgtgagctgcactacacccgggacctgggccatgacagagtgctggtggagggcatcgtgtgcatcagcaagaagcacctggacaagtacatcccctacaagtatgtgatctacaacggggagagctttgaatatgagttcatctacaagcaccagcagaagaagggggagtatgtgaaccgctgcctcttcatcaagagcagcctgctgggcagcggggactggcaccagtactatgacatcgtgtacatgaagccccacggccgcctgcagaaggtgatgaaccacatcacagatggccccaggaaggacctggtgaagggcaagcagattgctgctgccctgatgctggacagcaccttcagcatcctgcagacctgggacaccatcaacctgaacagcttcttcacccagtttgagcagttctgctttgtgctgcagcagcccatgatctatgagggccaggcccagctgtggacagacctgcagtaccgggagaaggaggtgaagcgctacctgtggcagcacctgaagaagcacgtggtgcccctgcctgatggcaagagcacagacttcctgcctgtggactgccctgtgcgcagcaagctgaagacaggcctgattgtgctgtttgtggtggagaagattgagctgctgctggagggcagcctggactggctgtgccacctgctgaccagtgatgccagcagcccagatgagttccaccgggacctgagccacatcctgggcatcccccagagctggaggctgtacctggtgaacctgtgccagcgctgcatggacaccaggacctacacctggctgggcgccctgcctgtgctgcactgctgcatggagctggcccccaggcacaaggatgcctggaggcagcctgaggacacctgggccgccctggagggcctgtccttcagccccttccgggagcagatgctggacaccagcagcctgctgcagttcatgagggagaagcagcacctgctgagcattgatgagcccctcttccgctcctggttcagcctgctgcccctgagccacctggtgatgtacatggagaacttcatcgagcacctgggccgcttccctgcccacatcctggactgcctgagcggcatctactaccgcctgcccggcctggagcaggtgctgaacacccaggatgtgcaggatgtgcagaatgtgcagaacatcctggagatgctgctgcggctgctggacacctacagagacaagatccctgaggaggccctgagccccagctacctgactgtgtgcctgaagctgcacgaggccatctgcagcagcaccaagctgctgaagttctatgagctgcctgccctgtctgctgagatcgtgtgcaggatgatccggctgctgagcctggtggacagcgctggccagagagatgagaccggcaacaacagcgtgcagacagtgttccagggcaccctggccgccaccaagcgctggctgcgggaggtgttcaccaagaacatgctgaccagcagcggggccagcttcacctacgtgaaggagattgaggtgtggaggcggctggtggagatccagtttcctgctgagcacggctggaaggagagcctgctgggggacatggagtggaggctgaccaaggaggagcccctgagccagatcacagcctactgcaacagctgctgggacaccaagggcctggaggacagcgtggccaagacctttgagaagtgcatcatcgaggccgtgtcctctgcctgccagagccagaccagcatcctgcagggcttctcctacagcgacctgaggaagtttggaattgtgctgtctgctgtgatcaccaagtcctggcccaggacagctgacaacttcaatgacatcctgaagcacctgctgaccctggctgatgtgaagcacgtgttccggctgtgtggcacagatgagaagatcctggccaacgtgacagaagatgccaagaggctgattgctgtggccgacagcgtgctgaccaaggtggtgggggacctgctgagcggcaccatcctggtgggccagctggagctgatcatcaagcacaagaaccagttcctggacatctggcagctgcgggagaagagcctgagcccccaggatgagcagtgtgctgtggaggaggccctggactggaggcgggaggagctgctgctgctgaagaaggagaagagatgtgtggacagcctgctgaagatgtgtggaaatgtgaagcacctgatccaggtggactttggagtgctggccgtgcgccacagccaggacctgagcagcaagaggctgaatgacacagtgacagtgcggctgagcaccagcagcaacagccagagggccacccactaccacctgagcagccaggtgcaggagatggccggcaagattgacctgctgcgggacagccacatcttccagctgttctggagggaggccgctgagcccctgtctgagcccaaggaggaccaggaggccgctgagctgctgtctgagcctgaggaggagagcgagcggcacatcctggagctggaggaggtgtatgactacctgtaccagcccagctacaggaagttcatcaagctgcaccaggacctgaagtctggagaggtgaccctggccgagattgatgtgatcttcaaggactttgtgaacaagtacacagacctggacagcgagctgaagatcatgtgcaccgtggaccaccaggaccagagggactggatcaaggacagagtggagcagatcaaggagtaccaccacctgcaccaggccgtgcatgctgccaaggtgatcctgcaggtgaaggagagcctgggcctgaatggagacttctctgtgctgaacaccctgctgaacttcacagacaactttgatgacttcagaagagagaccctggaccagatcaaccaggagctgatccaggccaagaagctgctgcaggacatcagcgaggcccgctgcaagggcctgcaggccctgagcctgaggaaggagttcatctgctgggtgcgggaggccctgggcggcatcaatgagctgaaggtgtttgtggacctggccagcatctctgctggggagaatgacattgatgtggacagagtggcctgcttccatgatgctgtgcagggctacgccagcctgctcttcaagctggaccccagcgtggacttcagcgccttcatgaagcacctgaagaagctgtggaaggccctggacaaggaccagtacctgcccaggaagctggtgtccctcatcctgagcctgatgcagatcctgctgaacagagccctgctgagcaatgtgcgggctgtgacagtggagatggtggcccacctgtgtggccgctttgtgcacagccgcttccagtag

SEQ ID NO: 168473 - DNA, 15771 bp, Artificial Sequence
  Description of Artificial Sequence: Synthetic coding sequence
atggagtgccccagctgccagcacgtgtccaaggaggagacccccaagttctgcagccagtgtggggagcggctgcccccagctgcccccatcgctgacagcgagaacaacaacagcaccatggccagcgccagcgagggggagatggagtgtggccaggagctgaaggaggagggcggcccctgcctcttccctggcagtgacagctggcaggagaaccctgaggagccctgcagcaaggcctcctggacagtgcaggagggcgccaccagcgaggtgctggtggatgctgctgtggacctgatcagtgatgagtgggaggccgccaatgccatccccagcaagaggaggaagcaggatgctgcccccctggaggccgcctctgtgcccagcgctgactgtgagcagagcaagaagaagaagaggaagaagaagaagaagggcaacaagagcgccagcagcgagctggccagcctgcccctgagccctgccagcccctgccacctgaccctgctgagcaacccctggccccaggacacagccctgccccacagccaggcccagcagagcggccccaccggccagcccagccagcccccaggcacagccaccacccccctggagggagatggcctgagcgcccccacagaggtgggggacagccccctgcaggcccaggccctgggggaggccggcgtggccactggaagtgaggcccagagcagcccccagttccaggaccacacagaaggagaggaccaggatgccagcatccccagcggcggccggggcctgagccaggagggcaccggcccccccaccagcgctggggagggccacagcaggacagaagatgctgcccaggagctgctgctgcctgagagcaagggcggcagcagcgagcccggcacagagctgcagaccacagagcagcaggccggggccagcgcctccatggctgtggatgctgtggccgagcccgccaatgctgtgaagggggccggcaaggagatgaaggagaagacccagaggatgaagcagcccccagccaccaccccacccttcaagacccactgccaggaggccgagaccaagaccaaggatgagatggctgctgctgaggagaaggtgggcaagaatgagcagggcgagcctgaggacctgaagaagccagagggcaagaacagatctgctgctgctgtgaagaatgagaaggagcagaagaaccaggaggctgatgtgcaggaggtgaaggccagcaccctgagccctgggggcggcgtgacagtgttcttccacgccatcatcagcctgcacttccccttcaacccagacctgcacaaggtgttcatccggggcggggaggagtttggagagagcaagtgggacagcaacatctgtgagctgcactacacccgggacctgggccatgacagagtgctggtggagggcatcgtgtgcatcagcaagaagcacctggacaagtacatcccctacaagtatgtgatctacaatggagagagctttgaatatgagttcatctacaagcaccagcagaagaagggggagtatgtgaaccgctgcctcttcatcaagagcagcctgctgggcagcggggactggcaccagtactatgacatcgtgtacatgaagccccacggccgcctgcagaaggtgatgaaccacatcacagatggccccaggaaggacctggtgaagggcaagcagattgctgctgccctgatgctggacagcaccttcagcatcctgcagacctgggacaccatcaacctgaacagcttcttcacccagtttgagcagttctgctttgtgctgcagcagcccatgatctatgagggccaggcccagctgtggacagacctgcagtaccgggagaaggaggtgaagcgctacctgtggcagcacctgaagaagcacgtggtgcccctgcctgatggcaagagcacagacttcctgcctgtggactgccctgtgcgcagcaagctgaagacaggcctcatcgtgctgtttgtggtggagaagattgagctgctgctggagggcagcctggactggctgtgccacctgctgaccagtgatgccagcagcccagatgagttccaccgggacctgagccacatcctgggcatcccccagagctggaggctgtacctggtgaacctgtgccagcgctgcatggacaccaggacctacacctggctgggcgccctgcctgtgctgcactgctgcatggagctggcccccaggcacaaggatgcctggaggcagcctgaggacacctgggccgccctggagggcctgtccttcagccccttccgggagcagatgctggacaccagcagcctgctgcagttcatgagggagaagcagcacctgctgagcattgatgagcccctcttccgctcctggttcagcctgctgcccctgagccacctggtgatgtacatggagaacttcatcgagcacctgggccgcttccctgcccacatcctggactgcctgagcggcatctactaccgcctgcccggcctggagcaggtgctgaacacccaggatgtgcaggatgtgcagaatgtgcagaacatcctggagatgctgctgcggctgctggacacctacagagacaagatccctgaggaggccctgagccccagctacctgactgtgtgcctgaagctgcacgaggccatctgcagcagcaccaagctgctgaagttctatgagctgcctgccctgtctgctgagatcgtgtgcaggatgatccggctgctgagcctggtggacagcgctggccagagagatgaaacaggcaacaacagcgtgcagaccgtcttccagggcaccctggccgccaccaagcgctggctgcgggaggtgttcaccaagaacatgctgaccagcagcggggccagcttcacctacgtgaaggagattgaggtgtggaggcggctggtggagatccagtttcctgctgagcacggctggaaggagagcctgctgggggacatggagtggaggctgaccaaggaggagcccctgagccagatcacagcctactgcaacagctgctgggacaccaagggcctggaggacagcgtggccaagacctttgagaagtgcatcattgaagctgtgagcagcgcctgccagagccagaccagcatcctgcagggcttctcctacagcgacctgaggaagtttggcatcgtgctgtctgctgtgatcaccaagtcctggcccaggacagctgacaacttcaatgacatcctgaagcacctgctgaccctggctgatgtgaagcacgtgttccggctgtgtggcacagatgagaagatcctggccaacgtgacagaagatgccaagaggctgattgctgtggccgacagcgtgctgaccaaggtggtgggggacctgctgagcggcaccatcctggtgggccagctggagctgatcatcaagcacaagaaccagttcctggacatctggcagctgcgggagaagagcctgagcccccaggatgagcagtgtgctgtggaggaggccctggactggaggcgggaggagctgctgctgctgaagaaggagaagagatgtgtggacagcctgctgaagatgtgtggaaatgtgaagcacctgatccaggtggactttggagtgctggccgtgcgccacagccaggacctgagcagcaagaggctgaatgacacagtgacagtgcggctgagcaccagcagcaacagccagagggccacccactaccacctgagcagccaggtgcaggagatggccggcaagattgacctgctgcgggacagccacatcttccagctgttctggagggaggccgctgagcccctgtctgagcccaaggaggaccaggaggccgctgagctgctgtctgagcctgaggaggagagcgagcggcacatcctggagctggaggaggtgtatgactacctgtaccagcccagctacaggaagttcatcaagctgcaccaggacctgaagagcggggaggtgaccctggccgagattgatgtgatcttcaaggactttgtgaacaagtacacagacctggacagcgagctgaagatcatgtgcaccgtggaccaccaggaccagagggactggatcaaggacagagtggagcagatcaaggagtaccaccacctgcaccaggccgtgcacgccgccaaggtgatcctgcaggtgaaggagagcctgggcctgaatggagacttctctgtgctgaacaccctgctgaacttcacagacaactttgatgacttccggcgggagaccctggaccagatcaaccaggagctgatccaggccaagaagctgctgcaggacatcagcgaggcccgctgcaagggcctgcaggccctgagcctgaggaaggagttcatctgctgggtgcgggaggccctgggcggcatcaatgagctgaaggtgtttgtggacctggccagcatctctgctggagaaaatgacattgatgtggacagagtggcctgcttccatgatgctgtgcagggctacgccagcctgctcttcaagctggaccccagcgtggacttcagcgccttcatgaagcacctgaagaagctgtggaaggccctggacaaggaccagtacctgcccaggaagctgtgtgacagcgccaggaacctggagtggctgaagacagtgaatgaaagccacggctctgtggagaggagcagcctgaccctggccacagccatcaaccagaggggcatctacgtgatccaggcccccaagggcggccagaagatcagcccagacacagtgctgcacctgatcctgcctgagagccctggcagccatgaggagagccgggagtacagcctggaggaggtgaaggagctgctgaacaagctgatgctgatgtctgggaagaaggacaggaacaacacagaggtggagcgcttcagcgaggtgttctgcagcgtgcagaggctgagccaggccttcatcgacctgcacagcgctggcaacatgctgttccgcacctggatcgccatggcctactgcagccccaagcagggcgtgtccctgcagatggactttggcctggacctggtgacagagctgaaggagggcggagatgtgacagagctgctggccgccctgtgccggcagatggagcacttcctggacagctggaagagatttgtgacccagaagaggatggagcacttctacctgaacttctacacagctgagcagctggtgtacctgagcacagagctgaggaagcagcccccatctgatgctgccctgaccatgctgtccttcatcaagagcaactgcaccctgagagatgtgctgcgggcctctgtgggctgcggcagcgaggccgcccgctacaggatgagaagagtgatggaggagctgcccctgatgctgctgtctgagttcagcctggtggacaagctgcgcatcatcatggagcagagcatgcgctgcctgcctgccttcctgcctgactgcctggacctggagaccctgggccactgcctggcccacctggccggcatgggcggcagccctgtggagcgctgcctgccccggggcctgcaggtgggccagcccaacctggtggtgtgtggccacagcgaggtgctgcctgctgccctggccgtgtacatgcagacccccagccagcccctgcccacctatgatgaggtgctgctgtgcaccccagccaccacctttgaggaggtggccctgctgctgcggcgctgcctgaccctgggcagcctgggccacaaggtgtacagcctgctgtttgctgaccagctgtcctatgaggtggcccggcaggccgaggagctgttccacaacctgtgcacccagcagcaccgggaggactaccagctggtgatggtgtgtgatggagactgggagcactgctacctgcccagcgccttcagccagcacaaggtgtttgtgaccccccaggcccccctggaggccatccaggcctacctggccggccactacagagtgcccaagcagaccctgtctgctgctgctgtgttcaatgaccggctgtgtgtgggcatcgtggccagcgagagagctggggtgggcaagagcctgtatgtgaagaggctgcatgacaagatgaagatgcagctgaatgtgaagaatgtgcccctgaagaccatccggctgattgacccccaggtggatgagagccgggtgctgggcgccctgctgcccttcctggatgcccagtaccagaaggtgcctgtgctcttccacctggatgtgaccagctctgtgcagacaggcatctgggtgttcctgttcaagctgctgatcctgcagtacctgatggacatcaacgggaagatgtggctgaggaacccctgccacctgtacatcgtggagatcctggagaggaggacctctgtgcccagccgcagcagcagcgccctgcggaccagggtgccccagttctccttcctggacatcttccccaaggtgacctgcaggcctcccaaggaggtgattgacatggagctgagcgccctgcggagtgacacagagcccggcatggacctgtgggagttctgcagcgagaccttccagaggccctaccagtacctgcggcgcttcaaccagaaccaggacctggacaccttccagtaccaggagggctctgtggagggcaccccagaagaatgtctgcagcacttcctgttccactgtggggtcatcaaccccagctggagcgagctgaggaactttgcccgcttcctgaactaccagctgcgggactgtgaggccagcctcttctgcaaccccagcttcatcggggacaccctgcggggcttcaagaagtttgtggtgaccttcatgatcttcatggcccgggactttgccacccccagcctgcacaccagtgaccagagccctgggaagcacatggtgaccatggatggagtgcgggaggaggacctggcccccttcagcctgaggaagcgctgggagagcgagccccacccctacgtgttcttcaatgatgaccacaccaccatgaccttcatcggcttccacctgcagcccaacatcaatggatctgtggatgccatcagccacctgaccgggaaggtgatcaagagagatgtgatgacccgggacctgtaccagggcctgctgctgcagagggtgcccttcaacgtggactttgacaagctgcccaggcacaagaagctggagcggctgtgcctgaccctgggcatcccccaggccacagatcctgacaagacctatgagctgaccacagacaacatgctgaagatcctggccatcgagatgaggttccgctgtggcatccctgtgatcatcatgggagaaacaggctgcggcaagaccaggctcatcaagttcctgagtgacctgcggcggggcggcaccaatgctgacaccatcaagctggtgaaggtgcatggaggcaccacagctgacatgatctacagccgggtgcgggaggctgaaaatgtggcctttgccaacaaggaccagcaccagctggacaccatcctcttctttgatgaggccaacaccacagaggccatcagctgcatcaaggaggtgctgtgtgaccacatggtggatggccagcccctggctgaagattctggcctgcacatcatcgccgcctgcaacccctacaggaagcacagcgaggagatgatctgccgcctggagagcgctggcctgggctacagagtgtccatggaggagacagctgaccggctgggcagcatccccctgcggcagctggtgtacagagtgcacgccctgccccccagcctcatccccctggtgtgggactttggccagctgagtgatgtggccgagaagctgtacatccagcagatcgtgcagaggctggtggagagcatcagcctggatgaaaatggcaccagggtcatcacagaggtgctgtgtgccagccagggcttcatgaggaagacagaagatgaatgttcctttgtgtccctgagagatgtggagcgctgtgtgaaggtgttccgctggttccacgagcacagcgccatgctgctggcccagctgaatgccttcctgagcaagagctctgtgtccaagaaccacacagagcgggaccctgtgctgtggagcctgatgctggccatcggcgtgtgctaccacgccagcctggagaagaaggacagctacaggaaggccatcgcccgcttcttccccaagccctatgatgacagccggctgctgctggatgagatcacccgggcccaggacctcttcctggatggagtgcccctgaggaagaccatcgccaagaacctggccctgaaggaaaatgtgttcatgatggtggtgtgcatcgagctgaagatccccctcttcctggtgggcaagccaggcagcagcaagagcctggccaagaccatcgtggctgatgccatgcagggccctgctgcctacagcgacctcttccgcagcctgaagcaggtgcacctggtgtccttccagtgcagcccccacagcaccccccagggcatcatcagcaccttccggcagtgtgcccgcttccagcagggcaaggacctgcagcagtatgtgtctgtggtggtgctggatgaggtgggcctggccgaggacagccccaagatgcccctgaagaccctgcaccccctgctggaggatggctgcattgaagatgatcctgccccccacaagaaggtgggctttgtgggcatcagcaactgggccctggaccctgccaagatgaacagaggcatctttgtgtcccggggcagccccaatgaaacagagctgattgagagcgccaagggcatctgcagcagtgacatcctggtgcaggacagagtgcagggctactttgccagctttgccaaggcctatgagaccgtgtgcaagaggcaggacaaggagttcttcggcctgcgggactactacagcctcatcaagatggtgtttgctgctgccaaggccagcaacaggaagcccagcccccaggacatcgcccaggccgtgctgaggaacttcagcggcaaggatgacatccaggccctggacatcttcctggccaacctgcctgaggccaagtgcagcgaggaggtgagccccatgcagctgatcaagcagaacatcttcggccccagccagaaggtgcctggaggagagcaggaggatgctgagagccgctacctgctggtgctgaccaagaactacgtggccctgcagatcctgcagcagaccttctttgaaggagaccagcagcctgagatcatctttggaagtggcttccccaaggaccaggagtacacccagctgtgcaggaacatcaacagagtgaagatctgcatggagaccgggaagatggtgctgctgctgaacctgcagaacctgtatgagagcctgtatgatgccctgaaccagtactacgtgcacctgggcggccagaagtatgtggacctgggcctgggcacccaccgggtgaagtgccgggtgcaccccaacttccgcctcatcgtcatcgaggagaaggatgtggtgtacaagcacttccccatccccctcatcaaccggctggagaagcactacctggacatcaacacagtgctggagaagtggcagaagagcatcgtggaggagctgtgtgcctgggtggagaagttcatcaacgtgaaggcccaccacttccagaagaggcacaagtacagccccagtgatgtgttcatcggctaccacagtgatgcctgtgcctctgtggtgctgcaggtgattgagcggcagggcccccgggccctgacagaggagctgcaccagaaggtgtctgaggaggccaagagcatcctgctgaactgtgccaccccagatgctgtggtgcggctgagcgcctacagcctgggcggctttgctgctgagtggctgagccaggagtacttccaccggcagaggcacaacagctttgctgacttcctgcaggcccacctgcacacagctgacctggagagacatgccatcttcacagagatcaccaccttcagccggctgctgaccagccatgactgtgagatcctggagagcgaggtgacaggccgggcccccaagcccaccctgctgtggctgcagcagtttgacacagagtacagcttcctgaaggaggtgaggaactgcctgaccaacacagccaagtgcaagatcctgatcttccagacagactttgaagatggcatccgcagcgcccagctgattgccagcgccaagtacagcgtcatcaatgagatcaacaagatccgggagaatgaagatcgcatctttgtgtacttcatcaccaagctgagccgggtgggccggggcacagcctacgtgggcttccacggcggcctgtggcagagcgtgcacattgatgacctgcggcgcagcaccctgatggtgtctgatgtgacccggctgcagcacgtgaccatcagccagctgtttgcccctggggacctgcctgagctgggcctggagcacagagcagaagatggccacgaggaggccatggagacagaggccagcaccagcggggaggtggccgaggtggccgaggaggccatggagacagagagcagcgagaaggtgggcaaggagaccagcgagctgggcggcagtgatgtgtccatcctggacaccacccggctgctgcggagctgtgtgcagagcgctgtgggcatgctgcgggaccagaatgaaagctgcaccaggaacatgagaagagtggtgctgctgctgggcctgctgaatgaagatgatgcctgccacgccagcttcctgcgggtgtccaagatgaggctgagcgtcttcctgaagaagcaggaggagagccagttccaccccctggagtggctggcccgggaggcctgcaaccaggatgccctgcaggaggccggcaccttccgccacaccctgtggaagagggtgcagggcgctgtgacccccctgctggcctccatgatctccttcatcgacagagatggcaacctggagctgctgaccaggccagacaccccaccctgggcccgggacctgtggatgttcatcttcagtgacaccatgctgctgaacatccccctggtgatgaacaatgaaagacacaagggggagatggcctacatcgtggtgcagaaccacatgaacctgtctgaaaatgccagcaacaacgtgcccttctcctggaagatcaaggactacctggaggagctgtgggtgcaggcccagtacatcacagatgctgagggcctgcccaagaagtttgtggacatcttccagcagacccccctgggccgcttcctggcccagctgcatggagagccccagcaggagctgctgcagtgctacctgaaggacttcatcctgctgaccatgagggtgtccacagaggaggagctgaagttcctgcagatggccctgtggagctgcaccaggaagctgaaggccgccagcgaggcccctgaggaggaggtgtccctgccctgggtgcacctggcctaccagcgcttccgcagccggctgcagaacttcagccgcatcctgaccatctacccccaggtgctgcacagcctgatggaggcccgctggaaccacgagctggccggctgtgagatgaccctggatgcctttgctgccatggcctgcacagagatgctgaccaggaacaccctgaagcccagcccccaggcctggctgcagctggtgaagaacctgtccatgcccctggagctgatctgcagtgatgagcacatgcagggcagcggcagcctggcccaggccgtcatccgggaggtgcgggcccagtggagccgcatcttcagcacagccctgtttgtggagcacgtgctgctgggcacagagagccgggtgcctgagctgcagggcctggtgacagagcacgtgttcctgctggacaagtgcctgcgggagaacagtgatgtgaagacccacggcccctttgaggccgtgatgaggaccctgtgtgagtgcaaggagacagccagcaagaccctgagcagatttggcatccagccctgcagcatctgcctgggagatgccaaggaccctgtgtgcctgccctgtgaccacgtgcactgcctgcgctgcctgcgggcctggtttgccagcgagcagatgatctgcccctactgcctgacagccctgcctgatgagttcagccctgctgtgtcccaggcccaccgggaggccatcgagaagcacgcccgcttccggcagatgtgcaacagcttctttgtggacctggtgtccaccatctgcttcaaggacaatgcccctcctgagaaggaggtgattgagagcctgctgagcctgctgtttgtgcagaagggccgcctgagagatgctgcccagaggcactgtgagcacaccaagagcctgagccccttcaatgatgtggtggacaagacccctgtgatccgcagcgtcatcctgaagctgctgctgaagtacagcttccatgatgtgaaggactacatccaggagtacctgaccctgctgaagaagaaggccttcatcacagaggacaagacagagctgtacatgctgttcatcaactgcctggaggacagcatcctggagaagaccagcgcctacagcagaaatgatgagctgaaccacctggaggaggagggccgcttcctgaaggcctacagccctgccagccggggccgggagcccgccaatgaggcctctgtggagtacctgcaggaggtggcccgcatccggctgtgcctggacagagctgctgacttcctgtctgagcctgagggcggccctgagatggccaaggagaagcagtgctacctgcagcaggtgaagcagttctgcatccgggtggagaatgactggcaccgggtgtacctggtgaggaagctgagcagccagaggggcatggagtttgtgcagggcctgagcaagccaggccggccccaccagtgggtgttccccaaggatgtggtgaagcagcagggcctgcggcaggaccaccctggccagatggaccgctacctggtgtatggagatgagtacaaggccctgagagatgctgtggccaaggctgtgctggagtgcaagcccctgggcatcaagacagccctgaaggcctgcaagaccccccagagccagcagagcgcctacttcctgctgaccctcttccgggaggtggccatcctgtaccgcagccacaatgccagcctgcaccccaccccagagcagtgtgaggccgtgtccaagttcatcggggagtgcaagatcctgagccccccagacatcagcagatttgccaccagcctggtggacaacagcgtgcccctgctgcgggccggccccagcgacagcaacctggatggcaccgtgacagagatggccatccatgctgctgctgtgctgctgtgtggccagaatgagctgctggagcccctgaagaacctggccttctccccagccaccatggcccacgccttcctgcccaccatgcctgaggacctgctggcccaggcccggcgctggaagggcctggagcgggtgcactggtacacctgccccaacggccacccctgcagcgtgggggagtgtggccggcccatggagcagagcatctgcatcgactgccacgcccccatcggcggcatcgaccacaagcccagagatggcttccacctggtgaaggacaaggctgacaggacccagacaggccacgtgctgggcaacccccagaggagagatgtggtgacctgtgaccggggcctgccccctgtggtgttcctgctgatccggctgctgacccacctggccctgctgctgggcgccagccagagcagccaggccctgatcaacatcatcaagccccctgtgcgggaccccaagggcttcctgcagcagcacatcctgaaggacctggagcagctggccaagatgctgggccacagcgcagatgagaccatcggcgtggtgcacctggtgctgcggcggctgctgcaggagcagcaccagctgagcagccggcggctgctgaactttgacacagagctgagcaccaaggagatgaggaacaactgggagaaggagattgctgctgtgatcagccctgagctggagcacctggacaagaccctgcccaccatgaacaacctgatcagccaggacaagaggatcagcagcaaccctgtggccaagatcatctacggggaccctgtgaccttcctgccccacctgcccaggaagtctgtggtgcactgcagcaagatctggagctgcaggaagaggatcaccgtggagtacctgcagcacatcgtggagcagaagaatggcaaggagcgggtgcccatcctgtggcacttcctgcagaaggaggccgagctgcggctggtgaagttcctgcctgagatcctggccctgcagagggacctggtgaagcagttccagaatgtgcagcaggtggagtacagcagcatccggggcttcctgagcaagcacagcagtgatggcctgcggcagctgctgcacaaccgcatcaccgtcttcctgagcacctggaacaagctgcggcgcagcctggagaccaatggagagatcaacctgcccaaggactactgcagcacagacctggacctggacacagaatttgagatcctgctgccccggcggcggggcctgggcctgtgtgccacagccctggtgtcctacctgatccggctgcacaatgaaattgtgtatgctgtggagaagctgagcaaagaaaacaacagctacagcgtggatgctgctgaggtgacagagctgcacgtgatctcctatgaggtggagcgggacctgacccccctcatcctgagcaactgccagtaccaggtggaggagggccgggagaccgtgcaggagtttgacctggagaagatccagaggcagatcgtgagccgcttcctgcagggcaagccccggctgagcctgaagggcatccccaccctggtgtacagacatgactggaactatgagcacctgttcatggacatcaagaacaagatggcccaggacagcctgcccagcagcgtcatcagcgccatcagcggccagctgcagagctacagtgatgcctgtgaggtgctgtctgtggtggaggtgaccctgggcttcctgagcacagctggaggagaccccaacatgcagctgaatgtgtacacccaggacatcctgcagatgggagaccagaccatccacgtgctgaaggccctgaaccgctgccagctgaagcacaccatcgccctgtggcagttcctgagcgcccacaagtctgagcagctgctgcggctgcacaaggagccctttggagagatcagcagccgctacaaggctgacctgagcccagaaaatgccaagctgctgagcaccttcctgaaccagacaggcctggatgccttcctgctggagctgcacgagatgatcatcctgaagctgaagaacccccagacccagacagaggagcgcttccggccccagtggagcctgcgggacaccctggtgtcctacatgcagaccaaggagagcgagatcctgcctgagatggccagccagtttcctgaggagatcctgctggccagctgtgtgtctgtgtggaagacagctgctgtgctgaagtggaaccgggagatgaggtag

SEQ ID NO: 168474 - DNA, 15624 bp, Artificial Sequence
  Description of Artificial Sequence: Synthetic coding sequence
atggagtgccccagctgccagcacgtgtccaaggaggagacccccaagttctgcagccagtgtggggagcggctgcccccagctgcccccatcgctgacagcgagaacaacaacagcaccatggccagcgccagcgagggggagatggagtgtggccaggagctgaaggaggagggcggcccctgcctcttccctggcagtgacagctggcaggagaaccctgaggagccctgcagcaaggcctcctggacagtgcaggagagcaagaagaagaagaggaagaagaagaagaagggcaacaagagcgccagcagcgagctggccagcctgcccctgagccctgccagcccctgccacctgaccctgctgagcaacccctggccccaggacacagccctgccccacagccaggcccagcagagcggccccaccggccagcccagccagcccccaggcacagccaccacccccctggagggagatggcctgagcgcccccacagaggtgggggacagccccctgcaggcccaggccctgggggaggccggcgtggccaccggcagcgaggcccagagcagcccccagttccaggaccacacagaaggagaggaccaggatgccagcatccccagcggcggccggggcctgagccaggagggcactggaccacccaccagcgctggggagggccacagcaggacagaagatgctgcccaggagctgctgctgcctgagagcaaaggaggcagcagcgagcctggaacagagctgcagaccacagagcagcaggccggggccagcgcctccatggctgtggatgctgtggccgagcccgccaatgctgtgaagggagctgggaaggagatgaaggagaagacccagaggatgaagcagcccccagccaccaccccacccttcaagacccactgccaggaggccgagaccaagaccaaggatgagatggctgctgctgaggagaaggtgggcaagaatgagcagggcgagcctgaggacctgaagaagccagagggcaagaacagatctgctgctgctgtgaagaatgagaaggagcagaagaaccaggaggctgatgtgcaggaggtgaaggccagcaccctgagccctgggggcggcgtgaccgtcttcttccacgccatcatcagcctgcacttccccttcaacccagacctgcacaaggtgttcatccggggcggggaggagtttggagagagcaagtgggacagcaacatctgtgagctgcactacacccgggacctgggccatgacagagtgctggtggagggcatcgtgtgcatcagcaagaagcacctggacaagtacatcccctacaagtatgtgatctacaacggggagagctttgaatatgagttcatctacaagcaccagcagaagaagggggagtatgtgaaccgctgcctcttcatcaagagcagcctgctgggcagcggggactggcaccagtactatgacatcgtgtacatgaagccccacggccgcctgcagaaggtgatgaaccacatcacagatggccccaggaaggacctggtgaagggcaagcagattgctgctgccctgatgctggacagcaccttcagcatcctgcagacctgggacaccatcaacctgaacagcttcttcacccagtttgagcagttctgctttgtgctgcagcagcccatgatctatgagggccaggcccagctgtggacagacctgcagtaccgggagaaggaggtgaagcgctacctgtggcagcacctgaagaagcacgtggtgcccctgcctgatggcaagagcacagacttcctgcctgtggactgccctgtgcgcagcaagctgaagacaggcctgattgtgctgtttgtggtggagaagattgagctgctgctggagggcagcctggactggctgtgccacctgctgaccagtgatgccagcagcccagatgagttccaccgggacctgagccacatcctgggcatcccccagagctggaggctgtacctggtgaacctgtgccagcgctgcatggacaccaggacctacacctggctgggcgccctgcctgtgctgcactgctgcatggagctggcccccaggcacaaggatgcctggaggcagcctgaggacacctgggccgccctggagggcctgtccttcagccccttccgggagcagatgctggacaccagcagcctgctgcagttcatgagggagaagcagcacctgctgagcattgatgagcccctcttccgctcctggttcagcctgctgcccctgagccacctggtgatgtacatggagaacttcatcgagcacctgggccgcttccctgcccacatcctggactgcctgagcggcatctactaccgcctgcccggcctggagcaggtgctgaacacccaggatgtgcaggatgtgcagaatgtgcagaacatcctggagatgctgctgcggctgctggacacctacagagacaagatccctgaggaggccctgagccccagctacctgactgtgtgcctgaagctgcacgaggccatctgcagcagcaccaagctgctgaagttctatgagctgcctgccctgtctgctgagatcgtgtgcaggatgatccggctgctgagcctggtggacagcgctggccagagagatgagaccggcaacaacagcgtgcagacagtgttccagggcaccctggccgccaccaagcgctggctgcgggaggtgttcaccaagaacatgctgaccagcagcggggccagcttcacctacgtgaaggagattgaggtgtggaggcggctggtggagatccagtttcctgctgagcacggctggaaggagagcctgctgggggacatggagtggaggctgaccaaggaggagcccctgagccagatcacagcctactgcaacagctgctgggacaccaagggcctggaggacagcgtggccaagacctttgagaagtgcatcatcgaggccgtgtcctctgcctgccagagccagaccagcatcctgcagggcttctcctacagcgacctgaggaagtttggaattgtgctgtctgctgtgatcaccaagtcctggcccaggacagctgacaacttcaatgacatcctgaagcacctgctgaccctggctgatgtgaagcacgtgttccggctgtgtggcacagatgagaagatcctggccaacgtgacagaagatgccaagaggctgattgctgtggccgacagcgtgctgaccaaggtggtgggggacctgctgagcggcaccatcctggtgggccagctggagctgatcatcaagcacaagaaccagttcctggacatctggcagctgcgggagaagagcctgagcccccaggatgagcagtgtgctgtggaggaggccctggactggaggcgggaggagctgctgctgctgaagaaggagaagagatgtgtggacagcctgctgaagatgtgtggaaatgtgaagcacctgatccaggtggactttggagtgctggccgtgcgccacagccaggacctgagcagcaagaggctgaatgacacagtgacagtgcggctgagcaccagcagcaacagccagagggccacccactaccacctgagcagccaggtgcaggagatggccggcaagattgacctgctgcgggacagccacatcttccagctgttctggagggaggccgctgagcccctgtctgagcccaaggaggaccaggaggccgctgagctgctgtctgagcctgaggaggagagcgagcggcacatcctggagctggaggaggtgtatgactacctgtaccagcccagctacaggaagttcatcaagctgcaccaggacctgaagtctggagaggtgaccctggccgagattgatgtgatcttcaaggactttgtgaacaagtacacagacctggacagcgagctgaagatcatgtgcaccgtggaccaccaggaccagagggactggatcaaggacagagtggagcagatcaaggagtaccaccacctgcaccaggccgtgcatgctgccaaggtgatcctgcaggtgaaggagagcctgggcctgaatggagacttctctgtgctgaacaccctgctgaacttcacagacaactttgatgacttcagaagagagaccctggaccagatcaaccaggagctgatccaggccaagaagctgctgcaggacatcagcgaggcccgctgcaagggcctgcaggccctgagcctgaggaaggagttcatctgctgggtgcgggaggccctgggcggcatcaatgagctgaaggtgtttgtggacctggccagcatctctgctggggagaatgacattgatgtggacagagtggcctgcttccatgatgctgtgcagggctacgccagcctgctcttcaagctggaccccagcgtggacttcagcgccttcatgaagcacctgaagaagctgtggaaggccctggacaaggaccagtacctgcccaggaagctgtgtgacagcgccaggaacctggagtggctgaagacagtgaatgaaagccacggctctgtggagaggagcagcctgaccctggccacagccatcaaccagaggggcatctacgtgatccaggcccccaagggcggccagaagatcagcccagacacagtgctgcacctgatcctgcctgagagccctggcagccatgaggagagccgggagtacagcctggaggaggtgaaggagctgctgaacaagctgatgctgatgtctgggaagaaggacaggaacaacacagaggtggagcgcttcagcgaggtgttctgcagcgtgcagaggctgagccaggccttcatcgacctgcacagcgctggcaacatgctgttccgcacctggatcgccatggcctactgcagccccaagcagggcgtgtccctgcagatggactttggcctggacctggtgacagagctgaaggagggcggagatgtgacagagctgctggccgccctgtgccggcagatggagcacttcctggacagctggaagagatttgtgacccagaagaggatggagcacttctacctgaacttctacacagctgagcagctggtgtacctgagcacagagctgaggaagcagcccccatctgatgctgccctgaccatgctgtccttcatcaagagcaactgcaccctgagagatgtgctgcgggcctctgtgggctgcggcagcgaggccgcccgctacaggatgagaagagtgatggaggagctgcccctgatgctgctgtctgagttcagcctggtggacaagctgcgcatcatcatggagcagagcatgcgctgcctgcctgccttcctgcctgactgcctggacctggagaccctgggccactgcctggcccacctggccggcatgggcggcagccctgtggagcgctgcctgccccggggcctgcaggtgggccagcccaacctggtggtgtgtggccacagcgaggtgctgcctgctgccctggccgtgtacatgcagacccccagccagcccctgcccacctatgatgaggtgctgctgtgcaccccagccaccacctttgaggaggtggccctgctgctgcggcgctgcctgaccctgggcagcctgggccacaaggtgtacagcctgctgtttgctgaccagctgtcctatgaggtggcccggcaggccgaggagctgttccacaacctgtgcacccagcagcaccgggaggactaccagctggtgatggtgtgtgatggagactgggagcactgctacctgcccagcgccttcagccagcacaaggtgtttgtgaccccccaggcccccctggaggccatccaggcctacctggccggccactacagagtgcccaagcagaccctgtctgctgctgctgtgttcaatgaccggctgtgtgtgggcatcgtggccagcgagcgggccggcgtgggcaagagcctgtatgtgaagaggctgcatgacaagatgaagatgcagctgaatgtgaagaatgtgcccctgaagaccatccggctgattgacccccaggtggatgagagccgggtgctgggcgccctgctgcccttcctggatgcccagtaccagaaggtgcctgtgctcttccacctggatgtgaccagctctgtgcagacaggcatctgggtgttcctgttcaagctgctgatcctgcagtacctgatggacatcaatggcaagatgtggctgaggaacccctgccacctgtacatcgtggagatcctggagaggaggacctctgtgcccagccgcagcagcagcgccctgcggaccagggtgccccagttctccttcctggacatcttccccaaggtgacctgccggccccccaaggaggtgattgacatggagctgagcgccctgcggagtgacacagagcccggcatggacctgtgggagttctgcagcgagaccttccagaggccctaccagtacctgcggcgcttcaaccagaaccaggacctggacaccttccagtaccaggagggctctgtggagggcaccccagaggagtgcctgcagcacttcctgttccactgtggggtcatcaaccccagctggagcgagctgaggaactttgcccgcttcctgaactaccagctgcgggactgtgaggccagcctcttctgcaaccccagcttcatcggggacaccctgcggggcttcaagaagtttgtggtgaccttcatgatcttcatggcccgggactttgccacccccagcctgcacaccagtgaccagagccctgggaagcacatggtgaccatggatggagtgcgggaggaggacctggcccccttcagcctgaggaagcgctgggagagcgagccccacccctacgtgttcttcaatgatgaccacaccaccatgaccttcatcggcttccacctgcagcccaacatcaatggatctgtggatgccatcagccacctgaccgggaaggtgatcaagagagatgtgatgacccgggacctgtaccagggcctgctgctgcagagggtgcccttcaacgtggactttgacaagctgcccaggcacaagaagctggagcggctgtgcctgaccctgggcatcccccaggccacagatcctgacaagacctatgagctgaccacagacaacatgctgaagatcctggccatcgagatgaggttccgctgtggcatccctgtgatcatcatgggagagaccggctgtgggaagaccaggctcatcaagttcctgagtgacctgcggcggggcggcaccaatgctgacaccatcaagctggtgaaggtgcacggcggcaccacagctgacatgatctacagccgggtgcgggaggccgagaatgtggcctttgccaacaaggaccagcaccagctggacaccatcctcttctttgatgaggccaacaccacagaggccatcagctgcatcaaggaggtgctgtgtgaccacatggtggatggccagcccctggccgaggacagcggcctgcacatcatcgccgcctgcaacccctacaggaagcacagcgaggagatgatctgccgcctggagagcgctggcctgggctacagagtgtccatggaggagacagctgaccggctgggcagcatccccctgcggcagctggtgtacagagtgcacgccctgccccccagcctcatccccctggtgtgggactttggccagctgagtgatgtggccgagaagctgtacatccagcagatcgtgcagaggctggtggagagcatcagcctggatgaaaatggcaccagggtcatcacagaggtgctgtgtgccagccagggcttcatgaggaagacagaagatgagtgcagctttgtgtccctgagagatgtggagcgctgtgtgaaggtgttccgctggttccacgagcacagcgccatgctgctggcccagctgaatgccttcctgagcaagagctctgtgtccaagaaccacacagagcgggaccctgtgctgtggagcctgatgctggccatcggcgtgtgctaccacgccagcctggagaagaaggacagctacaggaaggccatcgcccgcttcttccccaagccctatgatgacagccggctgctgctggatgagatcacccgggcccaggacctcttcctggatggagtgcccctgaggaagaccatcgccaagaacctggccctgaaggaaaatgtgttcatgatggtggtgtgcatcgagctgaagatccccctcttcctggtgggcaagccaggcagcagcaagagcctggccaagaccatcgtggctgatgccatgcagggccctgctgcctacagcgacctcttccgcagcctgaagcaggtgcacctggtgtccttccagtgcagcccccacagcaccccccagggcatcatcagcaccttccggcagtgtgcccgcttccagcagggcaaggacctgcagcagtatgtgtctgtggtggtgctggatgaggtgggcctggccgaggacagccccaagatgcccctgaagaccctgcaccccctgctggaggatggctgcattgaagatgatcctgccccccacaagaaggtgggctttgtgggcatcagcaactgggccctggaccctgccaagatgaacagaggcatctttgtgtcccggggcagccccaatgaaacagagctgattgaaagtgccaagggcatctgcagcagtgacatcctggtgcaggacagagtgcagggctactttgccagctttgccaaggcctatgaaacagtgtgcaagaggcaggacaaggagttcttcggcctgcgggactactacagcctcatcaagatggtgtttgctgctgccaaggccagcaacaggaagcccagcccccaggacatcgcccaggccgtgctgaggaacttcagcggcaaggatgacatccaggccctggacatcttcctggccaacctgcctgaggccaagtgcagcgaggaggtgagccccatgcagctgatcaagcagaacatcttcggccccagccagaaggtgcctggaggagagcaggaggatgctgagagccgctacctgctggtgctgaccaagaactacgtggccctgcagatcctgcagcagaccttctttgaaggagaccagcagcctgagatcatcttcggcagcggcttccccaaggaccaggagtacacccagctgtgcaggaacatcaacagagtgaagatctgcatggagaccgggaagatggtgctgctgctgaacctgcagaacctgtatgagagcctgtatgatgccctgaaccagtactacgtgcacctgggcggccagaagtatgtggacctgggcctgggcacccaccgggtgaagtgccgggtgcaccccaacttccggctgattgtgattgaggagaaggatgtggtgtacaagcacttccccatccccctcatcaaccggctggagaagcactacctggacatcaacacagtgctggagaagtggcagaagagcatcgtggaggagctgtgtgcctgggtggagaagttcatcaacgtgaaggcccaccacttccagaagaggcacaagtacagccccagtgatgtgttcatcggctaccacagtgatgcctgtgcctctgtggtgctgcaggtgattgaaaggcagggcccccgggccctgacagaggagctgcaccagaaggtgtctgaggaggccaagagcatcctgctgaactgtgccaccccagatgctgtggtgcggctgagcgcctacagcctgggcggctttgctgctgagtggctgagccaggagtacttccaccggcagaggcacaacagctttgctgacttcctgcaggcccacctgcacacagctgacctggagagacatgccatcttcacagagatcaccaccttcagccggctgctgaccagccatgactgtgagatcctggagagcgaggtgacaggccgggcccccaagcccaccctgctgtggctgcagcagtttgacacagagtacagcttcctgaaggaggtgaggaactgcctgaccaacacagccaagtgcaagatcctgatcttccagacagactttgaagatggcatccgcagcgcccagctgattgccagcgccaagtacagcgtcatcaatgagatcaacaagatcagagaaaatgaagatcgcatctttgtgtacttcatcaccaagctgagccgggtgggccggggcacagcctacgtgggcttccatggaggcctgtggcagagcgtgcacattgatgacctgcggcgcagcaccctgatggtgtctgatgtgacccggctgcagcacgtgaccatcagccagctgtttgcccctggggacctgcctgagctgggcctggagcacagagcagaagatggccacgaggaggccatggagacagaggccagcaccagcggggaggtggccgaggtggccgaggaggccatggagacagagagcagcgagaaggtgggcaaggagaccagcgagctgggcggcagtgatgtgtccatcctggacaccacccggctgctgcggagctgtgtgcagagcgctgtgggcatgctgcgggaccagaatgaaagctgcaccaggaacatgagaagagtggtgctgctgctgggcctgctgaatgaagatgatgcctgccacgccagcttcctgcgggtgtccaagatgaggctgtctgtgttcctgaagaagcaggaggagagccagttccaccccctggagtggctggcccgggaggcctgcaaccaggatgccctgcaggaggccggcaccttccgccacaccctgtggaagagggtgcagggcgctgtgacccccctgctggcctccatgatctccttcatcgacagagatggcaacctggagctgctgaccaggccagacaccccaccctgggcccgggacctgtggatgttcatcttcagtgacaccatgctgctgaacatccccctggtgatgaacaatgaaagacacaagggggagatggcctacatcgtggtgcagaaccacatgaacctgtctgaaaatgccagcaacaacgtgcccttctcctggaagatcaaggactacctggaggagctgtgggtgcaggcccagtacatcacagatgctgagggcctgcccaagaagtttgtggacatcttccagcagacccccctgggccgcttcctggcccagctgcacggggagccccagcaggagctgctgcagtgctacctgaaggacttcatcctgctgaccatgagggtgtccacagaggaggagctgaagttcctgcagatggccctgtggagctgcaccaggaagctgaaggccgccagcgaggcccctgaggaggaggtgtccctgccctgggtgcacctggcctaccagcgcttccgcagccggctgcagaacttcagccgcatcctgaccatctacccccaggtgctgcacagcctgatggaggcccgctggaaccacgagctggccggctgtgagatgaccctggatgcctttgctgccatggcctgcacagagatgctgaccaggaacaccctgaagcccagcccccaggcctggctgcagctggtgaagaacctgtccatgcccctggagctgatctgcagtgatgagcacatgcagggcagcggcagcctggcccaggccgtcatccgggaggtgcgggcccagtggagccgcatcttcagcacagccctgtttgtggagcacgtgctgctgggcacagagagccgggtgcctgagctgcagggcctggtgacagaacatgtgttcctgctggacaagtgcctgagagaaaattctgatgtgaagacccacggcccctttgaagctgtgatgaggaccctgtgtgagtgcaaggagacagccagcaagaccctgagccgcttcggcatccagccctgcagcatctgcctgggagatgccaaggaccctgtgtgcctgccctgtgaccacgtgcactgcctgcgctgcctgcgggcctggtttgccagcgagcagatgatctgcccctactgcctgacagccctgcctgatgagttctccccagctgtgtcccaggcccaccgggaggccatcgagaagcacgcccgcttccggcagatgtgcaacagcttctttgtggacctggtgtccaccatctgcttcaaggacaatgcccctcctgagaaggaggtgattgagagcctgctgagcctgctgtttgtgcagaagggccgcctgagagatgctgcccagaggcactgtgagcacaccaagagcctgagccccttcaatgatgtggtggacaagacccctgtgatccgcagcgtcatcctgaagctgctgctgaagtacagcttccatgatgtgaaggactacatccaggagtacctgaccctgctgaagaagaaggccttcatcacagaggacaagacagagctgtacatgctgttcatcaactgcctggaggacagcatcctggagaagaccagcgcctacagcagaaatgatgagctgaaccacctggaggaggagggccgcttcctgaaggcctacagccctgccagccggggccgggagcccgccaatgaggcctctgtggagtacctgcaggaggtggcccgcatccggctgtgcctggacagagctgctgacttcctgtctgagcctgagggcggccctgagatggccaaggagaagcagtgctacctgcagcaggtgaagcagttctgcatccgggtggagaatgactggcaccgggtgtacctggtgaggaagctgagcagccagaggggcatggagtttgtgcagggcctgagcaagccaggccggccccaccagtgggtgttccccaaggatgtggtgaagcagcagggcctgcggcaggaccaccctggccagatggaccgctacctggtgtatggagatgagtacaaggccctgagagatgctgtggccaaggctgtgctggagtgcaagcccctgggcatcaagacagccctgaaggcctgcaagaccccccagagccagcagagcgcctacttcctgctgaccctcttccgggaggtggccatcctgtaccgcagccacaatgccagcctgcaccccaccccagagcagtgtgaggccgtgtccaagttcatcggggagtgcaagatcctgagccccccagacatcagcagatttgccaccagcctggtggacaacagcgtgcccctgctgcgggccggccccagcgacagcaacctggatggcaccgtgacagagatggccatccacgccgctgctgtgctgctgtgtggccagaatgagctgctggagcccctgaagaacctggccttcagccctgccaccatggcccacgccttcctgcccaccatgcctgaggacctgctggcccaggcccggcgctggaagggcctggagcgggtgcactggtacacctgccccaacggccacccctgcagcgtgggagaatgtggccggcccatggagcagagcatctgcatcgactgccacgcccccatcggcggcatcgaccacaagcccagagatggcttccacctggtgaaggacaaggctgacaggacccagacaggccacgtgctgggcaacccccagaggagagatgtggtgacctgtgaccggggcctgccccctgtggtgttcctgctgatccggctgctgacccacctggccctgctgctgggcgccagccagagcagccaggccctgatcaacatcatcaagccccctgtgcgggaccccaagggcttcctgcagcagcacatcctgaaggacctggagcagctggccaagatgctgggccacagcgcagatgagaccatcggcgtggtgcacctggtgctgcggcggctgctgcaggagcagcaccagctgagcagccggcggctgctgaactttgacacagagctgagcaccaaggagatgaggaacaactgggagaaggagattgctgctgtgatcagccctgagctggagcacctggacaagaccctgcccaccatgaacaacctgatcagccaggacaagaggatcagcagcaaccctgtggccaagatcatctatggagaccctgtgaccttcctgccccacctgcccaggaagtctgtggtgcactgcagcaagatctggagctgcaggaagaggatcaccgtggagtacctgcagcacatcgtggagcagaagaatggcaaggagcgggtgcccatcctgtggcacttcctgcagaaggaggccgagctgcggctggtgaagttcctgcctgagatcctggccctgcagagggacctggtgaagcagttccagaatgtgcagcaggtggagtacagcagcatccggggcttcctgagcaagcacagcagtgatggcctgcggcagctgctgcacaaccgcatcaccgtcttcctgagcacctggaacaagctgcggcgcagcctggagaccaacggggagatcaacctgcccaaggactactgcagcacagacctggacctggacacagaatttgagatcctgctgcccaggagaagaggcctgggcctgtgtgccacagccctggtgtcctacctgatccggctgcacaatgagatcgtgtatgctgtggagaagctgagcaaggagaacaacagctacagcgtggatgctgctgaggtgacagagctgcacgtgatctcctatgaggtggagcgggacctgacccccctcatcctgagcaactgccagtaccaggtggaggagggccgggagaccgtgcaggagtttgacctggagaagatccagaggcagatcgtgagccgcttcctgcagggcaagccccggctgagcctgaagggcatccccaccctggtgtacagacatgactggaactatgagcacctgttcatggacatcaagaacaagatggcccaggacagcctgcccagcagcgtcatcagcgccatcagcggccagctgcagagctacagtgatgcctgtgaggtgctgtctgtggtggaggtgaccctgggcttcctgagcacagctggaggagaccccaacatgcagctgaatgtgtacacccaggacatcctgcagatgggagaccagaccatccacgtgctgaaggccctgaaccgctgccagctgaagcacaccatcgccctgtggcagttcctgagcgcccacaagtctgagcagctgctgcggctgcacaaggagccctttggagagatcagcagccgctacaaggctgacctgagcccagaaaatgccaagctgctgagcaccttcctgaaccagacaggcctggatgccttcctgctggagctgcacgagatgatcatcctgaagctgaagaacccccagacccagacagaggagcgcttccggccccagtggagcctgcgggacaccctggtgtcctacatgcagaccaaggagagcgagatcctgcctgagatggccagccagtttcctgaggagatcctgctggccagctgtgtgtctgtgtggaagacagctgctgtgctgaagtggaaccgggagatgaggtag

SEQ ID NO: 168475 - DNA, 2772 bp, Artificial Sequence
  Description of Artificial Sequence: Synthetic coding sequence
atggaggagggcaacaacaatgaggaggtgatccacctgaacaacttccactgccaccggggccaggagtggatcaacctgagagatggccccatcaccatcagtgacagcagtgatgaggagcgcatccccatgctggtgaccccagccccccagcagcacgaggaggaggacctggatgatgatgtgatcctgacagagaccaacaagccccagaggagccggcccaacctgatcaagccagctgcccagtggcaggacctgaagaggctgggggaggagcggcccaagaagagcagagctgcctttgaaagtgacaagagcagctacttctctgtgtgcaacaaccccctgtttgattctggggcccaggatgattctgaagatgattatggagagttcctggacctgggccccccaggcatcagcgagttcaccaagcccagcggccagacagagcgggagcccaagccaggccccagccacaaccaggccgccaatgacatcgtgaaccccaggtctgagcagaaggtgatcatcctggaggagggcagcctgctgtacacagaaagtgaccccctggagacccagaaccagagcagcgaggacagcgagacagagctgctgagcaacctgggggagagcgctgccctggctgatgaccaggccatcgaggaggactgctggctggaccacccctacttccagagcctgaaccagcagccccgggagatcaccaaccaggtggtgccccaggagcggcagcctgaggccgagctgggccgcctgctcttccagcacgagttccctggccctgccttccccaggcctgagccccagcagggcggcatcagcggccccagcagcccccagcctgcccaccccctgggggagtttgaggaccagcagctggccagtgatgatgaggagcccggccctgccttccccatgcaggagagccaggagcccaacctggagaacatctggggccaggaggccgctgaggtggaccaggagctggtggagctgctggtgaaggagacagaggcccgcttcccagatgtggccaacggcttcatcgaggagatcatccacttcaagaactactatgacctgaatgtgctgtgcaacttcctgctggagaacccagactaccccaagagagaagatcgcatcatcatcaaccccagcagcagcctgctggccagccaggatgagaccaagctgcccaagattgacttctttgactacagcaagctgacccccctggaccagcgctgcttcatccaggccgctgacctgctgatggctgacttcaaggtgctgagcagccaggacatcaagtgggccctgcacgagctgaagggccactacgccatcaccaggaaggccctgagtgatgccatcaagaagtggcaggagctgagccctgagaccagcggcaagaggaagaagaggaagcagatgaaccagtacagctacatcgacttcaagtttgagcagggcgacatcaagattgagaagaggatgttcttcctggagaacaagagaagacactgccgctcctatgacagaagagccctgctgcctgctgtgcagcaggagcaggagttctatgagcagaagatcaaggagatggccgagcacgaggacttcctgctggccctgcagatgaatgaggagcagtaccagaaggatggccagctgattgaatgtcgctgctgctacggggagttcccctttgaggagctgacccagtgtgctgatgcccacctgttctgcaaggagtgcctgatccgctatgcccaggaggccgtgtttggaagtggcaagctggagctgagctgcatggagggcagctgcacctgcagcttccccaccagcgagctggagaaggtgctgccccagaccatcctgtacaagtactatgaaaggaaggccgaggaggaggtggccgccgcctatgcagatgagctggtgcgctgccccagctgcagcttccctgccctgctggacagtgatgtgaagcgcttcagctgccccaacccccactgcaggaaggagacctgcaggaagtgccagggcctgtggaaggagcacaacggcctgacctgtgaggagctggccgagaaggatgacatcaagtaccgcaccagcattgaggagaagatgacagctgcccgcatcaggaagtgccacaagtgtggcaccggcctcatcaagtctgagggctgcaacaggatgagctgccgctgtggggcccagatgtgctacctgtgccgggtgtccatcaatggctatgaccacttctgccagcaccccaggagccctggggccccctgccaggagtgcagccgctgcagcctgtggacagaccccacagaagatgatgagaagctgattgaggagatccagaaggaggccgaggaggagcagaagaggaagaatggagagaacaccttcaagagaattggcccccccctggagaagcctgtggagaaggtgcagagggtggaggccctgcccaggcctgtgccccagaacctgccccagccccagatgccaccctatgcctttgcccacccccccttccccctgccccctgtgcggcctgtgttcaacaacttccccctgaacatgggccccatcccagccccctacgtgccccccctgcccaacgtgcgggtgaactatgactttggccccatccacatgcccctggagcacaacctgcccatgcacttcggcccccagcccaggcaccgcttctag

SEQ ID NO: 168476 - DNA, 63 bp, Artificial Sequence
  Description of Artificial Sequence: Synthetic coding sequence
atggaggagggcaacaacaatgaggaggtgatccacctgaacaacttccactgccacaggtag

SEQ ID NO: 168477 - DNA, 2601 bp, Artificial Sequence
  Description of Artificial Sequence: Synthetic coding sequence
atggaggagggcaacaacaatgaggaggtgatccacctgaacaacttccactgccaccggggccaggagtggatcaacctgagagatggccccatcaccatcagtgacagcagtgatgaggagcgcatccccatgctggtgaccccagccccccagcagcacgaggaggaggacctggatgatgatgtgatcctgacagaagatgacagtgaagatgattatggagagttcctggacctgggccccccaggcatcagcgagttcaccaagcccagcggccagacagagcgggagcccaagccaggccccagccacaaccaggccgccaatgacatcgtgaaccccaggtctgagcagaaggtgatcatcctggaggagggcagcctgctgtacacagaaagtgaccccctggagacccagaaccagagcagtgaagattctgaaacagagctgctgagcaacctgggggagagcgctgccctggctgatgaccaggccatcgaggaggactgctggctggaccacccctacttccagagcctgaaccagcagccccgggagatcaccaaccaggtggtgccccaggagcggcagcctgaggccgagctgggccgcctgctcttccagcacgagttccctggccctgccttccccaggcctgagccccagcagggcggcatcagcggccccagcagcccccagcctgcccaccccctgggggagtttgaggaccagcagctggccagtgatgatgaggagcccggccctgccttccccatgcaggagagccaggagcccaacctggagaacatctggggccaggaggccgctgaggtggaccaggagctggtggagctgctggtgaaggagacagaggcccgcttcccagatgtggccaacggcttcatcgaggagatcatccacttcaagaactactatgacctgaatgtgctgtgcaacttcctgctggagaacccagactaccccaagcgggaggaccgcatcatcatcaaccccagcagcagcctgctggccagccaggatgagaccaagctgcccaagattgacttctttgactacagcaagctgacccccctggaccagcgctgcttcatccaggccgctgacctgctgatggctgacttcaaggtgctgagcagccaggacatcaagtgggccctgcacgagctgaagggccactacgccatcaccaggaaggccctgagtgatgccatcaagaagtggcaggagctgagccctgagaccagcggcaagaggaagaagaggaagcagatgaaccagtacagctacatcgacttcaagtttgagcagggcgacatcaagattgagaagaggatgttcttcctggagaacaagaggaggcactgccgctcctatgaccggcgggccctgctgcctgctgtgcagcaggagcaggagttctatgagcagaagatcaaggagatggccgagcacgaggacttcctgctggccctgcagatgaatgaggagcagtaccagaaggatggccagctgattgagtgccgctgctgctatggagagttcccctttgaggagctgacccagtgtgctgatgcccacctgttctgcaaggaatgtctcatccgctatgcccaggaggccgtgtttggcagcggcaagctggagctgagctgcatggagggcagctgcacctgcagcttccccaccagcgagctggagaaggtgctgccccagaccatcctgtacaagtactatgaaaggaaggccgaggaggaggtggccgccgcctatgcagatgagctggtgcgctgccccagctgcagcttccctgccctgctggacagtgatgtgaagcgcttcagctgccccaacccccactgcaggaaggagacctgcaggaagtgccagggcctgtggaaggagcacaacggcctgacctgtgaggagctggccgagaaggatgacatcaagtaccgcaccagcattgaggagaagatgacagctgcccgcatcaggaagtgccacaagtgtggcaccggcctcatcaagtctgagggctgcaacaggatgagctgccgctgtggggcccagatgtgctacctgtgccgggtgtccatcaatggctatgaccacttctgccagcaccccaggagccctggggccccctgccaggagtgcagccgctgcagcctgtggacagaccccacagaagatgatgagaagctgattgaggagatccagaaggaggccgaggaggagcagaagaggaagaatggagagaacaccttcaagagaattggcccccccctggagaagcctgtggagaaggtgcagagggtggaggccctgcccaggcctgtgccccagaacctgccccagccccagatgccaccctatgcctttgcccacccccccttccccctgccccctgtgcggcctgtgttcaacaacttccccctgaacatgggccccatcccagccccctacgtgccccccctgcccaacgtgcgggtgaactatgactttggccccatccacatgcccctggagcacaacctgcccatgcacttcggcccccagcccaggcaccgcttctag

SEQ ID NO: 168478 - DNA, 2037 bp, Artificial Sequence
  Description of Artificial Sequence: Synthetic coding sequence
atggaggagggcaacaacaatgaggaggtgatccacctgaacaacttccactgccaccggggccaggagtggatcaacctgagagatggccccatcaccatcagtgacagcagtgatgaggagcgcatccccatgctggtgaccccagccccccagcagcacgaggaggaggacctggatgatgatgtgatcctgacagagaccaacaagccccagaggagccggcccaacctgatcaagccagctgcccagtggcaggaggccgctgaggtggaccaggagctggtggagctgctggtgaaggagacagaggcccgcttcccagatgtggccaacggcttcatcgaggagatcatccacttcaagaactactatgacctgaatgtgctgtgcaacttcctgctggagaacccagactaccccaagcgggaggaccgcatcatcatcaaccccagcagcagcctgctggccagccaggatgagaccaagctgcccaagattgacttctttgactacagcaagctgacccccctggaccagcgctgcttcatccaggccgctgacctgctgatggctgacttcaaggtgctgagcagccaggacatcaagtgggccctgcacgagctgaagggccactacgccatcaccaggaaggccctgagtgatgccatcaagaagtggcaggagctgagccctgagaccagcggcaagaggaagaagaggaagcagatgaaccagtacagctacatcgacttcaagtttgagcagggcgacatcaagattgagaagaggatgttcttcctggagaacaagaggaggcactgccgctcctatgaccggcgggccctgctgcctgctgtgcagcaggagcaggagttctatgagcagaagatcaaggagatggccgagcacgaggacttcctgctggccctgcagatgaatgaggagcagtaccagaaggatggccagctgattgagtgccgctgctgctatggagagttcccctttgaggagctgacccagtgtgctgatgcccacctgttctgcaaggaatgtctcatccgctatgcccaggaggccgtgtttggcagcggcaagctggagctgagctgcatggagggcagctgcacctgcagcttccccaccagcgagctggagaaggtgctgccccagaccatcctgtacaagtactatgaaaggaaggccgaggaggaggtggccgccgcctatgcagatgagctggtgcgctgccccagctgcagcttccctgccctgctggacagtgatgtgaagcgcttcagctgccccaacccccactgcaggaaggagacctgcaggaagtgccagggcctgtggaaggagcacaacggcctgacctgtgaggagctggccgagaaggatgacatcaagtaccgcaccagcattgaggagaagatgacagctgcccgcatcaggaagtgccacaagtgtggcaccggcctcatcaagtctgagggctgcaacaggatgagctgccgctgtggggcccagatgtgctacctgtgccgggtgtccatcaatggctatgaccacttctgccagcaccccaggagccctggggccccctgccaggagtgcagccgctgcagcctgtggacagaccccacagaagatgatgagaagctgattgaggagatccagaaggaggccgaggaggagcagaagaggaagaatggagagaacaccttcaagagaattggcccccccctggagaagcctgtggagaaggtgcagagggtggaggccctgcccaggcctgtgccccagaacctgccccagccccagatgccaccctatgcctttgcccacccccccttccccctgccccctgtgcggcctgtgttcaacaacttccccctgaacatgggccccatcccagccccctacgtgccccccctgcccaacgtgcgggtgaactatgactttggccccatccacatgcccctggagcacaacctgcccatgcacttcggcccccagcccaggcaccgcttctag

SEQ ID NO: 168479 - DNA, 447 bp, Artificial Sequence
  Description of Artificial Sequence: Synthetic coding sequence
atgagcagtgacttcccccactacaacttcaggatgcccaacatcggcttccagaacctgcccctgaacatctacatcgtggtgtttggaacagccatctttgtgttcatcctgagcctgctcttctgctgctacctgatccggctgcggcaccaggcccacaaggagttctacgcctacaagcaggtgatcctgaaggagaaggtgaaggagctgaacctgcacgagctgtgtgctgtgtgcctggaggacttcaagcccagagatgagctgggcatctgcccctgcaagcacgccttccacaggaaatgtctcatcaagtggctggaggtgaggaaggtgtgccccctgtgcaacatgcctgtgctgcagctggcccagctgcacagcaagcaggaccggggccccccccagggccccctgcccggggctgaaaatattgtgtag

SEQ ID NO: 168480 - DNA, 447 bp, Artificial Sequence; identical to SEQ ID NO: 168479
  Description of Artificial Sequence: Synthetic coding sequence

SEQ ID NO: 168481 - DNA, 510 bp, Artificial Sequence
  Description of Artificial Sequence: Synthetic coding sequence
atgctgaacaagtctggagagagccgctacccagccctcttccctgtgctgggcggcagctccatgagcagtgacttcccccactacaacttcaggatgcccaacatcggcttccagaacctgcccctgaacatctacatcgtggtgtttggaacagccatctttgtgttcatcctgagcctgctcttctgctgctacctgatccggctgcggcaccaggcccacaaggagttctacgcctacaagcaggtgatcctgaaggagaaggtgaaggagctgaacctgcacgagctgtgtgctgtgtgcctggaggacttcaagcccagagatgagctgggcatctgcccctgcaagcacgccttccacaggaagtgcctgatcaagtggctggaggtgaggaaggtgtgccccctgtgcaacatgcctgtgctgcagctggcccagctgcacagcaagcaggaccggggccccccccagggccccctgcctggagctgagaacatcgtgtag

SEQ ID NO: 168482 - DNA, 510 bp, Artificial Sequence; identical to SEQ ID NO: 168481
  Description of Artificial Sequence: Synthetic coding sequence

SEQ ID NO: 168483 - DNA, 1302 bp, Artificial Sequence
  Description of Artificial Sequence: Synthetic coding sequence
atggaggccgtgtacctggtggtgaatggcctgggcctggtgctggatgtgctgaccctggtgctggacctgaacttcctgctggtgagcagcctgctggccagcctggcctggctgctggcctttgtgtacaacctgccccacacagtgctgaccagcctgctgcacctgggccggggcgtgctgctgagcctgctggccctgattgaagctgtggtgcgcttcacctgtggcggcctgcaggccctgtgcaccctgctgtacagctgctgcagcggcctggagagcctgaagctgctgggccacctggccagccacggggccctgcggagccgggagatcctgcaccggggcgtgctgaatgtggtgagcagcggccacgccctgctgcggcaggcctgtgacatctgtgccatcgccatgagcctggtggcctacgtgatcaacagcctggtgaacatctgcctgattggcacccagaacctcttcagcctggtgctggccctgtgggatgctgtgacaggccccctgtggaggatgacagatgtggtggccgccttcctggcccacatcagcagcagcgctgtggccatggccatcctgctgtggaccccctgccagctggccctggagctgctggccagcgctgcccggctgctggccagctttgtgctggtgaacctgaccggcctggtgctgctggcctgtgtgctggccgtgacagtgacagtgctgcacccagacttcaccctgcggctggccacccaggccctgagccagctgcacgcccggcccagctaccaccggctgcgggaggatgtgatgaggctgagccggctggccctgggcagcgaggcctggaggagagtgtggagccgcagcctgcagctggcctcctggcccaacagaggaggagcccctggggccccccagggcgaccccatgagggtcttctctgtgaggacccggcggcaggacaccctgcctgaggccggcagaagaagtgaagctgaggaggaggaggcccggaccatccgggtgacccctgtgcggggccgggagcggctgaatgaggaggagcccccaggcggccaggacccctggaagctgctgaaggagcaggaggagaggaagaagtgtgtgatctgccaggaccagagcaagacagtgctgctgctgccctgccgccacctgtgcctgtgccaggcctgcacagagatcctgatgaggcaccctgtgtaccacaggaactgccccctgtgccggcggggcatcctgcagaccctgaatgtgtacctgtag

SEQ ID NO: 168484 - DNA, 3219 bp, Artificial Sequence
  Description of Artificial Sequence: Synthetic coding sequence
atgcctggagaggaggaggagcgggccttcctggtggcccgggaggagctggccagcgccctgcggcgggacagcggccaggccttcagcctggagcagctgcggcccctgctggccagcagcctgcccctggccgcccgctacctgcagctggatgctgcccggctggtgcgctgcaatgcccacggggagcccaggaactacctgaacaccctgagcacagccctgaacatcctggagaagtatggcaggaacctgctgagcccccagaggccccgctactggaggggcgtgaagttcaacaaccctgtgttccgcagcacagtggatgctgtgcagggcggcagagatgtgctgcggctgtatggctacacagaggagcagccagatggcctgtccttccctgagggccaggaggagccagatgagcaccaggtggccaccgtgaccctggaggtgctgctgctgaggacagagctgagcctgctgctgcagaacacccacccccggcagcaggccctggagcagctgctggaggacaaggtggaggatgacatgctgcagctgtctgaatttgaccccctgctgcgggagatcgcccctggccccctgaccacccccagcgtgcccggcagcaccccaggcccctgcttcctgtgtggcagcgcccctggcaccctgcactgccccagctgcaagcaggccctgtgcccagcctgtgaccacctgttccacggccaccccagccgggcccaccacctgcggcagaccctgcccggggtgctgcagggcacccacctgagccccagcctgcctgccagcgcccagccccggccccagagcaccagcctgctggccctgggggacagcagcctgagcagccccaacccagccagcgcccacctgccctggcactgtgccgcctgtgccatgctgaatgagccctgggccgtgctgtgtgtggcctgtgaccggccccggggctgcaagggcctgggcctgggcacagagggcccccagggcaccggcggcctggagccagacctggcccggggccgctgggcctgccagagctgcacctttgaaaatgaagctgctgctgtgctgtgcagcatctgtgagcggccccggctggcccagccccccagcctggtggtggacagcagagatgctggcatctgcctgcagcccctgcagcagggagatgccctgctggccagcgcccagagccaggtgtggtactgcatccactgcaccttctgcaacagcagccctggctgggtgtgtgtgatgtgcaacagaaccagcagccccatcccagcccagcacgccccccggccctatgccagcagcctggagaagggcccccccaagccaggccccccccggcggctgagcgcccccctgcccagcagctgtggggaccctgagaagcagaggcaggacaagatgagggaggagggcctgcagctggtgtccatgatccgggagggggaggccgccggggcctgcccagaggagatcttcagcgccctgcagtacagcggcacagaggtgcccctgcagtggctgcggtctgagctgccctacgtgctggagatggtggccgagctggccggccagcaggaccccggcctgggcgccttcagctgccaggaggcccggcgggcctggctggacagacatggcaacctggatgaggccgtggaggagtgtgtgaggaccaggaggaggaaggtgcaggagctgcagagcctgggcttcggccctgaggagggcagcctgcaggccctcttccagcacggcggagatgtgtcccgggccctgacagagctgcagaggcagaggctggagcccttccggcagaggctgtgggacagcggccctgagcccacccccagctgggatggccctgacaagcagagcctggtgcggcggctgctggccgtgtatgccctgcccagctggggccgggcagagctggccctgagcctgctgcaggagaccccaagaaattatgagctgggagatgtggtggaggccgtgcgccacagccaggaccgggccttcctgcggcggctgctggcccaggagtgtgctgtgtgtggctgggccctgccccacaacaggatgcaggccctgaccagctgtgagtgcaccatctgcccagactgcttccggcagcacttcaccatcgccctgaaggagaagcacatcacagacatggtgtgcccagcctgtggccgcccagacctgacagatgacacccagctgctgagctacttcagcaccctggacatccagctgcgggagagcctggagccagatgcctatgccctcttccacaagaagctgacagagggcgtgctgatgagggaccccaagttcctgtggtgtgcccagtgcagctttggcttcatctatgaaagagagcagctggaggccacctgcccccagtgccaccagaccttctgtgtgcgctgcaagaggcagtgggaggagcagcaccggggccgcagctgtgaggacttccagaactggaagaggatgaatgaccctgagtaccaggcccagggcctggccatgtacctgcaggagaatggaattgactgccccaagtgcaagttctcctatgccctggcccggggcggctgcatgcacttccactgcacccagtgccgccaccagttctgcagcggctgctacaatgccttctacgccaagaacaagtgcccagagcccaactgccgggtgaagaagagcctgcacggccaccacccccgggactgcctcttctacctgcgggactggacagccctgcggctgcagaagctgctgcaggacaacaacgtgatgttcaacacagagcccccagctggggcccgggctgtgcctgggggcggctgcagggtcatcgagcagaaggaggtgcccaacggcctgagagatgaggcctgtgggaaggagaccccagctggctacgccggcctgtgccaggcccactacaaggagtacctggtgtccctcatcaatgcccacagcctggaccctgccaccctgtatgaggtggaggagctggagacagccacagagcgctacctgcacgtgcggccccagcccctggccggggaggaccccccagcctaccaggcccggctgctgcagaagctgacagaggaggtgcccctgggccagagcatccccaggaggaggaagtag

SEQ ID NO: 168485 - DNA, 1518 bp, Artificial Sequence
  Description of Artificial Sequence: Synthetic coding sequence
atgcctggagaggaggaggagcgggccttcctggtggcccgggaggagctggccagcgccctgcggcgggacagcggccaggccttcagcctggagcagctgcggcccctgctggccagcagcctgcccctggccgcccgctacctgcagctggatgctgcccggctggtgcgctgcaatgcccacggggagcccaggaactacctgaacaccctgcccacccccagctgggatggccctgacaagcagagcctggtgcggcggctgctggccgtgtatgccctgcccagctggggccgggcagagctggccctgagcctgctgcaggagaccccaagaaattatgagctgggagatgtggtggaggccgtgcgccacagccaggaccgggccttcctgcggcggctgctggcccaggagtgtgctgtgtgtggctgggccctgccccacaacaggatgcaggccctgaccagctgtgagtgcaccatctgcccagactgcttccggcagcacttcaccatcgccctgaaggagaagcacatcacagacatggtgtgcccagcctgtggccgcccagacctgacagatgacacccagctgctgagctacttcagcaccctggacatccagctgcgggagagcctggagccagatgcctatgccctcttccacaagaagctgacagagggcgtgctgatgagggaccccaagttcctgtggtgtgcccagtgcagctttggcttcatctatgaaagagagcagctggaggccacctgcccccagtgccaccagaccttctgtgtgcgctgcaagaggcagtgtgaggacttccagaactggaagaggatgaatgaccctgagtaccaggcccagggcctggccatgtacctgcaggagaatggcatcgactgccccaagtgcaagttctcctatgccctggcccggggcggctgcatgcacttccactgcacccagtgccgccaccagttctgcagcggctgctacaatgccttctacgccaagaacaagtgcccagagcccaactgccgggtgaagaagagcctgcacggccaccacccccgggactgcctcttctacctgcgggactggacagccctgcggctgcagaagctgctgcaggacaacaacgtgatgttcaacacagagcccccagctggggcccgggctgtgcctgggggcggctgccgggtgattgagcagaaggaggtgcccaacggcctgagagatgaggcctgtgggaaggagaccccagctggctacgccggcctgtgccaggcccactacaaggagtacctggtgtccctcatcaatgcccacagcctggaccctgccaccctgtatgaggtggaggagctggagacagccacagagcgctacctgcacgtgcggccccagcccctggccggagaagatcctccagcctaccaggcccggctgctgcagaagctgacagaggaggtgcccctgggccagagcatccccaggaggaggaagtag

SEQ ID NO: 168486 - DNA, 2766 bp, Artificial Sequence
  Description of Artificial Sequence: Synthetic coding sequence
atggacctgtgcaccagggctggggagcccagcctgacccagaacacccacccccggcagcaggccctggagcagctgctggaggacaaggtggaggatgacatgctgcagctgtctgaatttgaccccctgctgcgggagatcgcccctggccccctgaccaccccatctgtgcccggcagcaccccaggcccctgcttcctgtgtggcagcgcccctggcaccctgcactgccccagctgcaagcaggccctgtgcccagcctgtgaccacctgttccacggccaccccagccgggcccaccacctgcggcagaccctgcccggggtgctgcagggcacccacctgagccccagcctgcctgccagcgcccagccccggccccagagcaccagcctgctggccctgggggacagcagcctgagcagccccaacccagccagcgcccacctgccctggcactgtgccgcctgtgccatgctgaatgagccctgggccgtgctgtgtgtggcctgtgaccggccccggggctgcaagggcctgggcctgggcacagagggcccccagggcactggaggcctggagccagacctggcccggggccgctgggcctgccagagctgcacctttgaaaatgaggccgctgctgtgctgtgcagcatctgtgagcggccccggctggcccagccccccagcctggtggtggacagcagagatgctggcatctgcctgcagcccctgcagcagggagatgccctgctggccagcgcccagagccaggtgtggtactgcatccactgcaccttctgcaacagcagccctggctgggtgtgtgtgatgtgcaacagaaccagcagccccatcccagcccagcacgccccccggccctatgccagcagcctggagaagggcccccccaagccaggccccccccggcggctgagcgcccccctgcccagcagctgtggggaccctgagaagcagaggcaggacaagatgagggaggagggcctgcagctggtgtccatgatccgggagggggaggccgccggggcctgcccagaggagatcttcagcgccctgcagtacagcggcacagaggtgcccctgcagtggctgcggtctgagctgccctacgtgctggagatggtggccgagctggccggccagcaggaccccggcctgggcgccttcagctgccaggaggcccggcgggcctggctggacagacatggcaacctggatgaagctgtggaggagtgtgtgaggaccaggaggaggaaggtgcaggagctgcagagcctgggctttggacctgaggagggcagcctgcaggccctcttccagcacggcggagatgtgtcccgggccctgacagagctgcagaggcagaggctggagcccttccggcagaggctgtgggacagcggccctgagcccacccccagctgggatggccctgacaagcagagcctggtgcggcggctgctggccgtgtatgccctgcccagctggggccgggcagagctggccctgagcctgctgcaggagacccccaggaactatgagctgggagatgtggtggaggccgtgcgccacagccaggaccgggccttcctgcggcggctgctggcccaggagtgtgctgtgtgtggctgggccctgccccacaacaggatgcaggccctgaccagctgtgaatgtaccatctgcccagactgcttccggcagcacttcaccatcgccctgaaggagaagcacatcacagacatggtgtgcccagcctgtggccgcccagacctgacagatgacacccagctgctgagctacttcagcaccctggacatccagctgcgggagagcctggagccagatgcctatgccctcttccacaagaagctgacagaaggagtgctgatgagggaccccaagttcctgtggtgtgcccagtgcagctttggcttcatctatgagcgggagcagctggaggccacctgcccccagtgccaccagaccttctgtgtgcgctgcaagaggcagtgggaggagcagcaccggggccgcagctgtgaggacttccagaactggaagaggatgaatgaccctgagtaccaggcccagggcctggccatgtacctgcaggagaatggcatcgactgccccaagtgcaagttctcctatgccctggcccggggcggctgcatgcacttccactgcacccagtgccgccaccagttctgcagcggctgctacaatgccttctacgccaagaacaagtgcccagagcccaactgccgggtgaagaagagcctgcacggccaccacccccgggactgcctcttctacctgcgggactggacagccctgcggctgcagaagctgctgcaggacaacaacgtgatgttcaacacagagcccccagctggggcccgggctgtgcctgggggcggctgccgggtgattgagcagaaggaggtgcccaacggcctgagagatgaggcctgtgggaaggagaccccagctggctacgccggcctgtgccaggcccactacaaggagtacctggtgtccctcatcaatgcccacagcctggaccctgccaccctgtatgaggtggaggagctggagacagccacagagcgctacctgcacgtgcggccccagcccctggccggagaagatcctccagcctaccaggcccggctgctgcagaagctgacagaggaggtgcccctgggccagagcatccccaggaggaggaagtag

SEQ ID NO: 168487 - DNA, 513 bp, Artificial Sequence
  Description of Artificial Sequence: Synthetic coding sequence
atgcctggagaggaggaggagcgggccttcctggtggcccgggaggagctggccagcgccctgcggcgggacagcggccaggccttcagcctggagcagctgcggcccctgctggccagcagcctgcccctggccgcccgctacctgcagctggatgctgcccggctggtgcgctgcaatgcccacggggagcccaggaactacctgaacaccctgagcacagccctgaacatcctggagaagtatggcaggaacctgctgagcccccagaggccccgctactggaggggcgtgaagttcaacaaccctgtgttccgcagcacagtggatgctgtgcagggcggcagagatgtgctgcggctgtatggctacacagaggagcagccagatggcctgtccttccctgagggccaggaggagccagatgagcaccaggtggccaccgtgaccctggaggtgctgctgctgaggacagagctgagcctgctgctgcagaacacccaccccaggtag

SEQ ID NO: 168488 - DNA, 171 bp, Artificial Sequence
  Description of Artificial Sequence: Synthetic coding sequence
atgcctggagaggaggaggagcgggccttcctggtggcccgggaggagctggccagcgccctgcggcgggacagcggccaggccttcagcctggagcagctgcggcccctgctggccagcagcctgcccctggccgcccgctacctgcagctggatgctgcccggctgtag

SEQ ID NO: 168489 - DNA, 1122 bp, Artificial Sequence
  Description of Artificial Sequence: Synthetic coding sequence
atgaggaaggccggggccacctccatgtgggccagctgctgcggcctgctgaatgaggtgatgggcactggagctgtgcggggccagcagagcgcctttgctggggccaccggccccttccgcttcacccccaaccctgagttcagcacctaccccccagctgccacagagggccccaacatcgtgtgcaaggcctgtggcctgtccttctctgtgttcaggaagaagcacgtgtgctgtgactgcaagaaggacttctgcagcgtgtgcagcgtgctgcaggagaacctgcggcgctgcagcacctgccacctgctgcaggagacagccttccagaggccccagctgatgaggctgaaggtgaaggacctgcggcagtacctgatcctgaggaacatccccatcgacacctgccgggagaaggaggacctggtggacctggtgctgtgccaccacggcctgggctctgaagatgacatggacaccagcagcctgaacagcagccgcagccagaccagcagcttcttcaccaggagcttcttcagcaactacacagcccccagcgccaccatgagcagcttccagggcgagctgatggatggagaccagaccagccgctctggagtgcctgcccaggtgcagagcgagatcaccagcgccaacacagaagatgatgatgatgatgatgatgaagatgatgatgatgaggaggagaatgcagaagatagaaatcctggcctgagcaaggagcgggtgcgggccagcctgagtgacctgagcagcctggatgatgtggagggcatgtctgtgcggcagctgaaggagatcctggccaggaactttgtgaactacagcggctgctgtgagaagtgggagctggtggagaaggtgaaccggctgtacaaggaaaatgaggagaaccagaagagctatggagagcggctgcagctgcaggatgaagaagatgacagcctgtgccgcatctgcatggatgctgtgattgactgtgtgctgctggagtgtggccacatggtgacctgcaccaagtgtgggaagaggatgtctgagtgccccatctgccggcagtatgtggtgcgggctgtgcacgtgttcaagagctag

SEQ ID NO: 168490 - DNA, 1119 bp, Artificial Sequence
  Description of Artificial Sequence: Synthetic coding sequence
atgaaggccggggccacctccatgtgggccagctgctgcggcctgctgaatgaggtgatgggcaccggggctgtgcggggccagcagagcgcctttgctggggccaccggccccttccgcttcacccccaaccctgagttcagcacctacccacctgctgccacagagggccccaacatcgtgtgcaaggcctgtggcctgtccttcagcgtcttcaggaagaagcacgtgtgctgtgactgcaagaaggacttctgcagcgtgtgcagcgtgctgcaggagaacctgcggcgctgcagcacctgccacctgctgcaggagacagccttccagaggccccagctgatgaggctgaaggtgaaggacctgcggcagtacctgatcctgaggaacatccccatcgacacctgccgggagaaggaggacctggtggacctggtgctgtgccaccacggcctgggctctgaagatgacatggacaccagcagcctgaacagcagccgcagccagaccagcagcttcttcaccaggagcttcttcagcaactacacagcccccagcgccaccatgagcagcttccagggcgagctgatggatggagaccagaccagccgcagcggcgtgcctgcccaggtgcagagcgagatcaccagcgccaacacagaagatgatgatgatgatgatgatgaagatgatgatgatgaggaggagaatgctgaggacaggaaccctggcctgagcaaggagcgggtgcgggccagcctgagtgacctgagcagcctggatgatgtggagggcatgtctgtgcggcagctgaaggagatcctggccaggaactttgtgaactacagcggctgctgtgagaagtgggagctggtggagaaggtgaacagactctacaaggaaaatgaggagaaccagaagagctatggagagcggctgcagctgcaggatgaggaggatgacagcctgtgccgcatctgcatggatgctgtgattgactgtgtgctgctggagtgtggccacatggtgacctgcaccaagtgtgggaagaggatgtctgaatgtcccatctgccggcagtatgtggtgcgggctgtgcacgtgttcaagagctag

SEQ ID NO: 168491 - DNA, 1122 bp, Artificial Sequence; identical to SEQ ID NO: 168489
  Description of Artificial Sequence: Synthetic coding sequence

SEQ ID NO: 168492 - DNA, 1548 bp, Artificial Sequence
  Description of Artificial Sequence: Synthetic coding sequence
atggcctgcaagatcagccctggggccaacagcgccagcctgcccggccaccccaacaaggtgatctgtgagcgggtgcggctgcagagcctcttccccctgctgcccagcgaccagaacaccaccgtgcaggaggatgcccacttcaaggccttcttccagagcgaggacagccccagccccaagaggcagaggctgagccacagcgtgtttgactacaccagcgccagccctgcccccagcccccccatgaggccctgggagatgaccagcaaccggcagcccccatctgtgcggcccagccagcaccacttcagcggggagcgctgcaacaccccagccaggaacagaagaagcccccctgtgcggcggcagaggggccggcgggaccggctgagccgccacaacagcatcagccaggatgagaactaccaccacctgccctatgcccagcagcaggccatcgaggagccccgggccttccaccccccaaatgtgagcccccggctgctgcaccctgctgcccaccccccccagcagaatgctgtgatggtggacatccatgaccagctgcaccagggcaccgtgcctgtgtcctacacagtgaccaccgtggccccccacggcatccccctgtgcaccggccagcacatcccagcctgcagcacccagcaggtgcccggctgcagcgtggtgttcagcggccagcacctgcctgtgtgcagcgtgcccccacccatgctgcaggcctgcagcgtgcagcacctgcctgtgccctatgctgccttccccccactcatcagcagtgaccccttcctgatccaccccccccacctgagcccccaccaccccccccacctgcccccacctggccagtttgtgcccttccagacccagcagagccgcagccccctgcagagaattgaaaatgaggtggagctgctgggggagcacctgcctgtgggcggcttcacctacccaccttctgcccacccccccaccctgccccccagcgcccccctgcagttcctgacccatgaccccctgcaccaggaggtgtcctttggagtgccctacccacccttcatgccccggcggctgaccggccgcagccgctaccgcagccagcagcccatccccccaccaccctaccaccccagcctgctgccctacgtgctgtccatgctgcctgtgcccccagctgtgggccccaccttctcctttgagctggatgtggaggatggagaggtggagaactatgaggccctgctgaacctggccgagcggctgggggaggccaagccccggggcctgaccaaggctgacatcgagcagctgcccagctaccgcttcaaccccaacaaccaccagagcgagcagaccctgtgtgtggtgtgcatgtgtgactttgagagccggcagctgctgcgggtgctgccctgcaaccacgagttccacgccaagtgtgtggacaagtggctgaaggccaacagaacctgccccatctgcagagcagatgccagcgaggtgcaccgggacagcgagtag

SEQ ID NO: 168493 - DNA, 1299 bp, Artificial Sequence
  Description of Artificial Sequence: Synthetic coding sequence
atgaggccctgggagatgaccagcaaccggcagccccccagcgtgcggcccagccagcaccacttctctggagagcgctgcaacaccccagccaggaacagaagaagcccccctgtgcggcggcagagaggaagaagagaccggctgagccgccacaacagcatcagccaggatgagaactaccaccacctgccctatgcccagcagcaggccatcgaggagccccgggccttccacccccccaacgtgagcccccggctgctgcaccctgctgcccaccccccccagcagaatgctgtgatggtggacatccatgaccagctgcaccagggcaccgtgcctgtgtcctacacagtgaccaccgtggcccctcatggcatccccctgtgcaccggccagcacatcccagcctgcagcacccagcaggtgcccggctgcagcgtggtgttttctggccagcacctgcctgtgtgcagcgtgcccccacccatgctgcaggcctgcagcgtgcagcacctgcctgtgccctatgctgccttccccccactcatcagcagtgaccccttcctgatccaccccccccacctgagcccccaccaccccccccacctgcccccacctggccagtttgtgcccttccagacccagcagagccgcagccccctgcagagaattgaaaatgaggtggagctgctgggggagcacctgcctgtgggcggcttcacctacccacccagcgcccacccccccaccctgcccccatctgcccccctgcagttcctgacccatgaccccctgcaccaggaggtgtcctttggagtgccctacccacccttcatgccccggcggctgaccggccgcagccgctaccgcagccagcagcccatccccccaccaccctaccaccccagcctgctgccctacgtgctgtccatgctgcctgtgcccccagctgtgggccccaccttctcctttgagctggatgtggaggatggagaggtggagaactatgaggccctgctgaacctggccgagcggctgggggaggccaagccccggggcctgaccaaggctgacatcgagcagctgcccagctaccgcttcaaccccaacaaccaccagagcgagcagaccctgtgtgtggtgtgcatgtgtgactttgagagccggcagctgctgcgggtgctgccctgcaaccacgagttccacgccaagtgtgtggacaagtggctgaaggccaacagaacctgccccatctgcagagcagatgccagcgaggtgcaccgggacagcgagtag

SEQ ID NO: 168494 - DNA, 1398 bp, Artificial Sequence
  Description of Artificial Sequence: Synthetic coding sequence
atggcctgcaagtctgaggacagccccagccccaagaggcagaggctgagccacagcgtgtttgactacaccagcgccagccctgcccccagcccccccatgaggccctgggagatgaccagcaaccggcagcccccatctgtgcggcccagccagcaccacttcagcggggagcgctgcaacaccccagccaggaacagaagaagcccccctgtgcggcggcagaggggccggcgggaccggctgagccgccacaacagcatcagccaggatgagaactaccaccacctgccctatgcccagcagcaggccatcgaggagccccgggccttccaccccccaaatgtgagcccccggctgctgcaccctgctgcccaccccccccagcagaatgctgtgatggtggacatccatgaccagctgcaccagggcaccgtgcctgtgtcctacacagtgaccaccgtggccccccacggcatccccctgtgcaccggccagcacatcccagcctgcagcacccagcaggtgcccggctgcagcgtggtgttcagcggccagcacctgcctgtgtgcagcgtgcccccacccatgctgcaggcctgcagcgtgcagcacctgcctgtgccctatgctgccttccccccactcatcagcagtgaccccttcctgatccaccccccccacctgagcccccaccaccccccccacctgcccccacctggccagtttgtgcccttccagacccagcagagccgcagccccctgcagagaattgaaaatgaggtggagctgctgggggagcacctgcctgtgggcggcttcacctacccaccttctgcccacccccccaccctgccccccagcgcccccctgcagttcctgacccatgaccccctgcaccaggaggtgtcctttggagtgccctacccacccttcatgccccggcggctgaccggccgcagccgctaccgcagccagcagcccatccccccaccaccctaccaccccagcctgctgccctacgtgctgtccatgctgcctgtgcccccagctgtgggccccaccttctcctttgagctggatgtggaggatggagaggtggagaactatgaggccctgctgaacctggccgagcggctgggggaggccaagccccggggcctgaccaaggctgacatcgagcagctgcccagctaccgcttcaaccccaacaaccaccagagcgagcagaccctgtgtgtggtgtgcatgtgtgactttgagagccggcagctgctgcgggtgctgccctgcaaccacgagttccacgccaagtgtgtggacaagtggctgaaggccaacagaacctgccccatctgcagagcagatgccagcgaggtgcaccgggacagcgagtag

SEQ ID NO: 168495 - DNA, 1299 bp, Artificial Sequence; identical to SEQ ID NO: 168493
  Description of Artificial Sequence: Synthetic coding sequence

SEQ ID NO: 168496 - DNA, 1320 bp, Artificial Sequence
  Description of Artificial Sequence: Synthetic coding sequence
atgcagcacacctgcacccagcagaagaaggtgacctacaagcacatcgcccgcttcagccccaggaaccggctgtgccaggctgatgctgtgttcaacaacaacctggccggcttccagctgcagagcccccctgtgcggcggcagaggggccggcgggaccggctgagccgccacaacagcatcagccaggatgagaactaccaccacctgccctatgcccagcagcaggccatcgaggagccccgggccttccaccccccaaatgtgagcccccggctgctgcaccctgctgcccaccccccccagcagaatgctgtgatggtggacatccatgaccagctgcaccagggcaccgtgcctgtgtcctacacagtgaccaccgtggccccccacggcatccccctgtgcaccggccagcacatcccagcctgcagcacccagcaggtgcccggctgcagcgtggtgttcagcggccagcacctgcctgtgtgcagcgtgcccccacccatgctgcaggcctgcagcgtgcagcacctgcctgtgccctatgctgccttccccccactcatcagcagtgaccccttcctgatccaccccccccacctgagcccccaccaccccccccacctgcccccacctggccagtttgtgcccttccagacccagcagagccgcagccccctgcagagaattgaaaatgaggtggagctgctgggggagcacctgcctgtgggcggcttcacctacccaccttctgcccacccccccaccctgccccccagcgcccccctgcagttcctgacccatgaccccctgcaccaggaggtgtcctttggagtgccctacccacccttcatgccccggcggctgaccggccgcagccgctaccgcagccagcagcccatccccccaccaccctaccaccccagcctgctgccctacgtgctgtccatgctgcctgtgcccccagctgtgggccccaccttctcctttgagctggatgtggaggatggagaggtggagaactatgaggccctgctgaacctggccgagcggctgggggaggccaagccccggggcctgaccaaggctgacatcgagcagctgcccagctaccgcttcaaccccaacaaccaccagagcgagcagaccctgtgtgtggtgtgcatgtgtgactttgagagccggcagctgctgcgggtgctgccctgcaaccacgagttccacgccaagtgtgtggacaagtggctgaaggccaacagaacctgccccatctgcagagcagatgccagcgaggtgcaccgggacagcgagtag

SEQ ID NO: 168497 - DNA, 999 bp, Artificial Sequence
  Description of Artificial Sequence: Synthetic coding sequence
atggtggacatccatgaccagctgcaccagggcaccgtgcctgtgtcctacacagtgaccaccgtggcccctcatggcatccccctgtgcaccggccagcacatcccagcctgcagcacccagcaggtgcccggctgcagcgtggtgttttctggccagcacctgcctgtgtgcagcgtgcccccacccatgctgcaggcctgcagcgtgcagcacctgcctgtgccctatgctgccttccccccactcatcagcagtgaccccttcctgatccaccccccccacctgagcccccaccaccccccccacctgcccccacctggccagtttgtgcccttccagacccagcagagccgcagccccctgcagagaattgaaaatgaggtggagctgctgggggagcacctgcctgtgggcggcttcacctacccacccagcgcccacccccccaccctgcccccatctgcccccctgcagttcctgacccatgaccccctgcaccaggaggtgtcctttggagtgccctacccacccttcatgccccggcggctgaccggccgcagccgctaccgcagccagcagcccatccccccaccaccctaccaccccagcctgctgccctacgtgctgtccatgctgcctgtgcccccagctgtgggccccaccttctcctttgagctggatgtggaggatggagaggtggagaactatgaggccctgctgaacctggccgagcggctgggggaggccaagccccggggcctgaccaaggctgacatcgagcagctgcccagctaccgcttcaaccccaacaaccaccagagcgagcagaccctgtgtgtggtgtgcatgtgtgactttgagagccggcagctgctgcgggtgctgccctgcaaccacgagttccacgccaagtgtgtggacaagtggctgaaggccaacagaacctgccccatctgcagagcagatgccagcgaggtgcaccgggacagcgagtag

SEQ ID NO: 168498 - DNA, 1320 bp, Artificial Sequence; identical to SEQ ID NO: 168496
  Description of Artificial Sequence: Synthetic coding sequence

SEQ ID NO: 168499 - DNA, 1299 bp, Artificial Sequence; identical to SEQ ID NO: 168493
  Description of Artificial Sequence: Synthetic coding sequence

SEQ ID NO: 168500 - DNA, 1263 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgcgggagaagctggccgagcccggggcccgggccggcagaagaagaggaggccgcatccccaccatgggctgcctggacctgcctggagaggacatgaggaagacctggaggagatttgaggtgcccaccagcaagagcagcaacagtgaagatgacctgcctgaggactaccctgtggtgaagaagatgctgcaccggctgacagctgacctgaccctggaccccggcacagcccaccggcggctgctgatctctgctgacagaagatctgtgcagctggcccctcctggcaccccagcccccccagatggccccaagagatttgaccagctgcctgctgtgctgggcgcccagggctttggagctggccgccactgctgggaggtggagacagcagatgctgccagctgccgggacagcagcggggaggatgctgatgatgaggagagccactatgctgtgggcgccgccggggagagcgtgcagaggaagggctgtgtgcggctgtgcccagctggagctgtgtgggccgtggagggccggggcggccgcctgtgggccctgacagcccctgagcccaccctgctgggcggcgtggagcccccaccccggcgcatccgggtggacctggactgggagcggggccgggtggccttctatgatggccgcagcctggacctgctgtatgccttccaggcccctggccccctgggggagcgcatcttccccctcttctgcacctgtgacccccgggcccccctgagaattgtgcctgctgagagctag

SEQ ID NO: 168501 - DNA, 756 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgctgtttggaggcggcatcccccacagcttcctgggcacccacagccacgcccactgccgcagcatcaacagcaacccccacttccggcccaagatcatgaggccccacctggtgtccaccttcccccggccctgcagcaagcccaaccccttcctgcccagcggcagccagaacctgctgagccccacagccaccaccgtgctgcctgacttcagccacagcaaccacagcaggcctgccatgggcaaccggcccagccccagcgtgctggtgaagtag

SEQ ID NO: 168502 - DNA, 1065 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgcgggagaagctggccgagcccggggcccgggccggcagaagaagaggaggccgcatccccaccatgggctgcctggacctgcctggagaggacatgaggaagacctggaggagatttgaggtgcccacccccaagagcagcaacagtgaagatgacctgcctgaggactaccctgtggtgaagaagatgctgcaccggctgacagctgacctgaccctggaccccggcacagcccaccggcggctgctgatcagcacagacagaagatctgtgcagctggcccctcctggcaccccagcccccccagatggccccaagagatttgaccagctgcctgctgtgctgggcgcccagggctttggagctggccgccactgctgggaggtggagacagcagatgctgccagctgccgggacagcagcggggaggatgaagatgatgaggagagccactatgctgtgggcgccgccggggagagcgtgcagaggaagggctgtgcccctggccccctgggggagcgcatcttccccctcttctgcacctgtgacccccgggcccccctgagaattgtgcctgctgagagctag

SEQ ID NO: 168503 - DNA, 1065 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgcgggagaagctggccgagcccggggcccgggccggcagaagaagaggaggccgcatccccaccatgggctgcctggacctgcctggagaggacatgaggaagacctggaggagatttgaggtgcccaccagcaagagcagcaacagtgaagatgacctgcctgaggactaccctgtggtgaagaagatgctgcaccggctgacagctgacctgaccctggaccccggcacagcccaccggcggctgctgatctctgctgacagaagatctgtgcagctggcccctcctggcaccccagcccccccagatggccccaagagatttgaccagctgcctgctgtgctgggcgcccagggctttggagctggccgccactgctgggaggtggagacagcagatgctgccagctgccgggacagcagcggggaggatgctgatgatgaggagagccactatgctgtgggcgccgccggggagagcgtgcagaggaagggctgtgcccctggccccctgggggagcgcatcttccccctcttctgcacctgtgacccccgggcccccctgagaattgtgcctgctgagagctag

SEQ ID NO: 168504 - DNA, 1263 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgcgggagaagctggccgagcccggggcccgggccggcagaagaagaggaggccgcatccccaccatgggctgcctggacctgcctggagaggacatgaggaagacctggaggagatttgaggtgcccacccccaagagcagcaacagtgaagatgacctgcctgaggactaccctgtggtgaagaagatgctgcaccggctgacagctgacctgaccctggaccccggcacagcccaccggcggctgctgatcagcacagacagaagatctgtgcagctggcccctcctggcaccccagcccccccagatggccccaagagatttgaccagctgcctgctgtgctgggcgcccagggctttggagctggccgccactgctgggaggtggagacagcagatgctgccagctgccgggacagcagcggggaggatgaagatgatgaggagagccactatgctgtgggcgccgccggggagagcgtgcagaggaagggctgtgtgcggctgtgcccagctggagctgtgtgggccgtggagggccggggcggccgcctgtgggccctgacagcccctgagcccaccctgctgggcggcgtggagcccccaccccggcgcatccgggtggacctggactgggagcggggccgggtggccttctatgatggccgcagcctggacctgctgtatgccttccaggcccctggccccctgggggagcgcatcttccccctcttctgcacctgtgacccccgggcccccctgagaattgtgcctgctgagagctag

SEQ ID NO: 168505 - DNA, 1065 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgcgggagaagctggccgagcccggggcccgggccggcagaagaagaggaggccgcatccccaccatgggctgcctggacctgcctggagaggacatgaggaagacctggaggagatttgaggtgcccaccagcaagagcagcaacagtgaagatgacctgcctgaggactaccctgtggtgaagaagatgctgcaccggctgacagctgacctgaccctggaccccggcacagcccaccggcggctgctgatctctgctgacagaagatctgtgcagctggcccctcctggcaccccagcccccccagatggccccaagcgcttcaaccagctgcctgctgtgctgggcgcccagggctttggagctggccgccactgctgggaggtggagacagcagatgctgccagctgccgggacagcagcggggaggatgctgatgatgaggagagccactatgctgtgggcgccgccggggagagcgtgcagaggaagggctgtgcccctggccccctgggggagcgcatcttccccctcttctgcacctgtgacccccgggcccccctgagaattgtgcctgctgagagctag

SEQ ID NO: 168506 - DNA, 1263 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgcgggagaagctggccgagcccggggcccgggccggcagaagaagaggaggccgcatccccaccatgggctgcctggacctgcctggagaggacatgaggaagacctggaggagatttgaggtgcccaccagcaagagcagcaacagtgaagatgacctgcctgaggactaccctgtggtgaagaagatgctgcaccggctgacagctgacctgaccctggaccccggcacagcccaccggcggctgctgatctctgctgacagaagatctgtgcagctggcccctcctggcaccccagcccccccagatggccccaagagatttgaccagctgcctgctgtgctgggcgcccagggctttggagctggccgccactgctgggaggtggagacagcagatgctgccagctgccgggacagcagcggggaggatgctgatgatgaggagagccactatgctgtgggcgccgccggggagagcgtgcagaggaagggctgtgtgcggctgtgcccagctggagctgtgtgggccgtgggcggccggggcggccgcctgtgggccctgacagcccctgagcccaccctgctgggcggcgtggagcccccaccccggcgcatccgggtggacctggactgggagcggggccgggtggccttctatgatggccgcagcctggacctgctgtatgccttccaggcccctggccccctgggggagcgcatcttccccctcttctgcacctgtgacccccgggcccccctgagaattgtgcctgctgagagctag

SEQ ID NO: 168507 - DNA, 1263 bp, Artificial Sequence; identical to SEQ ID NO: 168500
  Description of Artificial Sequence: Synthetic coding sequence

SEQ ID NO: 168508 - DNA, 1263 bp, Artificial Sequence; identical to SEQ ID NO: 168500
  Description of Artificial Sequence: Synthetic coding sequence

SEQ ID NO: 168509 - DNA, 1065 bp, Artificial Sequence; identical to SEQ ID NO: 168503
  Description of Artificial Sequence: Synthetic coding sequence

SEQ ID NO: 168510 - DNA, 1065 bp, Artificial Sequence; identical to SEQ ID NO: 168503
  Description of Artificial Sequence: Synthetic coding sequence

SEQ ID NO: 168511 - DNA, 1065 bp, Artificial Sequence; identical to SEQ ID NO: 168503
  Description of Artificial Sequence: Synthetic coding sequence

SEQ ID NO: 168512 - DNA, 1263 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgcgggagaagctggccgagcccggggcccgggccggcagaagaagaggaggccgcatccccaccatgggctgcctggacctgcctggagaggacatgaggaagacctggaggagatttgaggtgcccaccagcaagagcagcaacagtgaagatgacctgcctgaggactaccctgtggtgaagaagatgctgcaccggctgacagctgacctgaccctggaccccggcacagcccaccggcggctgctgatctctgctgacagaagatctgtgcagctggcccctcctggcaccccagcccccccagatggccccaagcgcttcaaccagctgcctgctgtgctgggcgcccagggctttggagctggccgccactgctgggaggtggagacagcagatgctgccagctgccgggacagcagcggggaggatgctgatgatgaggagagccactatgctgtgggcgccgccggggagagcgtgcagaggaagggctgtgtgcggctgtgcccagctggagctgtgtgggccgtggagggccggggcggccgcctgtgggccctgacagcccctgagcccaccctgctgggcggcgtggagcccccaccccggcgcatccgggtggacctggactgggagcggggccgggtggccttctatgatggccgcagcctggacctgctgtatgccttccaggcccctggccccctgggggagcgcatcttccccctcttctgcacctgtgacccccgggcccccctgagaattgtgcctgctgagagctag

SEQ ID NO: 168513 - DNA, 1263 bp, Artificial Sequence; identical to SEQ ID NO: 168500
  Description of Artificial Sequence: Synthetic coding sequence

SEQ ID NO: 168514 - DNA, 1065 bp, Artificial Sequence; identical to SEQ ID NO: 168503
  Description of Artificial Sequence: Synthetic coding sequence

SEQ ID NO: 168515 - DNA, 1263 bp, Artificial Sequence; identical to SEQ ID NO: 168500
  Description of Artificial Sequence: Synthetic coding sequence

SEQ ID NO: 168516 - DNA, 1065 bp, Artificial Sequence; identical to SEQ ID NO: 168503
  Description of Artificial Sequence: Synthetic coding sequence

SEQ ID NO: 168517 - DNA, 756 bp, Artificial Sequence; identical to SEQ ID NO: 168501
  Description of Artificial Sequence: Synthetic coding sequence

SEQ ID NO: 168518 - DNA, 756 bp, Artificial Sequence; identical to SEQ ID NO: 168501
  Description of Artificial Sequence: Synthetic coding sequence

SEQ ID NO: 168519 - DNA, 756 bp, Artificial Sequence; identical to SEQ ID NO: 168501
  Description of Artificial Sequence: Synthetic coding sequence

SEQ ID NO: 168520 - DNA, 756 bp, Artificial Sequence; identical to SEQ ID NO: 168501
  Description of Artificial Sequence: Synthetic coding sequence

SEQ ID NO: 168521 - DNA, 756 bp, Artificial Sequence; identical to SEQ ID NO: 168501
  Description of Artificial Sequence: Synthetic coding sequence

SEQ ID NO: 168522 - DNA, 756 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgctgtttggaggcggcatcccccacagcttcctgggcacccacagccacgcccactgccgcagcatcaacagcaacccccacttccggcccaagatcatgaggccccacctggtgtccaccttcccccggccctgcagcaagcccaaccccttcctgcccagcggcagccagaacctgctgagccccacagctgccaccgtgctgcctgacttcagccacagcaaccacagcaggcctgccatgggcaaccggcccagccccagcgtgctggtgaagtag

SEQ ID NO: 168523 - DNA, 756 bp, Artificial Sequence
  Description of Artificial Sequence: Synthetic coding sequence
atgtggtggagggacctgacccggctgcggctgtggctgaagcgggaggccatccctggagagggcaggaaggccgccaaggtgaatgctggggtgggggagaagggcatctacacagccagcagccggggcggcccccccagcgcccggagcaaggctgtgacagtggtggccgagggcgccgccagccgctcctggctgtccatggatgcccctgagctgggccctggcctggtggagcggctggagcagctggccacctgccccctgtgtggcggcagctttgaggaccctgtgctgctggcctgtgagcacagcttctgccgggcctgcctggcccggcgctggggcaccccaccagccaccggcacagaggccagccccacagcctgcccctgctgcggcctgccctgcccccggcgcagcctgcggagcaatgtgcggctggccgtggaggtgcgcatcagccgggagctgctgtttggccggggcatcccccacagcttcctgggcacccacagccacgcccactgccgcagcatcaacagcaacccccacttccggcccaagatcatgaggccccacctggtgtccaccttcccccacccctgcagcaagcccaaccccttcctgcccagcggcagccagaacctgctgagccccacagccaccaccgtgctgcctgacttcagccacagcaaccacagcaggcctgccatgggcaaccggcccagccccagcgtgctggtgaagtag

SEQ ID NO: 168524 - DNA, 573 bp, Artificial Sequence
  Description of Artificial Sequence: Synthetic coding sequence
atgagcaccaggaagaggcggggcggggccatcaacagccggcaggcccagaagaggacccgggaggccaccagcaccccagagatcagcctggaggccgagcccatcgagctggtggagacagctggagatgagatcgtggacctgacctgtgagagcctggagcctgtggtggtggacctgacccacaatgacagcgtggtgattgtggatgaaagaagaagaccaagaagaaatgcccggcggctgccccaggaccacgccgacagctgtgtggtgtccagtgatgatgaggagctgagccgggacagagatgtgtatgtgaccacccacaccccaagaaatgccagagatgagggcgccaccggcctgcggcccagcggcaccgtgtcctgccccatctgcatggatggctacagcgagatcgtgcagaatggccgcctgattgtgtccacagaatgtggccacgtgttctgcagccagtgcctgcgggacagcctgaagaatgccaacacctgccccacctgcaggaagaagatcaaccacaagcgctaccaccccatctacatctag

SEQ ID NO: 168525 - DNA, 18 bp, Artificial Sequence
  Description of Artificial Sequence: Synthetic coding sequence
atgagcaccaggaagtag

SEQ ID NO: 168526 - DNA, 573 bp, Artificial Sequence; identical to SEQ ID NO: 168524
  Description of Artificial Sequence: Synthetic coding sequence

SEQ ID NO: 168527 - DNA, 573 bp, Artificial Sequence; identical to SEQ ID NO: 168524
  Description of Artificial Sequence: Synthetic coding sequence

SEQ ID NO: 168528 - DNA, 165 bp, Artificial Sequence
  Description of Artificial Sequence: Synthetic coding sequence
atgagcaccaggaagaggcggggcggggccatcaacagccggcaggcccagaagaggacccgggaggccaccagcaccccagagatcagcctggaggccgagcccatcgagctggtggagacagctggagatgagatcgtggacctgacctgtgagagcctgtag

SEQ ID NO: 168529 - DNA, 345 bp, Artificial Sequence
  Description of Artificial Sequence: Synthetic coding sequence
atgagcaccaggaagaggcggggcggggccatcaacagccggcaggcccagaagaggacccgggaggccaccagcaccccagagatcagcctggaggccgagcccatcgagctggtggagacagctggagatgagatcgtggacctgacctgtgagagcctggagcctgtggtggtggacctgacccacaatgacagcgtggtggtgtctgtgggcgtgccccaggtgctgtctgtggtgcccagcgcctggacagacacccagaggagctgcaggatggatgtgtcctccttcccccagaatgctgccatgagctctgtggccagcgccagcgtcatcccctag

SEQ ID NO: 168530 - DNA, 573 bp, Artificial Sequence
  Description of Artificial Sequence: Synthetic coding sequence
atgagcaccaggaagaggcggggcggggccatcaacagccggcaggcccagaagaggacccgggaggccaccagcaccccagagatcagcctggaggccgagcccatcgagctggtggagacagctggagatgagatcgtggacctgacctgtgagagcctggagcctgtggtggtggacctgacccacaatgacagcgtggtggtgtctgatgaaagaagaagaccaagaagaaatgcccggcggctgccccaggaccacgccgacagctgtgtggtgtccagtgatgatgaggagctgagccgggacagagatgtgtatgtgaccacccacaccccaagaaatgccagagatgagggcgccaccggcctgcggcccagcggcaccgtgtcctgccccatctgcatggatggctacagcgagatcgtgcagaatggccgcctgattgtgtccacagaatgtggccacgtgttctgcagccagtgcctgcgggacagcctgaagaatgccaacacctgccccacctgcaggaagaagatcaaccacaagcgctaccaccccatctacatctag

SEQ ID NO: 168531 - DNA, 342 bp, Artificial Sequence
  Description of Artificial Sequence: Synthetic coding sequence
atgagcaccaggaagaggcggggcggggccatcaacagccggcaggcccagaagaggacccgggaggccaccagcaccccagagatcagcctggaggccgagcccatcgagctggtggagacagctggagatgagatcgtggacctgacctgtgagagcctggagcctgtggtggtggacctgacccacaatgacagcgtggtgattgtggatggcccccaggtgctgtctgtggtgcccagcgcctggacagacacccagaggagctgcaggatggatgtgagcagcttcccccagaatgctgccatgagctctgtggccagcgccagcgtcatcccctag

SEQ ID NO: 168532 - DNA, 2352 bp, Artificial Sequence
  Description of Artificial Sequence: Synthetic coding sequence
atgtctgggggccaccagctgcagctggccgccctgtggccctggctgctgatggccaccctgcaggccggctttggaagaacaggcctggtgctggccgctgctgtggagagcgagaggtctgctgagcagaaggccatcatccgggtcatccccctgaagatggaccccaccgggaagctgaacctgaccctggagggcgtgtttgctggggtggccgagatcaccccagctgagggcaagctgatgcagagccaccccctgtacctgtgcaatgccagtgatgatgacaacctggagcccggcttcatcagcatcgtgaagctggagagcccccggcgggccccccggccctgcctgagcctggccagcaaggccaggatggccggggagcggggggccagcgctgtgctgtttgacatcacagaagatagagctgctgctgagcagctgcagcagcccctgggcctgacctggcctgtggtgctgatctggggcaatgatgctgagaagctgatggagtttgtgtacaagaaccagaaggcccacgtgcgcatcgagctgaaggagcccccagcctggccagactatgatgtgtggatcctgatgacagtggtgggcaccatcttcgtcatcatcctggcctctgtgctgcgcatccgctgccggcccaggcacagcaggccagaccccctgcagcagaggacagcctgggccatcagccagctggccacccggcgctaccaggccagctgccggcaggcccggggggagtggccagacagcggcagcagctgcagcagcgcccctgtgtgtgccatctgcctggaggagttcagcgagggccaggagctgcgggtcatcagctgcctgcacgagttccacaggaactgtgtggacccctggctgcaccagcacaggacctgccccctgtgcatgttcaacatcacagaaggagacagcttcagccagagcctgggccccagccgcagctaccaggagcctggaagaaggctgcacctgatccggcagcaccctggccacgcccactaccacctgcctgctgcctacctgctgggccccagccgctctgctgtggcccggcccccccggcccggccccttcctgcccagccaggagcccggcatgggccccaggcaccaccgcttccccagggctgcccacccccgggcccctggagagcagcagaggctggccggggcccagcacccctatgcccagggctggggcctgagccacctgcagagcaccagccagcaccctgctgcctgccctgtgcccctgcggcgggcccggcccccagacagcagcggcagcggggagagctactgcacagagaggagcggctacctggctgatggccctgccagtgacagcagcagcggcccctgccacggcagcagcagtgacagcgtggtgaactgcacagacatcagcctgcagggcgtgcacggcagcagcagcaccttctgcagcagcctgagcagtgactttgaccccctggtgtactgcagccccaagggggacccccagagggtggacatgcagcccagcgtgaccagccggcccaggagcctggacagcgtggtgcccactggagagacccaggtgagcagccacgtgcactaccaccgccaccgccaccaccactacaagaagcgcttccagtggcacggcaggaagccaggccctgagactggagtgccccagagccggccccccatccccaggacccagccccagcctgagccccccagcccagaccagcaggtgaccaggagcaacagcgctgcccccagcggccgcctgagcaacccccagtgcccccgggccctgcctgagcccgcccctggccctgtggatgccagcagcatctgccccagcaccagcagcctcttcaacctgcagaagagcagcctgagcgcccggcacccccagaggaagaggcggggcggccccagcgagcccaccccaggcagccggccccaggatgccaccgtgcacccagcctgccagatcttcccccactacaccccatctgtggcctacccctggagccctgaggcccaccccctcatctgtggccccccaggcctggacaagaggctgctgcctgagaccccaggcccctgctacagcaacagccagcctgtgtggctgtgcctgaccccccggcagcccctggagccccaccccccaggagagggccccagcgagtggagcagtgacacagctgagggccggccctgcccctacccccactgccaggtgctgagcgcccagcccggcagcgaggaggagctggaggagctgtgtgagcaggccgtgtag

SEQ ID NO: 168533 - DNA, 2229 bp, Artificial Sequence
  Description of Artificial Sequence: Synthetic coding sequence
atgtctgggggccaccagctgcagctggccgccctgtggccctggctgctgatggccaccctgcaggccggctttggaagaacaggcctggtgctggccgctgctgtggagagcgagaggtctgctgagcagaaggccatcatccgggtcatccccctgaagatggaccccaccgggaagctgaacctgaccctggagggcgtgtttgctggggtggccgagatcaccccagctgagggcaagctgatgcaggccaggatggccggggagcggggggccagcgctgtgctgtttgacatcacagaggacagagctgctgctgagcagctgcagcagcccctgggcctgacctggcctgtggtgctgatctggggcaatgatgctgagaagctgatggagtttgtgtacaagaaccagaaggcccacgtgagaattgagctgaaggagcccccagcctggccagactatgatgtgtggatcctgatgacagtggtgggcaccatctttgtgatcatcctggcctctgtgctgcgcatccgctgccggcccaggcacagcaggccagaccccctgcagcagaggacagcctgggccatcagccagctggccacccggcgctaccaggccagctgccggcaggcccggggggagtggccagattctggcagcagctgcagcagcgcccctgtgtgtgccatctgcctggaggagttcagcgagggccaggagctgcgggtcatcagctgcctgcacgagttccacaggaactgtgtggacccctggctgcaccagcacaggacctgccccctgtgcatgttcaacatcacagaaggagacagcttcagccagagcctgggccccagccgcagctaccaggagcccggccggcggctgcacctgatccggcagcaccctggccacgcccactaccacctgcctgctgcctacctgctgggccccagccgctctgctgtggcccggccccccaggcctggccccttcctgcccagccaggagcccggcatgggccccaggcaccaccgcttcccccgggccgcccacccccgggcccctggagagcagcagaggctggccggggcccagcacccctatgcccagggctggggcctgagccacctgcagagcaccagccagcaccctgctgcctgccctgtgcccctgcggcgggcccggcccccagacagcagcggcagcggggagagctactgcacagagaggagcggctacctggctgatggccctgccagtgacagcagcagcggcccctgccacggcagcagcagtgacagcgtggtgaactgcacagacatcagcctgcagggcgtgcacggcagcagcagcaccttctgcagcagcctgagcagtgactttgaccccctggtgtactgcagccccaagggggacccccagagggtggacatgcagcccagcgtgaccagccggcccaggagcctggacagcgtggtgcccaccggggagacccaggtgagcagccacgtgcactaccaccgccaccgccaccaccactacaagaagcgcttccagtggcacggcaggaagccaggccctgagaccggggtgccccagagcaggcctcccatccccaggacccagccccagcctgagccccccagcccagaccagcaggtgaccaggagcaacagcgctgcccccagcggccgcctgagcaacccccagtgcccccgggccctgcctgagcccgcccctggccctgtggatgccagcagcatctgccccagcaccagcagcctcttcaacctgcagaagagcagcctgagcgcccggcacccccagaggaagagaagaggaggccccagcgagcccaccccaggcagccggccccaggatgccaccgtgcacccagcctgccagatcttcccccactacacccccagcgtggcctacccctggagccctgaggcccaccccctcatctgtggccccccaggcctggacaagaggctgctgcctgagaccccaggcccctgctacagcaacagccagcctgtgtggctgtgcctgaccccccggcagcccctggagccccaccccccaggagagggccccagcgagtggagcagtgacacagctgagggccggccctgcccctacccccactgccaggtgctgagcgcccagcccggcagcgaggaggagctggaggagctgtgtgagcaggccgtgtag

SEQ ID NO: 168534 - DNA, 543 bp, Artificial Sequence
  Description of Artificial Sequence: Synthetic coding sequence
atggctgctgctgaggaggaggatggcggccctgagggccccaaccgggagcggggcggggccggggccacctttgagtgcaacatctgcctggagacagcccgggaggccgtggtgtctgtgtgtggccacctgtactgctggccctgcctgcaccagtggctggagaccaggcctgagcggcaggagtgccctgtgtgcaaggccggcatcagccgggagaaggtggtgcccctgtatggccggggcagccagaagccccaggacccccggctgaagaccccaccccggccccagggccagaggcctgcccctgagagcagaggaggcttccagccctttggagacacaggaggcttccacttctcctttggagtgggcgccttccccttcggcttcttcaccaccgtcttcaatgcccacgagcccttcagaagaggcaccggggtggacctgggccagggccacccagccagctcctggcaggacagcctcttcctgttcctggccatcttcttcttcttctggctgctgagcatctag

SEQ ID NO: 168535 - DNA, 543 bp, Artificial Sequence; identical to SEQ ID NO: 168534
  Description of Artificial Sequence: Synthetic coding sequence

SEQ ID NO: 168536 - DNA, 549 bp, Artificial Sequence
  Description of Artificial Sequence: Synthetic coding sequence
atggctgctgctgaggaggaggatggcggccctgagggccccaaccgggagcggggcggggccggggccacctttgagtgcaacatctgcctggagacagcccgggaggccgtggtgtctgtgtgtggccacctgtactgctggccctgcctgcaccagtggctggagaccaggcctgagcggcaggagtgccctgtgtgcaaggccggcatcagccgggagaaggtggtgcccctgtatggccggggcagccagaagccccaggacccccggctgaagaccccaccccggccccagggccagaggcctgcccctgagagcagaggaggcttccagccctttggagacacaggaggcttccacttctcctttggagtgggcgccttccccttcggcttcttcaccaccgtcttcaatgcccacgagcccttcagaagaggcaccggccccttcagcaccagccctgccttcttccactacctgattggcaacaccagccgggagttccggggccgcatctacaacttctggctgcccaggaacctgtag

SEQ ID NO: 168537 - DNA, 543 bp, Artificial Sequence; identical to SEQ ID NO: 168534
  Description of Artificial Sequence: Synthetic coding sequence

SEQ ID NO: 168538 - DNA, 543 bp, Artificial Sequence; identical to SEQ ID NO: 168534
  Description of Artificial Sequence: Synthetic coding sequence

SEQ ID NO: 168539 - DNA, 543 bp, Artificial Sequence; identical to SEQ ID NO: 168534
  Description of Artificial Sequence: Synthetic coding sequence

SEQ ID NO: 168540 - DNA, 543 bp, Artificial Sequence; identical to SEQ ID NO: 168534
  Description of Artificial Sequence: Synthetic coding sequence

SEQ ID NO: 168541 - DNA, 543 bp, Artificial Sequence; identical to SEQ ID NO: 168534
  Description of Artificial Sequence: Synthetic coding sequence

SEQ ID NO: 168542 - DNA, 549 bp, Artificial Sequence; identical to SEQ ID NO: 168536
  Description of Artificial Sequence: Synthetic coding sequence

SEQ ID NO: 168543 - DNA, 549 bp, Artificial Sequence; identical to SEQ ID NO: 168536
  Description of Artificial Sequence: Synthetic coding sequence

SEQ ID NO: 168544 - DNA, 549 bp, Artificial Sequence; identical to SEQ ID NO: 168536
  Description of Artificial Sequence: Synthetic coding sequence

SEQ ID NO: 168545 - DNA, 549 bp, Artificial Sequence; identical to SEQ ID NO: 168536
  Description of Artificial Sequence: Synthetic coding sequence

SEQ ID NO: 168546 - DNA, 549 bp, Artificial Sequence; identical to SEQ ID NO: 168536
  Description of Artificial Sequence: Synthetic coding sequence

SEQ ID NO: 168547 - DNA, 549 bp, Artificial Sequence; identical to SEQ ID NO: 168536
  Description of Artificial Sequence: Synthetic coding sequence

SEQ ID NO: 168548 - DNA, 342 bp, Artificial Sequence
  Description of Artificial Sequence: Synthetic coding sequence
atggctgatgtggaggatggagaggagacctgtgccctggccagccacagcggcagcagcggcagcaagagcggcggggacaagatgttcagcctgaagaagtggaatgctgtggccatgtggagctgggatgtggagtgtgacacctgtgccatctgccgggtgcaggtgatggatgcctgcctgcgctgccaggccgagaacaagcaggaggactgtgtggtggtgtggggcgagtgcaaccacagcttccacaactgctgcatgagcctgtgggtgaagcagaacaaccgctgccccctgtgccagcaggactgggtggtgcagagaattggcaagtag

SEQ ID NO: 168549 - DNA, 273 bp, Artificial Sequence
  Description of Artificial Sequence: Synthetic coding sequence
atggctgatgtggaggatggagaggagacctgtgccctggccagccacagcggcagcagcggcagcaagagcggcggggacaagatgttcagcctgaagaagtggaatgctgtggccatgtggagctgggatgtggagtgtgacacctgtgccatctgccgggtgcagatgcctgtgctggatgtgaagctgaagaccaacaagaggacagtgctgtggagcggggagaatgtcatcatccccagcaccacagctgcctgcccctgtggctag

SEQ ID NO: 168550 - DNA, 294 bp, Artificial Sequence
  Description of Artificial Sequence: Synthetic coding sequence
atggctgatgtggaggatggagaggagacctgtgccctggccagccacagcggcagcagcggcagcaagagcggcggggacaagatgttcagcctgaagaagtggaatgctgtggccatgtggagctgggatgtggagtgtgacacctgtgccatctgccgggtgcaggtgatggtggtgtggggcgagtgcaaccacagcttccacaactgctgcatgagcctgtgggtgaagcagaacaaccgctgccccctgtgccagcaggactgggtggtgcagagaattggcaagtag

SEQ ID NO: 168551 - DNA, 1875 bp, Artificial Sequence
  Description of Artificial Sequence: Synthetic coding sequence
atggagaacagcgacagcaatgacaagggcagcggggaccagagcgctgcccagaggaggagccagatggaccggctggaccgggaggaggccttctaccagtttgtgaacaacctgtctgaggaggactaccgcctgatgagggacaacaacctgctgggcaccccaggagagagcacagaggaggagctgctgcggcggctgcagcagatcaaggagggccccccaccccagaacagtgatgagaacagaggaggagacagcagtgatgatgtgtccaatggagacagcatcatcgactggctgaacagcgtgcggcagacaggcaacaccaccaggagcggccagaggggcaaccagagctggagggctgtgtccaggaccaaccccaacagcggggacttccgcttcagcctggagatcaacgtgaacagaaataatggcagccagaacagtgaaaatgaaaatgagcccagcgcccggcgcagcagcggggagaatgtggagaacaacagccagaggcaggtggagaaccccaggtctgagagcaccagcgcccggcccagccgctcagaaagaaacagcacagaggccctgacagaggtgccccccacccggggccagaggcgggcccggagccgcagcccagaccacaggaggacccgggcccgggcagagaggagccgcagccccctgcaccccatgtctgagatcccccggcgcagccaccacagcatcagcagccagacctttgagcaccccctggtgaatgaaacagagggcagcagcaggaccaggcaccacgtgaccctgcggcagcagatcagcggccctgagctgctgagccggggcctgtttgctgccagcggcaccagaaatgccagccagggcgccggcagcagtgacacagctgccagcggggagagcacaggcagcggccagaggcctcccaccatcgtgctggacctgcaggtgcggcgggtgcggcctggagagtaccggcagagggacagcatcgccagcaggaccaggagccgcagccagacccccaacaacacagtgacctatgagagcgagcggggcggcttccggaggaccttcagccgctcagaaagagctggggtgaggacctacgtgtccaccatccgcatccccatccgccgcatcctgaacacaggcctgtctgagaccacctctgtggccatccagaccatgctgcggcagatcatgactggatttggagagctgagctacttcatgtacagcgacagcgacagcgagcccactggatctgtgagcaacagaaacatggagcgggcagagagccgcagcggccggggcggcagcggcggcggcagcagcagcggcagcagcagcagcagcagcagcagcagcagcagcagcagcagcagcagcagcagcagcagccccagcagcagcagtggaggagagagcagcgagaccagcagtgacctgtttgagggcagcaatgaaggcagcagcagcagcggcagcagcggggcccggcgggagggccgccaccgggcccctgtgacctttgatgaaagtggcagcctgcccttcctgagcctggcccagttcttcctgctgaatgaagatgatgatgaccagccccggggcctgaccaaggagcagattgacaacctggccatgaggagctttggagaaaatgatgccctgaagacctgcagcgtgtgcatcacagagtacacagagggcaacaagctgaggaagctgccctgcagccatgagtaccacgtgcactgcatcgaccgctggctgtctgagaacagcacctgccccatctgcagaagagctgtgctggccagcggcaaccgggagagcgtggtgtag

SEQ ID NO: 168552 - DNA, 1875 bp, Artificial Sequence; identical to SEQ ID NO: 168551
  Description of Artificial Sequence: Synthetic coding sequence

SEQ ID NO: 168553 - DNA, 954 bp, Artificial Sequence
  Description of Artificial Sequence: Synthetic coding sequence
tgactgcctgccccagctgctgccctgcccggggcccctcctcctcctcctggggtgcggggctacccagcccgggcccggggcctgcagggcgccagcggcggggcccgcttccccagcagcctgagcctgcctgtgcctggaaaaggaggctgggtggtgtcccgggccaagtttcctgccctggacagctgtgagatcaccacagcccacccccggctgtgctttgctgtgagcccccccttcagctgcagcctgcccctgcccagcctcttcccccacagccccctgctgggccggcccaagaggcaggccaagccagctgctgatgagggcttctgggactgcagcgtgtgcaccttcaggaacagcgctgaggccttcaagtgcagcatctgtgatgtgaggaagggcaccagcaccaggaagccccgcatcaacagccagctggtggcccagcaggtggcccagcagtatgccaccccacctccacccaagaaggagaagaaggagaaggtggagaagcaggacaaggagaagccagagaaggacaaggagatcagccccagcgtgaccaagaagaacaccaacaagaagaccaagcccaagagtgacatcctgaaggacccccccagcgaggccaacagcatccagagcgccaatgccaccaccaagaccagcgagaccaaccacaccagccggccccggctgaagaatgtggacaggagcacagcccagcagctggccgtgacagtgggcaatgtgaccgtcatcatcacagacttcaaggagaagaccaggagcagcagcaccagcagcagcacagtgaccagcagcgctggcagcgagcagcagaaccagagcagcagcggcagcgagagcacagacaagggcagcagccgcagcagcacccccaagggggacatgtctgctgtgaatgatgagagcttctag

SEQ ID NO: 168554 - DNA, 456 bp, Artificial Sequence
  Description of Artificial Sequence: Synthetic coding sequence
atggattctgctgcctgtgccgctgctgccacccctgtgcctgccctggccctggccctggccccagacctggcccaggcccccctggccctgcccggcctgctgagccccagctgcctgctgagcagcggccaggaggtgaatggcagcgagcggggcacctgcctgtggaggccctggctgagcagcaccaatgacagcccccggcagatgaggaagctggtggacctggccgccggcggggccacagctgctgaggtgaccaaggccgagagcaagttccaccaccctgtgcggctcttctggcccaagagccgcagctttgactacctgtacagcgctggggagatcctgctgcagaacttccctgtgcaggccaccatcaacctgtatgaggacagcgacagcgaggaggaggaggaggatgaggagcaggaggatgaggaggagaagtag

SEQ ID NO: 168555 - DNA, 315 bp, Artificial Sequence
  Description of Artificial Sequence: Synthetic coding sequence
atggattctgctgcctgtgccgctgctgccacccctgtgcctgccctggccctggccctggccccagacctggcccaggcccccctggccctgcccggcctgctgagccccagctgcctgctgagcagcggccaggaggtgaatggcagcgagcggctcttctggcccaagagccgcagctttgactacctgtacagcgctggggagatcctgctgcagaacttccctgtgcaggccaccatcaacctgtatgaagattctgattctgaggaggaggaggaggatgaggagcaggaggatgaggaggagaagtag

SEQ ID NO: 168556 - DNA, 213 bp, Artificial Sequence
  Description of Artificial Sequence: Synthetic coding sequence
atgccagatggccctggcatgacagctgccagcggcaagctgtaccagttccgccaccctgtgcggctcttctggcccaagagcaaatgttatgactacctgtaccaggaggccgaggccctgctgaagaacttccccatccaggccaccatctccttctatgaagattctgattctgaagatgaaattgaggacctgacctgtgaaaattag

SEQ ID NO: 168557 - DNA, 387 bp, Artificial Sequence
  Description of Artificial Sequence: Synthetic coding sequence
atggagaatgctgggggcgctgagggcacagagagcggggctgctgcctgtgccgccacagatggccccaccaggagagctggagctgacagcggctacgccggcttctggaggccctgggtggatgctgggggcaagaaggaggaggagacccccaaccacgccgctgaggccatgccagatggccctggcatgacagctgccagcggcaagctgtaccagttccgccaccctgtgcggctcttctggcccaagagcaaatgttatgactacctgtaccaggaggccgaggccctgctgaagaacttccccatccaggccaccatctccttctatgaagattctgattctgaagatgaaattgaggacctgacctgtgaaaattag

SEQ ID NO: 168558 - DNA, 444 bp, Artificial Sequence
  Description of Artificial Sequence: Synthetic coding sequence
atggctgctgctgctgacagcttcagcggcggccctgctggggtgcggctgcccaggagcccccccctgaaggtgctggccgagcagctgcggagagatgctgagggcggccctggggcctggaggctgagcagagctgctgctggccggggccccctggacctggccgctgtgtggatgcagggccgggtggtgatggctgacagaggagaggcccggctgcgggaccccagcggggacttctctgtgcggggcctggagcgggtgccccggggccggccctgcctggtgcctgggaagtatgtgatggtgatgggcgtggtgcaggcctgcagccctgagccctgcctgcaggccgtgaagatgacagacctgagtgacaaccccatccacgagagcatgtgggagctggaggtggaggacctgcacaggaacatcccctag

SEQ ID NO: 168559 - DNA, 255 bp, Artificial Sequence
  Description of Artificial Sequence: Synthetic coding sequence
atgaagcagacccaggtgggcagcctcttcagcctgggcatcagaaatcctgagcccggccctgtgtctggaacagctgtgccccggcagctggcctggaagagcggcaagtatgtgatggtgatgggcgtggtgcaggcctgcagccctgagccctgcctgcaggccgtgaagatgacagacctgagtgacaaccccatccacgagagcatgtgggagctggaggtggaggacctgcacaggaacatcccctag

SEQ ID NO: 168560 - DNA, 1431 bp, Artificial Sequence
  Description of Artificial Sequence: Synthetic coding sequence
atggccaacagcgccaaggccgaggagtatgagaagatgagcctggagcaggccaaggcctctgtgaacagcgagacagagagcagcttcaacatcaatgaaaacaccacagccagcggcaccggcctgtctgagaagacctctgtgtgccggcaggtggacatcgccaggaagaggaaggagtttgaagatgacctggtgaaggagagcagcagctgtgggaaggacacccccagcaagaagaggaagctggaccctgagatcgtgcctgaggagaaggactgtggagatgctgagggcaacagcaagaagaggaagcgggagacagaagatgtgcccaaggacaagagcagcactggagatggcacccagaacaagaggaagatcgccctggaggatgtgcctgagaagcagaagaacctggaggagggccacagcagcacagtggccgcccactacaatgagctgcaggaggtgggcctggagaagaggagccagagccgcatcttctacctgaggaacttcaacaactggatgaagtctgtgctgattggagagttcctggagaaggtgcggcagaagaagaagagggacatcaccgtgctggacctgggctgtgggaagggcggggacctgctgaagtggaagaagggccgcatcaacaagctggtgtgcacagacattgctgatgtgtctgtgaagcagtgccagcagagatatgaggacatgaagaacagaagagattctgagtacatcttctctgctgagttcatcacagctgacagcagcaaggagctgctgattgacaagttccgggacccccagatgtgctttgacatctgcagctgccagtttgtgtgccactacagctttgagagctatgagcaggccgacatgatgctgagaaatgcctgtgagcggctgagccctgggggctacttcatcggcaccacccccaacagctttgagctgatccggcggctggaggccagcgagacagagagctttggaaatgagatctacacagtgaagttccagaagaagggggactaccccctgtttggctgcaagtatgacttcaacctggagggcgtggtggatgtgcctgagttcctggtgtacttccccctgctgaatgagatggccaagaagtacaacatgaagctggtgtacaagaagaccttcctggagttctatgaggagaagatcaagaacaatgaaaacaagatgctgctgaagaggatgcaggccctggagccctacccagccaatgaaagcagcaagctggtgtctgagaaggtggatgattatgaacatgctgccaagtacatgaagaacagccaggtgcggctgcccctgggcaccctgagcaagtctgagtgggaggccaccagcatctacctggtgtttgcctttgagaagcagcagtag

SEQ ID NO: 168561 - DNA, 1431 bp, Artificial Sequence; identical to SEQ ID NO: 168560
  Description of Artificial Sequence: Synthetic coding sequence

SEQ ID NO: 168562 - DNA, 705 bp, Artificial Sequence
  Description of Artificial Sequence: Synthetic coding sequence
atgaagaacagaagagattctgagtacatcttctctgctgagttcatcacagctgacagcagcaaggagctgctgattgacaagttccgggacccccagatgtgctttgacatctgcagctgccagtttgtgtgccactacagctttgagagctatgagcaggccgacatgatgctgagaaatgcctgtgagcggctgagccctgggggctacttcatcggcaccacccccaacagctttgagctgatccggcggctggaggccagcgagacagagagctttggaaatgagatctacacagtgaagttccagaagaagggggactaccccctgtttggctgcaagtatgacttcaacctggagggcgtggtggatgtgcctgagttcctggtgtacttccccctgctgaatgagatggccaagaagtacaacatgaagctggtgtacaagaagaccttcctggagttctatgaggagaagatcaagaacaatgaaaacaagatgctgctgaagaggatgcaggccctggagccctacccagccaatgaaagcagcaagctggtgtctgagaaggtggatgattatgaacatgctgccaagtacatgaagaacagccaggtgcggctgcccctgggcaccctgagcaagtctgagtgggaggccaccagcatctacctggtgtttgcctttgagaagcagcagtag

SEQ ID NO: 168563 - DNA, 1431 bp, Artificial Sequence; identical to SEQ ID NO: 168560
  Description of Artificial Sequence: Synthetic coding sequence

SEQ ID NO: 168564 - DNA, 390 bp, Artificial Sequence
  Description of Artificial Sequence: Synthetic coding sequence
atgaagtctgtgctgattggagagttcctggagaaggtgcggcagaagaagaagagggacatcaccgtgctggacctgggctgtgggaagggcggggacctgctgaagtggaagaagggccgcatcaacaagctggtgtgcacagacattgctgatgtgtctgtgaagcagtgccagcagagatatgaggacatgaagaacagaagagattctgagtacatcttctctgctgagttcatcacagctgacagcagcaaggagctgctgattgacaagttccgggacccccagatgtgctttgacatctgcagctgccagtttgtgtgccactacagctttgagagctatgagcaggccgacatgatgctgagaaatgcctgtggcacctag

SEQ ID NO: 168565 - DNA, 468 bp, Artificial Sequence
  Description of Artificial Sequence: Synthetic coding sequence
atggcccccaggacctggtgcccagctggcatcttcggcctcttctgccccctgaccctggcctgcagcagcctgaccatcgccctgacagactgccagcccatcatcctggtgagccccaccctgagcctgtggatggtggtgcgctctgtgtggatcatgcaggccagcctgctgggggagcctgaggaggtggccctgggccccatgggcgtggtggccgccaccctggaggtggtgggcacccgggccatgggcgtggccggcatcatgacagtggacctggagggcatggacatggacatggatgtgcctgagaccatcatggccgagaccagggtggtgatgacagccacccaggaggagatcacagagaccatcatgaccacagagatgagacatgcccacaacatcggggagacctggatcagcgccctgtctgagcctgtgtgccacaccctgtcctag

SEQ ID NO: 168566 - DNA, 474 bp, Artificial Sequence
  Description of Artificial Sequence: Synthetic coding sequence
atgagcagcgaggagggcaagctgtttgtgggcggcctgaacttcaacacagatgagcaggccctggaggaccacttcagcagctttggccccatcagcgaggtggtggtggtgaaggaccgggagacccagaggagccggggcttcggcttcatcaccttcaccaaccctgagcacgcctctgtggccatgagggccatgaatggagagagcctggatggccggcagatccgggtggaccacgccggcaagagcgcccggggcacccggggcggcggctttggagcccacggccggggccgcagctacagccggggcggcggggaccagggctacggcagcggccgctactatgacagcaggcctgggggctacggctacggctacggccgcagccgggactacaacggcaggaaccagggcggctatgaccgctacagcggcggcaactacagagacaactatgacaactag

SEQ ID NO: 168567 - DNA, 474 bp, Artificial Sequence; identical to SEQ ID NO: 168566
  Description of Artificial Sequence: Synthetic coding sequence

SEQ ID NO: 168568 - DNA, 510 bp, Artificial Sequence
  Description of Artificial Sequence: Synthetic coding sequence
atggcccccaggacctggtgcccagctggcatcttcggcctcttctgccccctgaccctggcctgcagcagcctgaccatcgccctgacagactgccagcccatcatcctggtgagccccaccctgagcctgtggatggtggtgcgctctgtgtggatcatgcaggccagcctgctgggggagcctgaggaggtggccctgggccccatgggcgtggtggccgccaccctggaggtggtgggcacccgggccatgggcgtggccggcatcatgacagtggacctggagggcatggacatggacatggatgtgcctgagaccatcatggccgagaccagggtggtgatgacagccacccaggaggagatcacagagaccatcatgaccacagagatgagacatgcccacaacatcgacacccagggcatcatcagtgaccccggcagcagcttccagatggctgtgttcatcaaggtgtttggagctgcccccaagcacctgatcctgtag

SEQ ID NO: 168569 - DNA, 2559 bp, Artificial Sequence
  Description of Artificial Sequence: Synthetic coding sequence
atggagtatgaaagaagaggaggccgcggggacagaacaggccgctacggggccacagacaggagccaggatgatggaggagagaacagaagccgggaccatgactacagagacatggactaccgcagctacccccgggagtatggcagccaggagggcaagcatgactatgatgacagcagcgaggagcagagcgctgagatccggggccagctgcagagccatggagtgcaggcccgggaggtgcggctgatgaggaacaagagcagcggccagagccggggctttgcctttgtggagttcagccacctgcaggatgccacccgctggatggaggccaaccagcacagcctgaacatcctgggccagaaggtgtccatgcactacagcgaccccaagcccaagatcaatgaagactggctgtgcaacaagtgtggggtgcagaacttcaagaggcgggagaagtgcttcaagtgtggggtgcccaagtctgaggccgagcagaagctgcccctgggcacccggctggaccagcagaccctgcccctgggcggccgggagctgagccagggcctgctgcccctgccccagccctaccaggcccagggcgtgctggccagccaggccctgagccagggcagcgagcccagcagtgaaaatgccaatgacaccatcatcctgaggaacctgaacccccacagcaccatggacagcatcctgggcgccctggccccctatgctgtgctgagcagcagcaatgtgcgggtcatcaaggacaagcagacccagctgaacagaggatttgccttcatccagctgagcaccatcgaggccgcccagctgctgcagatcctgcaggccctgcacccccccctgaccattgatggcaagaccatcaacgtggagtttgccaagggcagcaagagggacatggccagcaatgaaggcagccgcatctctgctgcctctgtggccagcacagccatcgctgctgcccagtgggccatcagccaggccagccagggcggggagggcacctgggccaccagcgaggagccccctgtggactacagctactaccagcaggatgagggctacggcaacagccagggcacagagagcagcctgtatgcccacggctacctgaagggcaccaagggccctggcatcaccggcaccaagggggaccccaccggggccggccctgaggccagcctggagcccggggctgacagcgtgtccatgcaggccttcagccgggcccagcctggagctgcccctggcatctaccagcagagcgctgaggccagcagcagccagggcacagctgccaacagccagagctacaccatcatgagccctgctgtgctgaagtctgagctgcagagccccacccaccccagcagcgccctgcccccagccaccagccccacagcccaggagagctacagccagtaccctgtgcctgatgtgtccacctaccagtatgatgagaccagcggctactactatgacccccagacaggcctgtactatgaccccaacagccagtactactacaatgcccagagccagcagtacctgtactgggatggagagaggaggacctacgtgcctgccctggagcagagcgcagatggccacaaggagactggagcccccagcaaggagggcaaggagaagaaggagaagcacaagaccaagacagcccagcagatcgccaaggacatggagcgctgggcccggagcctgaacaagcagaaggagaacttcaagaacagcttccagcccatcagcagcctgagagatgatgagcggcgggagagcgccacagcagatgctggctacgccatcctggagaagaagggggccctggccgagcggcagcacacctccatggacctgcccaagctggccagtgatgaccggcccagccccccccggggcctggtggccgcctacagcggggagagtgacagcgaggaggagcaggagcggggcggccctgagcgggaggagaagctgacagactggcagaagctggcctgcctgctgtgccggcggcagttccccagcaaggaggccctgatccgccaccagcagctgagcggcctgcacaagcagaacctggagatccaccggcgggcccacctgtctgaaaatgagctggaggccctggagaagaatgacatggagcagatgaagtacagagacagagctgctgagcggcgggagaagtatggcatccctgagcccccagagcccaagaggaggaaatatggaggcatcagcacagcctctgtggactttgagcagcccaccagagatggcctgggcagtgacaacatcggcagcaggatgctgcaggccatgggctggaaggagggcagcggcctgggcaggaagaagcagggcatcgtgacccccatcgaggcccagaccagggtgcggggcagcggcctgggcgcccggggcagcagctatggagtgaccagcacagagagctacaaggagaccctgcacaagaccatggtgacccgcttcaatgaggcccagtag

SEQ ID NO: 168570 - DNA, 2562 bp, Artificial Sequence
  Description of Artificial Sequence: Synthetic coding sequence
atggagtatgaaagaagaggaggccgcggggacagaacaggccgctacggggccacagacaggagccaggatgatggaggagagaacagaagccgggaccatgactacagagacatggactaccgcagctacccccgggagtatggcagccaggagggcaagcatgactatgatgacagcagcgaggagcagagcgctgagatccggggccagctgcagagccatggagtgcaggcccgggaggtgcggctgatgaggaacaagagcagcggccagagccggggctttgcctttgtggagttcagccacctgcaggatgccacccgctggatggaggccaaccagcacagcctgaacatcctgggccagaaggtgtccatgcactacagcgaccccaagcccaagatcaatgaagactggctgtgcaacaagtgtggggtgcagaacttcaagaggcgggagaagtgcttcaagtgtggggtgcccaagtctgaggccgagcagaagctgcccctgggcacccggctggaccagcagaccctgcccctgggcggccgggagctgagccagggcctgctgcccctgccccagccctaccaggcccagggcgtgctggccagccaggccctgagccagggcagcgagcccagcagtgaaaatgccaatgacaccatcatcctgaggaacctgaacccccacagcaccatggacagcatcctgggcgccctggccccctatgctgtgctgagcagcagcaatgtgcgggtcatcaaggacaagcagacccagctgaacagaggatttgccttcatccagctgagcaccatcgtggaggccgcccagctgctgcagatcctgcaggccctgcacccccccctgaccattgatggcaagaccatcaacgtggagtttgccaagggcagcaagagggacatggccagcaatgaaggcagccgcatctctgctgcctctgtggccagcacagccatcgccgccgcccagtgggccatcagccaggccagccagggcggggagggcacctgggccaccagcgaggagccccctgtggactacagctactaccagcaggatgagggctacggcaacagccagggcacagagagcagcctgtatgcccacggctacctgaagggcaccaagggccctggcatcaccggcaccaagggggaccccactggagctggccctgaggccagcctggagcctggagctgacagcgtgtccatgcaggccttcagccgggcccagcccggggccgcccctggcatctaccagcagagcgctgaggccagcagcagccagggcacagctgccaacagccagagctacaccatcatgagccctgctgtgctgaagtctgagctgcagagccccacccaccccagcagcgccctgcccccagccaccagccccacagcccaggagagctacagccagtaccctgtgcctgatgtgtccacctaccagtatgatgagaccagcggctactactatgacccccagacaggcctgtactatgaccccaacagccagtactactacaatgcccagagccagcagtacctgtactgggatggagagaggaggacctacgtgcctgccctggagcagagcgcagatggccacaaggagaccggggcccccagcaaggagggcaaggagaagaaggagaagcacaagaccaagacagcccagcagatcgccaaggacatggagcgctgggcccggagcctgaacaagcagaaggagaacttcaagaacagcttccagcccatcagcagcctgagagatgatgaaagaagagagagcgccacagcagatgctggctacgccatcctggagaagaagggggccctggccgagcggcagcacacctccatggacctgcccaagctggccagtgatgaccggcccagccccccccggggcctggtggccgcctacagcggggagagtgacagcgaggaggagcaggagcggggcggccctgagcgggaggagaagctgacagactggcagaagctggcctgcctgctgtgccggcggcagttccccagcaaggaggccctgatccgccaccagcagctgagcggcctgcacaagcagaacctggagatccacagaagagcccacctgtctgaaaatgagctggaggccctggagaagaatgacatggagcagatgaagtacagagacagagctgctgagcggcgggagaagtatggcatccctgagcccccagagcccaagaggaggaaatatggaggcatcagcacagcctctgtggactttgagcagcccaccagagatggcctgggcagtgacaacatcggcagcaggatgctgcaggccatgggctggaaggagggcagcggcctgggcaggaagaagcagggcatcgtgacccccatcgaggcccagaccagggtgcggggcagcggcctgggcgcccggggcagcagctatggagtgaccagcacagagagctacaaggagaccctgcacaagaccatggtgacccgcttcaatgaggcccagtag

SEQ ID NO: 168571 - DNA, 2793 bp, Artificial Sequence
  Description of Artificial Sequence: Synthetic coding sequence
atggagtatgaaagaagaggaggccgcggggacagaacaggccgctacggggccacagacaggagccaggatgatggaggagagaacagaagccgggaccatgactacagagacatggactaccgcagctacccccgggagtatggcagccaggagggcaagcatgactatgatgacagcagcgaggagcagagcgcagaagattcctatgaggccagccctggcagcgagacccagaggagaagaagaagaagacaccgccacagccccactggacctcctggcttccccagagatggagactacagagaccaggactacagaacagagcagggcgaggaggaggaggaggaggaggatgaggaggaggaggagaaggccagcaacatcgtgatgctgaggatgctgccccaggccgccacagaagatgacatccggggccagctgcagagccacggcgtgcaggcccgggaggtgcggctgatgaggaacaagagcagcggccagagccggggctttgcctttgtggagttcagccacctgcaggatgccacccgctggatggaggccaaccagcacagcctgaacatcctgggccagaaggtgtccatgcactacagcgaccccaagcccaagatcaatgaagactggctgtgcaacaagtgtggggtgcagaacttcaagagaagagagaagtgcttcaagtgtggggtgcccaagtctgaggccgagcagaagctgcccctgggcacccggctggaccagcagaccctgcccctgggcggccgggagctgagccagggcctgctgcccctgccccagccctaccaggcccagggcgtgctggccagccaggccctgagccagggcagcgagcccagcagtgaaaatgccaatgacaccatcatcctgaggaacctgaacccccacagcaccatggacagcatcctgggcgccctggccccctatgctgtgctgagcagcagcaatgtgcgggtcatcaaggacaagcagacccagctgaacagaggatttgccttcatccagctgagcaccatcgtggaggccgcccagctgctgcagatcctgcaggccctgcacccccccctgaccattgatggcaagaccatcaacgtggagtttgccaagggcagcaagagggacatggccagcaatgaaggcagccgcatctctgctgcctctgtggccagcacagccatcgctgctgcccagtgggccatcagccaggccagccagggcggggagggcacctgggccaccagcgaggagccccctgtggactacagctactaccagcaggatgagggctacggcaacagccagggcacagagagcagcctgtatgcccacggctacctgaagggcaccaagggccctggcatcaccggcaccaagggggaccccaccggggccggccctgaggccagcctggagcccggggctgacagcgtgtccatgcaggccttcagccgggcccagcctggagctgcccctggcatctaccagcagagcgctgaggccagcagcagccagggcacagctgccaacagccagagctacaccatcatgagccctgctgtgctgaagtctgagctgcagagccccacccaccccagcagcgccctgcccccagccaccagccccacagcccaggagagctacagccagtaccctgtgcctgatgtgtccacctaccagtatgatgagaccagcggctactactatgacccccagacaggcctgtactatgaccccaacagccagtactactacaatgcccagagccagcagtacctgtactgggatggagagaggaggacctacgtgcctgccctggagcagagcgcagatggccacaaggagactggagcccccagcaaggagggcaaggagaagaaggagaagcacaagaccaagacagcccagcagatcgccaaggacatggagcgctgggcccggagcctgaacaagcagaaggagaacttcaagaacagcttccagcccatcagcagcctgagagatgatgagcggcgggagagcgccacagcagatgctggctacgccatcctggagaagaagggggccctggccgagcggcagcacacctccatggacctgcccaagctggccagtgatgaccggcccagccccccccggggcctggtggccgcctacagcggggagagtgacagcgaggaggagcaggagcggggcggccctgagcgggaggagaagctgacagactggcagaagctggcctgcctgctgtgccggcggcagttccccagcaaggaggccctgatccgccaccagcagctgagcggcctgcacaagcagaacctggagatccaccggcgggcccacctgtctgaaaatgagctggaggccctggagaagaatgacatggagcagatgaagtacagagacagagctgctgagcggcgggagaagtatggcatccctgagcccccagagcccaagaggaggaaatatggaggcatcagcacagcctctgtggactttgagcagcccaccagagatggcctgggcagtgacaacatcggcagcaggatgctgcaggccatgggctggaaggagggcagcggcctgggcaggaagaagcagggcatcgtgacccccatcgaggcccagaccagggtgcggggcagcggcctgggcgcccggggcagcagctatggagtgaccagcacagagagctacaaggagaccctgcacaagaccatggtgacccgcttcaatgaggcccagtag

SEQ ID NO: 168572 - DNA, 2010 bp, Artificial Sequence
  Description of Artificial Sequence: Synthetic coding sequence
atgaagatctttgtgggcaatgtggatggagctgacaccaccccagaggagctggccgccctgtttgccccctatggaacagtgatgagctgtgctgtgatgaagcagtttgcctttgtgcacatgagagaaaatgctggggccctgcgggccatcgaggccctgcacggccacgagctgcggcccggccgggccctggtggtggagatgagccggccccggcccctgaacacctggaagatctttgtgggcaatgtgtctgctgcctgcaccagccaggagctgcggagcctgtttgaaagaagaggccgggtgattgaatgtgatgtggtgaaggactatgcctttgtgcacatggagaaggaggctgatgccaaggccgccatcgcccagctgaatggcaaggaggtgaagggcaagaggatcaacgtggagctgagcaccaagggccagaagaagggccctggcctggccgtgcagagcggggacaagaccaagaagccaggggccggggacacagccttccctggcaccggcggcttcagcgccacctttgactaccagcaggcctttggaaacagcactggaggctttgatggccaggcccggcagcccaccccacccttcttcggccgggacaggagccccctgcggcgcagccccccccgggccagctatgtggcccccctgacagcccagcctgccacctaccgggcccagcccagcgtgtccctgggcgccgcctaccgggcccagcccagcgccagcctgggcgtgggctaccgcacccagcccatgacagcccaggccgccagctaccgggcccagcccagcgtgtccctgggcgccccctaccggggccagctggccagccccagcagccagagcgctgctgccagcagcctgggcccctatggaggagcccagcccagcgccagcgccctgagcagctatggaggccaggccgccgccgccagcagcctgaacagctatggagcccagggcagcagcctggccagctatggcaaccagcccagcagctatggagcccaggccgccagcagctatggagtgcgggctgctgccagcagctacaacacccagggcgccgccagcagcctgggcagctatggagcccaggccgccagctatggagcccagagcgctgccagcagcctggcctatggagcccaggccgccagctacaatgcccagcccagcgccagctacaatgcccagagcgccccctatgctgcccagcaggccgccagctacagcagccagcctgctgcctacgtggcccagcctgccacagctgctgcctatgccagccagcctgctgcctatgctgcccaggccaccacccccatggccggcagctatggagcccagcctgtggtgcagacccagctgaacagctatggagcccaggcctccatgggcctgagcggcagctatggagcccagagcgctgctgctgccaccggcagctatggagctgctgctgcctacggggcccagcccagcgccaccctggccgccccctaccgcacccagagcagcgccagcctggccgccagctatgctgcccagcagcacccccaggccgccgccagctaccggggccagcctggaaatgcctatgatggagctggccagcccagcgctgcctacctgtccatgagccagggcgctgtggccaatgccaacagcaccccaccaccctatgaaagaacccggctgagccccccccgggccagctatgatgacccctacaagaaggctgtggccatgagcaagagatatggcagtgaccggcggctggccgagctgagtgactacagaaggctgtctgagagccagctgtccttcagaagaagccccaccaagagcagcctggactaccgccgcctgcctgatgcccacagcgactatgcccgctacagcggcagctacaatgactacctgcgggccgcccagatgcacagcggctaccagaggaggatgtag

SEQ ID NO: 168573 - DNA, 471 bp, Artificial Sequence
  Description of Artificial Sequence: Synthetic coding sequence
atgaagatctttgtgggcaatgtggatggagctgacaccaccccagaggagctggccgccctgtttgccccctatggaacagtgatgagctgtgctgtgatgaagcagtttgcctttgtgcacatgagagaaaatgctggggccctgcgggccatcgaggccctgcacggccacgagctgcggcccggccgggccctggtggtggagatgagccggccccggcccctgaacacctggaagatctttgtgggcaatgtgtctgctgcctgcaccagccaggagctgcggagcctgtttgaaagaagaggccgggtgattgaatgtgatgtggtgaaggactatgcctttgtgcacatggagaaggaggctgatgccaaggccgccatcgcccagctgaatggcaaggaggtgaagggcaagaggatcaacgtggagctgagcaccaagggcatggtgcccaccggggtgtag

SEQ ID NO: 168574 - DNA, 360 bp, Artificial Sequence
  Description of Artificial Sequence: Synthetic coding sequence
atgaagatctttgtgggcaatgtggatggagctgacaccaccccagaggagctggccgccctgtttgccccctatggaacagtgatgagctgtgctgtgatgaagcagtttgcctttgtgcacatgagagaaaatgctggggccctgcgggccatcgaggccctgcacggccacgagctgcggcccggccgggccctggtggtggagatgagccggccccggcccctgaacacctggaagatctttgtgggcaatgtgtctgctgcctgcaccagccaggagctgcggagcctgtttgaaagaagaggccgggtgattgaatgtgatgtggtgaagggcatggtgcccactggagtgtag

SEQ ID NO: 168575 - DNA, 2934 bp, Artificial Sequence
  Description of Artificial Sequence: Synthetic coding sequence
atgaggacagctggccgggaccctgtgcccaggaggagcccccgctggaggagagctgtgcccctgtgtgagaccagcgctggaagaagagtgacccagctgcggggagatgacctgcggcggcctgccaccatgaagggcaaggagaggagccctgtgaaggccaagaggagccggggcggggaggacagcaccagcagaggagagaggagcaagaagctgggcggcagcggcggcagcaatggcagcagcagcggcaagacagacagcggcggcggcagcagaagaagcctgcacctggacaagagcagcagcagaggaggcagccgggagtatgacaccggcggcggcagcagcagcagccggctgcacagctacagcagccccagcaccaagaacagcagcggcggcggggagagccgcagcagcagccggggcggcggcggggagagccgcagcagcggggccgccagcagcgcccctggaggaggagatggagctgagtacaagaccctgaagatcagcgagctgggcagccagctgagtgatgaagctgtggaggatggcctcttccacgagttcaagagatttggagatgtgtctgtgaagatcagccacctgagcggcagcggcagcggagatgagcgggtggcctttgtgaacttcagaagaccagaagatgcccgggccgccaagcacgcccggggccgcctggtgctgtatgaccggcccctgaagattgaagctgtgtatgtgtccagaagaagaagccgcagccccctggacaaggacacctacccaccttctgcctctgtggtgggcgcctctgtgggcggccaccgccaccccccaggcggcggcggcggccagaggagcctgagccctggaggagctgccctgggctacagagactaccgcctgcagcagctggccctgggccgcctgcccccacctcctcctccacccctgccccgggacctggagcgggagcgggactaccccttctatgaaagagtgcggcctgcctacagcctggagccccgggtgggcgctggggccggggccgcccccttccgggaggtggatgagatcagcccagaagatgaccagagggccaacagaaccctcttcctgggcaacctggacatcaccgtgacagaaagtgacctgcggcgggcctttgacagatttggagtcatcacagaggtggacatcaagaggcccagccggggccagaccagcacctacggcttcctgaagtttgagaacctggacatgagccaccgggccaagctggccatgtctgggaagatcatcatccggaaccccatcaagattggctacggcaaggccacccccaccacccggctgtgggtgggcggcctgggcccctgggtgcccctggccgccctggcccgggagtttgaccgcttcggcaccatccgcaccatcgactacaggaagggggacagctgggcctacatccagtatgagagcctggatgctgcccatgctgcctggacccacatgaggggcttccccctgggcggccctgaccggcggctgcgggtggactttgctgacacagagcaccgctaccagcagcagtacctgcagcccctgcccctgacccactatgagctggtgacagatgccttcggccaccgggccccagaccccctgcggggggcccgggacaggaccccacccctgctgtacagagaccgggaccgggacctgtacccagacagcgactgggtgcccccacctcctcctgtgcgggagaggagcaccaggacagctgccacctctgtgcctgcctatgagcccctggacagcctggacagaagaagagatggctggagcctggaccgggacagaggagaccgggacctgcccagcagccgggaccagcccaggaagaggcggctgcctgaggagagcggcggccgccacctggacaggagccctgagagtgaccggcccaggaagaggcactgtgcccccagcccagacaggagccctgagctgagcagcagccgggaccgctacaacagcgacaatgacaggagcagccggctgctgctggagcggcccagccccatccgggacagaagaggcagcctggagaagagccagggcgacaagagggacaggaagaacagcgccagcgctgagcgggacaggaagcacaggaccacagcccccacagagggcaagagccccctgaagaaggaggacagaagtgatggcagcgcccccagcaccagcacagccagcagcaagctgaagagccccagccagaagcaggacggcggcacagcccctgtggccagcgccagccccaagctgtgcctggcctggcagggcatgctgctgctgaagaacagcaacttccccagcaacatgcacctgctgcagggcgacctgcaggtggccagcagcctgctggtggagggcagcactggaggcaaggtggcccagctgaagatcacccagaggctgcggctggaccagcccaagctggatgaggtgacccggcgcatcaaggtggccggccccaacggctacgccatcctgctggccgtgcccggcagcagtgacagccgcagcagcagcagcagcgctgccagtgacacagccaccagcacccagaggcccctgaggaacctggtgtcctacctgaagcagaagcaggccgccggggtcatcagcctgcctgtgggcggcaacaaggacaaggaaaatactggagtgctgcacgccttccccccctgtgagttcagccagcagttcctggacagccctgccaaggccctggccaagtctgaggaggactacctggtgatgatcatcgtgcggggcttcggcttccagatcggcgtgcgctatgagaacaagaagcgggagaacctggccctgaccctgctgtag

SEQ ID NO: 168576 - DNA, 2673 bp, Artificial Sequence
  Description of Artificial Sequence: Synthetic coding sequence
atgaagaggcagagcgagcgggacagcagccccagcggccggggcagcagcagcagcgccaagaggccccgggagcgggagcgggaggccgaggccggcggcagaagagctgcccacaaggccagcggcggggccaagcaccctgtgcctgcccgggcccgggacaagccccggggcagcggcagcggcggcggcggccacagagatggccggggcactggagatgccaaccaccgggccagcagcggccgcagcagcggcagcggggccggcggcggcggccggggcggcaaggccagcggggaccccggggccagcggcatgagcccccgggccagccccctgcccccacctcctcctcctcctggagctgagcccgcctgccccggcagcagcgctgctgcccctgagtacaagaccctgctgatcagcagcctgagccctgccctgcctgctgagcacctggaggacaggctcttccaccagttcaagagatttggagagatcagcctgcggctgagccacaccccagagctgggccgggtggcctacgtgaacttccgccacccccaggatgcccgggaggcccggcagcacgccctggcccggcagctgctgctgtatgaccggcccctgaaggtggagcctgtgtacctgcggggcggcggcggcagcagcagaagaagcagcagcagcagcgctgctgccagcaccccacctcctggccccccagccccagctgaccccctgggctacctgcccctgcacggcggctaccagtacaagcagaggagcctgagccctgtggccgccccacccctgcgggagccccgggcccggcatgctgctgctgcctttgccctggatgctgctgctgctgctgctgtgggcctgagccgggagcgggccctggactactacggcctgtatgatgaccggggccggccctacggctacccagctgtgtgtgaggaggacctgatgccagaagatgaccagagggccaccaggaacctcttcatcggcaacctggaccacagcgtgtctgaggtggagctgcggcgggcctttgagaagtatggcatcatcgaggaggtggtgatcaagaggcctgcccggggccagggcggggcctatgccttcctgaagttccagaacctggacatggcccaccgggccaaggtggccatgagcggccgggtcatcggcaggaaccccatcaagattggctacggcaaggccaaccccaccacccggctgtgggtgggcggcctgggccccaacaccagcctggccgccctggcccgggagtttgacagatttggcagcatccgcaccatcgaccacgtgaagggggacagctttgcctacatccagtatgagagcctggatgctgcccaggccgcctgtgccaagatgaggggcttccccctgggcggccctgaccggcggctgcgggtggactttgccaaggccgaggagacccgctacccccagcagtaccagcccagccccctgcctgtgcactatgagctgctgacagatggctacaccaggcacaggaacctggatgctgacctggtgcgggacaggaccccaccccacctgctgtacagcgaccgggacaggaccttcctggagggggactggaccagccccagcaagagcagtgacagaagaaacagcctggagggctacagccgctctgtgcgcagccgcagcggggagcgctggggcgcagatggagaccggggcctgcccaagccctgggaggagaggaggaagaggaggagcctgagcagtgaccggggccgcaccacccacagcccctatgaggagaggagcaggaccaagggcagcggccagcagagcgagcggggcagtgacaggaccccagagaggagcaggaaggagaaccacagcagcgagggcaccaaggagagcagcagcaacagcctgagcaacagccgccacggggctgaggagcggggccaccaccaccaccaccacgaggccgctgacagcagccacggcaagaaggcccgggacagcgagaggaaccacaggaccacagaagctgagcccaagcccctggaggagcccaagcatgagaccaagaagctgaagaacctgtctgaatatgcccagaccctgcagctgggctggaatggcctgctggtgctgaagaacagctgcttccccacctccatgcacatcctggagggggaccagggcgtcatcagcagcctgctgaaggaccacaccagcggcagcaagctgacccagctgaagatcgcccagaggctgcggctggaccagcccaagctggatgaggtgacccggcgcatcaagcagggcagccccaacggctatgctgtgctgctggccacccaggccacccccagcggcctgggcacagagggcatgcccaccgtggagcccggcctgcagaggcggctgctgaggaacctggtgtcctacctgaagcagaagcaggccgccggggtcatcagcctgcctgtgggcggcagcaagggcagagatggcaccggcatgctgtatgccttccccccctgtgacttcagccagcagtacctgcagagcgccctgcggaccctgggcaagctggaggaggagcacatggtgattgtgattgtgcgggacacagcctag

SEQ ID NO: 168577 - DNA, 765 bp, Artificial Sequence
  Description of Artificial Sequence: Synthetic coding sequence
atggagaccgtggtgtgccccccctgggaggagaggaggaagagaagaagcctgagcagtgaccggggccgcaccacccacagcccctatgaggagaggagcaggaccaagggcagcggccagcagagcgagcggggcagtgacaggaccccagagaggagcaggaaagaaaaccacagcagcgagggcaccaaggagagcagcagcaacagcctgagcaacagcagacatggagctgaggagcggggccaccaccaccaccaccatgaagctgctgacagcagccacggcaagaaggcccgggacagcgagaggaaccacaggaccacagaggccgagcccaagcccctggaggagcccaagcatgagaccaagaagctgaagaacctgtctgaatatgcccagaccctgcagctgggctggaatggcctgctggtgctgaagaacagctgcttccccacctccatgcacatcctggagggggaccagggcgtcatcagcagcctgctgaaggaccacaccagcggcagcaagctgacccagctgaagatcgcccagaggctgcggctggaccagcccaagctggatgaggtgacccggcgcatcaagcagggcagccccaacggctatgctgtgctgctggccacccaggccaccccatctggcctgggcacagagggcatgcccaccgtggagcccggcctgcagaggcggctgctgaggaacctggtgtcctacctgaagcagaagcaggccgccggctag

SEQ ID NO: 168578 - DNA, 636 bp, Artificial Sequence
  Description of Artificial Sequence: Synthetic coding sequence
atgaagaggcagagcgagaggaaccacaggaccacagaggccgagcccaagcccctggaggagcccaagcatgagaccaagaagctgaagaacctgtctgaatatgcccagaccctgcagctgggctggaatggcctgctggtgctgaagaacagctgcttccccacctccatgcacatcctggagggggaccagggcgtcatcagcagcctgctgaaggaccacaccagcggcagcaagctgacccagctgaagatcgcccagaggctgcggctggaccagcccaagctggatgaggtgacccggcgcatcaagcagggcagccccaacggctatgctgtgctgctggccacccaggccaccccatctggcctgggcacagagggcatgcccaccgtggagcccggcctgcagaggcggctgctgaggaacctggtgtcctacctgaagcagaagcaggccgccggggtcatcagcctgcctgtgggcggcagcaagggcagagatggcaccggcatgctgtatgccttccccccctgtgacttcagccagcagtacctgcagagcgccctgcggaccctgggcaagctggaggaggagcacatggtgattgtcatcgtgcgggacacagcctag

SEQ ID NO: 168579 - DNA, 1692 bp, Artificial Sequence
  Description of Artificial Sequence: Synthetic coding sequence
atgccagaagatgaccagagggccaccaggaacctcttcatcggcaacctggaccacagcgtgtctgaggtggagctgcggcgggcctttgagaagtatggcatcatcgaggaggtggtgatcaagaggcctgcccggggccagggcggggcctatgccttcctgaagttccagaacctggacatggcccaccgggccaaggtggccatgagcggccgggtgattggaagaaaccccatcaagattggctacggcaaggccaaccccaccacccggctgtgggtgggcggcctgggccccaacaccagcctggccgccctggcccgggagtttgaccgcttcggcagcatccgcaccatcgaccacgtgaagggggacagctttgcctacatccagtatgagagcctggatgctgcccaggccgcctgtgccaagatgaggggcttccccctgggcggccctgaccggcggctgcgggtggactttgccaaggccgaggagacccgctacccccagcagtaccagcccagccccctgcctgtgcactatgagctgctgacagatggctacaccaggcacaggaacctggatgctgacctggtgcgggacaggaccccaccccacctgctgtacagcgaccgggacaggaccttcctggagggggactggaccagccccagcaagagcagtgacagaagaaacagcctggagggctacagccgctctgtgcgcagccgctctggagagcgctggggcgcagatggagaccggggcctgcccaagccctgggaggagaggaggaagagaagaagcctgagcagtgaccggggccgcaccacccacagcccctatgaggagaggagcaggaccaagggcagcggccagcagagcgagcggggcagtgacaggaccccagagaggagcaggaaagaaaaccacagcagcgagggcaccaaggagagcagcagcaacagcctgagcaacagcagacatggagctgaggagcggggccaccaccaccaccaccatgaagctgctgacagcagccacggcaagaaggcccgggacagcgagaggaaccacaggaccacagaggccgagcccaagcccctggaggagcccaagcatgagaccaagaagctgaagaacctgtctgaatatgcccagaccctgcagctgggctggaatggcctgctggtgctgaagaacagctgcttccccacctccatgcacatcctggagggggaccagggcgtcatcagcagcctgctgaaggaccacaccagcggcagcaagctgacccagctgaagatcgcccagaggctgcggctggaccagcccaagctggatgaggtgacccggcgcatcaagcagggcagccccaacggctatgctgtgctgctggccacccaggccaccccatctggcctgggcacagagggcatgcccaccgtggagcccggcctgcagaggcggctgctgaggaacctggtgtcctacctgaagcagaagcaggccgccggggtcatcagcctgcctgtgggcggcagcaagggcagagatggcaccggcatgctgtatgccttccccccctgtgacttcagccagcagtacctgcagagcgccctgcggaccctgggcaagctggaggaggagcacatggtgattgtcatcgtgcgggacacagcctag

SEQ ID NO: 168580 - DNA, 732 bp, Artificial Sequence
  Description of Artificial Sequence: Synthetic coding sequence
atgggccgggtgggccgggccggccgcagccagaggaccaagcagagcacagtgctggcccctgtgattgacctgaagaggggcggcagcagtgatgaccggcagatcgtggacaccccaccccacgtggccgccggcctgaaggaccctgtgcccagcggcttctctgctggggaggtgctgatccccctggctgatgaatatgaccccatgttccccaatgactatgagaaggtggtgaagaggcagcgggaggagcggcagaggcagcgggagctggagcggcagaaggagattgaggagcgggagaagaggaggaaggacagacatgaggccagcggctttgcccggcggccagaccctgacagtgatgaagatgaagattatgagcgggagaggaggaagaggtccatgggcggggccgccatcgccccacccaccagcctggtggagaaggacaaggagctgccccgggacttcccctatgaggaggacagccggcccaggagccagagcagcaaggccgccatccccccacctgtgtatgaggagcaggaccggcccaggagccccaccggccccagcaacagcttcctggccaacatgggcggcaccgtggcccacaagatcatgcagaagtatggcttccgggagggccagggcctgggcaagcatgagcagggcctgagcacagccctgtctgtggagaagaccagcaagaggggcggctag

SEQ ID NO: 168581 - DNA, 1206 bp, Artificial Sequence
  Description of Artificial Sequence: Synthetic coding sequence
atgagcctgtatgatgacctgggcgtggagaccagtgacagcaagacagagggctggagcaagaacttcaagctgctgcagagccagctgcaggtgaagaaggccgccctgacccaggccaagagccagaggaccaagcagagcacagtgctggcccctgtgattgacctgaagaggggcggcagcagtgatgaccggcagatcgtggacaccccaccccacgtggccgccggcctgaaggaccctgtgcccagcggcttctctgctggggaggtgctgatccccctggctgatgaatatgaccccatgttccccaatgactatgagaaggtggtgaagaggcagcgggaggagcggcagaggcagcgggagctggagcggcagaaggagattgaggagcgggagaagaggaggaaggacagacatgaggccagcggctttgcccggcggccagaccctgacagtgatgaagatgaagattatgagcgggagaggaggaagaggtccatgggcggggccgccatcgccccacccaccagcctggtggagaaggacaaggagctgccccgggacttcccctatgaggaggacagccggcccaggagccagagcagcaaggccgccatccccccacctgtgtatgaggagcaggaccggcccaggagccccaccggccccagcaacagcttcctggccaacatgggcggcaccgtggcccacaagatcatgcagaagtatggcttccgggagggccagggcctgggcaagcatgagcagggcctgagcacagccctgtctgtggagaagaccagcaagaggggcggcaagatcatcgtgggagatgccacagagaaggatgccagcaagaagagtgacagcaaccccctgacagagatcctgaagtgccccaccaaggtggtgctgctgaggaacatggtgggcgctggggaggtggatgaggacctggaggtggagaccaaggaggagtgtgagaagtatggcaaggtgggcaaatgtgtgatctttgagatccctggggccccagatgatgaggccgtgcgcatcttcctggagtttgagcgggtggagagcgccatcaaggctgtggtggacctgaatggccgctactttggaggccgggtggtgaaggcctgcttctacaacctggacaagttccgggtgctggacctggccgagcaggtgtag

SEQ ID NO: 168582 - DNA, 639 bp, Artificial Sequence
  Description of Artificial Sequence: Synthetic coding sequence
atgagcctgtatgatgacctgggcgtggagaccagtgacagcaagacagagggctggagcaagaacttcaagctgctgcagagccagctgcaggtgaagaaggccgccctgacccaggccaagagccagaggaccaagcagagcacagtgctggcccctgtgattgacctgaagaggggcggcagcagtgatgaccggcagatcgtggacaccccaccccacgtggccgccggcctgaaggaccctgtgcccagcggcttctctgctggggaggtgctgatccccctggctgatgaatatgaccccatgttccccaatgactatgagaaggtggtgaagaggcagcgggaggagcggcagaggcagcgggagctggagcggcagaaggagattgaggagcgggagaagaggaggaaggacagacatgaggccagcggctttgcccggcggccagaccctgacagtgatgaagatgaagattatgagcgggagaggaggaagaggtccatgggcggggccgccatcgccccacccaccagcctggtggagaaggacaaggagctgccccgggacttcccctatgaggaggacagccggcccaggagccagagcagcaaggccgccatccccccaccctag

SEQ ID NO: 168583 - DNA, 666 bp, Artificial Sequence
  Description of Artificial Sequence: Synthetic coding sequence
atgagcctgtatgatgacctgggcgtggagaccagtgacagcaagacagagggctggagcaagaacttcaagctgctgcagagccagctgcaggtgaagaaggccgccctgacccaggccaagagccagaggaccaagcagagcacagtgctggcccctgtgattgacctgaagaggggcggcagcagtgatgaccggcagatcgtggacaccccaccccacgtggccgccggcctgaaggaccctgtgcccagcggcttctctgctggggaggtgctgatccccctggctgatgaatatgaccccatgttccccaatgactatgagaaggtggtgaagaggcagcgggaggagcggcagaggcagcgggagctggagcggcagaaggagattgaggagcgggagaagaggaaggacagacatgaggccagcggctttgcccggcggccagaccctgacagtgatgaagatgaggactatgaaagagagaggaggaagaggtccatgggcggggccgccatcgccccacccaccagcctggtggagaaggacaaggagctgccccgggacttcccctatgaggaggacagccggcccaggagccagagcagcaaggccgccatccccccacctgtgtatgaggagcaggaccggcccaggagctag

SEQ ID NO: 168584 - DNA, 732 bp, Artificial Sequence; identical to SEQ ID NO: 168580
  Description of Artificial Sequence: Synthetic coding sequence

SEQ ID NO: 168585 - DNA, 1206 bp, Artificial Sequence; identical to SEQ ID NO: 168581
  Description of Artificial Sequence: Synthetic coding sequence

SEQ ID NO: 168586 - DNA, 678 bp, Artificial Sequence
  Description of Artificial Sequence: Synthetic coding sequence
tgacccctggctgatgaatatgaccccatgttccccaatgactatgagaaggtggtgaagaggcagcgggaggagcggcagaggcagcgggagctggagcggcagaaggagattgaggagcgggagaagaggaggaaggacagacatgaggccagcggctttgcccggcggccagaccctgacagtgatgaagatgaggactatgaaagagagaggaggaagaggtccatgggcggggccgccatcgccccacccaccagcctggtggagaaggacaaggagctgccccgggacttcccctatgaggaggacagccggcccaggagccagagcagcaaggccgccatccccccacctgtgtatgaggagcaggaccggcccaggagccccaccggccccagcaacagcttcctggccaacatgggcggcaccgtggcccacaagatcatgcagaagtatggcttccgggagggccagggcctgggcaagcatgagcagggcctgagcacagccctgtctgtggagaagaccagcaagagaggaggcaagatcatcgtgggagatgccacagagaagggcgtgtcccctgggaagagggtgacccggggcaagggcctggcccccagcatcagtgacatggccagcctggacccccacgtgtctgctgggggccagtag

SEQ ID NO: 168587 - DNA, 3684 bp, Artificial Sequence
  Description of Artificial Sequence: Synthetic coding sequence
atggtgctggccgccgccatgagccaggatgctgaccccagcggccctgagcagcctgacagagtggcctgcagcgtgcctggggcccgggccagccctgcccccagcggcccccggggcatgcagcagcccccacctccaccccagcccccacctccaccccaggccggcctgccccagatcatccagaatgctgccaagctgctggacaagaaccccttctctgtgagcaaccccaaccccctgctgcccagccctgccagcctgcagctggcccagctgcaggcccagctgaccctgcaccggctgaagctggcccagacagctgtgaccaacaacacagctgctgccaccgtgctgaaccaggtgctgagcaaggtggccatgagccagcccctcttcaaccagctgcggcaccccagcgtcatcaccggcccccacggccacgccggcgtgccccagcacgccgccgccatccccagcacccgcttccccagcaatgccatcgccttcagcccccccagccagacccggggccctggccccagcatgaacctgcccaaccagccccccagcgccatggtgatgcaccccttcaccggggtgatgccccagaccccaggccagcctgctgtgatcctgggcatcggcaagacaggccctgccccagccacagctggcttctatgaatatggcaaggccagcagcggccagacctacggccctgagacagatggccagcccggcttcctgcccagcagcgccagcaccagcggctctgtgacctatgagggccactacagccacacaggccaggacggccaggccgccttcagcaaggacttctacggccccaacagccagggcagccacgtggccagcggcttccctgctgagcaggccggcggcctgaagtctgaggtgggccccctgctgcagggcaccaacagccagtgggagagcccccacggcttcagcggccagagcaagccagacctgacagctggccccatgtggcccccaccccacaaccagccctatgagctgtatgaccctgaggagcccaccagtgacaggaccccacccagctttggaggccgcctgaacaacagcaagcagggcttcatcggggccggccggcgggccaaggaggaccaggccctgctgtctgtgcggcccctgcaggcccacgagctgaatgacttccatggagtggcccccctgcacctgccccacatctgcagcatctgtgacaagaaggtgtttgacctgaaggactgggagctgcacgtgaagggcaagctgcacgcccagaagtgcctggtgttttctgaaaatgccggcatccgctgcatcctgggcagcgctgagggcaccctgtgtgccagccccaacagcacagctgtgtacaacccagctggaaatgaagattatgccagcaacctgggcaccagctatgtgcccatcccagcccgctccttcacccagagcagccccaccttccccctggcctctgtgggcaccacctttgcccagaggaagggggccggccgggtggtgcacatctgcaacctgcctgagggcagctgcacagaaaatgatgtgatcaacctgggcctgccctttgggaaggtgaccaactacatcctgatgaagagcaccaaccaggccttcctggagatggcctacacagaggccgcccaggccatggtgcagtactaccaggagaagtctgctgtgatcaacggggagaagctgctgatccgcatgagcaagcgctacaaggagctgcagctgaagaagccaggcaaggctgtggccgccatcatccaggacatccacagccagcgggagcgggacatgttccgggaggccgacagatatggccctgagcggcccaggagccgcagccctgtgagccgcagcctgagccccaggagccacacccccagcttcaccagctgcagcagcagccacagccccccaggccccagcagagctgactggggcaatggccgggacagctgggagcacagcccctatgcccggcgggaggaggagcgggaccctgccccctggagggacaatggagatgacaagagggacaggatggacccctgggcccatgacaggaagcaccacccccggcagctggacaaggccgagctggatgagaggcctgagggcggccggccccaccgggagaagtaccccaggagcggcagccccaacctgccccacagcgtgtcctcctacaagagccgggaggatggctactacaggaaggagcccaaggccaagtgggacaagtacctgaagcagcagcaggatgcccctggccgcagcaggaggaaggatgaggcccggctgcgggagagccgccacccccacccagatgattctgggaaggaggatggcctgggccccaaggtgacccgggcccctgagggcgccaaggccaagcagaatgagaagaacaagaccaagaggacagaccgggaccaggagggcgcagatgacagaaaagaaaacaccatggccgagaatgaagctgggaaggaggagcaggagggcatggaggagagcccccagagcgtgggccggcaggagaaggaggccgagttcagtgaccctgagaacaccaggaccaagaaggagcaggactgggagagcgagagcgaggccgagggggagagctggtaccccaccaacatggaggagctggtgacagtggatgaggtgggggaggaggaggacttcatcgtggagccagacatccctgagctggaggagatcgtgcccatcgaccagaaggacaagatctgcccagagacctgcctgtgtgtgaccaccaccctggacctggacctggcccaggacttccccaaggagggcgtgaaggctgtgggcaatggagctgctgagatcagcctgaagagcccccgggagctgcccagcgccagcaccagctgccccagcgacatggatgtggagatgcctggcctgaacctggatgctgagaggaagccagctgagagcgagaccggcctgagcctggaggacagcgactgctatgagaaggaggccaagggcgtggagagcagtgatgtgcacccagcccccaccgtgcagcagatgagcagccccaagccagctgaggagcgggcccggcagcccagcccctttgtggatgactgcaagacccggggcaccccagaagatggagcctgtgagggcagccccctggaggagaaggccagcccccccatcgagacagacctgcagaaccaggcctgccaggaggtgctgaccccagagaacagccgctacgtggagatgaagagcctggaggtgcgcagccctgagtacacagaggtggagctgaagcagcccctgagcctgcccagctgggagccagaagatgtgttcagcgagctgagcatccccctgggcgtggagtttgtggtgcccaggacaggcttctactgcaagctgtgtggcctcttctacaccagcgaggagacagccaagatgagccactgccgctctgctgtgcactacagaaacctgcagaagtacctgagccagctggccgaggagggcctgaaggagacagaaggagctgacagccccaggcctgaggacagcggcatcgtgcccaggtttgagaggaagaagctgtag

SEQ ID NO: 168588 - DNA, 3378 bp, Artificial Sequence
  Description of Artificial Sequence: Synthetic coding sequence
atggtgctggccgccgccatgagccaggatgctgaccccagcggccctgagcagcctgacagagtggcctgcagcgtgcctggggcccgggccagccctgcccccagcggcccccggggcatgcagcagcccccacctccaccccagcccccacctccaccccaggccggcctgccccagatcatccagaatgctgccaagctgctggacaagaaccccttctctgtgagcaaccccaaccccctgctgcccagccctgccagcctgcagctggcccagctgcaggcccagctgaccctgcaccggctgaagctggcccagacagctgtgaccaacaacacagctgctgccaccgtgctgaaccaggtgctgagcaaggtggccatgagccagcccctcttcaaccagctgcggcaccccagcgtcatcaccggcccccacggccacgccggcgtgccccagcacgccgccgccatccccagcacccgcttccccagcaatgccatcgccttcagcccccccagccagacccggggccctggccccagcatgaacctgcccaaccagccccccagcgccatggtgatgcaccccttcaccggggtgatgccccagaccccaggccagcctgctgtgatcctgggcatcggcaagacaggccctgccccagccacagctggcttctatgaatatggcaaggccagcagcggccagacctacggccctgagacagatggccagcccggcttcctgcccagcagcgccagcaccagcggctctgtgacctatgagggccactacagccacacaggccaggacggccaggccgccttcagcaaggacttctacggccccaacagccagggcagccacgtggccagcggcttccctgctgagcaggccggcggcctgaagtctgaggtgggccccctgctgcagggcaccaacagccagtgggagagcccccacggcttcagcggccagagcaagccagacctgacagctggccccatgtggcccccaccccacaaccagccctatgagctgtatgaccctgaggagcccaccagtgacaggaccccacccagctttggaggccgcctgaacaacagcaagcagggcttcatcggggccggccggcgggccaaggaggaccaggccctgctgtctgtgcggcccctgcaggcccacgagctgaatgacttccatggagtggcccccctgcacctgccccacatctgcagcatctgtgacaagaaggtgtttgacctgaaggactgggagctgcacgtgaagggcaagctgcacgcccagaagtgcctggtgttttctgaaaatgccggcatccgctgcatcctgggcagcgctgagggcaccctgtgtgccagccccaacagcacagctgtgtacaacccagctggaaatgaagattatgccagcaacctgggcaccagctatgtgcccatcccagcccgctccttcacccagagcagccccaccttccccctggcctctgtgggcaccacctttgcccagaggaagggggccggccgggtggtgcacatctgcaacctgcctgagggcagctgcacagaaaatgatgtgatcaacctgggcctgccctttgggaaggtgaccaactacatcctgatgaagagcaccaaccaggccttcctggagatggcctacacagaggccgcccaggccatggtgcagtactaccaggagaagtctgctgtgatcaacggggagaagctgctgatccgcatgagcaagcgctacaaggagctgcagctgaagaagccaggcaaggctgtggccgccatcatccaggacatccacagccagcgggagcgggacatgttccgggaggccgacagatatggccctgagcggcccaggagccgcagccctgtgagccgcagcctgagccccaggagccacacccccagcttcaccagctgcagcagcagccacagccccccaggccccagcagagctgactggggcaatggccgggacagctgggagcacagcccctatgcccggcgggaggaggagcgggaccctgccccctggagggacaatggagatgacaagagggacaggatggacccctgggcccatgacaggaagcaccacccccggcagctggacaaggccgagctggatgagaggcctgagggcggccggccccaccgggagaagtaccccaggagcggcagccccaacctgccccacagcgtgtcctcctacaagagccgggaggatggctactacaggaaggagcccaaggccaagtgggacaagtacctgaagcagcagcaggatgcccctggccgcagcaggaggaaggatgaggcccggctgcgggagagccgccacccccacccagatgattctgggaaggaggatggcctgggccccaaggtgacccgggcccctgagggcgccaaggccaagcagaatgagaagaacaagaccaagaggacagaccgggaccaggagggcgcagatgacagaaaagaaaacaccatggccgagaatgaagctgggaaggaggagcaggagggcatggaggagagcccccagagcgtgggccggcaggagaaggaggccgagttcagtgaccctgagaacaccaggaccaagaaggagcaggactgggagagcgagagcgaggccgagggggagagctggtaccccaccaacatggaggagctggtgacagtggatgaggtgggggaggaggaggacttcatcgtggagccagacatccctgagctggaggagatcgtgcccatcgaccagaaggacaagatctgcccagagacctgcctgtgtgtgaccaccaccctggacctggacctggcccaggacttccccaaggagggcgtgaaggctgtgggcaatggagctgctgagatcagcctgaagagcccccgggagctgcccagcgccagcaccagctgccccagcgacatggatgtggagatgcctggcctgaacctggatgctgagaggaagccagctgagagcgagaccggcctgagcctggaggacagcgactgctatgagaaggaggccaagggcgtggagagcagtgatgtgcacccagcccccaccgtgcagcagatgagcagccccaagccagctgaggagcgggcccggcagcccagcccctttgtggatgactgcaagacccggggcaccccagaagatggagcctgtgagggcagccccctggaggagaaggccagcccccccatcgagacagacctgcagaaccaggcctgccagggcagtgacagcgacacccggctggtgtctggctacagcctgacccccctggagaagaccccaggcacctggaagtag

SEQ ID NO: 168589 - DNA, 1263 bp, Artificial Sequence
  Description of Artificial Sequence: Synthetic coding sequence
atggccaccagcctgggcagcaacacctacaaccggcagaactgggaggatgctgacttccccatcctgtgccagacctgcctgggggagaacccctacatccgcatgaccaaggagaagtatggcaaggagtgcaagatctgtgcccggcccttcaccgtcttccgctggtgccctggggtgaggatgaggttcaagaagacagaggtgtgccagacctgcagcaagctgaagaatgtgtgccagacctgcctgctggacctggagtatggcctgcccatccaggtgagagatgctggcctgtccttcaaggatgacatgcccaagagtgatgtgaacaaggagtactacacccagaacatggagcgggagatcagcaacagtgatggcaccaggcctgtgggcatgctgggcaaggccaccagcaccagtgacatgctgctgaagctggcccggaccaccccctactacaagaggaaccggccccacatctgcagcttctgggtgaagggggagtgcaagagaggagaggagtgcccctacagacatgagaagcccacagatcctgatgaccccctggccgaccagaacatcaaggaccgctactacggcatcaatgaccctgtggccgacaagctgctgaagagggccagcaccatgccccggctggaccccccagaggacaagaccatcaccaccctgtatgtgggcggcctgggggacaccatcacagaaacagacctgaggaaccacttctaccagtttggagagatccgcaccatcaccgtggtgcagaggcagcagtgtgccttcatccagtttgccacccggcaggccgctgaggtggccgctgagaagagcttcaacaagctgattgtgaatggccggcggctgaatgtgaagtggggccgcagccaggccgcccggggcaaggagaaggagaaggatggcaccacagattctggcatcaagctggagcctgtgcccggcctgcccggggccctgcccccacctcctgctgctgaggaggaggccagcgccaactacttcaacctgcccccatctggccccccagctgtggtgaacatcgccctgcccccacctcctggcatcgcccctcctcctcctcctggcttcggcccccacatgttccaccccatgggccccccaccacccttcatgagggcccctggccccatccactaccccagccaggacccccagaggatgggcgcccacgccggcaagcacagcagcccctag

SEQ ID NO: 168590 - DNA, 1116 bp, Artificial Sequence
  Description of Artificial Sequence: Synthetic coding sequence
atggccaccagcctgggcagcaacacctacaaccggcagaactgggaggatgctgacttccccatcctgtgccagacctgcctgggggagaacccctacatccgcatgaccaaggagaagtatggcctgcccatccaggtgagagatgctggcctgtccttcaaggatgacatgcccaagagtgatgtgaacaaggagtactacacccagaacatggagcgggagatcagcaacagtgatggcaccaggcctgtgggcatgctgggcaaggccaccagcaccagtgacatgctgctgaagctggcccggaccaccccctactacaagaggaaccggccccacatctgcagcttctgggtgaagggggagtgcaagagaggagaagaatgtccctacagacatgagaagcccacagatcctgatgaccccctggccgaccagaacatcaaggaccgctactacggcatcaatgaccctgtggccgacaagctgctgaagagggccagcaccatgccccggctggaccccccagaggacaagaccatcaccaccctgtatgtgggcggcctgggggacaccatcacagaaacagacctgaggaaccacttctaccagtttggagagatccgcaccatcaccgtggtgcagaggcagcagtgtgccttcatccagtttgccacccggcaggccgctgaggtggccgctgagaagagcttcaacaagctgattgtgaatggaagaaggctgaatgtgaagtggggccgcagccaggccgcccggggcaaggagaaggagaaggatggcaccacagacagcggcatcaagctggagcctgtgcccggcctgcccggggccctgcccccacctcctgctgctgaggaggaggccagcgccaactacttcaacctgccccccagcggccccccagctgtggtgaacatcgccctgcccccacctcctggcatcgcccctcctcctcctcctggcttcggcccccacatgttccaccccatgggccccccaccacccttcatgagggcccctggccccatccactaccccagccaggacccccagaggatgggcgcccatgctgggaagcacagcagcccctag

SEQ ID NO: 168591 - DNA, 1116 bp, Artificial Sequence
  Description of Artificial Sequence: Synthetic coding sequence
atggccaccagcctgggcagcaacacctacaaccggcagaactgggaggatgctgacttccccatcctgtgccagacctgcctgggggagaacccctacatccgcatggagcgggagaagagcggcctgcccatccaggtgagagatgctggcctgtccttcaaggatgacatgcccaagagtgatgtgaacaaggagtactacacccagaacatggagcgggagatcagcaacagtgatggcaccaggcctgtgggcatgctgggcaaggccaccagcaccagtgacatgctgctgaagctggcccggaccaccccctactacaagaggaaccggccccacatctgcagcttctgggtgaagggggagtgcaagagaggagaagaatgtccctacagacatgagaagcccacagatcctgatgaccccctggccgaccagaacatcaaggaccgctactacggcatcaatgaccctgtggccgacaagctgctgaagagggccagcaccatgccccggctggaccccccagaggacaagaccatcaccaccctgtatgtgggcggcctgggggacaccatcacagaaacagacctgaggaaccacttctaccagtttggagagatccgcaccatcaccgtggtgcagaggcagcagtgtgccttcatccagtttgccacccggcaggccgctgaggtggccgctgagaagagcttcaacaagctgattgtgaatggaagaaggctgaatgtgaagtggggccgcagccaggccgcccggggcaaggagaaggagaaggatggcaccacagacagcggcatcaagctggagcctgtgcccggcctgcccggggccctgcccccacctcctgctgctgaggaggaggccagcgccaactacttcaacctgccccccagcggccccccagctgtggtgaacatcgccctgcccccacctcctggcatcgcccctcctcctcctcctggcttcggcccccacatgttccaccccatgggccccccaccacccttcatgagggcccctggccccatccactaccccagccaggacccccagaggatgggcgcccatgctgggaagcacagcagcccctag

SEQ ID NO: 168592 - DNA, 2532 bp, Artificial Sequence
  Description of Artificial Sequence: Synthetic coding sequence
atgtccttccccccccacctgaaccggccccccatgggcatcccagccctgcccccaggcatccccccaccccagtttcctggcttccccccacctgtgcccccaggcacccccatgatccctgtgcccatgagcatcatggccccagcccccaccgtgctggtgcccaccgtgtccatggtgggcaagcacctgggcgccaggaaggaccaccctggcctgaaggccaaggaaaatgatgagaactgtggccccaccaccaccgtgtttgtgggcaacatcagcgagaaggccagtgacatgctgatccggcagctgctggccaagtgtggcctggtgctgtcctggaagagggtgcagggcgccagcggcaagctgcaggccttcggcttctgtgagtacaaggagcctgagagcaccctgcgggccctgcggctgctgcatgacctgcagatcggggagaagaagctgctggtgaaggtggatgccaagaccaaggcccagctggatgagtggaaggccaagaagaaggccagcaatggaaatgcccggcctgagaccgtgaccaatgatgatgaggaggccctggatgaggagaccaagaggcgggaccagatgatcaagggggccatcgaggtgctgatccgggagtacagcagcgagctgaatgcccccagccaggagagtgacagccaccccaggaagaagaagaaggagaagaaggaggacatcttccgccgcttccctgtggcccccctcatcccctaccccctcatcaccaaggaggacatcaatgccatcgagatggaggaggacaagagggacctgatcagccgggagatcagcaagttccgggacacccacaagaagctggaggaggagaagggcaagaaggagaaggagcggcaggagattgagaaggagcggcgggagcgggagcgggagcgggagcgggagcgggagcggcgggagcgggagcgggagcgggagcgggagcgggagcgggagaaggagaaggagcgggagcgggagcgggagcgggaccgggaccgggacaggaccaaggagcgggaccgggaccgggaccgggagcgggaccgggaccgggaccgggagaggagcagtgacaggaacaaggacaggagccgcagccgggagaagagccgggaccgggagcgggagcgggagcgggagcgggagcgggagcgggagcgggagcgggagcgggagcgggagcgggagcgggagcgggagcgggagcgggagcgggagcgggagaaggacaagaagagggaccgggaggaggatgaggaggatgcctatgaaagaaggaagctggagaggaagctgcgggagaaggaggccgcctaccaggagcggctgaagaactgggagatccgggagaggaagaagacccgggagtatgagaaggaggccgagcgggaggaggagcggcggcgggagatggccaaggaggccaagaggctgaaggagttcctggaggactatgatgatgacagagatgaccccaagtactaccggggcagcgccctgcagaagaggctgcgggaccgggagaaggagatggaggctgatgagcgggacaggaagcgggagaaggaggagctggaggagatccggcagaggctgctggccgagggccacccagaccctgatgctgagctgcagaggatggagcaggaggccgagcggcggcggcagccccagatcaagcaggagcctgagagcgaggaggaggaggaggagaagcaggagaaggaggagaagcgggaggagcccatggaggaggaggaggagcctgagcagaagccctgcctgaagcccaccctgcggcccatcagcagcgcccccagcgtgagcagcgccagcggaaatgccacccccaacaccccaggagatgagagcccctgtggcatcatcatcccccatgagaacagcccagaccagcagcagcctgaggagcaccggcccaagattggcctgagcctgaagctgggcgccagcaacagccctggccagcccaacagcgtgaagaggaagaagctgcctgtggacagcgtcttcaacaagtttgaagatgaagattctgatgatgtgcccaggaagaggaagctggtgcccctggactatggagaagatgacaagaatgccaccaagggcaccgtgaacacagaggagaagaggaagcacatcaagagcctcatcgagaagatccccacagccaagccagagctgtttgcctaccccctggactggagcatcgtggacagcatcctgatggagcggcgcatccggccctggatcaacaagaagatcatcgagtacatcggggaggaggaggccaccctggtggactttgtgtgcagcaaggtgatggcccacagcagcccccagagcatcctggatgatgtggccatggtgctggatgaggaggccgaggtgttcatcgtgaagatgtggaggctgctgatctatgaaacagaggccaagaagattggcctggtgaagtag

SEQ ID NO: 168593 - DNA, 384 bp, Artificial Sequence
  Description of Artificial Sequence: Synthetic coding sequence
atgtccttccccccccacctgaaccggccccccatgggcatcccagccctgcccccaggcatccccccaccccagtttcctggcttccccccacctgtgcccccaggcacccccatgatccctgtgcccatgagcatcatggccccagcccccaccgtgctggtgcccaccgtgtccatggtgggcaagcacctgggcgccaggaaggaccaccctggcctgaaggccaaggaaaatgatgagaactgtggccccaccaccaccgtgtttgtgggcaacatcagcgagaaggccagtgacatgctgatccggcagctgctggccaagtgtggcctggtgctgtcctggaagagggtgcagggcgccagcggcaagctgcagtag

SEQ ID NO: 168594 - DNA, 903 bp, Artificial Sequence
  Description of Artificial Sequence: Synthetic coding sequence
atgtccttccccccccacctgaaccggccccccatgggcatcccagccctgcccccaggcatccccccaccccagtttcctggcttccccccacctgtgcccccaggcacccccatgatccctgtgcccatgagcatcatggccccagcccccaccgtgctggtgcccaccgtgtccatggtgggcaagcacctgggcgccaggaaggaccaccctggcctgaaggccaaggaaaatgatgagaactgtggccccaccaccaccgtgtttgtgggcaacatcagcgagaaggccagtgacatgctgatccggcagctgctggccaagtgtggcctggtgctgtcctggaagagggtgcagggcgccagcggcaagctgcaggccttcggcttctgtgagtacaaggagcctgagagcaccctgcgggccctgcggctgctgcatgacctgcagatcggggagaagaagctgctggtgaaggtggatgccaagaccaaggcccagctggatgagtggaaggccaagaagaaggccagcaatggaaatgcccggcctgagaccgtgaccaatgatgatgaggaggccctggatgaggagaccaagaggcgggaccagatgatcaagggggccatcgaggtgctgatccgggagtacagcagcgagctgaatgcccccagccaggagagtgacagccaccccaggaagaagaagaaggagaagaaggaggacatcttccgccgcttccctgtggcccccctcatcccctaccccctcatcaccaaggaggacatcaatgccatcgagatggaggaggacaagagggacctgatcagccgggagatcagcaagttccgggacacccacaaggtggtgttcctgtccttccacctgatccccatctag

SEQ ID NO: 168595 - DNA, 885 bp, Artificial Sequence
  Description of Artificial Sequence: Synthetic coding sequence
atgtccttccccccccacctgaaccggccccccatgggcatcccagccctgcccccaggcatccccccaccccagtttcctggcttccccccacctgtgcccccaggcacccccatgatccctgtgcccatgagcatcatggccccagcccccaccgtgctggtgcccaccgtgtccatggtgggcaagcacctgggcgccaggaaggaccaccctggcctgaaggccaaggaaaatgatgagaactgtggccccaccaccaccgtgtttgtgggcaacatcagcgagaaggccagtgacatgctgatccggcagctgctggccaagtgtggcctggtgctgtcctggaagagggtgcagggcgccagcggcaagctgcaggccttcggcttctgtgagtacaaggagcctgagagcaccctgcgggccctgcggctgctgcatgacctgcagatcggggagaagaagctgctggtgaaggtggatgccaagaccaaggcccagctggatgagtggaaggccaagaagaaggccagcaatggaaatgcccggcctgagaccgtgaccaatgatgatgaggaggccctggatgaggagaccaagaggcgggaccagatgatcaagggggccatcgaggtgctgatccgggagtacagcagcgagctgaatgcccccagccaggagagtgacagccaccccaggaagaagaagaaggagaagaaggaggacatcttccgccgcttccctgtggcccccctcatcccctaccccctcatcaccaaggaggacatcaatgccatcgagatggaggaggacaagagggacctgatcagccgggagatcagcaagttccgggacacccacaagaggagctatggagactag

SEQ ID NO: 168596 - DNA, 2532 bp, Artificial Sequence; identical to SEQ ID NO: 168592
  Description of Artificial Sequence: Synthetic coding sequence

SEQ ID NO: 168597 - DNA, 732 bp, Artificial Sequence
  Description of Artificial Sequence: Synthetic coding sequence
atgtccttccccccccacctgaaccggccccccatgggcatcccagccctgcccccaggcatccccccaccccagtttcctggcttccccccacctgtgcccccaggcacccccatgatccctgtgcccatgagcatcatggccccagcccccaccgtgctggtgcccaccgtgtccatggtgggcaagcacctgggcgccaggaaggaccaccctggcctgaaggccaaggaaaatgatgagaactgtggccccaccaccaccgtgtttgtgggcaacatcagcgagaaggccagtgacatgctgatccggcagctgctggccaagtgtggcctggtgctgtcctggaagagggtgcagggcgccagcggcaagctgcaggccttcggcttctgtgagtacaaggagcctgagagcaccctgcgggccctgcggctgctgcatgacctgcagatcggggagaagaagctgctggtgaaggtggatgccaagaccaaggcccagctggatgagtggaaggccaagaagaaggccagcaatggaaatgcccggcctgagaccgtgaccaatgatgatgaggaggccctggatgaggagaccaagaggcgggaccagatgatcaagggggccatcgaggtgctgatccgggagtacagcagcgagctgaatgcccccagccaggagagtgacagccaccccaggaagaagaagaaggagaagaaggaggactag

SEQ ID NO: 168598 - DNA, 885 bp, Artificial Sequence; identical to SEQ ID NO: 168595
  Description of Artificial Sequence: Synthetic coding sequence

SEQ ID NO: 168599 - DNA, 1350 bp, Artificial Sequence
  Description of Artificial Sequence: Synthetic coding sequence
atgctgcctgctgccacagccagcctgctgggccccctgctgacagcctgtgccctgctgccctttgcccagggccagacccccaactacaccaggcctgtgttcctgtgtggaggagatgtgaagggggagagcggctacgtggccagcgagggcttccccaacctgtacccacccaacaaggagtgcatctggaccatcaccgtgcctgagggccagacagtgtccctgtccttccgggtgtttgacctggagctgcacccagcctgccgctatgatgccctggaggtgtttgctggcagcggcaccagcggccagaggctgggccgcttctgtggcaccttccggcctgcccccctggtggcccctggcaaccaggtgaccctgaggatgaccacagatgagggcactggaggccggggcttcctgctgtggtacagcggccgggccaccagcggcacagagcaccagttctgtggcggccgcctggagaaggcccagggcaccctgaccacccccaactggccagagagtgactacccacctggcatcagctgctcctggcacatcatcgcccccccagaccaggtgattgccctgacctttgagaagtttgacctggagccagacacctactgccgctatgattctgtgtctgtgttcaacggggctgtgtctgatgacagccggcggctgggcaagttctgtggagatgctgtgcccggcagcatcagcagcgagggcaatgagctgctggtgcagtttgtgtctgacctgtctgtgacagcagatggcttcagcgccagctacaagaccctgccccggggcacagccaaggagggccagggccctggccccaagaggggcacagagcccaaggtgaagctgccccccaagagccagcccccagagaagacagaggagagccccagcgccccagatgcccccacctgccccaagcagtgcagaagaacaggcaccctgcagagcaacttctgtgccagcagcctggtggtgacagccaccgtgaagtccatggtgcgggagcccggggagggcctggccgtgacagtgtccctgattggagcctacaagacaggaggcctggacctgcccagcccccccaccggggccagcctgaagttctacgtgccctgcaagcagtgcccccccatgaagaagggcgtgtcctacctgctgatgggccaggtggaggagaacagaggccctgtgctgcccccagagagctttgtggtgctgcaccggcccaaccaggaccagatcctgaccaacctgagcaagaggaagtgccccagccagcctgtgcgggctgctgccagccaggactag

SEQ ID NO: 168600 - DNA, 1857 bp, Artificial Sequence
  Description of Artificial Sequence: Synthetic coding sequence
atggccggcctgaccctgtttgtgggccgcctgccccccagcgcccggtctgagcagctggaggagctgttcagccaggtgggccctgtgaagcagtgctttgtggtgacagagaagggccgcacagtggccgtggactgggccgtggccaaggacaagtacaaggacacccagagcgtgtctgccatcggggaggagaagagccatgagagcaagcaccaggagagcgtgaagaagaagggccgggaggaggaggacatggaggaggaggagaatgatgatgatgatgatgatgatgatgaggaggatggagtgtttgatgatgaagatgaggaggaggagaacatcgagagcaaggtgaccaagcctgtgcagatccagaagagagctgtgaagaggcctgccccagccaagagcagtgaccacagtgaagaagattctgacctggaggagagtgacagcattgatgatggagaggagctggcccagagcgacaccagcacagaggagcaggaggacaaggctgtgcaggtgagcaacaagaagaagaggaagctgcccagtgatgtgaatgaaggcaagacagtgttcatccggaacctgagctttgattctgaggaggaggagctgggggagctgctgcagcagtttggagagctgaagtatgtgagaattgtgctgcacccagacacagagcacagcaagggctgtgcctttgcccagttcatgacccaggaggccgcccagaagtgcctgctggccgccagcccagaaaatgaagctgggggcctgaagctggatggccggcagctgaaggtggacctggccgtgaccagagatgaggccgccaagctgcagaccaccaaggtgaagaagcccaccggcaccaggaacctgtacctggcccgggagggcctcatccgggccggcaccaaggctgctgagggcgtgtctgctgctgacatggccaagcgggagagatttgagctgctgaagcaccagaagctgaaggaccagaacatctttgtgtccaggacccggctgtgcctgcacaacctgcccaaggctgtggatgacaagcagctgaggaagctgctgctgagcgccaccagcggggagaagggcgtgcgcatcaaggagtgccgggtgatgagggacctgaagggcgtgcacggcaacatgaagggccagagcctgggctacgcctttgctgagttccaggagcatgaacatgccctgaaggccctgcggctcatcaacaacaaccctgagatcttcggccccctgaagaggcccatcgtggagttcagcctggaggacaggaggaagctgaagatgaaggagctgcgcatccagaggagcctgcagaagatgaggagcaagccagccaccggggagccccagaagggccagcctgagcccgccaaggaccagcagcagaaggccgcccagcaccacacagaggagcagagcaaggtgcccccagagcagaagaggaaggccggcagcacctcctggacaggcttccagaccaaggccgaggtggagcaggtggagctgcctgatggcaagaagaggaggaaggtgctggccctgcccagccaccggggccccaagatccggctgcgggacaagggcaaggtgaagcctgtgcaccccaagaagcccaagccccagatcaaccagtggaagcaggagaagcagcagctgagcagcgagcaggtgtccaggaagaaggccaagggcaacaagacagagacccgcttcaaccagctggtggagcagtacaagcagaagctgctgggccccagcaaaggagcccccctggccaagaggagcaagtggtttgacagctag

SEQ ID NO: 168601 - DNA, 720 bp, Artificial Sequence
  Description of Artificial Sequence: Synthetic coding sequence
atgctgctgcagcctgccccctgtgcccccagcgctggcttcccccggcccctggccgcccctggggccatgcacggcagccagaaggacaccaccttcaccaagatctttgtgggcggcctgccctaccacaccacagatgccagcctgaggaagtactttgagggctttggagacatcgaggaggccgtggtgatcacagaccggcagacaggcaagagccggggctacggctttgtgaccatggctgacagagctgctgctgagcgggcctgcaaggaccccaaccccatcattgatggcaggaaggccaacgtgaacctggcctacctgggcgccaagcccaggagcctgcagacaggctttgccatcggcgtgcagcagctgcaccccaccctcatccagaggacctacggcctgaccccccactacatctaccccccagccatcgtgcagcccagcgtggtgatcccagctgcccctgtgcccagcctgagcagcccctacatcgagtacaccccagccagccctgcctatgcccagtaccccccagccacctatgaccagtacccctatgctgccagccctgccacagctgccagctttgtgggctacagctacccagctgctgtgccccaggccctgtctgctgctgccccagctggcaccacctttgtgcagtaccaggccccccagctgcagcctgacaggatgcagtag

SEQ ID NO: 168602 - DNA, 477 bp, Artificial Sequence
  Description of Artificial Sequence: Synthetic coding sequence
atggctgacagagctgctgctgagcgggcctgcaaggaccccaaccccatcattgatggcaggaaggccaacgtgaacctggcctacctgggcgccaagcccaggagcctgcagacaggctttgccatcggcgtgcagcagctgcaccccaccctcatccagaggacctacggcctgaccccccactacatctaccccccagccatcgtgcagcccagcgtggtgatcccagctgcccctgtgcccagcctgagcagcccctacatcgagtacaccccagccagccctgcctatgcccagtaccccccagccacctatgaccagtacccctatgctgccagccctgccacagctgccagctttgtgggctacagctacccagctgctgtgccccaggccctgtctgctgctgccccagctggcaccacctttgtgcagtaccaggccccccagctgcagcctgacaggatgcagtag

SEQ ID NO: 168603 - DNA, 366 bp, Artificial Sequence
  Description of Artificial Sequence: Synthetic coding sequence
atgctgctgcagcctgccccctgtgcccccagcgctggcttcccccggcccctggccgcccctggggccatgcacggcagccagaaggacaccaccttcaccaagatctttgtgggcggcctgccctaccacaccacagatgccagcctgaggaagtactttgagggctttggagacatcgaggaggccgtggtgatcacagaccggcagacaggcaagagccggggctacggctttgtgaccatggctgacagagctgctgctgagcgggcctgcaaggaccccaaccccatcattgatggcaggaaggccaacgtgaacctggcctacctgggcgccaagcccaggagcctgcagacaggatag

SEQ ID NO: 168604 - DNA, 1095 bp, Artificial Sequence
  Description of Artificial Sequence: Synthetic coding sequence
atggtgaagctgttcatcggcaacctgccccgggaggccacagagcaggagatccgcagcctgtttgagcagtatggcaaggtgctggagtgtgacatcatcaagaactacggctttgtgcacatcgaggacaagacagctgctgaagatgccatccggaacctgcaccactacaagctgcatggagtgaacatcaacgtggaggccagcaagaacaagagcaagaccagcaccaagctgcacgtgggcaacatcagccccacctgcaccaacaaggagctgcgggccaagtttgaggagtatggccctgtgattgaatgtgacatcgtgaaggactatgcctttgtgcacatggagcgggcagaagatgctgtggaggccatccggggcctggacaacacagagttccagggcaagaggatgcacgtgcagctgagcaccagccggctgaggacagcccctggcatgggagaccagagcggctgctaccgctgtgggaaggagggccactggagcaaggagtgccccatcgacaggagcggccgggtggccgacctgacagagcagtacaatgagcagtacggggctgtgaggaccccctacaccatgtcctatggagacagcctgtactacaacaatgcctatggagccctggatgcctactacaagcgctgcagagctgcccggagctatgaagctgtggccgctgctgctgcctctgtgtacaactatgcagagcagaccctgagccagctgccccaggtgcagaacacagccatggccagccacctgaccagcaccagcctggacccctatgacagacacctgctgcccaccagcggggctgctgccacagctgctgctgctgctgctgctgctgctgctgtgacagctgccagcaccagctactacggccgggacaggagccccctgcggcgggccacagcccctgtgcccaccgtgggggagggctacggctacggccatgaaagtgagctgagccaggccagcgctgctgccaggaacagcctgtatgacatggcccgctatgaaagagagcagtatgctgaccgggcccgctacagcgccttctag

SEQ ID NO: 168605 - DNA, 1095 bp, Artificial Sequence; identical to SEQ ID NO: 168604
  Description of Artificial Sequence: Synthetic coding sequence

SEQ ID NO: 168606 - DNA, 1095 bp, Artificial Sequence; identical to SEQ ID NO: 168604
  Description of Artificial Sequence: Synthetic coding sequence

SEQ ID NO: 168607 - DNA, 534 bp, Artificial Sequence
  Description of Artificial Sequence: Synthetic coding sequence
atggtgaagctgttcatcggcaacctgccccgggaggccacagagcaggagatccgcagcctgtttgagcagtatggcaaggtgctggagtgtgacatcatcaagaactacggctttgtgcacatcgaggacaagacagctgctgaagatgccatccggaacctgcaccactacaagctgcatggagtgaacatcaacgtggaggccagcaagaacaagagcaagaccagcaccaagctgcacgtgggcaacatcagccccacctgcaccaacaaggagctgcgggccaagtttgaggagtatggccctgtgattgaatgtgacatcgtgaaggactatgcctttgtgcacatggagcgggcagaagatgctgtggaggccatccggggcctggacaacacagagttccagggcgagccccccagcctgggccggggcctgaacacccggctgtgtgccgagaatggctggatcagcaagagaagaggcctggtgaagatcacagctgtgggctggctggtgatgaagaagtag

SEQ ID NO: 168608 - DNA, 534 bp, Artificial Sequence; identical to SEQ ID NO: 168607
  Description of Artificial Sequence: Synthetic coding sequence

SEQ ID NO: 168609 - DNA, 522 bp, Artificial Sequence
  Description of Artificial Sequence: Synthetic coding sequence
atggtgaagctgttcatcggcaacctgccccgggaggccacagagcaggagatccgcagcctgtttgagcagtatggcaaggtgctggagtgtgacatcatcaagaactacggctttgtgcacatcgaggacaagacagctgctgaagatgccatccggaacctgcaccactacaagctgcatggagtgaacatcaacgtggaggccagcaagaacaagagcaagaccagcaccaagctgcacgtgggcaacatcagccccacctgcaccaacaaggagctgcgggccaagtttgaggagtatggccctgtgattgaatgtgacatcgtgaaggactatgcctttgtgcacatggagcgggcagaagatgctgtggaggccatccggggcctggacaacacagagttccagggcaagatcacccctgtgacagagggctactgctgctgcaacaagggccacacctacatcttcaagaactgcaacctgatcctggagagcaggaagagccgccgctgctag

SEQ ID NO: 168610 - DNA, 432 bp, Artificial Sequence
  Description of Artificial Sequence: Synthetic coding sequence
atggtgaagctgttcatcggcaacctgccccgggaggccacagagcaggagatccgcagcctgtttgagcagtatggcaaggtgctggagtgtgacatcatcaagaactacggctttgtgcacatcgaggacaagacagctgctgaagatgccatccggaacctgcaccactacaagctgcatggagtgaacatcaacgtggaggccagcaagaacaagagcaagaccagcaccaagctgcacgtgggcaacatcagccccacctgcaccaacaaggagctgcgggccaagtttgaggagtatggccctgtgattgaatgtgacatcgtgaaggactatgcctttgtgcacatggagcgggcagaagatgctgtggaggccatccggggcctggacaacacagagttccagggcggcatgtgtgtgggctag

SEQ ID NO: 168611 - DNA, 1443 bp, Artificial Sequence
  Description of Artificial Sequence: Synthetic coding sequence
atggccggggccggccctgcccctggcctgcctggagctgggggccctgtggtgcccggccctggagctggcatccctgggaagtctggagaggagcggctgaaggagatggaggccgagatggccctgtttgagcaggaggtgctgggcgcccctgtgcccggcatccccacagctgtgcctgctgtgcccaccgtgcccaccgtgcccaccgtggaggccatgcaggtgcctgctgcccctgtgatccggcccatcatcgccaccaacacctaccagcaggtgcagcagaccctggaggcccgggctgctgctgctgccaccgtggtgccccccatggtgggcggccccccatttgtgggccctgtgggctttggacctggggacaggagccacctggacagccctgaggcccgggaggccatgttcctgcggcgggctgctgtggccccccagagggcccccatcctgcggcctgcctttgtgccccacgtgctgcagagagctgacagcgccctgagcagcgctgctgctggcccccggcccatggccctgcggcccccccaccaggccctggtgggcccccccctgcccggccccccaggcccccccatgatgctgccccccatggcccgggcccctggcccccccctgggctccatggccgccctgcggccccccctggaggagcctgctgccccccgggagctgggcctgggcctgggcctgggcctgaaggagaaggaggaggccgtggtggccgctgctgctggcctggaggaggccagcgctgctgtggccgtgggcgctgggggcgccccagctggccctgctgtgattggccccagcctgcccctggccctggccatgcccctgcctgagcctgagcccctgcccctgcccctggaggtggtgcggggcctgctgccccccctgcgcatccctgagctgctgagcctgcggccccggccccggccccccaggcctgagcccccacctggcctgatggccctggaggtgcctgagcccctgggggaggacaagaagaagggcaagccagagaagctgaagcgctgcatcagaacagctgctggcagctcctgggaggaccccagcctgctggagtgggatgctgatgacttccgcatcttctgtggggacctgggcaatgaggtgaatgatgacatcctggcccgggccttcagccgcttccccagcttcctgaaggccaaggtgatccgggacaagaggacaggcaagaccaagggctacggctttgtgtccttcaaggaccccagcgactatgtgcgggccatgagggagatgaatggcaagtatgtgggcagccggcccatcaagctgaggaagtccatgtggaaggacaggaacctggatgtggtgaggaagaagcagaaggagaagaagaagctgggcctgaggtag

SEQ ID NO: 168612 - DNA, 1356 bp, Artificial Sequence
  Description of Artificial Sequence: Synthetic coding sequence
atggccggggccggccctgcccctggcctgcctggagctgggggccctgtggtgcccggccctggagctggcatccctgggaagtctggagaggagcggctgaaggagatggaggccgagatggccctgtttgagcaggaggtgctgggcgcccctgtgcccggcatccccacagctgtgcctgctgtgcccaccgtgcccaccgtgcccaccgtggaggccatgcaggtgcctgctgcccctgtgatccggcccatcatcgccaccaacacctaccagcaggtgcagcagaccctggaggcccgggctgctgctgctgccaccgtggtgccccccatggtgggcggccccccatttgtgggccctgtgggctttggacctggggacaggagccacctggacagccctgaggcccgggaggccatgttcctgcggcgggctgctgctggcccccggcccatggccctgcggcccccccaccaggccctggtgggcccccccctgcccggccccccaggcccccccatgatgctgccccccatggcccgggcccctggcccccccctgggctccatggccgccctgcggccccccctggaggagcctgctgccccccgggagctgggcctgggcctgggcctgggcctgaaggagaaggaggaggccgtggtggccgctgctgctggcctggaggaggccagcgctgctgtggccgtgggcgccggcggggccccagctggccctgctgtgattggccccagcctgcccctggccctggccatgcccctgcctgagcctgagcccctgcccctgcccctggaggtggtgcggggcctgctgccccccctgcgcatccctgagctgctgagcctgcggccccggcccaggcctcccaggcctgagcccccacctggcctgatggccctggaggtgcctgagcccctgggggaggacaagaagaagggcaagccagagaagctgaagcgctgcatcagaacagctgctggcagctcctgggaggaccccagcctgctggagtgggatgctgatgacttccgcatcttctgtggggacctgggcaatgaggtgaatgatgacatcctggcccgggccttcagccgcttccccagcttcctgaaggccaaggtgatccgggacaagaggacaggcaagaccaagggctacggctttgtgtccttcaaggaccccagcgactatgtgcgggccatgagggagatgaatggcaagtatgtgggcagccggcccatcaagctgaggaagtccatgtggaaggacaggaacctggatgtggtgaggaagaagcagaaggagaagaagaagctgggcctgaggtag

SEQ ID NO: 168613 - DNA, 801 bp, Artificial Sequence
  Description of Artificial Sequence: Synthetic coding sequence
atgggcgctgctgctgctgaggccgacaggaccctgtttgtgggcaacctggagaccaaggtgacagaggagctgctgtttgagctgttccaccaggccggccctgtgatcaaggtgaagatccccaaggacaaggatggcaagcccaagcagtttgcctttgtgaacttcaagcatgaggtgtctgtgccctatgccatgaacctgctgaatggcatcaagctgtatggccggcccatcaagatccagttccgcagcggcagcagccacgccccccaggatgtgtccctgagctacccccagcaccacgtgggcaacagcagccccaccagcaccagccccagccgctatgaaagaaccatggacaacatgaccagcagcgcccagatcatccagaggagcttcagcagccctgagaacttccagaggcaggccgtgatgaacagcgccctgcggcagatgtcctatggaggcaagtttggcagcagccccctggaccagagcggcttcagccccagcgtgcagagccacagccacagcttcaaccagagcagcagcagccagtggaggcagggcacccccagcagccagaggaaggtgaggatgaacagctacccctacctggccgacagacactacagccgggagcagcgctacacagaccacggcagtgaccaccactaccggggcaagagagatgacttcttctatgaggacaggaaccatgatgactggagccatgactatgacaacagaagagacagcagcagagatggcaagtggaggagcagccgccactag

SEQ ID NO: 168614 - DNA, 525 bp, Artificial Sequence
  Description of Artificial Sequence: Synthetic coding sequence
atggctgatgtgctggacctgcacgaggccggaggagaagattttgccatggatgaagatggagatgagagcatccacaagctgaaggagaaggccaagaagaggaagggccggggcttcggcagcgaggagggcagccgggccaggatgagggaggactatgacagcgtggagcaggatggagatgagcccggcccccagaggtctgtggagggctggatcctgtttgtgactggagtgcatgaggaggccacagaggaggacatccatgacaagtttgctgaatatggagagatcaagaacatccacctgaacctggacagaagaacaggctacctgaagggctacaccctggtggagtatgagacctacaaggaggcccaggccgccatggagggcctgaatggccaggacctgatgggccagcccatctctgtggactggtgctttgtgcggggcccccccaagggcaagagaagaggaggaagaagaagaagccgcagcccagacagaagaagaagatag

SEQ ID NO: 168615 - DNA, 522 bp, Artificial Sequence
  Description of Artificial Sequence: Synthetic coding sequence
atggctgatgtgctggacctgcacgaggccggaggagaagattttgccatggatgaagatggagatgagagcatccacaagctgaaggagaaggccaagaagaggaagggccggggcttcggcagcgagggcagccgggccaggatgagagaagattatgattctgtggagcaggatggagatgagcccggcccccagaggtctgtggagggctggatcctgtttgtgactggagtgcatgaggaggccacagaggaggacatccatgacaagtttgctgaatatggagagatcaagaacatccacctgaacctggacagaagaacaggctacctgaagggctacaccctggtggagtatgagacctacaaggaggcccaggccgccatggagggcctgaatggccaggacctgatgggccagcccatctctgtggactggtgctttgtgcggggcccccccaagggcaagaggcggggcggcagaagaagaagccgcagcccagacagaagaagaagatag

SEQ ID NO: 168616 - DNA, 1179 bp, Artificial Sequence
  Description of Artificial Sequence: Synthetic coding sequence
atggtggaggccgacaggcctgggaagctgttcatcggcggcctgaacctggagacagatgagaaggccctggaggccgagtttgggaagtatggccgcatcgtggaggtgctgctgatgaaggaccgggagaccaacaagagccggggctttgcctttgtgacctttgagagccctgcagatgccaaggctgctgcccgggacatgaatggcaagagcctggatggcaaggccatcaaggtggcccaggccaccaagccagcctttgagagcagcagaagaggccccccaccacccaggagccggggccggccccgcttcctgcggggcacccggggcggcggcggcggccccaggaggagccccagcagaggaggcccagatgatgatggcggctacacagctgactttgacctgcggcccagccgggcccccatgcccatgaagaggggccccccaccaagaagagtgggccccccacccaagagagctgcccccagcggccctgcccggagcagcggcggcggcatgaggggccgggccctggccgtgcggggcagagatggctacagcggccccccaagaagagagcccctgcccccccggcgggacccctacctgggccccagagatgagggctacagcagcagagatggctacagcagccgggactaccgggagccccggggctttgcccccagccctggagagtacacccaccgggactatggccacagctctgtgagagatgactgccccctgcggggctacagcgacagagatggctatggaggccgggaccgggactatggagaccacctgagccggggcagccaccgggagccctttgagagctatggagagctgcggggggccgcccctggccggggcaccccacccagctatggaggcggcggccgctatgaggagtaccggggctacagcccagatgcctacagcggcggccgggacagctacagcagcagctatggccgcagtgaccgctacagccggggccgccaccgggtgggccgcccagaccggggcctgagcctgtccatggagcggggctgccccccccagagggacagctacagccgcagcggctgccgggtgccccggggcggcggccgcctgggcggccgcctggagcggggcggcggccgcagccgctactag

SEQ ID NO: 168617 - DNA, 1491 bp, Artificial Sequence
  Description of Artificial Sequence: Synthetic coding sequence
atggtggaggccgaccaccctgggaagctgttcatcggcggcctgaaccgggagaccaatgagaagatgctgaaggctgtgtttgggaagcacggccccatcagcgaggtgctgctgatcaaggacaggaccagcaagagccggggctttgccttcatcacctttgagaacccagcagatgccaagaatgctgccaaggacatgaatggcaagagcctgcacggcaaggccatcaaggtggagcaggccaagaagcccagcttccagagcggcggcagaagaagacctccagccagcagcaggaacagaagccccagcggcagcctgcggagcgcccggggcagcagaggaggcacccggggctggctgcccagccatgagggccacctggatgatggcggctacaccccagacctgaagatgagctacagccggggcctcatccctgtgaagaggggccccagcagccgcagcggcggccccccacccaagaagagcgcccccagcgctgtggcccggagcaacagctggatgggcagccagggccccatgagccagaggagagaaaattatggagtgcccccccggcgggccaccatcagctcctggagaaatgacaggatgagcaccaggcatgatggctacgccaccaatgatggcaaccaccccagctgccaggagacccgggactatgccccacccagccggggctacgcctacagagacaatggccacagcaacagagatgagcacagcagccggggctacagaaaccacaggagcagccgggagacccgggactatgccccacccagccggggccacgcctacagagattatggccacagcagaagagatgagagctacagccggggctacagaaacagaagaagcagccgggagacccgggagtatgccccacccagccggggccacggctacagagattatggccacagcagaagacatgagagctacagccggggctacagaaaccaccccagcagccgggagacccgggactatgccccaccccaccgggactatgcctacagagattatggccacagctcctgggatgagcacagcagccggggctacagctaccatgatggctatggagaggccctgggccgggaccacagcgagcacctgagcggcagcagctacagagatgccctgcagagatatggcaccagccatggagcccccccagcccggggccccaggatgtcctatggaggcagcacctgccacgcctacagcaacacccgggacagatatggccgctcctgggagagctacagcagctgtggggacttccactactgtgaccgggagcacgtgtgcaggaaggaccagagaaatccacccagcctgggccgggtgctgcctgacccccgggaggcctgtggcagcagcagctatgtggccagcatcgtggatggaggagagagccgctctgagaagggggacagcagccgctactag

SEQ ID NO: 168618 - DNA, 1491 bp, Artificial Sequence; identical to SEQ ID NO: 168617
  Description of Artificial Sequence: Synthetic coding sequence

SEQ ID NO: 168619 - DNA, 870 bp, Artificial Sequence
  Description of Artificial Sequence: Synthetic coding sequence
atgagcaccaggcatgatggctacgccaccaatgatggcaaccaccccagctgccaggagacccgggactatgccccacccagccggggctacgcctacagagacaatggccacagcaacagagatgagcacagcagccggggctacagaaaccacaggagcagccgggagacccgggactatgccccacccagccggggccacgcctacagagattatggccacagcagaagagatgagagctacagccggggctacagaaacagaagaagcagccgggagacccgggagtatgccccacccagccggggccacggctacagagattatggccacagcagaagacatgagagctacagccggggctacagaaaccaccccagcagccgggagacccgggactatgccccaccccaccgggactatgcctacagagattatggccacagctcctgggatgagcacagcagccggggctacagctaccatgatggctacggggaggccctgggccgggaccacagcgagcacctgagcggcagcagctacagagatgccctgcagagatatggcaccagccacggggcccccccagcccggggccccaggatgtcctatggaggcagcacctgccacgcctacagcaacacccgggacagatatggccgctcctgggagagctacagcagctgtggggacttccactactgtgaccgggagcacgtgtgcaggaaggaccagaggaacccccccagcctgggccgggtgctgcctgacccccgggaggcctgtggcagcagcagctatgtggccagcatcgtggatggaggagagagccgctctgagaagggggacagcagccgctactag

SEQ ID NO: 168620 - DNA, 1266 bp, Artificial Sequence
  Description of Artificial Sequence: Synthetic coding sequence
atgggcaagaggctggaccagccccagatgtacccccagtacacctactactacccccactacctgcagaccaagcagagctatgccccagccccccaccccatggccccacccagccccagcaccaacagcagcagcaacaacagcagcaacaacagcagcggggagcagctgagcaagaccaacctgtacatccggggcctgcccccaggcaccacagaccaggacctgatcaagctgtgccagccctacggcaagatcgtgtccaccaaggccatcctggacaagaacaccaaccagtgcaagggctacggctttgtggactttgacagccctgctgctgcccagaaggctgtggccagcctgaaggccaatggagtgcaggcccagatggccaagcagcaggagcaggaccccaccaacctgtacatcagcaacctgcccatctccatggatgagcaggagctggagaacatgctgaagccctttggacatgtgatcagcacccgcatcctgagagatgccaacggggtgtccagaggagtgggctttgccaggatggagagcacagagaagtgtgaggtggtgatccagcacttcaacgggaagtacctgaagaccccacctggcatcccagcccccagcgagcccctgctgtgcaagtttgctgatggcggccagaagaagaggcagaaccagagcaagtacacccagaatggccggccctggccccgggagggggaggccggcatggccctgacctatgaccccacagctgccatccagaatggcttctacagcagcccctacagcatcgccaccaacaggatgatcccccagaccagcatcacccccttcatcgccgccagccctgtgtccacctaccaggtgcagagcacctcctggatgccccaccccccctacgtgatgcagcccactggagctgtgatcacccccaccatggaccaccccatgtccatgcagcctgccaacatgatgggccccctgacccagcagatgaaccacctgagcctgggcaccaccggcacctacatgacagctgctgcccccatgcagggcacctacatcccccagtacacccctgtgcccccaacagctgtgtccattgagggcgtggtggccgacaccagcccccagacagtggcccccagcagccaggacaccagcggccagcagcagcagattgctgtggacaccagcaatgagcacgccccagcctacagctaccagcagagcaagccctag

SEQ ID NO: 168621 - DNA, 1263 bp, Artificial Sequence
  Description of Artificial Sequence: Synthetic coding sequence
atgggcaagaggctggaccagccccagatgtacccccagtacacctactactacccccactacctgcagaccaagcagagctatgccccagccccccaccccatggccccacccagccccagcaccaacagcagcagcaacaacagcagcaacaacagcagcggggagcagctgagcaagaccaacctgtacatccggggcctgcccccaggcaccacagaccaggacctgatcaagctgtgccagccctacggcaagatcgtgtccaccaaggccatcctggacaagaacaccaaccagtgcaagggctacggctttgtggactttgacagccctgctgctgcccagaaggctgtggccagcctgaaggccaatggagtgcaggcccagatggccaagcagcaggagcaggaccccaccaacctgtacatcagcaacctgcccatctccatggatgagcaggagctggagaacatgctgaagccctttggacatgtgatcagcacccgcatcctgagagatgccaacggggtgtccagaggagtgggctttgccaggatggagagcacagagaagtgtgaggtggtgatccagcacttcaacgggaagtacctgaagaccccacctggcatcccagcccccagcgagcccctgctgtgcaagtttgctgatggcggccagaagaagaggcagaaccagagcaagtacacccagaatggccggccctggccccgggagggggaggccggcatggccctgacctatgaccccacagctgccatccagaatggcttctacagcagcccctacagcatcgccaccaacaggatgatcccccagaccagcatcacccccttcatcgccgccagccctgtgtccacctaccaggtgcagagcacctcctggatgccccaccccccctacgtgatgcagcccactggagctgtgatcacccccaccatggaccaccccatgtccatgcagcctgccaacatgatgggccccctgacccagcagatgaaccacctgagcctgggcaccaccggcacctacatgacagctgctgcccccatgcagggcacctacatcccccagtacacccctgtgcccccaacagctgtgtccattgagggcgtggtggccgacaccagcccccagacagtggcccccagcagccaggacaccagcggccagcagcagcagattgctgtggacaccagcaatgagcacgccccagcctacagctaccagcagagcaagtag

SEQ ID NO: 168622 - DNA, 1260 bp, Artificial Sequence
  Description of Artificial Sequence: Synthetic coding sequence
atgggcaagaggctggaccagccccagatgtacccccagtacacctactactacccccactacctgcagaccaagagctatgccccagccccccaccccatggccccacccagccccagcaccaacagcagcagcaacaacagcagcaacaacagcagtggagagcagctgagcaagaccaacctgtacatccggggcctgcccccaggcaccacagaccaggacctgatcaagctgtgccagccctacggcaagatcgtgtccaccaaggccatcctggacaagaacaccaaccagtgcaagggctacggctttgtggactttgacagccctgctgctgcccagaaggctgtggccagcctgaaggccaacggggtgcaggcccagatggccaagcagcaggagcaggaccccaccaacctgtacatcagcaacctgcccatctccatggatgagcaggagctggagaacatgctgaagcccttcggccacgtgatcagcacccgcatcctgagagatgccaatggagtgtcccggggcgtgggctttgccaggatggagagcacagagaagtgtgaggtggtgatccagcacttcaacgggaagtacctgaagaccccacctggcatcccagcccccagcgagcccctgctgtgcaagtttgctgatggcggccagaagaagaggcagaaccagagcaagtacacccagaatggccggccctggccccgggagggggaggccggcatggccctgacctatgaccccacagctgccatccagaatggcttctacagcagcccctacagcatcgccaccaacaggatgatcccccagaccagcatcacccccttcatcgccgccagccctgtgtccacctaccagggcgctgtgatcacccccaccatggaccaccccatgtccatgcagcctgccaacatgatgggccccctgacccagcagatgaaccacctgagcctgggcaccaccggcaccatccagagccaggaccgcatcatgatcctgcaccagctgctgtgccagtacatgacagctgctgcccccatgcagggcacctacatcccccagtacacccctgtgcccccaacagctgtgtccattgagggcgtggtggccgacaccagcccccagacagtggcccccagcagccaggacaccagcggccagcagcagcagattgctgtggacaccagcaatgagcacgccccagcctacagctaccagcagagcaagccctag

SEQ ID NO: 168623 - DNA, 1314 bp, Artificial Sequence
  Description of Artificial Sequence: Synthetic coding sequence
atgggcaagaggctggaccagccccagatgtacccccagtacacctactactacccccactacctgcagaccaagcagagctatgccccagccccccaccccatggccccacccagccccagcaccaacagcagcagcaacaacagcagcaacaacagcagcggggagcagctgagcaagaccaacctgtacatccggggcctgcccccaggcaccacagaccaggacctgatcaagctgtgccagccctacggcaagatcgtgtccaccaaggccatcctggacaagaacaccaaccagtgcaagggctacggctttgtggactttgacagccctgctgctgcccagaaggctgtggccagcctgaaggccaatggagtgcaggcccagatggccaagcagcaggagcaggaccccaccaacctgtacatcagcaacctgcccatctccatggatgagcaggagctggagaacatgctgaagccctttggacatgtgatcagcacccgcatcctgagagatgccaacggggtgtccagaggagtgggctttgccaggatggagagcacagagaagtgtgaggtggtgatccagcacttcaacgggaagtacctgaagaccccacctggcatcccagcccccagcgagcccctgctgtgcaagtttgctgatggcggccagaagaagaggcagaaccagagcaagtacacccagaatggccggccctggccccgggagggggaggccggcatggccctgacctatgaccccacagctgccatccagaatggcttctacagcagcccctacagcatcgccaccaacaggatgatcccccagaccagcatcacccccttcatcgccgccagccctgtgtccacctaccaggtgcagagcacctcctggatgccccaccccccctacgtgatgcagcccactggagctgtgatcacccccaccatggaccaccccatgtccatgcagcctgccaacatgatgggccccctgacccagcagatgaaccacctgagcctgggcaccaccggcaccatccagagccaggaccgcatcatgatcctgcaccagctgctgtgccagtacatgacagctgctgcccccatgcagggcacctacatcccccagtacacccctgtgcccccaacagctgtgtccattgagggcgtggtggccgacaccagcccccagacagtggcccccagcagccaggacaccagcggccagcagcagcagattgctgtggacaccagcaatgagcacgccccagcctacagctaccagcagagcaagccctag

SEQ ID NO: 168624 - DNA, 1305 bp, Artificial Sequence
  Description of Artificial Sequence: Synthetic coding sequence
atgggcaagaggctggaccagccccagatgtacccccagtacacctactactacccccactacctgcagaccaagcagagctatgccccagccccccaccccatggccccacccagccccagcaccaacagcagcagcaacaacagcagcaacaacagcagcggggagcagctgagcaagaccaacctgtacatccggggcctgcccccaggcaccacagaccaggacctgatcaagctgtgccagccctacggcaagatcgtgtccaccaaggccatcctggacaagaacaccaaccagtgcaagggctacggctttgtggactttgacagccctgctgctgcccagaaggctgtggccagcctgaaggccaatggagtgcaggcccagatggccaagcagcaggagcaggaccccaccaacctgtacatcagcaacctgcccatctccatggatgagcaggagctggagaacatgctgaagccctttggacatgtgatcagcacccgcatcctgagagatgccaacggggtgtccagaggagtgggctttgccaggatggagagcacagagaagtgtgaggtggtgatccagcacttcaacgggaagtacctgaagaccccacctggcatcccagcccccagcgagcccctgctgtgcaagtttgctgatggcggccagaagaagaggcagaaccagagcaagtacacccagaatggccggccctggccccgggagggggaggtgctgcggggccgcacagtgccccggcagaaccgggaggccggcatggccctgacctatgaccccacagctgccatccagaatggcttctacagcagcccctacagcatcgccaccaacaggatgatcccccagaccagcatcacccccttcatcgccgccagccctgtgtccacctaccaggtgcagagcacctcctggatgccccaccccccctacgtgatgcagcccaccggggccgtcatcacccccaccatggaccaccccatgtccatgcagcctgccaacatgatgggccccctgacccagcagatgaaccacctgagcctgggcaccaccggcacctacatgacagctgctgcccccatgcagggcacctacatcccccagtacacccctgtgcccccaacagctgtgtccattgaaggagtggtggccgacaccagcccccagacagtggcccccagcagccaggacaccagcggccagcagcagcagattgctgtggacaccagcaatgaacatgccccagcctacagctaccagcagagcaagccctag

SEQ ID NO: 168625 - DNA, 1311 bp, Artificial Sequence
  Description of Artificial Sequence: Synthetic coding sequence
atgggcaagaggctggaccagccccagatgtacccccagtacacctactactacccccactacctgcagaccaagagctatgccccagccccccaccccatggccccacccagccccagcaccaacagcagcagcaacaacagcagcaacaacagcagtggagagcagctgagcaagaccaacctgtacatccggggcctgcccccaggcaccacagaccaggacctgatcaagctgtgccagccctacggcaagatcgtgtccaccaaggccatcctggacaagaacaccaaccagtgcaagggctacggctttgtggactttgacagccctgctgctgcccagaaggctgtggccagcctgaaggccaacggggtgcaggcccagatggccaagcagcaggagcaggaccccaccaacctgtacatcagcaacctgcccatctccatggatgagcaggagctggagaacatgctgaagcccttcggccacgtgatcagcacccgcatcctgagagatgccaatggagtgtcccggggcgtgggctttgccaggatggagagcacagagaagtgtgaggtggtgatccagcacttcaacgggaagtacctgaagaccccacctggcatcccagcccccagcgagcccctgctgtgcaagtttgctgatggcggccagaagaagaggcagaaccagagcaagtacacccagaatggccggccctggccccgggagggggaggccggcatggccctgacctatgaccccacagctgccatccagaatggcttctacagcagcccctacagcatcgccaccaacaggatgatcccccagaccagcatcacccccttcatcgccgccagccctgtgtccacctaccaggtgcagagcacctcctggatgccccaccccccctacgtgatgcagcccaccggggccgtcatcacccccaccatggaccaccccatgtccatgcagcctgccaacatgatgggccccctgacccagcagatgaaccacctgagcctgggcaccaccggcaccatccagagccaggaccgcatcatgatcctgcaccagctgctgtgccagtacatgacagctgctgcccccatgcagggcacctacatcccccagtacacccctgtgcccccaacagctgtgtccattgaaggagtggtggccgacaccagcccccagacagtggcccccagcagccaggacaccagcggccagcagcagcagattgctgtggacaccagcaatgaacatgccccagcctacagctaccagcagagcaagccctag

SEQ ID NO: 168626 - DNA, 1302 bp, Artificial Sequence
  Description of Artificial Sequence: Synthetic coding sequence
atgggcaagaggctggaccagccccagatgtacccccagtacacctactactacccccactacctgcagaccaagcagagctatgccccagccccccaccccatggccccacccagccccagcaccaacagcagcagcaacaacagcagcaacaacagcagcggggagcagctgagcaagaccaacctgtacatccggggcctgcccccaggcaccacagaccaggacctgatcaagctgtgccagccctacggcaagatcgtgtccaccaaggccatcctggacaagaacaccaaccagtgcaagggctacggctttgtggactttgacagccctgctgctgcccagaaggctgtggccagcctgaaggccaatggagtgcaggcccagatggccaagcagcaggagcaggaccccaccaacctgtacatcagcaacctgcccatctccatggatgagcaggagctggagaacatgctgaagccctttggacatgtgatcagcacccgcatcctgagagatgccaacggggtgtccagaggagtgggctttgccaggatggagagcacagagaagtgtgaggtggtgatccagcacttcaacgggaagtacctgaagaccccacctggcatcccagcccccagcgagcccctgctgtgcaagtttgctgatggcggccagaagaagaggcagaaccagagcaagtacacccagaatggccggccctggccccgggagggggaggtgctgcggggccgcacagtgccccggcagaaccgggaggccggcatggccctgacctatgaccccacagctgccatccagaatggcttctacagcagcccctacagcatcgccaccaacaggatgatcccccagaccagcatcacccccttcatcgccgccagccctgtgtccacctaccaggtgcagagcacctcctggatgccccaccccccctacgtgatgcagcccaccggggccgtcatcacccccaccatggaccaccccatgtccatgcagcctgccaacatgatgggccccctgacccagcagatgaaccacctgagcctgggcaccaccggcacctacatgacagctgctgcccccatgcagggcacctacatcccccagtacacccctgtgcccccaacagctgtgtccattgaaggagtggtggccgacaccagcccccagacagtggcccccagcagccaggacaccagcggccagcagcagcagattgctgtggacaccagcaatgaacatgccccagcctacagctaccagcagagcaagtag

SEQ ID NO: 168627 - DNA, 615 bp, Artificial Sequence
  Description of Artificial Sequence: Synthetic coding sequence
atgaacaatggaggcaaggccgagaaggagaacacccccagcgaggccaacctgcaggaggaggaggtgaggaccctgtttgtgtctggcctgcccctggacatcaagccccgggagctgtacctgctcttccggcccttcaagggctatgagggcagcctcatcaagctgaccagcaagcagcctgtgggctttgtgtcctttgacagccgctctgaggccgaggccgccaagaatgccctgaatggcatccgctttgatcctgagatcccccagaccctgcggctggagtttgccaaggccaacaccaagatggccaagaacaagctggtgggcacccccaaccccagcacccccctgcccaacacagtgccccagttcatcgcccgggagccctatgagctgactgtgcctgccctgtaccccagcagccctgaggtgtgggccccctaccccctgtacccagctgagctggccccagccctgcccccaccagccttcacctacccagccagcctgcacgcccagctgtgtgagggccagacagtgcggcgcagccaccccctgagcgcccccagcccagacagcgccagcctggcctggttccctgtgtag

SEQ ID NO: 168628 - DNA, 591 bp, Artificial Sequence
  Description of Artificial Sequence: Synthetic coding sequence
atgaacaatggaggcaaggccgagaaggagaacacccccagcgaggccaacctgcaggaggaggaggtgaggaccctgtttgtgtctggcctgcccctggacatcaagccccgggagctgtacctgctcttccggcccttcaagggctatgagggcagcctcatcaagctgaccagcaagcagcctgtgggctttgtgtcctttgacagccgctctgaggccgaggccgccaagaatgccctgaatggcatccgctttgatcctgagatcccccagaccctgcggctggagtttgccaaggccaacaccaagatggccaagaacaagctggtgggcacccccaaccccagcacccccctgcccaacacagtgccccagttcatcgcccgggagccctatgagctgactgtgcctgccctgtaccccagcagccctgaggtgtgggccccctaccccctgtacccagctgagctggccccagccctgcccccaccagccttcacctacccagccagcctgcacgcccagatgcgctggctgcccccatctgaggccaccagccagggctggaagagccggcagttctgctag

SEQ ID NO: 168629 - DNA, 660 bp, Artificial Sequence
  Description of Artificial Sequence: Synthetic coding sequence
atgaacaatggaggcaaggccgagaaggagaacacccccagcgaggccaacctgcaggaggaggaggtgaggaccctgtttgtgtctggcctgcccctggacatcaagccccgggagctgtacctgctcttccggcccttcaagggctatgagggcagcctcatcaagctgaccagcaagcagcctgtgggctttgtgtcctttgacagccgctctgaggccgaggccgccaagaatgccctgaatggcatccgctttgatcctgagatcccccagaccctgcggctggagtttgccaaggccaacaccaagatggccaagaacaagctggtgggcacccccaaccccagcacccccctgcccaacacagtgccccagttcatcgcccgggagccctatgagctgactgtgcctgccctgtaccccagcagccctgaggtgtgggccccctaccccctgtacccagctgagctggccccagccctgcccccaccagccttcacctacccagccagcctgcacgcccagtgcttcagccctgaggccaagcccaacacccctgtgttctgccccctgctgcagcagatccgctttgtgtctggaaatgtgtttgtgacctaccagcccacagctgaccagcagcgggagctgccctgctag

SEQ ID NO: 168630 - DNA, 591 bp, Artificial Sequence; identical to SEQ ID NO: 168628
  Description of Artificial Sequence: Synthetic coding sequence

SEQ ID NO: 168631 - DNA, 462 bp, Artificial Sequence
  Description of Artificial Sequence: Synthetic coding sequence
atgaacaatggaggcaaggccgagaaggagaacacccccagcgaggccaacctgcaggaggaggaggtgaggaccctgtttgtgtctggcctgcccctggacatcaagccccgggagctgtacctgctcttccggcccttcaagggctatgagggcagcctcatcaagctgaccagcaagcagcctgtgggctttgtgtcctttgacagccgctctgaggccgaggccgccaagaatgccctgaatggcatccgctttgatcctgagatcccccagaccctgcggctggagtttgccaaggccaacaccaagatggccaagaacaagctggtgggcacccccaaccccagcacccccctgcccaacacagtgccccagttcatcgcccgggagcccctgatgcgctggctgccccccagcgaggccaccagccagggctggaagagccggcagttctgctag

SEQ ID NO: 168632 - DNA, 1257 bp, Artificial Sequence
  Description of Artificial Sequence: Synthetic coding sequence
atgctggccagccagggcgtgctgctgcacccctacggcgtgcccatgattgtgcctgctgccccctacctgcccggcctcatccagggcaaccaggaggccgccgccgccccagacaccatggcccagccctatgccagcgcccagtttgccccaccccagaatggcatcccagctgagtacacagccccccacccccacccagcccctgagtacacaggccagaccaccgtgcctgagcacaccctgaacctgtaccccccagcccagacccacagcgagcagagccctgctgacaccagcgcccagacagtgtctggaacagccacccagacagatgatgctgcccccacagatggccagccccagacccagcccagcgagaacacagagaacaagagccagcccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagacagtgaacccctacaccaacggctggaagctgaaccctgtggtgggcgctgtgtacagccctgagttctacgccggcaccgtgctgctgtgccaggccaaccaggagggcagctccatgtacagcgcccccagcagcctggtgtacaccagcgccatgcctggcttcccctacccagctgccacagctgctgctgcctacagaggagcccacctgcggggccggggccgcacagtgtacaacaccttccgggccgccgcccctcctccacccatcccagcctatggaggagtggtgtaccaggagcctgtgtatggcaacaagctgctgcagggcggctatgctgcctaccgctatgcccagcccaccccagccacagctgctgcctacagcgacagctatggccgggtgtatgctgctgacccctaccaccacgccctggccccagcccccacctatggagtgggcgccatgaatgcctttgcccccctgacagatgccaagaccaggagccatgctgatgatgtgggcctggtgctgagcagcctgcaggccagcatctaccggggcggctacaacagatttgccccctactag

SEQ ID NO: 168633 - DNA, 1209 bp, Artificial Sequence
  Description of Artificial Sequence: Synthetic coding sequence
atgattgtgcctgctgccccctacctgcccggcctcatccagggcaaccaggaggccgctgctgccccagacaccatggcccagccctatgccagcgcccagtttgccccaccccagaatggcatcccagctgagtacacagccccccacccccacccagcccctgagtacacaggccagaccaccgtgcctgagcacaccctgaacctgtaccccccagcccagacccacagcgagcagagccctgctgacaccagcgcccagacagtgtctggaacagccacccagacagatgatgctgcccccacagatggccagccccagacccagcccagtgaaaatacagagaacaagagccagcccaagaggctgcacgtgagcaacatccccttccgcttccgggaccctgacctgcggcagatgtttggccagtttgggaagatcctggatgtggagatcatcttcaatgaaagaggcagcaaaggatttggatttgtgacctttgaaaattctgcagatgctgaccgggcccgggagaagctgcacggcaccgtggtggagggcaggaagattgaggtgaacaatgccacagcccgggtgatgaccaacaagaagacagtgaacccctacaccaacggctggaagctgaaccctgtggtgggcgctgtgtacagccctgagttctacgccggcaccgtgctgctgtgccaggccaaccaggagggcagctccatgtacagcgcccccagcagcctggtgtacaccagcgccatgcctggcttcccctacccagctgccacagctgctgctgcctacagaggagcccacctgcggggccggggccgcacagtgtacaacaccttccgggctgctgcccctcctccacccatcccagcctacggcggcgtggtgtaccaggacggcttctacggggctgacatctatggaggctatgctgcctaccgctatgcccagcccaccccagccacagctgctgcctacagcgacagctatggccgggtgtatgctgctgacccctaccaccacgccctggccccagcccccacctatggagtgggcgccatgaatgcctttgcccccctgacagatgccaagaccaggagccatgctgatgatgtgggcctggtgctgagcagcctgcaggccagcatctaccggggcggctacaacagatttgccccctactag

SEQ ID NO: 168634 - DNA, 1176 bp, Artificial Sequence
  Description of Artificial Sequence: Synthetic coding sequence
atgctggccagccagggcgtgctgctgcacccctacggcgtgcccatgattgtgcctgctgccccctacctgcccggcctcatccagggcaaccaggaggccgccgccgccccagacaccatggcccagccctatgccagcgcccagtttgccccaccccagaatggcatcccagctgagtacacagccccccacccccacccagcccctgagtacacaggccagaccaccgtgcctgagcacaccctgaacctgtaccccccagcccagacccacagcgagcagagccctgctgacaccagcgcccagacagtgtctggaacagccacccagacagatgatgctgcccccacagatggccagccccagacccagcccagcgagaacacagagaacaagagccagcccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagacagtgaacccctacaccaacggctggaagctgaaccctgtggtgggcgctgtgtacagccctgagttctatgctgtgcccggcttcccctacccagctgccacagctgctgctgcctacagaggagcccacctgcggggccggggccgcacagtgtacaacaccttccgggctgctgcccctcctccacccatcccagcctacggcggcgtggtgtaccaggagcctgtgtatggcaacaagctgctgcagggcggctacgccgcctaccgctatgcccagcccaccccagccacagctgctgcctacagcgacagctatggccgggtgtatgctgctgacccctaccaccacgccctggccccagcccccacctacggcgtgggcgccatgaatgcctttgcccccctgacagatgccaagaccaggagccatgctgatgatgtgggcctggtgctgagcagcctgcaggccagcatctacagaggaggctacaacagatttgccccctactag

SEQ ID NO: 168635 - DNA, 1188 bp, Artificial Sequence
  Description of Artificial Sequence: Synthetic coding sequence
atgctggccagccagggcgtgctgctgcacccctacggcgtgcccatgattgtgcctgctgccccctacctgcccggcctcatccagggcaaccaggaggccgccgccgccccagacaccatggcccagccctatgccagcgcccagtttgccccaccccagaatggcatcccagctgagtacacagccccccacccccacccagcccctgagtacacaggccagaccaccgtgcctgagcacaccctgaacctgtaccccccagcccagacccacagcgagcagagccctgctgacaccagcgcccagacagtgtctggaacagccacccagacagatgatgctgcccccacagatggccagccccagacccagcccagcgagaacacagagaacaagagccagcccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagacagtgaacccctacaccaacggctggaagctgaaccctgtggtgggcgctgtgtacagccctgagttctacgccggcaccgtgctgctgtgccaggccaaccaggagggcagctccatgtacagcgcccccagcagcctggtgtacaccagcgccatgcctggcttcccctacccagctgccacagctgctgctgcctacagaggagcccacctgcggggccggggccgcacagtgtacaacaccttccgggccgccgcccctcctccacccatcccagcctatggaggagtggtgtaccaggagcctgtgtatggcaacaagctgctgcagggcggctatgctgcctaccgctatgcccagcccaccccagccacagctgctgcctacagcgacaggaaccagtttgtgtttgtggccgcagatgagatcagctgcaacaccagcgctgtgacagatgagttcatgctgcccacccccaccaccacccacctgctgcagcccccacccacagccctggtgccctag

SEQ ID NO: 168636 - DNA, 1179 bp, Artificial Sequence
  Description of Artificial Sequence: Synthetic coding sequence
atgctggccagccagggcgtgctgctgcacccctacggcgtgcccatgattgtgcctgctgccccctacctgcccggcctcatccagggcaaccaggaggccgccgccgccccagacaccatggcccagccctatgccagcgcccagtttgccccaccccagaatggcatcccagctgagtacacagccccccacccccacccagcccctgagtacacaggccagaccaccgtgcctgagcacaccctgaacctgtaccccccagcccagacccacagcgagcagagccctgctgacaccagcgcccagacagtgtctggaacagccacccagacagatgatgctgcccccacagatggccagccccagacccagcccagcgagaacacagagaacaagagccagcccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagacagtgaacccctacaccaacggctggaagctgaaccctgtggtgggcgctgtgtacagccctgagttctacgccggcaccgtgctgctgtgccaggccaaccaggagggcagctccatgtacagcgcccccagcagcctggtgtacaccagcgccatgcctggcttcccctacccagctgccacagctgctgctgcctacagaggagcccacctgcggggccggggccgcacagtgtacaacaccttccgggccgccgcccctcctccacccatcccagcctatggaggagtggtgtaccaggagcctgtgtatggcaacaagctgctgcagggcggctatgctgcctaccgctatgcccagcccaccccagccacagctgctgcctacagcgacagctatggccgggtgtatgctgctgacccctaccaccacgccctggccccagcccccacctatggagtgggcgccatggccagcatctaccggggcggctacaacagatttgccccctactag

SEQ ID NO: 168637 - DNA, 1194 bp, Artificial Sequence
  Description of Artificial Sequence: Synthetic coding sequence
atgaactgtgagcgggagcagctgcggggcaaccaggaggccgccgccgccccagacaccatggcccagccctatgccagcgcccagtttgccccaccccagaatggcatcccagctgagtacacagccccccacccccacccagcccctgagtacacaggccagaccaccgtgcctgagcacaccctgaacctgtaccccccagcccagacccacagcgagcagagccctgctgacaccagcgcccagacagtgtctggaacagccacccagacagatgatgctgcccccacagatggccagccccagacccagcccagcgagaacacagagaacaagagccagcccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagacagtgaacccctacaccaacggctggaagctgaaccctgtggtgggcgctgtgtacagccctgagttctacgccggcaccgtgctgctgtgccaggccaaccaggagggcagctccatgtacagcgcccccagcagcctggtgtacaccagcgccatgcctggcttcccctacccagctgccacagctgctgctgcctacagaggagcccacctgcggggccggggccgcacagtgtacaacaccttccgggccgccgcccctcctccacccatcccagcctatggaggagtggtgtaccaggacggcttctatggagctgacatctacggcggctacgccgcctaccgctatgcccagcccaccccagccacagctgctgcctacagcgacagctatggccgggtgtatgctgctgacccctaccaccacgccctggccccagcccccacctacggcgtgggcgccatgaatgcctttgcccccctgacagatgccaagaccaggagccatgctgatgatgtgggcctggtgctgagcagcctgcaggccagcatctacagaggaggctacaacagatttgccccctactag

SEQ ID NO: 168638 - DNA, 1401 bp, Artificial Sequence
  Description of Artificial Sequence: Synthetic coding sequence
atggagaccggccagaggacccacgccagcggcacctacagcttcctggacaggacccagcacagcgacatcaaggctgactgcaacacctgtgtggagattgaggacaggaaggtgtcccggcagcagatgaactgtgagcgggagcagctgcggggcaaccaggaggccgctgctgccccagacaccatggcccagccctatgccagcgcccagtttgccccaccccagaatggcatcccagctgagtacacagccccccacccccacccagcccctgagtacacaggccagaccaccgtgcctgagcacaccctgaacctgtaccccccagcccagacccacagcgagcagagccctgctgacaccagcgcccagacagtgtctggaacagccacccagacagatgatgctgcccccacagatggccagccccagacccagcccagtgaaaatacagagaacaagagccagcccaagaggctgcacgtgagcaacatccccttccgcttccgggaccctgacctgcggcagatgtttggccagtttgggaagatcctggatgtggagatcatcttcaatgaaagaggcagcaaaggatttggatttgtgacctttgaaaattctgcagatgctgaccgggcccgggagaagctgcacggcaccgtggtggagggcaggaagattgaggtgaacaatgccacagcccgggtgatgaccaacaagaagacagtgaacccctacaccaacggctggaagctgaaccctgtggtgggcgctgtgtacagccctgagttctacgccggcaccgtgctgctgtgccaggccaaccaggagggcagctccatgtacagcgcccccagcagcctggtgtacaccagcgccatgcctggcttcccctacccagctgccacagctgctgctgcctacagaggagcccacctgcggggccggggccgcacagtgtacaacaccttccgggctgctgcccctcctccacccatcccagcctacggcggcgtggtgtaccaggacggcttctacggggctgacatctatggaggctatgctgcctaccgctatgcccagcccaccccagccacagctgctgcctacagcgacaggaaccagtttgtgtttgtggccgcagatgagatcagctgcaacaccagcgctgtgacagatgagttcatgctgcccacccccaccaccacccacctgctgcagcccccacccacagccctggtgccctgccccaaggtgcctgccccagcccagaccagcgaggagctgagctgcaccctgcccggcctgtgctgccaggccgctgagaacctgacagccagcccccccctgctgcagttcatgttcaaggtgattgtggcccaggagaggaagtag

SEQ ID NO: 168639 - DNA, 1194 bp, Artificial Sequence; identical to SEQ ID NO: 168637
  Description of Artificial Sequence: Synthetic coding sequence

SEQ ID NO: 168640 - DNA, 792 bp, Artificial Sequence
  Description of Artificial Sequence: Synthetic coding sequence
atgaactgtgagcgggagcagctgcggggcaaccaggaggccgccgccgccccagacaccatggcccagccctatgccagcgcccagtttgccccaccccagaatggcatcccagctgagtacacagccccccacccccacccagcccctgagtacacaggccagaccaccgtgcctgagcacaccctgaacctgtaccccccagcccagacccacagcgagcagagccctgctgacaccagcgcccagacagtgtctggaacagccacccagacagatgatgctgcccccacagatggccagccccagacccagcccagcgagaacacagagaacaagagccagcccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagacagtgaacccctacaccaacggctggaagctgaaccctgtggtgggcgctgtgtacagccctgagttctacgccggcaccgtgctgctgtgccaggccaaccaggagggcagctccatgtacagcgcccccagcagcctggtgtacaccagcgccatgcctggcttcccctacccagctgccacagcctag

SEQ ID NO: 168641 - DNA, 1113 bp, Artificial Sequence
  Description of Artificial Sequence: Synthetic coding sequence
atgaactgtgagcgggagcagctgcggggcaaccaggaggccgccgccgccccagacaccatggcccagccctatgccagcgcccagtttgccccaccccagaatggcatcccagctgagtacacagccccccacccccacccagcccctgagtacacaggccagaccaccgtgcctgagcacaccctgaacctgtaccccccagcccagacccacagcgagcagagccctgctgacaccagcgcccagacagtgtctggaacagccacccagacagatgatgctgcccccacagatggccagccccagacccagcccagcgagaacacagagaacaagagccagcccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagacagtgaacccctacaccaacggctggaagctgaaccctgtggtgggcgctgtgtacagccctgagttctatgctgtgcccggcttcccctacccagctgccacagctgctgctgcctacagaggagcccacctgcggggccggggccgcacagtgtacaacaccttccgggctgctgcccctcctccacccatcccagcctacggcggcgtggtgtaccaggacggcttctacggggctgacatctatggaggctatgctgcctaccgctatgcccagcccaccccagccacagctgctgcctacagcgacagctatggccgggtgtatgctgctgacccctaccaccacgccctggccccagcccccacctatggagtgggcgccatgaatgcctttgcccccctgacagatgccaagaccaggagccatgctgatgatgtgggcctggtgctgagcagcctgcaggccagcatctaccggggcggctacaacagatttgccccctactag

SEQ ID NO: 168642 - DNA, 1725 bp, Artificial Sequence
  Description of Artificial Sequence: Synthetic coding sequence
atggcccacaacaagatccccccacgctggctgaactgcccccggcggggccagcctgtggccggccgcttcctgcccctgaagaccatgctgggccccaggtatgacagccaggtggccgaggagaaccgcttccaccccagcatgctgagcaactacctgaagagcctgaaggtgaagatgggcctgctggtggacctgaccaacaccagccgcttctatgacagaaatgacatcgagaaggagggcatcaagtacatcaagctgcagtgcaagggccacggggagtgccccaccacagaaaatacagagaccttcatccggctgtgtgagcgcttcaatgaaagaaaccccccagagctgattggagtgcactgcacccacggcttcaacagaacaggcttcctgatctgtgccttcctggtggagaagatggactggagcattgaagctgctgtggccacctttgcccaggcccggcccccaggcatctacaagggggactacctgaaggagctgttcagaagatatggagacatcgaggaggcccctcctccacccctgctgcctgactggtgctttgaagatgatgaagatgaagatgaagatgaagatggcaagaaggagagcgagcccggcagcagcgccagctttgggaagaggaggaaggagcggctgaagctgggcgccatcttcctggagggcgtgacagtgaagggcgtgacccaggtgaccacccagcccaagctgggggaggtgcagcagaagtgccaccagttctgtggctgggagggcagcggcttccctggggcccagcctgtgtccatggacaagcagaacatcaagctgctggacctgaagccctacaaggtgtcctggaaggcagatggcacccgctacatgatgctgattgatggcaccaatgaggtgttcatgattgaccgggacaacagcgtcttccacgtgagcaacctggagttccccttcaggaaggacctgaggatgcacctgagcaacaccctgctggatggagagatgatcatcgacagagtgaatggccaggccgtgccccgctacctgatctatgacatcatcaagttcaacagccagcctgtgggggactgtgacttcaacgtgcggctgcagtgcatcgagcgggagatcatcagccccaggcatgagaagatgaagacaggcctgattgacaagacccaggagcccttctctgtgaggaacaagcccttctttgacatctgcaccagcaggaagaagtacaagccaggccgctgtgatgacatcctgaagtggaagccacccagcctgaacagcgtggacttccggctgaagatcaccaggatgggcggggagggcctgctgccccagaatgtgggcctgctgtatgtgggcggctatgagcggccctttgcccagatcaaggtgaccaaggagctgaagcagtatgacaacaagatcatcgagtgcaagtttgagaacaacagctgggtgttcatgaggcagaggacagacaagagcttccccaatgcctacaacacagccatggctgtgtgcaacagcatcagcaaccctgtgaccaaggagatgctgtttgagttcatcgaccgctgcacagctgccagccagggccagaagaggaagcaccacctggaccctgacacagagctgatgcctcctcctccacccaagaggccccggcccctgacctag

SEQ ID NO: 168643 - DNA, 1626 bp, Artificial Sequence
  Description of Artificial Sequence: Synthetic coding sequence
atggcccacaacaagatccccccacgctggctgaactgcccccggcggggccagcctgtggccggccgcttcctgcccctgaagaccatgctgggccccaggtatgacagccaggtggccgaggagaaccgcttccaccccagcatgctgagcaactacctgaagagcctgaaggtgaagatgggcctgctggtggacctgaccaacaccagccgcttctatgacagaaatgacatcgagaaggagggcatcaagtacatcaagctgcagtgcaagggccacggggagtgccccaccacagaaaatacagagaccttcatccggctgtgtgagcgcttcaatgaaagaaaccccccagagctgattggagtgcactgcacccacggcttcaacagaacaggcttcctgatctgtgccttcctggtggagaagatggactggagcattgaagctgctgtggccacctttgcccaggcccggcccccaggcatctacaagggggactacctgaaggagctgttcagaagatatggagacatcgaggaggcccctcctccacccctgctgcctgactggtgctttgaagatgatgaagatgaagatgaagatgaagatggcaagaaggagagcgagcccggcagcagcgccagctttgggaagaggaggaaggagcggctgaagctgggcgccatcttcctggagggcgtgacagtgaagggcgtgacccaggtgaccacccagcccaagctgggggaggtgcagcagaagtgccaccagttctgtggctgggagggcagcggcttccctggggcccagcctgtgtccatggacaagcagaacatcaagctgctggacctgaagccctacaaggtgtcctggaaggcagatggcacccgctacatgatgctgattgatggcaccaatgaggtgttcatgattgaccgggacaacagcgtcttccacgtgagcaacctggagttccccttcaggaaggacctgaggatgcacctgagcaacaccctgctggatggagagatgatcatcgacagagtgaatggccaggccgtgccccgctacctgatctatgacatcatcaagttcaacagccagcctgtgggggactgtgacttcaacgtgcggctgcagtgcatcgagcgggagatcatcagccccaggcatgagaagatgaagacaggcctgattgacaagacccaggagcccttctctgtgaggaacaagcccttctttgacatctgcaccagcaggaagctgctggagggcaactttgccaaggaggtgtcccatgagatggatggcctcatcttccagcccaccgggaagtacaagccaggccgctgtgatgacatcctgaagtggaagccacccagcctgaacagcgtggacttccggctgaagatcaccaggatgggcggggagggcctgctgccccagaatgtgggcctgctgtatgtgggcggctatgaaagaccatttgcccagatcaaggtgtgcctcttcatcttctctgtgctcttcctggatgtgctgctgagccgcatccaccagaacctggccaacaacaaccagcacatcaagatcagctgcagcagcaccctgggcggctag

SEQ ID NO: 168644 - DNA, 1794 bp, Artificial Sequence
  Description of Artificial Sequence: Synthetic coding sequence
atggcccacaacaagatccccccacgctggctgaactgcccccggcggggccagcctgtggccggccgcttcctgcccctgaagaccatgctgggccccaggtatgacagccaggtggccgaggagaaccgcttccaccccagcatgctgagcaactacctgaagagcctgaaggtgaagatgggcctgctggtggacctgaccaacaccagccgcttctatgacagaaatgacatcgagaaggagggcatcaagtacatcaagctgcagtgcaagggccacggggagtgccccaccacagaaaatacagagaccttcatccggctgtgtgagcgcttcaatgaaagaaaccccccagagctgattggagtgcactgcacccacggcttcaacagaacaggcttcctgatctgtgccttcctggtggagaagatggactggagcattgaagctgctgtggccacctttgcccaggcccggcccccaggcatctacaagggggactacctgaaggagctgttcagaagatatggagacatcgaggaggcccctcctccacccctgctgcctgactggtgctttgaagatgatgaagatgaagatgaagatgaagatggcaagaaggagagcgagcccggcagcagcgccagctttgggaagaggaggaaggagcggctgaagctgggcgccatcttcctggagggcgtgacagtgaagggcgtgacccaggtgaccacccagcccaagctgggggaggtgcagcagaagtgccaccagttctgtggctgggagggcagcggcttccctggggcccagcctgtgtccatggacaagcagaacatcaagctgctggacctgaagccctacaaggtgtcctggaaggcagatggcacccgctacatgatgctgattgatggcaccaatgaggtgttcatgattgaccgggacaacagcgtcttccacgtgagcaacctggagttccccttcaggaaggacctgaggatgcacctgagcaacaccctgctggatggagagatgatcatcgacagagtgaatggccaggccgtgccccgctacctgatctatgacatcatcaagttcaacagccagcctgtgggggactgtgacttcaacgtgcggctgcagtgcatcgagcgggagatcatcagccccaggcatgagaagatgaagacaggcctgattgacaagacccaggagcccttctctgtgaggaacaagcccttctttgacatctgcaccagcaggaagctgctggagggcaactttgccaaggaggtgtcccatgagatggatggcctcatcttccagcccaccgggaagtacaagccaggccgctgtgatgacatcctgaagtggaagccacccagcctgaacagcgtggacttccggctgaagatcaccaggatgggcggggagggcctgctgccccagaatgtgggcctgctgtatgtgggcggctatgaaagaccatttgcccagatcaaggtgaccaaggagctgaagcagtatgacaacaagatcatcgagtgcaagtttgagaacaacagctgggtgttcatgaggcagaggacagacaagagcttccccaatgcctacaacacagccatggctgtgtgcaacagcatcagcaaccctgtgaccaaggagatgctgtttgagttcatcgaccgctgcacagctgccagccagggccagaagaggaagcaccacctggaccctgacacagagctgatgcctcctcctccacccaagaggccccggcccctgacctag

SEQ ID NO: 168645 - DNA, 1707 bp, Artificial Sequence
  Description of Artificial Sequence: Synthetic coding sequence
atgctgggccccaggtatgacagccaggtggccgaggagaaccgcttccaccccagcatgctgagcaactacctgaagagcctgaaggtgaagatgggcctgctggtggacctgaccaacaccagccgcttctatgacagaaatgacatcgagaaggagggcatcaagtacatcaagctgcagtgcaagggccatggagaatgtcccaccacagagaacacagagaccttcatccggctgtgtgagcgcttcaatgaaagaaatcctcctgagctgattggagtgcactgcacccacggcttcaacagaacaggcttcctgatctgtgccttcctggtggagaagatggactggagcattgaggccgctgtggccacctttgcccaggcccggcccccaggcatctacaagggggactacctgaaggagctgttccgccgctacggggacatcgaggaggcccctcctccacccctgctgcctgactggtgctttgaagatgatgaagatgaagatgaagatgaagatggcaagaaggagagcgagcccggcagcagcgccagctttgggaagaggaggaaggagcggctgaagctgggcgccatcttcctggagggcgtgacagtgaagggcgtgacccaggtgaccacccagcccaagctgggggaggtgcagcagaagtgccaccagttctgtggctgggagggcagcggcttccctggggcccagcctgtgtccatggacaagcagaacatcaagctgctggacctgaagccctacaaggtgtcctggaaggcagatggcacccgctacatgatgctgattgatggcaccaatgaggtgttcatgattgaccgggacaacagcgtcttccacgtgagcaacctggagttccccttcaggaaggacctgaggatgcacctgagcaacaccctgctggatggagagatgatcatcgacagagtgaatggccaggccgtgccccgctacctgatctatgacatcatcaagttcaacagccagcctgtgggggactgtgacttcaacgtgcggctgcagtgcatcgagcgggagatcatcagccccaggcatgagaagatgaagacaggcctgattgacaagacccaggagcccttctctgtgaggaacaagcccttctttgacatctgcaccagcaggaagctgctggagggcaactttgccaaggaggtgtcccatgagatggatggcctcatcttccagcccaccgggaagtacaagccaggccgctgtgatgacatcctgaagtggaagccacccagcctgaacagcgtggacttccggctgaagatcaccaggatgggcggggagggcctgctgccccagaatgtgggcctgctgtatgtgggcggctatgagcggccctttgcccagatcaaggtgaccaaggagctgaagcagtatgacaacaagatcatcgagtgcaagtttgagaacaacagctgggtgttcatgaggcagaggacagacaagagcttccccaatgcctacaacacagccatggctgtgtgcaacagcatcagcaaccctgtgaccaaggagatgctgtttgagttcatcgaccgctgcacagctgccagccagggccagaagaggaagcaccacctggaccctgacacagagctgatgcctcctcctccacccaagaggccccggcccctgacctag

SEQ ID NO: 168646 - DNA, 1545 bp, Artificial Sequence
  Description of Artificial Sequence: Synthetic coding sequence
atgggcctgctggtggacctgaccaacaccagccgcttctatgacagaaatgacatcgagaaggagggcatcaagtacatcaagctgcagtgcaagggccacggggagtgccccaccacagaaaatacagagaccttcatccggctgtgtgagcgcttcaatgaaagaaaccccccagagctgattggagtgcactgcacccacggcttcaacagaacaggcttcctgatctgtgccttcctggtggagaagatggactggagcattgaagctgctgtggccacctttgcccaggcccggcccccaggcatctacaagggggactacctgaaggagctgttcagaagatatggagacatcgaggaggcccctcctccacccctgctgcctgactggtgctttgaagatgatgaagatgaagatgaagatgaagatggcaagaaggagagcgagcccggcagcagcgccagctttgggaagaggaggaaggagcggctgaagctgggcgccatcttcctggagggcgtgacagtgaagggcgtgacccaggtgaccacccagcccaagctgggggaggtgcagcagaagtgccaccagttctgtggctgggagggcagcggcttccctggggcccagcctgtgtccatggacaagcagaacatcaagctgctggacctgaagccctacaaggtgtcctggaaggcagatggcacccgctacatgatgctgattgatggcaccaatgaggtgttcatgattgaccgggacaacagcgtcttccacgtgagcaacctggagttccccttcaggaaggacctgaggatgcacctgagcaacaccctgctggatggagagatgatcatcgacagagtgaatggccaggccgtgccccgctacctgatctatgacatcatcaagttcaacagccagcctgtgggggactgtgacttcaacgtgcggctgcagtgcatcgagcgggagatcatcagccccaggcatgagaagatgaagacaggcctgattgacaagacccaggagcccttctctgtgaggaacaagcccttctttgacatctgcaccagcaggaagaagtacaagccaggccgctgtgatgacatcctgaagtggaagccacccagcctgaacagcgtggacttccggctgaagatcaccaggatgggcggggagggcctgctgccccagaatgtgggcctgctgtatgtgggcggctatgagcggccctttgcccagatcaaggtgaccaaggagctgaagcagtatgacaacaagatcatcgagtgcaagtttgagaacaacagctgggtgttcatgaggcagaggacagacaagagcttccccaatgcctacaacacagccatggctgtgtgcaacagcatcagcaaccctgtgaccaaggagatgctgtttgagttcatcgaccgctgcacagctgccagccagggccagaagaggaagcaccacctggaccctgacacagagctgatgcctcctcctccacccaagaggccccggcccctgacctag

SEQ ID NO: 168647 - DNA, 1263 bp, Artificial Sequence
  Description of Artificial Sequence: Synthetic coding sequence
atggccgccctggtgcggcctgccaggtttgtggtgcggcccctgctgcaggtggtgcaggcctgggacctggatgcccggcgctgggtgcgggccctgcggcgcagccctgtgaaggtggtgttccccagcggggaggtggtggagcagaagagggcccctgggaagcagcccaggaaggcccccagcgaggccagcgcccaggagcagcgggagaagcagcccctggaggagagcgccagccgggcccccagcacctgggaggagagcggcctgcgctatgacaaggcctacccaggggaccggcggctgagctctgtgatgaccatcgtgaagagccggcccttccgggagaagcagggcaagatcctgctggagggccggcggctcatcagtgatgccctgaaggccggggctgtgcccaagatgttcttcttcagccggctggagtacctgaaggagctgcctgtggacaagctgaagggcgtgtccctcatcaaggtgaagtttgaggacatcaaggactggagcgacctggtgaccccccagggcatcatgggcatctttgccaagccagaccacgtgaagatgacctaccccaagacccagctgcagcacagcctgcccctgctgctgatctgtgacaacctgcgggaccccggcaacctgggcaccatcctgcggtctgctgctggagctggctgcagcaaggtgctgctgaccaagggctgtgtggatgcctgggagcccaaggtgctgcgggccggcatgggcgcccacttcaggatgcccatcatcaacaacctggagtgggagaccgtgcccaactacctgcccccagacaccagggtgtatgtggccgacaactgtggcctgtatgcccaggccgagatgagcaacaaggccagtgaccacggctgggtgtgtgaccagagggtgatgaagttccacaagtatgaggaggaggaggatgtggagactggagccagccaggactggctgccccacgtggaggtgcagagctatgacagcgactggacagaggccccagctgctgtggtgattggaggagagacctacggcgtgtccctggagagcctgcagctggccgagagcactggaggcaagaggctgctgatccctgtggtgcctggggtggacagcctgaacagcgccatggccgccagcatcctgctgtttgagggcaagaggcagctgcggggccgggcagaggacctgagccgggacaggagctaccactag

SEQ ID NO: 168648 - DNA, 4182 bp, Artificial Sequence
  Description of Artificial Sequence: Synthetic coding sequence
atgctgagccggcccaagccaggagagagcgaggtggacctgctgcacttccagagccagttcctggccgccggggccgccccagctgtgcagctggtgaagaagggcaacagaggaggaggagatgccaacagcgaccggccccccctgcaggaccacagagatgtggtgatgctggacaacctgcctgacctgcccccagccctggtgcccagcccccccaagagggcccggcccagccctggccactgcctgcctgaagatgaagatcctgaggagcggctgcggagacatgaccagcacatcacagctgtgctgaccaagatcatcgagcgggacaccagctctgtggccgtgaacctgcctgtgcccagcggcgtggccttccctgctgtgttcctgcggagccgggacacccagggcaagagcgccaccagcggcaagaggagcatctttgcccaggagattgctgccaggagaattgctgaggccaagggccccagcgtgggggaggtggtgcccaacgtgggccccccagagggcgctgtgacctgtgagacccccaccccaagaaaccagggctgccagctgcccggcagcagccacagcttccagggccccaacctggtgacaggcaagggcctgcgggaccaggaggccgagcaggaggcccagaccatccacgaggagaacatcgcccggctgcaggccatggcccctgaggagatcctgcaggagcagcagaggctgctggcccagctggaccccagcctggtggccttcctgcggagccacagccacacccaggagcagacaggagaaacagccagcgaggagcagaggcctgggggccccagcgccaacgtgaccaaggaggagcccctgatgtctgcctttgccagcgagcccaggaagagggacaagctggagcctgaggccccagccctggccctgcctgtgaccccccagaaggagtggctgcacatggacacagtggagctggagaagctgcactggacccaggacctgccccctgtgcggcggcagcagacccaggagaggatgcaggcccgcttcagcctgcagggcgagctgctggccccagatgtggacctgcccacccacctgggcctgcaccaccacggggaggaggccgagcgggccggctacagcctgcaggagctgttccacctgaccaggagccaggtgtcccagcagagggccctggccctgcacgtgctggcccaggtgatcagccgggcccaggccggggagtttggagaccggctggccggctctgtgctgagcctgctgctggatgctggcttcctgttcctgctgcgcttcagcctggatgacagagtggatggagtgattgccacagccatccgggccctgcgggccctgctggtggcccctggagatgaggagctgctggacagcaccttctcctggtaccatggagccctgaccttccccctgatgcccagccaggaggacaaggaggatgaagatgaagatgaagaatgtcctgctgggaaggccaagaggaagagccctgaggaggagagccggcccccaccagacctggcccggcatgatgtgatcaagggcctgctggccaccagcctgctgccccggctgcgctacgtgctggaggtgacctacccaggccctgctgtggtgctggacatcctggccgtgctgatccggctggcccggcacagcctggagagcgccaccagggtgctggagtgccccaggctcatcgagaccatcgtgcgggagttcctgcccacctcctggagccctgtgggcgccggccccacccccagcctgtacaaggtgccctgtgccacagccatgaagctgctgcgggtgctggccagcgctggaagaaatattgctgcccggctgctgagcagctttgacctgcggagccggctgtgccgcatcatcgccgaggccccccaggagctggccctgcccccagaggaggccgagatgctgagcacagaggccctgcggctgtgggccgtggccgccagctatggccagggcggctacctgtaccgggagctgtaccctgtgctgatgagggccctgcaggtggtgccccgggagctgagcacccaccccccccagcccctgtccatgcagagaattgccagcctgctgaccctgctgacccagctgaccctggccgccggcagcaccccagctgagaccatcagtgacagcgctgaggccagcctgagcgccacccccagcctggtgacctggacccaggtgtctggcctgcagcccctggtggagccctgcctgcggcagaccctgaagctgctgagcaggcctgagatgtggagggctgtgggccctgtgcctgtggcctgcctgctcttcctgggcgcctactaccaggcctggagccagcagcccagcagctgcccagaggactggctgcaggacatgcagaggctgtctgaggagctgctgctgcccctgctgagccagcccaccctgggcagcctgtgggacagcctgcggcactgcagcctgctgtgcaaccccctgagctgtgtgcctgccctggaggccccacccagcctggtgtccctgggctgcagcggcggctgcccccggctgagcctggccggcagcgccagccccttccccttcctgacagccctgctgagcctgctgaacaccctggcccagatccacaagggcctgtgtggccagctggccgccatcctggccgcccctggcctgcagaactacttcctgcagtgtgtggcccctggggccgccccccacctgacccccttcagcgcctgggccctgcggcatgagtaccacctgcagtacctggccctggccctggcccagaaggccgccgccctgcagcccctgcctgccacccacgccgccctgtaccacggcatggccctggccctgctgagccggctgctgcccggcagcgagtacctgacccatgagctgctgctgagctgtgtgttccggctggagttcctgcctgagaggaccagcggcggccctgaggccgctgacttcagtgaccagctgagcctgggcagcagccgggtgccccgctgtggccagggcaccctgctggcccaggcctgccaggacctgcccagcatccggaactgctacctgacccactgcagccctgcccgggccagcctgctggccagccaggccctgcacagaggagagctgcagagggtgcccaccctgctgctgcccatgcccacagagcccctgctgcccacagactggcccttcctgcccctcatccggctgtaccaccgggccagtgacacccccagcggcctgagccccacagacaccatgggcacagccatgagggtgctgcagtgggtgctggtgctggagagctggaggccccaggccctgtgggccgtgcccccagctgcccggctggcccggctgatgtgtgtgttcctggtggacagcgagctgttccgggagagccctgtgcagcacctggtggccgccctgctggcccagctgtgccagccccaggtgctgcccaacctgaacctggactgccgcctgcccggcctgaccagcttcccagacctgtatgccaacttcctggaccactttgaggccgtgtcctttggagaccacctgtttggagccctggtgctgctgcccctgcagaggcgcttctctgtgaccctgcggctggccctgtttggagagcacgtgggcgccctgcgggccctgagcctgcccctgacccagctgcctgtgtccctggagtgctacacagtgcccccagaggacaacctggccctgctgcagctgtacttccgcaccctggtgactggagccctgcggccccgctggtgccctgtgctgtatgctgtggccgtggcccacgtgaacagcttcatcttcagccaggacccccagagcagtgatgaggtgaaggccgcccggcgctccatgctgcagaagacctggctgctggctgatgagggcctgcggcagcacctgctgcactacaagctgcccaacagcaccctgcctgagggctttgagctgtacagccagctgccccccctgcggcagcactacctgcagaggctgaccagcacagtgctgcagaatggagtgtctgagacctag

SEQ ID NO: 168649 - DNA, 1839 bp, Artificial Sequence
  Description of Artificial Sequence: Synthetic coding sequence
atggctgactttgctggccccagcagcgctggcaggaaggccggggccccccgctgcagcaggaaggccgccggcaccaagcagaccagcaccctgaagcaggaggatgccagcaagaggaaggccgagctggaggccgctgtgaggaagaagattgaatttgagaggaaggccctgcacatcgtggagcagctgctggaggagaacatcacagaggagttcctgatggagtgtggccgcttcatcaccccagcccactacagtgatgtggtggatgagaggagcatcgtgaagctgtgtggctaccccctgtgccagaagaagctgggcatcgtgcccaagcagaagtacaagatcagcaccaagaccaacaaggtgtatgacatcacagagaggaagagcttctgcagcaacttctgctaccaggccagcaagttctttgaggcccagatccccaagacccctgtgtgggtgcgggaggaggagcggcacccagacttccagctgctgaaggaggagcagagcggccacagcggggaggaggtgcagctgtgcagcaaggccatcaagaccagtgacatcgacaaccccagccactttgagaagcagtatgagagcagcagcagcagcacccacagcgacagcagcagtgacaatgagcaggactttgtgagcagcatcctgcccggcaaccggcccaacagcaccaacatccggccccagctgcaccagaagagcatcatgaagaagaaggccggccacaaggccaacagcaagcacaaggacaaggagcagacagtggtggatgtgacagagcagctgggggactgcaagctggacagccaggagaaggatgccacctgtgagctgcccctgcagaaggtgaacacccagagcagcagcaacagcaccctgcctgagcggctgaaggcctctgaaaattctgagagcgagtacagccgctctgagatcaccctggtgggcatcagcaagaagtctgctgagcacttcaagaggaagtttgccaagagcaaccaggtgagccgctctgtgagcagctctgtgcaggtgtgcccagaggtgggcaagaggaacctgctgaaggtgctgaaggagaccctgattgagtggaagacagaggagaccctgcgcttcctgtatggccagaactatgcctctgtgtgcctgaagccagaggccagcctggtgaaggaggagctggatgaagatgacatcatcagtgaccctgacagccacttccctgcctggagggagagccagaacagcctggatgagagcctgcccttccggggcagcggcacagccatcaagcccctgcccagctatgagaacctgaagaaggagacagagaagctgaacctgcgcatccgggagttctaccggggccgctacgtgctgggggaggagaccaccaagagccaggacagcgaggagcatgacagcaccttccccctgattgacagcagcagccagaaccagatcaggaagagaattgtgctggagaagctgagcaaggtgctgcccggcctgctggtgcccctgcagatcaccctgggggacatctacacccagctgaagaacctggtgaggaccttccggctgaccaacagaaacatcatccacaagccagctgagtggaccctcatcgccatggtgctgctgagcctgctgacccccatcctgggcatccagaagcacagccaggagggcatggtgttcacccgcttcctggacaccctgctggaggagctgcacctgaagaatgaagacctggagagcctgaccatcatcttccgcaccagctgcctgcctgagtag

SEQ ID NO: 168650 - DNA, 1755 bp, Artificial Sequence
  Description of Artificial Sequence: Synthetic coding sequence
atggctgactttgctggccccagcagcgctggcaggaaggccggggccccccgctgcagcaggaaggccgccggcaccaagcagaccagcaccctgaagcaggaggatgccagcaagaggaaggccgagctggaggccgctgtgaggaagaagattgaatttgagaggaaggccctgcacatcgtggagcagctgctggaggagaacatcacagaggagttcctgatggagtgtggccgcttcatcaccccagcccactacagtgatgtggtggatgagaggagcatcgtgaagctgtgtggctaccccctgtgccagaagaagctgggcatcgtgcccaagcagaagtacaagatcagcaccaagaccaacaaggtgtatgacatcacagagaggaagagcttctgcagcaacttctgctaccaggccagcaagttctttgaggcccagatccccaagacccctgtgtgggtgcgggaggaggagcggcacccagacttccagctgctgaaggaggagcagagcggccacagcggggaggaggtgcagctgtgcagcaaggccatcaagaccagtgacatcgacaaccccagccactttgagaagcagtatgagagcagcagcagcagcacccacagcgacagcagcagtgacaatgagcaggactttgtgagcagcatcctgcccggcaaccggcccaacagcaccaacatccggccccagctgcaccagaagagcatcatgaagaagaaggccggccacaaggccaacagcaagcacaaggacaaggagcagacagtggtggatgtgacagagcagctgggggactgcaagctggacagccaggagaaggatgccacctgtgagctgcccctgcagaaggtgaacacccagagcagcagcaacagcaccctgcctgagcggctgaaggcctctgaaaattctgagagcgagtacagccgctctgagatcaccctggtgggcatcagcaagaagtctgctgagcacttcaagaggaagtttgccaagagcaaccaggtgagccgctctgtgagcagctctgtgcaggtgtgcccagaggtgggcaagaggaacctgctgaaggtgctgaaggagaccctgattgagtggaagacagaggagaccctgcgcttcctgtatggccagaactatgcctctgtgtgcctgaagccagaggccagcctggtgaaggaggagctggatgaagatgacatcatcagtgaccctgacagccacttccctgcctggagggagagccagaacagcctggatgagagcctgcccttccggggcagcggcacagccatcaagcccctgcccagctatgagaacctgaagaaggagacagagaagctgaacctgcgcatccgggagttctaccggggccgctacgtgctgggggaggagaccaccaagagccaggacagcgaggagcatgacagcaccttccccctgattgacagcagcagccagaaccagatcaggaagagaattgtgctggagaagctgagcaaggtgctgcccggcctgctggtgcccctgcagatcaccctgggggacatctacacccagctgaagaacctggtgaggaccttccggctgaccaacagaaacatcatccacaagccagctgagtggaccctcatcgccatggtgctgctgtccttcctgctgaatgtgaagacccgcatcaagaccttcatgatgatctacttccacctgatgaacagctag

SEQ ID NO: 168651 - DNA, 1998 bp, Artificial Sequence
  Description of Artificial Sequence: Synthetic coding sequence
atgaccagcgccaacaaggccatcgagctgcagctgcaggtgaagcagaatgctgaggagctgcaggacttcatgagggacctggagaactgggagaaggacatcaagcagaaggacatggagctgcggcggcagaatggagtgcctgaggagaacctgccccccatcagaaatggaaacttcaggaagaagaagaagggcaaggccaaggagagcagcaagaagacccgggaggagaacaccaagaaccgcatcaagagctatgactatgaggcctgggccaagctggatgtggaccgcatcctggatgagctggacaaggatgacagcacccatgagagcctgagccaggagagcgagagtgaagaagatggcatccacgtggacagccagaaggccctggtgctgaaggagaagggcaacaagtacttcaagcagggcaagtatgatgaggccatcgactgctacaccaagggcatggatgctgacccctacaaccctgtgctgcccaccaacagagccagcgcctacttccggctgaagaagtttgctgtggccgagagtgactgcaacctggccgtggccctgaacagaagctacaccaaggcctacagcagaagaggagctgccaggtttgccctgcagaagctggaggaggccaagaaggactatgaaagagtgctggagctggagcccaacaactttgaggccaccaatgagctgaggaagatcagccaggccctggccagcaaggagaacagctaccccaaggaggccgacatcgtcatcaagagcacagaaggagagaggaagcagatcgaggcccagcagaacaagcagcaggccatcagcgagaaggacagaggaaatggcttcttcaaggagggcaagtatgaaagagccatcgagtgctacacccggggcattgctgctgatggagccaatgccctgctgcctgccaacagagccatggcctacctgaagatccagaagtatgaggaggccgagaaggactgcacccaggccatcctgctggatggcagctacagcaaggcctttgcccggcggggcacagcccggaccttcctgggcaagctgaatgaggccaagcaggactttgaaacagtgctgctgctggagcccggcaacaagcaggccgtgacagagctgagcaagatcaagaaggagctgattgagaagggccactgggatgatgtgttcctggacagcacccagaggcagaatgtggtgaagcccatcgacaaccccccccaccctggcagcaccaagcccctgaagaaggtgatcatcgaggagaccggcaacctgatccagaccattgatgtgcctgacagcaccacagctgctgcccctgagaacaaccccatcaacctggccaacgtgattgctgccaccggcaccaccagcaagaagaacagcagccaggatgacctcttccccaccagtgacaccccccgggccaaggtgctgaagattgaggaggtgtctgacaccagcagcctgcagccccaggccagcctgaagcaggatgtgtgccagagctacagcgagaagatgcccatcgagattgagcagaagccagcccagtttgccaccaccgtgctgccccccatcccagccaacagcttccagctggagagtgacttccggcagctgaagagcagcccagacatgctgtaccagtacctgaagcagatcgagcccagcctgtaccccaagctgttccagaagaacctggaccctgatgtgttcaaccagatcgtgaagatcctgcatgacttctacatcgagaaggagaagcccctgctgatctttgagatcctgcagaggctgtctgagctgaagagatttgacatggctgtgatgttcatgtctgaaacagagaagaagatcgcccgggccctcttcaaccacatcgacaagagcggcctgaaggacagctctgtggaggagctgaagaagagatatggaggatag

SEQ ID NO: 168652 - DNA, 1896 bp, Artificial Sequence
  Description of Artificial Sequence: Synthetic coding sequence
atgaccagcgccaacaaggccatcgagctgcagctgcaggtgaagcagaatgctgaggagctgcaggacttcatgagggacctggagaactgggagaaggacatcaagcagaaggacatggagctgcggcggcagaatggagtgcctgaggagaacctgccccccatcagaaatggaaacttcaggaagaagaagaagggcaaggccaaggagagcagcaagaagacccgggaggagaacaccaagaaccgcatcaagagctatgactatgaggcctgggccaagctggatgtggaccgcatcctggatgagctggacaaggatgacagcacccatgagagcctgagccaggagagcgagagtgaagaagatggcatccacgtggacagccagaaggccctggtgctgaaggagaagggcaacaagtacttcaagcagggcaagtatgatgaggccatcgactgctacaccaagggcatggatgctgacccctacaaccctgtgctgcccaccaacagagccagcgcctacttccggctgaagaagtttgctgtggccgagagtgactgcaacctggccgtggccctgaacagaagctacaccaaggcctacagcagaagaggagctgccaggtttgccctgcagaagctggaggaggccaagaaggactatgaaagagtgctggagctggagcccaacaactttgaggccaccaatgagctgaggaagatcagccaggccctggccagcaaggagaacagctaccccaaggaggccgacatcgtcatcaagagcacagaaggagagaggaagcagatcgaggcccagcagaacaagcagcaggccatcagcgagaaggacagaggaaatggcttcttcaaggagggcaagtatgaaagagccatcgagtgctacacccggggcattgctgctgatggagccaatgccctgctgcctgccaacagagccatggcctacctgaagatccagaagtatgaggaggccgagaaggactgcacccaggccatcctgctggatggcagctacagcaaggcctttgcccggcggggcacagcccggaccttcctgggcaagctgaatgaggccaagcaggactttgaaacagtgctgctgctggagcccggcaacaagcaggccgtgacagagctgagcaagatcaagaagaagcccctgaagaaggtgatcatcgaggagaccggcaacctgatccagaccattgatgtgcctgacagcaccacagctgctgcccctgagaacaaccccatcaacctggccaacgtgattgctgccaccggcaccaccagcaagaagaacagcagccaggatgacctcttccccaccagtgacaccccccgggccaaggtgctgaagattgaggaggtgtctgacaccagcagcctgcagccccaggccagcctgaagcaggatgtgtgccagagctacagcgagaagatgcccatcgagattgagcagaagccagcccagtttgccaccaccgtgctgccccccatcccagccaacagcttccagctggagagtgacttccggcagctgaagagcagcccagacatgctgtaccagtacctgaagcagatcgagcccagcctgtaccccaagctgttccagaagaacctggaccctgatgtgttcaaccagatcgtgaagatcctgcatgacttctacatcgagaaggagaagcccctgctgatctttgagatcctgcagaggctgtctgagctgaagagatttgacatggctgtgatgttcatgtctgaaacagagaagaagatcgcccgggccctcttcaaccacatcgacaagagcggcctgaaggacagctctgtggaggagctgaagaagagatatggaggatag

SEQ ID NO: 168653 - DNA, 1521 bp, Artificial Sequence
  Description of Artificial Sequence: Synthetic coding sequence
atggatgctgacccctacaaccctgtgctgcccaccaacagagccagcgcctacttccggctgaagaagtttgctgtggccgagagtgactgcaacctggccgtggccctgaacagaagctacaccaaggcctacagcagaagaggagctgccaggtttgccctgcagaagctggaggaggccaagaaggactatgagcgggtgctggagctggagcccaacaactttgaggccaccaatgagctgaggaagatcagccaggccctggccagcaaagaaaattcctaccccaaggaggccgacatcgtcatcaagagcacagaaggagagaggaagcagatcgaggcccagcagaacaagcagcaggccatcagcgagaaggacagaggaaatggcttcttcaaggagggcaagtatgagcgggccatcgagtgctacacccggggcattgctgctgatggagccaatgccctgctgcctgccaacagagccatggcctacctgaagatccagaagtatgaggaggccgagaaggactgcacccaggccatcctgctggatggcagctacagcaaggcctttgcccggcggggcacagcccggaccttcctgggcaagctgaatgaggccaagcaggactttgagaccgtgctgctgctggagcccggcaacaagcaggccgtgacagagctgagcaagatcaagaaggagctgattgagaagggccactgggatgatgtgttcctggacagcacccagaggcagaatgtggtgaagcccatcgacaaccccccccaccctggcagcaccaagcccctgaagaaggtgatcatcgaggagactggaaacctgatccagaccattgatgtgcctgacagcaccacagctgctgcccctgagaacaaccccatcaacctggccaacgtgattgctgccaccggcaccaccagcaagaagaacagcagccaggatgacctcttccccaccagtgacaccccccgggccaaggtgctgaagattgaggaggtgtctgacaccagcagcctgcagccccaggccagcctgaagcaggatgtgtgccagagctacagcgagaagatgcccattgaaattgagcagaagccagcccagtttgccaccaccgtgctgccccccatcccagccaacagcttccagctggagagtgacttccggcagctgaagagcagcccagacatgctgtaccagtacctgaagcagatcgagcccagcctgtaccccaagctgttccagaagaacctggaccctgatgtgttcaaccagatcgtgaagatcctgcatgacttctacatcgagaaggagaagcccctgctgatctttgagatcctgcagaggctgtctgagctgaagagatttgacatggctgtgatgttcatgtctgaaacagagaagaagatcgcccgggccctcttcaaccacatcgacaagagcggcctgaaggacagctctgtggaggagctgaagaagagatatggaggatag

SEQ ID NO: 168654 - DNA, 4821 bp, Artificial Sequence
  Description of Artificial Sequence: Synthetic coding sequence
atgattgctgagcccgcccacttctacctgtttggcctcatctgcctgtgcagcggcagccggctgcggcaggaggacttccccccaagaattgtggagcaccccagcgacctgattgtgtccaagggggagcccgccaccctgaactgcaaggccgagggccggcccacccccaccatcgagtggtacaagggcggggagcgggtggagacagacaaggatgaccccaggagccacaggatgctgctgcccagcggcagcctcttcttcctgagaattgtgcacggcaggaagagcaggccagatgagggcgtgtatgtgtgtgtggccaggaactacctgggggaggccgtgagccacaatgccagcctggaggtggccatcctgagagatgacttccggcagaaccccagtgatgtgatggtggccgtgggggagcctgctgtgatggagtgccagcccccccggggccaccctgagcccaccatctcctggaagaaggatggcagccccctggatgacaaggatgagcgcatcaccatccggggcggcaagctgatgatcacctacaccaggaagagtgatgctgggaagtatgtgtgtgtgggcaccaacatggtgggggagcgggagagcgaggtggccgagctgactgtgctggagcggcccagctttgtgaagaggcccagcaacctggccgtgacagtggatgattctgctgagttcaagtgtgaggcccggggggaccctgtgcccaccgtgcgctggaggaaggatgatggagagctgcccaagagccgctatgagatcagagatgaccacaccctgaagatcaggaaggtgacagctggggacatgggcagctacacctgtgtggccgagaacatggtgggcaaggccgaggccagcgccaccctgactgtgcaggcccccagcgagcccccccactttgtggtgaagccccgggaccaggtggtggccctgggccgcacagtgaccttccagtgtgaggccactggaaacccccagcctgccatcttctggaggcgggagggcagccagaacctgctcttctcctaccagcccccccagagcagcagccgcttctctgtgtcccagacaggagacctgaccatcaccaacgtgcagaggagtgatgtgggctactacatctgccagaccctgaatgtggccggcagcatcatcaccaaggcctacctggaggtgacagatgtgattgctgacaggcctcctcctgtgatccggcagggccctgtgaaccagacagtggccgtggatggcacctttgtgctgagctgtgtggccaccggcagccctgtgcccaccatcctgtggaggaaggatggagtgctggtgtccacccaggacagccgcatcaagcagctggagaatggagtgctgcagatccgctatgccaagctgggggacaccggccgctacacctgcatcgccagcaccccatctggagaggccacctggagcgcctacatcgaggtgcaggagtttggagtgcctgtgcagcccccccggcccacagaccccaacctgatccccagcgcccccagcaagccagaggtgacagatgtgtccaggaacacagtgaccctgtcctggcagcccaacctgaacagcggggccacccccaccagctacatcatcgaggccttcagccacgccagcggcagctcctggcagacagtggccgagaatgtgaagacagagaccagcgccatcaagggcctgaagcccaatgccatctacctgttcctggtgcgggccgccaatgcctacggcatcagtgaccccagccagatcagtgaccctgtgaagacccaggatgtgctgcccaccagccagggcgtggaccacaagcaggtgcagcgggagctgggcaatgctgtgctgcacctgcacaaccccaccgtgctgagcagcagcagcattgaggtgcactggacagtggaccagcagagccagtacatccagggctacaagatcctgtaccggcccagcggggccaaccacggggagagtgactggctggtgtttgaggtgaggaccccagccaagaacagcgtggtgatcccagacctgaggaaaggagtgaactatgagatcaaggcccggcccttcttcaatgagttccagggcgctgacagcgagatcaagtttgccaagaccctggaggaggcccccagcgccccaccccagggcgtgacagtgtccaagaatgatggaaatggaacagccatcctggtgtcctggcagcccccacctgaggacacccagaatggcatggtgcaggagtacaaggtgtggtgcctgggcaatgagacccgctaccacatcaacaagacagtggatggcagcaccttctctgtggtgatccccttcctggtgcccggcatccgctacagcgtggaggtggccgccagcactggagctggcagcggcgtgaagtctgagccccagttcatccagctggatgcccacggcaaccctgtgtccccagaggaccaggtgtccctggcccagcagatcagtgatgtggtgaagcagcctgccttcatcgccggcattggagctgcctgctggatcatcctgatggtgttcagcatctggctgtaccgccacaggaagaagagaaatggcctgaccagcacctacgccggcatcaggaaggtgacctaccagagaggaggagaggccgtgtcctctgggggccggcccggcctgctgaacatcagcgagcctgctgcccagccctggctggccgacacctggcccaacacaggcaacaaccacaatgactgcagcatcagctgctgcacagctggaaatggaaacagcgacagcaacctgaccacctacagcaggcctgctgactgcatcgccaactacaacaaccagctggacaacaagcagaccaacctgatgctgcctgagagcacagtgtatggagatgtggacctgagcaacaagatcaatgagatgaagaccttcaacagccccaacctgaaggatggccgctttgtgaaccccagcggccagcccaccccctatgccaccacccagctgatccagagcaacctgagcaacaacatgaacaacggcagcggggacagcggggagaagcactggaagcccctgggccagcagaagcaggaggtggcccctgtgcagtacaacatcgtggagcagaacaagctgaacaaggactaccgggccaatgacacagtgccccccaccatcccctacaaccagagctatgaccagaacacaggaggcagctacaacagcagtgaccggggcagcagcaccagcggcagccagggccacaagaagggggcccggacccccaaggtgcccaagcagggcggcatgaactgggccgacctgctgcccccacctccagcccaccccccaccccacagcaacagcgaggagtacaacatctctgtggatgagagctatgaccaggagatgccctgccctgtgcccccagccaggatgtacctgcagcaggatgagctggaggaggaggaggatgagcggggccccaccccacctgtgagaggagctgccagcagccctgctgctgtgtcctacagccaccagagcacagccaccctgacccccagcccccaggaggagctgcagcccatgctgcaggactgcccagaggagaccggccacatgcagcaccagcctgacagaagacggcagcctgtgtccccacctcctccaccccggcccatcagccccccccacacctacggctacatcagcggccccctggtgtctgacatggacacagatgcccctgaggaggaggaggatgaagctgacatggaggtggccaagatgcagacccggcggctgctgctgcggggcctggagcagaccccagccagctctgtgggggacctggagagctctgtgacaggctccatgatcaatggctggggcagcgccagcgaggaggacaacatcagcagcggccgcagctctgtgagcagcagtgatggcagcttcttcacagatgctgactttgcccaggccgtggccgctgctgctgaatatgccggcctgaaggtggcccggcggcagatgcaggatgctgctggccgccgccacttccacgccagccagtgcccccggcccaccagccctgtgtccacagacagcaacatgtctgctgctgtgatgcagaagaccaggcctgccaagaagctgaagcaccagcccggccacctgcggcgggagacctacacagatgacctgcccccacctcctgtgcccccaccagccatcaagagccccacagcccagagcaagacccagctggaggtgcggcctgtggtggtgcccaagctgcccagcatggatgccaggacagacaggagcagtgacaggaagggcagcagctacaagggccgggaggtgctggatggccggcaggtggtggacatgaggaccaaccctggggacccccgggaggcccaggagcagcagaatgatggcaagggccggggcaacaaggccgccaagagggacctgcccccagccaagacccacctgatccaggaggacatcctgccctactgccggcccaccttccccaccagcaacaacccccgggaccccagcagcagcagctccatgagcagccggggcagcggcagccggcagcgggagcaggccaacgtgggcagaagaaatattgctgagatgcaggtgctgggcggctatgaaagaggagaggacaacaatgaggagctggaggagacagagagctag

SEQ ID NO: 168655 - DNA, 4968 bp, Artificial Sequence
  Description of Artificial Sequence: Synthetic coding sequence
atgaagtggaagcacgtgcccttcctggtgatgatcagcctgctgagcctgagccccaaccacctgttcctggcccagctgatcccagaccctgaagatgtggagagaggaaatgaccacggcacccccatccccaccagtgacaatgatgacaacagcctgggctacacaggcagccggctgcggcaggaggacttccccccacgcatcgtggagcaccccagcgacctgattgtgtccaaaggagagcccgccaccctgaactgcaaggccgagggccggcccacccccaccatcgagtggtacaagggcggggagcgggtggagacagacaaggatgaccccaggagccacaggatgctgctgcccagcggcagcctcttcttcctgcgcatcgtgcacggcaggaagagcaggccagatgaaggagtgtatgtgtgtgtggccaggaactacctgggggaggccgtgagccacaatgccagcctggaggtggccatcctgagagatgacttccggcagaaccccagtgatgtgatggtggccgtgggggagcctgctgtgatggagtgccagcccccccggggccaccctgagcccaccatctcctggaagaaggatggcagccccctggatgacaaggatgagcgcatcaccatccggggcggcaagctgatgatcacctacaccaggaagagtgatgctgggaagtatgtgtgtgtgggcaccaacatggtgggggagcgggagagcgaggtggccgagctgactgtgctggagcggcccagctttgtgaagaggcccagcaacctggccgtgacagtggatgacagcgctgagttcaagtgtgaggcccggggggaccctgtgcccaccgtgcgctggaggaaggatgatggagagctgcccaagagccgctatgagatcagagatgaccacaccctgaagatcaggaaggtgacagctggggacatgggcagctacacctgtgtggccgagaacatggtgggcaaggccgaggccagcgccaccctgactgtgcaggagcccccccactttgtggtgaagccccgggaccaggtggtggccctgggccgcacagtgaccttccagtgtgaggccactggaaacccccagcctgccatcttctggaggcgggagggcagccagaacctgctcttctcctaccagcccccccagagcagcagccgcttctctgtgtcccagacaggagacctgaccatcaccaacgtgcagaggagtgatgtgggctactacatctgccagaccctgaatgtggccggcagcatcatcaccaaggcctacctggaggtgacagatgtgattgctgacaggcctcctcctgtgatccggcagggccctgtgaaccagacagtggccgtggatggcacctttgtgctgagctgtgtggccaccggcagccctgtgcccaccatcctgtggaggaaggatggagtgctggtgtccacccaggacagccgcatcaagcagctggagaatggagtgctgcagatccgctatgccaagctgggggacaccggccgctacacctgcatcgccagcaccccatctggagaggccacctggagcgcctacatcgaggtgcagggcaaggtgaatgaatttggagtgcctgtgcagcccccccggcccacagaccccaacctgatccccagcgcccccagcaagccagaggtgacagatgtgtccaggaacacagtgaccctgtcctggcagcccaacctgaacagcggggccacccccaccagctacatcatcgaggccttcagccacgccagcggcagctcctggcagacagtggccgagaatgtgaagacagagaccagcgccatcaagggcctgaagcccaatgccatctacctgttcctggtgcgggccgccaatgcctacggcatcagtgaccccagccagatcagtgaccctgtgaagacccaggatgtgctgcccaccagccagggcgtggaccacaagcaggtgcagcgggagctgggcaatgctgtgctgcacctgcacaaccccaccgtgctgagcagcagcagcattgaggtgcactggacagtggaccagcagagccagtacatccagggctacaagatcctgtaccggcccagcggggccaaccacggggagagtgactggctggtgtttgaggtgaggaccccagccaagaacagcgtggtgatcccagacctgaggaaaggagtgaactatgagatcaaggcccggcccttcttcaatgagttccagggcgctgacagcgagatcaagtttgccaagaccctggaggaggcccccagcgccccaccccagggcgtgacagtgtccaagaatgatggaaatggaacagccatcctggtgtcctggcagcccccacctgaggacacccagaatggcatggtgcaggagtacaaggtgtggtgcctgggcaatgagacccgctaccacatcaacaagacagtggatggcagcaccttctctgtggtgatccccttcctggtgcccggcatccgctacagcgtggaggtggccgccagcactggagctggcagcggcgtgaagtctgagccccagttcatccagctggatgcccacggcaaccctgtgtccccagaggaccaggtgtccctggcccagcagatcagtgatgtggtgaagcagcctgccttcatcgccggcattggagctgcctgctggatcatcctgatggtgttcagcatctggctgtaccgccacaggaagaagagaaatggcctgaccagcacctacgccggcatcaggaaggtgcccagcttcaccttcacccccaccgtgacctaccagaggggcggggaggccgtgagcagcggcggccggcccggcctgctgaacatcagcgagcctgctgcccagccctggctggccgacacctggcccaacacaggcaacaaccacaatgactgcagcatcagctgctgcacagctggaaatggaaacagcgacagcaacctgaccacctacagcaggcctgctgactgcatcgccaactacaacaaccagctggacaacaagcagaccaacctgatgctgcctgagagcacagtgtatggagatgtggacctgagcaacaagatcaatgagatgaagaccttcaacagccccaacctgaaggatggccgctttgtgaaccccagcggccagcccaccccctatgccaccacccagctgatccagagcaacctgagcaacaacatgaacaatggaagtggggacagcggggagaagcactggaagcccctgggccagcagaagcaggaggtggcccctgtgcagtacaacatcgtggagcagaacaagctgaacaaggactaccgggccaatgacacagtgccccccaccatcccctacaaccagagctatgaccagaacacaggaggcagctacaacagcagtgaccggggcagcagcaccagcggcagccagggccacaagaagggggcccggacccccaaggtgcccaagcagggcggcatgaactgggccgacctgctgcccccacctccagcccaccccccaccccacagcaacagcgaggagtacaacatctctgtggatgagagctatgaccaggagatgccctgccctgtgcccccagccaggatgtacctgcagcaggatgagctggaggaggaggaggatgagcggggccccaccccacctgtgcggggggccgccagcagccctgctgctgtgtcctacagccaccagagcacagccaccctgacccccagcccccaggaggagctgcagcccatgctgcaggactgcccagaggagaccggccacatgcagcaccagcctgacagaagacggcagcctgtgagccccccacctccaccccggcccatcagccccccccacacctacggctacatcagcggccccctggtgtctgacatggacacagatgcccctgaggaggaggaggatgaggccgacatggaggtggccaagatgcagacccggcggctgctgctgcggggcctggagcagaccccagccagctctgtgggggacctggagagctctgtgacaggctccatgatcaatggctggggcagcgccagcgaggaggacaacatcagcagcggccgcagctctgtgagcagcagtgatggcagcttcttcacagatgctgactttgcccaggccgtggccgctgctgctgaatatgccggcctgaaggtggcccggcggcagatgcaggatgctgctggaagaagacacttccacgccagccagtgcccccggcccaccagccctgtgtccacagacagcaacatgtctgctgctgtgatgcagaagaccaggcctgccaagaagctgaagcaccagcccggccacctgcggcgggagacctacacagatgacctgcccccacctcctgtgcccccaccagccatcaagagccccacagcccagagcaagacccagctggaggtgcggcctgtggtggtgcccaagctgcccagcatggatgccaggacagacaggagcagtgacaggaagggcagcagctacaagggccgggaggtgctggatggccggcaggtggtggacatgaggaccaaccctggggacccccgggaggcccaggagcagcagaatgatggcaagggccggggcaacaaggccgccaagagggacctgcccccagccaagacccacctgatccaggaggacatcctgccctactgccggcccaccttccccaccagcaacaacccccgggaccccagcagcagcagctccatgagcagccggggcagcggcagccggcagcgggagcaggccaacgtgggcagaagaaatattgctgagatgcaggtgctgggcggctatgaaagaggagaggacaacaatgaggagctggaggagcccagcagctag

SEQ ID NO: 168656 - DNA, 4839 bp, Artificial Sequence
  Description of Artificial Sequence: Synthetic coding sequence
atgattgctgagcccgcccacttctacctgtttggcctcatctgcctgtgcagcggcagccggctgcggcaggaggacttccccccaagaattgtggagcaccccagcgacctgattgtgtccaagggggagcccgccaccctgaactgcaaggccgagggccggcccacccccaccatcgagtggtacaagggcggggagcgggtggagacagacaaggatgaccccaggagccacaggatgctgctgcccagcggcagcctcttcttcctgagaattgtgcacggcaggaagagcaggccagatgagggcgtgtatgtgtgtgtggccaggaactacctgggggaggccgtgagccacaatgccagcctggaggtggccatcctgagagatgacttccggcagaaccccagtgatgtgatggtggccgtgggggagcctgctgtgatggagtgccagcccccccggggccaccctgagcccaccatctcctggaagaaggatggcagccccctggatgacaaggatgagcgcatcaccatccggggcggcaagctgatgatcacctacaccaggaagagtgatgctgggaagtatgtgtgtgtgggcaccaacatggtgggggagcgggagagcgaggtggccgagctgactgtgctggagcggcccagctttgtgaagaggcccagcaacctggccgtgacagtggatgattctgctgagttcaagtgtgaggcccggggggaccctgtgcccaccgtgcgctggaggaaggatgatggagagctgcccaagagccgctatgagatcagagatgaccacaccctgaagatcaggaaggtgacagctggggacatgggcagctacacctgtgtggccgagaacatggtgggcaaggccgaggccagcgccaccctgactgtgcaggagcccccccactttgtggtgaagccccgggaccaggtggtggccctgggccgcacagtgaccttccagtgtgaggccaccggcaacccccagcctgccatcttctggaggcgggagggcagccagaacctgctcttctcctaccagcccccccagagcagcagccgcttctctgtgtcccagacaggagacctgaccatcaccaacgtgcagaggagtgatgtgggctactacatctgccagaccctgaatgtggccggcagcatcatcaccaaggcctacctggaggtgacagatgtgattgctgaccggcccccacctgtgatccggcagggccctgtgaaccagacagtggccgtggatggcacctttgtgctgagctgtgtggccaccggcagccctgtgcccaccatcctgtggaggaaggatggagtgctggtgtccacccaggacagccgcatcaagcagctggagaatggagtgctgcagatccgctatgccaagctgggggacaccggccgctacacctgcatcgccagcacccccagcggggaggccacctggagcgcctacatcgaggtgcaggagtttggagtgcctgtgcagcccccccggcccacagaccccaacctgatccccagcgcccccagcaagccagaggtgacagatgtgtccaggaacacagtgaccctgtcctggcagcccaacctgaacagcggggccacccccaccagctacatcatcgaggccttcagccacgccagcggcagctcctggcagacagtggctgaaaatgtgaagacagagaccagcgccatcaagggcctgaagcccaatgccatctacctgttcctggtgcgggccgccaatgcctacggcatcagtgaccccagccagatcagtgaccctgtgaagacccaggatgtgctgcccaccagccagggcgtggaccacaagcaggtgcagcgggagctgggcaatgctgtgctgcacctgcacaaccccaccgtgctgagcagcagcagcattgaggtgcactggacagtggaccagcagagccagtacatccagggctacaagatcctgtaccggcccagcggggccaaccacggggagagtgactggctggtgtttgaggtgaggaccccagccaagaacagcgtggtgatcccagacctgaggaagggcgtgaactatgagatcaaggcccggcccttcttcaatgagttccagggcgctgacagcgagatcaagtttgccaagaccctggaggaggcccccagcgccccaccccagggcgtgacagtgtccaagaatgatggaaatggaacagccatcctggtgtcctggcagcccccacctgaggacacccagaatggcatggtgcaggagtacaaggtgtggtgcctgggcaatgagacccgctaccacatcaacaagacagtggatggcagcaccttctctgtggtgatccccttcctggtgcccggcatccgctacagcgtggaggtggccgccagcactggagctggcagcggcgtgaagtctgagccccagttcatccagctggatgcccacggcaaccctgtgtccccagaggaccaggtgtccctggcccagcagatcagtgatgtggtgaagcagcctgccttcatcgccggcatcggggccgcctgctggatcatcctgatggtgttcagcatctggctgtaccgccacaggaagaagagaaatggcctgaccagcacctacgccggcatcaggaaggtgcccagcttcaccttcacccccaccgtgacctaccagagaggaggagaggccgtgtcctctgggggccggcccggcctgctgaacatcagcgagcctgctgcccagccctggctggccgacacctggcccaacacaggcaacaaccacaatgactgcagcatcagctgctgcacagctggaaatggaaacagcgacagcaacctgaccacctacagcaggcctgctgactgcatcgccaactacaacaaccagctggacaacaagcagaccaacctgatgctgcctgagagcacagtgtatggagatgtggacctgagcaacaagatcaatgagatgaagaccttcaacagccccaacctgaaggatggccgctttgtgaaccccagcggccagcccaccccctatgccaccacccagctgatccagagcaacctgagcaacaacatgaacaacggcagcggggacagcggggagaagcactggaagcccctgggccagcagaagcaggaggtggcccctgtgcagtacaacatcgtggagcagaacaagctgaacaaggactaccgggccaatgacacagtgccccccaccatcccctacaaccagagctatgaccagaacacaggaggcagctacaacagcagtgaccggggcagcagcaccagcggcagccagggccacaagaagggggcccggacccccaaggtgcccaagcagggcggcatgaactgggccgacctgctgcccccacctccagcccaccccccaccccacagcaacagcgaggagtacaacatctctgtggatgagagctatgaccaggagatgccctgccctgtgcccccagccaggatgtacctgcagcaggatgagctggaggaggaggaggatgagcggggccccaccccacctgtgagaggagctgccagcagccctgctgctgtgtcctacagccaccagagcacagccaccctgacccccagcccccaggaggagctgcagcccatgctgcaggactgcccagaggagaccggccacatgcagcaccagcctgacagaagacggcagcctgtgtccccacctcctccaccccggcccatcagccccccccacacctacggctacatcagcggccccctggtgtctgacatggacacagatgcccctgaggaggaggaggatgaagctgacatggaggtggccaagatgcagacccggcggctgctgctgcggggcctggagcagaccccagccagctctgtgggggacctggagagctctgtgacaggctccatgatcaatggctggggcagcgccagcgaggaggacaacatcagcagcggccgcagctctgtgagcagcagtgatggcagcttcttcacagatgctgactttgcccaggccgtggccgctgctgctgaatatgccggcctgaaggtggcccggcggcagatgcaggatgctgctggccgccgccacttccacgccagccagtgcccccggcccaccagccctgtgtccacagacagcaacatgtctgctgctgtgatgcagaagaccaggcctgccaagaagctgaagcaccagcccggccacctgcggcgggagacctacacagatgacctgcccccacctcctgtgcccccaccagccatcaagagccccacagcccagagcaagacccagctggaggtgcggcctgtggtggtgcccaagctgcccagcatggatgccaggacagacaggagcagtgacaggaagggcagcagctacaagggccgggaggtgctggatggccggcaggtggtggacatgaggaccaaccctggggacccccgggaggcccaggagcagcagaatgatggcaagggccggggcaacaaggccgccaagagggacctgcccccagccaagacccacctgatccaggaggacatcctgccctactgccggcccaccttccccaccagcaacaacccccgggaccccagcagcagcagctccatgagcagccggggcagcggcagccggcagcgggagcaggccaacgtgggcagaagaaatattgctgagatgcaggtgctgggcggctatgaaagaggagaggacaacaatgaggagctggaggagacagagagctag

SEQ ID NO: 168657 - DNA, 4956 bp, Artificial Sequence
  Description of Artificial Sequence: Synthetic coding sequence
atgaagtggaagcacgtgcccttcctggtgatgatcagcctgctgagcctgagccccaaccacctgttcctggcccagctgatcccagaccctgaagatgtggagagaggaaatgaccacggcacccccatccccaccagtgacaatgatgacaacagcctgggctacacaggcagccggctgcggcaggaggacttccccccacgcatcgtggagcaccccagcgacctgattgtgtccaaaggagagcccgccaccctgaactgcaaggccgagggccggcccacccccaccatcgagtggtacaagggcggggagcgggtggagacagacaaggatgaccccaggagccacaggatgctgctgcccagcggcagcctcttcttcctgcgcatcgtgcacggcaggaagagcaggccagatgaaggagtgtatgtgtgtgtggccaggaactacctgggggaggccgtgagccacaatgccagcctggaggtggccatcctgagagatgacttccggcagaaccccagtgatgtgatggtggccgtgggggagcctgctgtgatggagtgccagcccccccggggccaccctgagcccaccatctcctggaagaaggatggcagccccctggatgacaaggatgagcgcatcaccatccggggcggcaagctgatgatcacctacaccaggaagagtgatgctgggaagtatgtgtgtgtgggcaccaacatggtgggggagcgggagagcgaggtggccgagctgactgtgctggagcggcccagctttgtgaagaggcccagcaacctggccgtgacagtggatgacagcgctgagttcaagtgtgaggcccggggggaccctgtgcccaccgtgcgctggaggaaggatgatggagagctgcccaagagccgctatgagatcagagatgaccacaccctgaagatcaggaaggtgacagctggggacatgggcagctacacctgtgtggccgagaacatggtgggcaaggccgaggccagcgccaccctgactgtgcaggagcccccccactttgtggtgaagccccgggaccaggtggtggccctgggccgcacagtgaccttccagtgtgaggccactggaaacccccagcctgccatcttctggaggcgggagggcagccagaacctgctcttctcctaccagcccccccagagcagcagccgcttctctgtgtcccagacaggagacctgaccatcaccaacgtgcagaggagtgatgtgggctactacatctgccagaccctgaatgtggccggcagcatcatcaccaaggcctacctggaggtgacagatgtgattgctgacaggcctcctcctgtgatccggcagggccctgtgaaccagacagtggccgtggatggcacctttgtgctgagctgtgtggccaccggcagccctgtgcccaccatcctgtggaggaaggatggagtgctggtgtccacccaggacagccgcatcaagcagctggagaatggagtgctgcagatccgctatgccaagctgggggacaccggccgctacacctgcatcgccagcaccccatctggagaggccacctggagcgcctacatcgaggtgcaggagtttggagtgcctgtgcagcccccccggcccacagaccccaacctgatccccagcgcccccagcaagccagaggtgacagatgtgtccaggaacacagtgaccctgtcctggcagcccaacctgaacagcggggccacccccaccagctacatcatcgaggccttcagccacgccagcggcagctcctggcagacagtggccgagaatgtgaagacagagaccagcgccatcaagggcctgaagcccaatgccatctacctgttcctggtgcgggccgccaatgcctacggcatcagtgaccccagccagatcagtgaccctgtgaagacccaggatgtgctgcccaccagccagggcgtggaccacaagcaggtgcagcgggagctgggcaatgctgtgctgcacctgcacaaccccaccgtgctgagcagcagcagcattgaggtgcactggacagtggaccagcagagccagtacatccagggctacaagatcctgtaccggcccagcggggccaaccacggggagagtgactggctggtgtttgaggtgaggaccccagccaagaacagcgtggtgatcccagacctgaggaaaggagtgaactatgagatcaaggcccggcccttcttcaatgagttccagggcgctgacagcgagatcaagtttgccaagaccctggaggaggcccccagcgccccaccccagggcgtgacagtgtccaagaatgatggaaatggaacagccatcctggtgtcctggcagcccccacctgaggacacccagaatggcatggtgcaggagtacaaggtgtggtgcctgggcaatgagacccgctaccacatcaacaagacagtggatggcagcaccttctctgtggtgatccccttcctggtgcccggcatccgctacagcgtggaggtggccgccagcactggagctggcagcggcgtgaagtctgagccccagttcatccagctggatgcccacggcaaccctgtgtccccagaggaccaggtgtccctggcccagcagatcagtgatgtggtgaagcagcctgccttcatcgccggcattggagctgcctgctggatcatcctgatggtgttcagcatctggctgtaccgccacaggaagaagagaaatggcctgaccagcacctacgccggcatcaggaaggtgcccagcttcaccttcacccccaccgtgacctaccagaggggcggggaggccgtgagcagcggcggccggcccggcctgctgaacatcagcgagcctgctgcccagccctggctggccgacacctggcccaacacaggcaacaaccacaatgactgcagcatcagctgctgcacagctggaaatggaaacagcgacagcaacctgaccacctacagcaggcctgctgactgcatcgccaactacaacaaccagctggacaacaagcagaccaacctgatgctgcctgagagcacagtgtatggagatgtggacctgagcaacaagatcaatgagatgaagaccttcaacagccccaacctgaaggatggccgctttgtgaaccccagcggccagcccaccccctatgccaccacccagctgatccagagcaacctgagcaacaacatgaacaatggaagtggggacagcggggagaagcactggaagcccctgggccagcagaagcaggaggtggcccctgtgcagtacaacatcgtggagcagaacaagctgaacaaggactaccgggccaatgacacagtgccccccaccatcccctacaaccagagctatgaccagaacacaggaggcagctacaacagcagtgaccggggcagcagcaccagcggcagccagggccacaagaagggggcccggacccccaaggtgcccaagcagggcggcatgaactgggccgacctgctgcccccacctccagcccaccccccaccccacagcaacagcgaggagtacaacatctctgtggatgagagctatgaccaggagatgccctgccctgtgcccccagccaggatgtacctgcagcaggatgagctggaggaggaggaggatgagcggggccccaccccacctgtgcggggggccgccagcagccctgctgctgtgtcctacagccaccagagcacagccaccctgacccccagcccccaggaggagctgcagcccatgctgcaggactgcccagaggagaccggccacatgcagcaccagcctgacagaagacggcagcctgtgagccccccacctccaccccggcccatcagccccccccacacctacggctacatcagcggccccctggtgtctgacatggacacagatgcccctgaggaggaggaggatgaggccgacatggaggtggccaagatgcagacccggcggctgctgctgcggggcctggagcagaccccagccagctctgtgggggacctggagagctctgtgacaggctccatgatcaatggctggggcagcgccagcgaggaggacaacatcagcagcggccgcagctctgtgagcagcagtgatggcagcttcttcacagatgctgactttgcccaggccgtggccgctgctgctgaatatgccggcctgaaggtggcccggcggcagatgcaggatgctgctggaagaagacacttccacgccagccagtgcccccggcccaccagccctgtgtccacagacagcaacatgtctgctgctgtgatgcagaagaccaggcctgccaagaagctgaagcaccagcccggccacctgcggcgggagacctacacagatgacctgcccccacctcctgtgcccccaccagccatcaagagccccacagcccagagcaagacccagctggaggtgcggcctgtggtggtgcccaagctgcccagcatggatgccaggacagacaggagcagtgacaggaagggcagcagctacaagggccgggaggtgctggatggccggcaggtggtggacatgaggaccaaccctggggacccccgggaggcccaggagcagcagaatgatggcaagggccggggcaacaaggccgccaagagggacctgcccccagccaagacccacctgatccaggaggacatcctgccctactgccggcccaccttccccaccagcaacaacccccgggaccccagcagcagcagctccatgagcagccggggcagcggcagccggcagcgggagcaggccaacgtgggcagaagaaatattgctgagatgcaggtgctgggcggctatgaaagaggagaggacaacaatgaggagctggaggagacagagagctag

SEQ ID NO: 168658 - DNA, 4656 bp, Artificial Sequence
  Description of Artificial Sequence: Synthetic coding sequence
atgattgctgagcccgcccacttctacctgtttggcctcatctgcctgtgcagcggcagccggctgcggcaggaggacttccccccaagaattgtggagcaccccagcgacctgattgtgtccaagggggagcccgccaccctgaactgcaaggccgagggccggcccacccccaccatcgagtggtacaagggcggggagcgggtggagacagacaaggatgaccccaggagccacaggatgctgctgcccagcggcagcctcttcttcctgagaattgtgcacggcaggaagagcaggccagatgagggcgtgtatgtgtgtgtggccaggaactacctgggggaggccgtgagccacaatgccagcctggaggtggccatcctgagagatgacttccggcagaaccccagtgatgtgatggtggccgtgggggagcctgctgtgatggagtgccagcccccccggggccaccctgagcccaccatctcctggaagaaggatggcagccccctggatgacaaggatgagcgcatcaccatccggggcggcaagctgatgatcacctacaccaggaagagtgatgctgggaagtatgtgtgtgtgggcaccaacatggtgggggagcgggagagcgaggtggccgagctgactgtgctggagcggcccagctttgtgaagaggcccagcaacctggccgtgacagtggatgattctgctgagttcaagtgtgaggcccggggggaccctgtgcccaccgtgcgctggaggaaggatgatggagagctgcccaagagccgctatgagatcagagatgaccacaccctgaagatcaggaaggtgacagctggggacatgggcagctacacctgtgtggccgagaacatggtgggcaaggccgaggccagcgccaccctgactgtgcaggtgggcagcgagcccccccactttgtggtgaagccccgggaccaggtggtggccctgggccgcacagtgaccttccagtgtgaggccactggaaacccccagcctgccatcttctggaggcgggagggcagccagaacctgctcttctcctaccagcccccccagagcagcagccgcttctctgtgtcccagacaggagacctgaccatcaccaacgtgcagaggagtgatgtgggctactacatctgccagaccctgaatgtggccggcagcatcatcaccaaggcctacctggaggtgacagatgtgattgctgacaggcctcctcctgtgatccggcagggccctgtgaaccagacagtggccgtggatggcacctttgtgctgagctgtgtggccaccggcagccctgtgcccaccatcctgtggaggaaggatggagtgctggtgtccacccaggacagccgcatcaagcagctggagaatggagtgctgcagatccgctatgccaagctgggggacaccggccgctacacctgcatcgccagcaccccatctggagaggccacctggagcgcctacatcgaggtgcaggagtttggagtgcctgtgcagcccccccggcccacagaccccaacctgatccccagcgcccccagcaagccagaggtgacagatgtgtccaggaacacagtgaccctgtcctggcagcccaacctgaacagcggggccacccccaccagctacatcatcgaggccttcagccacgccagcggcagctcctggcagacagtggccgagaatgtgaagacagagaccagcgccatcaagggcctgaagcccaatgccatctacctgttcctggtgcgggccgccaatgcctacggcatcagtgaccccagccagatcagtgaccctgtgaagacccaggatgtgctgcccaccagccagggcgtggaccacaagcaggtgcagcgggagctgggcaatgctgtgctgcacctgcacaaccccaccgtgctgagcagcagcagcattgaggtgcactggacagtggaccagcagagccagtacatccagggctacaagatcctgtaccggcccagcggggccaaccacggggagagtgactggctggtgtttgaggtgaggaccccagccaagaacagcgtggtgatcccagacctgaggaaaggagtgaactatgagatcaaggcccggcccttcttcaatgagttccagggcgctgacagcgagatcaagtttgccaagaccctggaggaggcccccagcgccccaccccagggcgtgacagtgtccaagaatgatggaaatggaacagccatcctggtgtcctggcagcccccacctgaggacacccagaatggcatggtgcaggagtacaaggtgtggtgcctgggcaatgagacccgctaccacatcaacaagacagtggatggcagcaccttctctgtggtgatccccttcctggtgcccggcatccgctacagcgtggaggtggccgccagcactggagctggcagcggcgtgaagtctgagccccagttcatccagctggatgcccacggcaaccctgtgtccccagaggaccaggtgtccctggcccagcagatcagtgatgtggtgaagcagcctgccttcatcgccggcattggagctgcctgctggatcatcctgatggtgttcagcatctggctgtaccgccacaggaagaagagaaatggcctgaccagcacctacgccggcatcaggaaggtgacctaccagagaggaggagaggccgtgtcctctgggggccggcccggcctgctgaacatcagcgagcctgctgcccagccctggctggccgacacctggcccaacacaggcaacaaccacaatgactgcagcatcagctgctgcacagctggaaatggaaacagcgacagcaacctgaccacctacagcaggcctggccagcccaccccctatgccaccacccagctgatccagagcaacctgagcaacaacatgaacaatggaagtggggacagcggggagaagcactggaagcccctgggccagcagaagcaggaggtggcccctgtgcagtacaacatcgtggagcagaacaagctgaacaaggactaccgggccaatgacacagtgccccccaccatcccctacaaccagagctatgaccagaacacaggaggcagctacaacagcagtgaccggggcagcagcaccagcggcagccagggccacaagaagggggcccggacccccaaggtgcccaagcagggcggcatgaactgggccgacctgctgcccccacctccagcccaccccccaccccacagcaacagcgaggagtacaacatctctgtggatgagagctatgaccaggagatgccctgccctgtgcccccagccaggatgtacctgcagcaggatgagctggaggaggaggaggatgagcggggccccaccccacctgtgcggggggccgccagcagccctgctgctgtgtcctacagccaccagagcacagccaccctgacccccagcccccaggaggagctgcagcccatgctgcaggactgcccagaggagaccggccacatgcagcaccagcctgacagaagacggcagcctgtgagccccccacctccaccccggcccatcagccccccccacacctacggctacatcagcggccccctggtgtctgacatggacacagatgcccctgaggaggaggaggatgaggccgacatggaggtggccaagatgcagacccggcggctgctgctgcggggcctggagcagaccccagccagctctgtgggggacctggagagctctgtgacaggctccatgatcaatggctggggcagcgccagcgaggaggacaacatcagcagcggccgcagctctgtgagcagcagtgatggcagcttcttcacagatgctgactttgcccaggccgtggccgctgctgctgaatatgccggcctgaaggtggcccggcggcagatgcaggatgctgctggaagaagacacttccacgccagccagtgcccccggcccaccagccctgtgtccacagacagcaacatgtctgctgctgtgatgcagaagaccaggcctgccaagaagctgaagcaccagcccggccacctgcggcgggagacctacacagatgacctgcccccacctcctgtgcccccaccagccatcaagagccccacagcccagagcaagacccagctggaggtgcggcctgtggtggtgcccaagctgcccagcatggatgccaggacagacaggagcagtgacaggaagggcagcagctacaagggccgggaggtgctggatggccggcaggtggtggacatgaggaccaaccctggggacccccgggaggcccaggagcagcagaatgatggcaagggccggggcaacaaggccgccaagagggacctgcccccagccaagacccacctgatccaggaggacatcctgccctactgccggcccaccttccccaccagcaacaacccccgggaccccagcagcagcagctccatgagcagccggggcagcggcagccggcagcgggagcaggccaacgtgggcagaagaaatattgctgagatgcaggtgctgggcggctatgaaagaggagaggacaacaatgaggagctggaggagacagagagctag

SEQ ID NO: 168659 - DNA, 4821 bp, Artificial Sequence
  Description of Artificial Sequence: Synthetic coding sequence
atgattgctgagcccgcccacttctacctgtttggcctcatctgcctgtgcagcggcagccggctgcggcaggaggacttccccccaagaattgtggagcaccccagcgacctgattgtgtccaagggggagcccgccaccctgaactgcaaggccgagggccggcccacccccaccatcgagtggtacaagggcggggagcgggtggagacagacaaggatgaccccaggagccacaggatgctgctgcccagcggcagcctcttcttcctgagaattgtgcacggcaggaagagcaggccagatgagggcgtgtatgtgtgtgtggccaggaactacctgggggaggccgtgagccacaatgccagcctggaggtggccatcctgagagatgacttccggcagaaccccagtgatgtgatggtggccgtgggggagcctgctgtgatggagtgccagcccccccggggccaccctgagcccaccatctcctggaagaaggatggcagccccctggatgacaaggatgagcgcatcaccatccggggcggcaagctgatgatcacctacaccaggaagagtgatgctgggaagtatgtgtgtgtgggcaccaacatggtgggggagcgggagagcgaggtggccgagctgactgtgctggagcggcccagctttgtgaagaggcccagcaacctggccgtgacagtggatgattctgctgagttcaagtgtgaggcccggggggaccctgtgcccaccgtgcgctggaggaaggatgatggagagctgcccaagagccgctatgagatcagagatgaccacaccctgaagatcaggaaggtgacagctggggacatgggcagctacacctgtgtggccgagaacatggtgggcaaggccgaggccagcgccaccctgactgtgcaggtgggcagcgagcccccccactttgtggtgaagccccgggaccaggtggtggccctgggccgcacagtgaccttccagtgtgaggccactggaaacccccagcctgccatcttctggaggcgggagggcagccagaacctgctcttctcctaccagcccccccagagcagcagccgcttctctgtgtcccagacaggagacctgaccatcaccaacgtgcagaggagtgatgtgggctactacatctgccagaccctgaatgtggccggcagcatcatcaccaaggcctacctggaggtgacagatgtgattgctgacaggcctcctcctgtgatccggcagggccctgtgaaccagacagtggccgtggatggcacctttgtgctgagctgtgtggccaccggcagccctgtgcccaccatcctgtggaggaaggatggagtgctggtgtccacccaggacagccgcatcaagcagctggagaatggagtgctgcagatccgctatgccaagctgggggacaccggccgctacacctgcatcgccagcaccccatctggagaggccacctggagcgcctacatcgaggtgcaggagtttggagtgcctgtgcagcccccccggcccacagaccccaacctgatccccagcgcccccagcaagccagaggtgacagatgtgtccaggaacacagtgaccctgtcctggcagcccaacctgaacagcggggccacccccaccagctacatcatcgaggccttcagccacgccagcggcagctcctggcagacagtggccgagaatgtgaagacagagaccagcgccatcaagggcctgaagcccaatgccatctacctgttcctggtgcgggccgccaatgcctacggcatcagtgaccccagccagatcagtgaccctgtgaagacccaggatgtgctgcccaccagccagggcgtggaccacaagcaggtgcagcgggagctgggcaatgctgtgctgcacctgcacaaccccaccgtgctgagcagcagcagcattgaggtgcactggacagtggaccagcagagccagtacatccagggctacaagatcctgtaccggcccagcggggccaaccacggggagagtgactggctggtgtttgaggtgaggaccccagccaagaacagcgtggtgatcccagacctgaggaaaggagtgaactatgagatcaaggcccggcccttcttcaatgagttccagggcgctgacagcgagatcaagtttgccaagaccctggaggaggcccccagcgccccaccccagggcgtgacagtgtccaagaatgatggaaatggaacagccatcctggtgtcctggcagcccccacctgaggacacccagaatggcatggtgcaggagtacaaggtgtggtgcctgggcaatgagacccgctaccacatcaacaagacagtggatggcagcaccttctctgtggtgatccccttcctggtgcccggcatccgctacagcgtggaggtggccgccagcactggagctggcagcggcgtgaagtctgagccccagttcatccagctggatgcccacggcaaccctgtgtccccagaggaccaggtgtccctggcccagcagatcagtgatgtggtgaagcagcctgccttcatcgccggcattggagctgcctgctggatcatcctgatggtgttcagcatctggctgtaccgccacaggaagaagagaaatggcctgaccagcacctacgccggcatcaggaaggtgacctaccagagaggaggagaggccgtgtcctctgggggccggcccggcctgctgaacatcagcgagcctgctgcccagccctggctggccgacacctggcccaacacaggcaacaaccacaatgactgcagcatcagctgctgcacagctggaaatggaaacagcgacagcaacctgaccacctacagcaggcctgctgactgcatcgccaactacaacaaccagctggacaacaagcagaccaacctgatgctgcctgagagcacagtgtatggagatgtggacctgagcaacaagatcaatgagatgaagaccttcaacagccccaacctgaaggatggccgctttgtgaaccccagcggccagcccaccccctatgccaccacccagctgatccagagcaacctgagcaacaacatgaacaacggcagcggggacagcggggagaagcactggaagcccctgggccagcagaagcaggaggtggcccctgtgcagtacaacatcgtggagcagaacaagctgaacaaggactaccgggccaatgacacagtgccccccaccatcccctacaaccagagctatgaccagaacacaggaggcagctacaacagcagtgaccggggcagcagcaccagcggcagccagggccacaagaagggggcccggacccccaaggtgcccaagcagggcggcatgaactgggccgacctgctgcccccacctccagcccaccccccaccccacagcaacagcgaggagtacaacatctctgtggatgagagctatgaccaggagatgccctgccctgtgcccccagccaggatgtacctgcagcaggatgagctggaggaggaggaggatgagcggggccccaccccacctgtgagaggagctgccagcagccctgctgctgtgtcctacagccaccagagcacagccaccctgacccccagcccccaggaggagctgcagcccatgctgcaggactgcccagaggagaccggccacatgcagcaccagcctgacagaagacggcagcctgtgtccccacctcctccaccccggcccatcagccccccccacacctacggctacatcagcggccccctggtgtctgacatggacacagatgcccctgaggaggaggaggatgaagctgacatggaggtggccaagatgcagacccggcggctgctgctgcggggcctggagcagaccccagccagctctgtgggggacctggagagctctgtgacaggctccatgatcaatggctggggcagcgccagcgaggaggacaacatcagcagcggccgcagctctgtgagcagcagtgatggcagcttcttcacagatgctgactttgcccaggccgtggccgctgctgctgaatatgccggcctgaaggtggcccggcggcagatgcaggatgctgctggccgccgccacttccacgccagccagtgcccccggcccaccagccctgtgtccacagacagcaacatgtctgctgctgtgatgcagaagaccaggcctgccaagaagctgaagcaccagcccggccacctgcggcgggagacctacacagatgacctgcccccacctcctgtgcccccaccagccatcaagagccccacagcccagagcaagacccagctggaggtgcggcctgtggtggtgcccaagctgcccagcatggatgccaggacagacaggagcagtgacaggaagggcagcagctacaagggccgggaggtgctggatggccggcaggtggtggacatgaggaccaaccctggggacccccgggaggcccaggagcagcagaatgatggcaagggccggggcaacaaggccgccaagagggacctgcccccagccaagacccacctgatccaggaggacatcctgccctactgccggcccaccttccccaccagcaacaacccccgggaccccagcagcagcagctccatgagcagccggggcagcggcagccggcagcgggagcaggccaacgtgggcagaagaaatattgctgagatgcaggtgctgggcggctatgaaagaggagaggacaacaatgaggagctggaggagacagagagctag

SEQ ID NO: 168660 - DNA, 3213 bp, Artificial Sequence
  Description of Artificial Sequence: Synthetic coding sequence
atggccaggagacatgagcgggtgaccaggaggatgtggacctgggcccctggcctgctgatgatgacagtggtgttctggggccaccagggcaatggccagggccagggcagccggctgcggcaggaggacttccccccaagaattgtggagcaccccagtgatgtgattgtgtccaagggggagcccaccaccctgaactgcaaggccgagggccggcccacccccaccatcgagtggtacaaggatggagagcgggtggagacagacaaggatgaccccaggagccacaggatgctgctgcccagcggcagcctcttcttcctgagaattgtgcatggaagaagaagcaagccagatgagggcagctatgtgtgtgtggccaggaactacctgggggaggccgtgtccagaaatgccagcctggaggtggccctgctgagagatgacttccggcagaaccccacagatgtggtggtggccgccggggagcccgccatcctggagtgccagcccccccggggccaccctgagcccaccatctactggaagaaggacaaggtgagaattgatgacaaggaggagcgcatcagcatccggggcggcaagctgatgatcagcaacaccaggaagagtgatgctggcatgtacacctgtgtgggcaccaacatggtgggggagcgggacagcgaccctgctgagctgactgtgtttgagcggcccaccttcctgcggcggcccatcaaccaggtggtgctggaggaggaggccgtggagttccgctgccaggtgcagggcgacccccagcccaccgtgcgctggaagaaggatgatgctgacctgccccggggccgctatgacatcaaggatgactacaccctgcgcatcaagaagaccatgagcacagatgagggcacctacatgtgcatcgccgagaacagagtgggcaagatggaggccagcgccaccctgactgtgcggggcggcgtgattgccccaccccagtttgtggtgcggccccgggaccagatcgtggcccagggccgcacagtgaccttcccctgtgagaccaagggcaacccccagcctgctgtgttctggcagaaggagggcagccagaacctgctcttccccaaccagccccagcagcccaacagccgctgcagcgtgagccccactggagacctgaccatcaccaacatccagaggagtgatgctggctactacatctgccaggccctgactgtggccggcagcatcctggccaaggcccagctggaggtgacagatgtgctgacagaccggcccccacccatcatcctgcagggccctgccaaccagaccctggccgtggatggaacagccctgctgaagtgcaaggccaccggggaccccctgcctgtgatctcctggctgaaggagggcttcaccttccctggccgggacccccgggccaccatccaggagcagggcaccctgcagatcaagaacctgcgcatcagtgacaccggcacctacacctgtgtggccaccagcagcagcggggagacctcctggagcgctgtgctggatgtgacagagagcggggccaccatcagcaagaactatgacctgagtgacctgcccggcccccccagcaagccccaggtgacagatgtgaccaagaacagcgtgaccctgtcctggcagcccggcaccccaggcaccctgcctgccagcgcctacatcatcgaggccttcagccagagcgtgagcaacagctggcagacagtggccaaccacgtgaagaccaccctgtacacagtgcggggcctgcggcccaacaccatctacctgttcatggtgcgggccatcaacccccagggcctgagtgaccccagccccatgtctgaccctgtgaggacccaggacatcagccccccagcccagggcgtggaccaccggcaggtgcagaaggagctgggagatgtgctggtgcggctgcacaaccctgtggtgctgacccccaccaccgtgcaggtgacctggacagtggaccggcagccccagttcatccagggctacagagtgatgtaccggcagaccagcggcctgcaggccaccagctcctggcagaacctggatgccaaggtgcccacagagaggtctgctgtgctggtgaacctgaagaagggcgtgacctatgagatcaaggtgcggccctacttcaatgagttccagggcatggacagcgagagcaagacagtgaggaccacagaggaggcccccagcgccccaccccagagcgtgacagtgctgactgtgggcagctacaacagcaccagcatctctgtgtcctgggaccccccacctccagaccaccagaatggcatcatccaggagtacaagatctggtgcctgggcaatgagacccgcttccacatcaacaagacagtggatgctgccatccgcagcgtcatcattggaggcctcttccctggcatccagtacagagtggaggtggccgccagcaccagcgctggggtgggcgtgaagtctgagccccagcccatcatcattggaagaagaaatgaggtggtgatcacagagaacaacaacagcatcacagagcagatcacagatgtggtgaagcagcctgccttcatcgccggcattggaggagcctgctgggtgatcctgatgggcttcagcatctggctgtactggaggaggaagaagaggaagggcctgagcaactatgctgtgaccttccagagaggagatggcggcctgatgagcaatggcagcaggcctggcctgctgaatgctggggaccccagctacccctggctggccgacagctggccagccaccagcctgcctgtgaacaacagcaacagcggccccaatgaaattggcaactttggaagaggagatgtgctgccccctgtgcccggccagggcgacaagacagccaccatgctgagtgatggagccatctacagcagcattgacttcaccaccaagaccagctacaacagcagcagccagatcacccaggccaccccctatgccaccacccagatcctgcacagcaacagcatccacgagctggccgtggacctgcctgacccccagtggaagagcagcatccagcagaagacagacctgatgggcttcggctacagcctgcctgaccagaacaagggcaacaatggagagagcggcagctag

SEQ ID NO: 168661 - DNA, 1713 bp, Artificial Sequence
  Description of Artificial Sequence: Synthetic coding sequence
atgagcacagatgagggcacctacatgtgcatcgcagaaaatagagtgggcaagatggaggccagcgccaccctgactgtgcggggcggcgtcatcgccccaccccagtttgtggtgcggccccgggaccagatcgtggcccagggccgcacagtgaccttcccctgtgagaccaagggcaacccccagcctgctgtgttctggcagaaggagggcagccagaacctgctcttccccaaccagccccagcagcccaacagccgctgcagcgtgagccccaccggggacctgaccatcaccaacatccagaggagtgatgctggctactacatctgccaggccctgactgtggccggcagcatcctggccaaggcccagctggaggtgacagatgtgctgacagaccggcccccacccatcatcctgcagggccctgccaaccagaccctggccgtggatggaacagccctgctgaagtgcaaggccactggagaccccctgcccgtcatctcctggctgaaggagggcttcaccttccctggccgggacccccgggccaccatccaggagcagggcaccctgcagatcaagaacctgcgcatcagtgacaccggcacctacacctgtgtggccaccagcagcagtggagagacctcctggagcgctgtgctggatgtgacagaaagtggggccaccatcagcaagaactatgacctgagtgacctgcccggcccccccagcaagccccaggtgacagatgtgaccaagaacagcgtgaccctgtcctggcagcccggcaccccaggcaccctgcctgccagcgcctacatcatcgaggccttcagccagagcgtgagcaacagctggcagacagtggccaaccacgtgaagaccaccctgtacacagtgcggggcctgcggcccaacaccatctacctgttcatggtgcgggccatcaacccccagggcctgagtgaccccagccccatgtctgaccctgtgaggacccaggacatcagccccccagcccagggcgtggaccaccggcaggtgcagaaggagctgggagatgtgctggtgcggctgcacaaccctgtggtgctgacccccaccaccgtgcaggtgacctggacagtggaccggcagccccagttcatccagggctacagagtgatgtaccggcagaccagcggcctgcaggccaccagctcctggcagaacctggatgccaaggtgcccacagagaggtctgctgtgctggtgaacctgaagaagggcgtgacctatgagatcaaggtgcggccctacttcaatgagttccagggcatggattctgagagcaagacagtgaggaccacagaggaggcccccagcgccccaccccagagcgtgacagtgctgactgtgggcagctacaacagcaccagcatctctgtgtcctgggaccccccacctccagaccaccagaatggcatcatccaggagtacaagatctggtgcctgggcaatgagacccgcttccacatcaacaagacagtggatgctgccatccgcagcgtcatcatcggcggcctcttccctggcatccagtacagagtggaggtggccgccagcaccagcgctggggtgggcgtgaagtctgagccccagcccaacaacacaggctaccccatctgccacgacacagacctggccttccagcagcacacctag

SEQ ID NO: 168662 - DNA, 4185 bp, Artificial Sequence
  Description of Artificial Sequence: Synthetic coding sequence
atggccaggagacatgagcgggtgaccaggaggatgtggacctgggcccctggcctgctgatgatgacagtggtgttctggggccaccagggcaatggccagggccagggcagccggctgcggcaggaggacttccccccaagaattgtggagcaccccagtgatgtgattgtgtccaagggggagcccaccaccctgaactgcaaggccgagggccggcccacccccaccatcgagtggtacaaggatggagagcgggtggagacagacaaggatgaccccaggagccacaggatgctgctgcccagcggcagcctcttcttcctgagaattgtgcatggaagaagaagcaagccagatgagggcagctatgtgtgtgtggccaggaactacctgggggaggccgtgtccagaaatgccagcctggaggtggccctgctgagagatgacttccggcagaaccccacagatgtggtggtggccgccggggagcccgccatcctggagtgccagcccccccggggccaccctgagcccaccatctactggaagaaggacaaggtgagaattgatgacaaggaggagcgcatcagcatccggggcggcaagctgatgatcagcaacaccaggaagagtgatgctggcatgtacacctgtgtgggcaccaacatggtgggggagcgggacagcgaccctgctgagctgactgtgtttgagcggcccaccttcctgcggcggcccatcaaccaggtggtgctggaggaggaggccgtggagttccgctgccaggtgcagggcgacccccagcccaccgtgcgctggaagaaggatgatgctgacctgccccggggccgctatgacatcaaggatgactacaccctgcgcatcaagaagaccatgagcacagatgagggcacctacatgtgcatcgccgagaacagagtgggcaagatggaggccagcgccaccctgactgtgcgggccccaccccagtttgtggtgcggccccgggaccagatcgtggcccagggccgcacagtgaccttcccctgtgagaccaagggcaacccccagcctgctgtgttctggcagaaggagggcagccagaacctgctcttccccaaccagccccagcagcccaacagccgctgcagcgtgagccccactggagacctgaccatcaccaacatccagaggagtgatgctggctactacatctgccaggccctgactgtggccggcagcatcctggccaaggcccagctggaggtgacagatgtgctgacagaccggcccccacccatcatcctgcagggccctgccaaccagaccctggccgtggatggaacagccctgctgaagtgcaaggccaccggggaccccctgcctgtgatctcctggctgaaggagggcttcaccttccctggccgggacccccgggccaccatccaggagcagggcaccctgcagatcaagaacctgcgcatcagtgacaccggcacctacacctgtgtggccaccagcagcagcggggagacctcctggagcgctgtgctggatgtgacagagagcggggccaccatcagcaagaactatgacctgagtgacctgcccggcccccccagcaagccccaggtgacagatgtgaccaagaacagcgtgaccctgtcctggcagcccggcaccccaggcaccctgcctgccagcgcctacatcatcgaggccttcagccagagcgtgagcaacagctggcagacagtggccaaccacgtgaagaccaccctgtacacagtgcggggcctgcggcccaacaccatctacctgttcatggtgcgggccatcaacccccagggcctgagtgaccccagccccatgtctgaccctgtgaggacccaggacatcagccccccagcccagggcgtggaccaccggcaggtgcagaaggagctgggagatgtgctggtgcggctgcacaaccctgtggtgctgacccccaccaccgtgcaggtgacctggacagtggaccggcagccccagttcatccagggctacagagtgatgtaccggcagaccagcggcctgcaggccaccagctcctggcagaacctggatgccaaggtgcccacagagaggtctgctgtgctggtgaacctgaagaagggcgtgacctatgagatcaaggtgcggccctacttcaatgagttccagggcatggacagcgagagcaagacagtgaggaccacagaggaggcccccagcgccccaccccagagcgtgacagtgctgactgtgggcagctacaacagcaccagcatctctgtgtcctgggaccccccacctccagaccaccagaatggcatcatccaggagtacaagatctggtgcctgggcaatgagacccgcttccacatcaacaagacagtggatgctgccatccgcagcgtcatcattggaggcctcttccctggcatccagtacagagtggaggtggccgccagcaccagcgctggggtgggcgtgaagtctgagccccagcccatcatcattggaagaagaaatgaggtggtgatcacagagaacaacaacagcatcacagagcagatcacagatgtggtgaagcagcctgccttcatcgccggcattggaggagcctgctgggtgatcctgatgggcttcagcatctggctgtactggaggaggaagaagaggaagggcctgagcaactatgctgtgaccttccagagaggagatggcggcctgatgagcaatggcagcaggcctggcctgctgaatgctggggaccccagctacccctggctggccgacagctggccagccaccagcctgcctgtgaacaacagcaacagcggccccaatgaaattggcaactttggaagaggagatgtgctgccccctgtgcccggccagggcgacaagacagccaccatgctgagtgatggagccatctacagcagcattgacttcaccaccaagaccagctacaacagcagcagccagatcacccaggccaccccctatgccaccacccagatcctgcacagcaacagcatccacgagctggccgtggacctgcctgacccccagtggaagagcagcatccagcagaagacagacctgatgggcttcggctacagcctgcctgaccagaacaagggcaacaatggaggcaagggcggcaagaagaagaagaacaagaacagcagcaagccccagaagaacaacggcagcacctgggccaacgtgcccctgcccccacctcctgtgcagcccctgcctggaacagagctggagcactatgctgtggagcagcaggagaatggctatgacagcgacagctggtgcccccccctgcctgtgcagacctacctgcaccagggcctggaggatgagctggaggaggatgatgacagagtgcccaccccacctgtgcggggcgtggccagcagccctgccatcagctttggccagcagagcacagccaccctgacccccagcccccgggaggagatgcagcccatgctgcaggcccacctggatgagctgacccgggcctaccagtttgacatcgccaagcagacctggcacatccagagcaacaaccagcccccccagccccctgtgccccccctgggctacgtgtctggggccctgatcagtgacctggagacagatgtggctgatgatgatgctgatgatgaggaggaggccctggagatcccccggcccctgcgggccctggaccagaccccaggcagctccatggacaacctggacagctctgtgacaggcaaggccttcaccagcagccagaggccccggcccaccagccccttcagcacagacagcaacaccagcgctgccctgagccagagccagaggccccggcccaccaagaagcacaagggcggccgcatggaccagcagcctgccctgccccacagaagagagggcatgacagatgaggaggccctggtgccctacagcaagcccagcttccccagccctgggggccacagcagcagcggcacagccagcagcaagggcagcacaggccccaggaagacagaggtgctgcgggccggccaccagagaaatgccagtgacctgctggacatcggctacatgggcagcaacagccagggccagttcaccggggagctgtag

SEQ ID NO: 168663 - DNA, 4137 bp, Artificial Sequence
  Description of Artificial Sequence: Synthetic coding sequence
atgagcctgctgatgttcacccagctgctgctgtgtggcttcctgtatgtgcgggtggatggcagccggctgcggcaggaggacttccccccaagaattgtggagcaccccagtgatgtgattgtgtccaagggggagcccaccaccctgaactgcaaggccgagggccggcccacccccaccatcgagtggtacaaggatggagagcgggtggagacagacaaggatgaccccaggagccacaggatgctgctgcccagcggcagcctcttcttcctgagaattgtgcatggaagaagaagcaagccagatgagggcagctatgtgtgtgtggccaggaactacctgggggaggccgtgtccagaaatgccagcctggaggtggccctgctgagagatgacttccggcagaaccccacagatgtggtggtggccgccggggagcccgccatcctggagtgccagcccccccggggccaccctgagcccaccatctactggaagaaggacaaggtgagaattgatgacaaggaggagcgcatcagcatccggggcggcaagctgatgatcagcaacaccaggaagagtgatgctggcatgtacacctgtgtgggcaccaacatggtgggggagcgggacagcgaccctgctgagctgactgtgtttgagcggcccaccttcctgcggcggcccatcaaccaggtggtgctggaggaggaggccgtggagttccgctgccaggtgcagggcgacccccagcccaccgtgcgctggaagaaggatgatgctgacctgccccggggccgctatgacatcaaggatgactacaccctgcgcatcaagaagaccatgagcacagatgagggcacctacatgtgcatcgccgagaacagagtgggcaagatggaggccagcgccaccctgactgtgcgggccccaccccagtttgtggtgcggccccgggaccagatcgtggcccagggccgcacagtgaccttcccctgtgagaccaagggcaacccccagcctgctgtgttctggcagaaggagggcagccagaacctgctcttccccaaccagccccagcagcccaacagccgctgcagcgtgagccccactggagacctgaccatcaccaacatccagaggagtgatgctggctactacatctgccaggccctgactgtggccggcagcatcctggccaaggcccagctggaggtgacagatgtgctgacagaccggcccccacccatcatcctgcagggccctgccaaccagaccctggccgtggatggaacagccctgctgaagtgcaaggccaccggggaccccctgcctgtgatctcctggctgaaggagggcttcaccttccctggccgggacccccgggccaccatccaggagcagggcaccctgcagatcaagaacctgcgcatcagtgacaccggcacctacacctgtgtggccaccagcagcagcggggagacctcctggagcgctgtgctggatgtgacagagagcggggccaccatcagcaagaactatgacctgagtgacctgcccggcccccccagcaagccccaggtgacagatgtgaccaagaacagcgtgaccctgtcctggcagcccggcaccccaggcaccctgcctgccagcgcctacatcatcgaggccttcagccagagcgtgagcaacagctggcagacagtggccaaccacgtgaagaccaccctgtacacagtgcggggcctgcggcccaacaccatctacctgttcatggtgcgggccatcaacccccagggcctgagtgaccccagccccatgtctgaccctgtgaggacccaggacatcagccccccagcccagggcgtggaccaccggcaggtgcagaaggagctgggagatgtgctggtgcggctgcacaaccctgtggtgctgacccccaccaccgtgcaggtgacctggacagtggaccggcagccccagttcatccagggctacagagtgatgtaccggcagaccagcggcctgcaggccaccagctcctggcagaacctggatgccaaggtgcccacagagaggtctgctgtgctggtgaacctgaagaagggcgtgacctatgagatcaaggtgcggccctacttcaatgagttccagggcatggacagcgagagcaagacagtgaggaccacagaggaggcccccagcgccccaccccagagcgtgacagtgctgactgtgggcagctacaacagcaccagcatctctgtgtcctgggaccccccacctccagaccaccagaatggcatcatccaggagtacaagatctggtgcctgggcaatgagacccgcttccacatcaacaagacagtggatgctgccatccgcagcgtcatcattggaggcctcttccctggcatccagtacagagtggaggtggccgccagcaccagcgctggggtgggcgtgaagtctgagccccagcccatcatcattggaagaagaaatgaggtggtgatcacagagaacaacaacagcatcacagagcagatcacagatgtggtgaagcagcctgccttcatcgccggcattggaggagcctgctgggtgatcctgatgggcttcagcatctggctgtactggaggaggaagaagaggaagggcctgagcaactatgctgtgaccttccagagaggagatggcggcctgatgagcaatggcagcaggcctggcctgctgaatgctggggaccccagctacccctggctggccgacagctggccagccaccagcctgcctgtgaacaacagcaacagcggccccaatgaaattggcaactttggaagaggagatgtgctgccccctgtgcccggccagggcgacaagacagccaccatgctgagtgatggagccatctacagcagcattgacttcaccaccaagaccagctacaacagcagcagccagatcacccaggccaccccctatgccaccacccagatcctgcacagcaacagcatccacgagctggccgtggacctgcctgacccccagtggaagagcagcatccagcagaagacagacctgatgggcttcggctacagcctgcctgaccagaacaagggcaacaatggaggcaagggcggcaagaagaagaagaacaagaacagcagcaagccccagaagaacaacggcagcacctgggccaacgtgcccctgcccccacctcctgtgcagcccctgcctggaacagagctggagcactatgctgtggagcagcaggagaatggctatgacagcgacagctggtgcccccccctgcctgtgcagacctacctgcaccagggcctggaggatgagctggaggaggatgatgacagagtgcccaccccacctgtgcggggcgtggccagcagccctgccatcagctttggccagcagagcacagccaccctgacccccagcccccgggaggagatgcagcccatgctgcaggcccacctggatgagctgacccgggcctaccagtttgacatcgccaagcagacctggcacatccagagcaacaaccagcccccccagccccctgtgccccccctgggctacgtgtctggggccctgatcagtgacctggagacagatgtggctgatgatgatgctgatgatgaggaggaggccctggagatcccccggcccctgcgggccctggaccagaccccaggcagctccatggacaacctggacagctctgtgacaggcaaggccttcaccagcagccagaggccccggcccaccagccccttcagcacagacagcaacaccagcgctgccctgagccagagccagaggccccggcccaccaagaagcacaagggcggccgcatggaccagcagcctgccctgccccacagaagagagggcatgacagatgaggaggccctggtgccctacagcaagcccagcttccccagccctgggggccacagcagcagcggcacagccagcagcaagggcagcacaggccccaggaagacagaggtgctgcgggccggccaccagagaaatgccagtgacctgctggacatcggctacatgggcagcaacagccagggccagttcaccggggagctgtag

SEQ ID NO: 168664 - DNA, 4185 bp, Artificial Sequence; identical to SEQ ID NO: 168662
  Description of Artificial Sequence: Synthetic coding sequence

SEQ ID NO: 168665 - DNA, 4161 bp, Artificial Sequence
  Description of Artificial Sequence: Synthetic coding sequence
atgctgcgctacctgctgaagaccctgctgcagatgaacctgtttgctgacagcctggccggggacatcagcaacagcagcgagctgctgctgggcttcaacagcagcctggccgccctgaaccacaccctgctgcccccaggggaccccagcctgaatggcagccgggtgggcccagaagatgccatgccccgcatcgtggagcagcccccagacctgctggtgtccagaggagagcccgccaccctgccctgcagagctgagggccggccccggcccaacatcgagtggtacaagaatggagcccgggtggccaccgtgcgggaggacccccgggcccaccggctgctgctgcccagcggggccctcttcttcccccgcatcgtgcacggccggcgggcccggccagatgaaggagtgtacacctgtgtggccaggaactacctgggcgccgccgccagcagaaatgccagcctggaggtggccgtgctgagagatgacttccggcagagccctggaaatgtggtggtggccgtgggggagcctgctgtgctggagtgtgtgcccccccggggccaccctgagcccagcgtgtcctggaggaaggatggagcccggctgaaggaggaggagggccgcatcaccatccggggcggcaagctgatgatgagccacaccctgaagagtgatgctggcatgtatgtgtgtgtggccagcaacatggccggggagcgggagagcgctgctgctgaggtgatggtgctggagcggcccagcttcctgcggcggcctgtgaaccaggtggtgctggctgatgcccctgtgaccttcctgtgtgaggtgaagggggaccccccaccccggctgcgctggaggaaggaggatggagagctgcccaccggccgctatgagatccgcagtgaccacagcctgtggattggacatgtgtctgcagaagatgagggcacctacacctgtgtggctgaaaattctgtgggccgggcagaggccagcggcagcctgtctgtgcacgtgcccccccagctggtgacccagccccaggaccagatggccgcccctggagagagcgtggccttccagtgtgagaccaagggcaaccccccaccagccatcttctggcagaaggagggcagccaggtgctgctcttccccagccagagcctgcagcccaccggccgcttctctgtgagcccccggggccagctgaacatcacagctgtgcagagaggagatgctggctactacgtgtgccaggccgtgtctgtggccggcagcatcctggccaaggccctgctggagatcaagggggccagcctggatggcctgccccctgtgatcctgcagggccctgccaaccagaccctggtgctgggcagctctgtgtggctgccctgccgggtgactggaaacccccagcccagcgtgcgctggaagaaggatggccagtggctgcagggagatgacctgcagttcaagaccatggccaacggcaccctgtacatcgccaacgtgcaggagatggacatgggcttctacagctgtgtggccaagagcagcactggagaggccacctggagcggctggctgaagatgagggaggactggggcgtgtccccagaccccccaacagagcccagcagccccccaggggcccccagccagcctgtggtgacagagatcaccaagaacagcatcaccctgacctggaagcccaacccccagacaggagctgctgtgaccagctatgtgattgaggccttcagccctgctgctggcaacacctggaggacagtggctgatggagtgcagctggagacccacacagtgtctggcctgcagcccaacaccatctacctgttcctggtgcgggctgtgggcgcctggggcctgtctgagcccagccctgtgtctgagcctgtgaggacccaggacagcagccccagcaggcctgtggaggacccctggaggggccagcagggcctggccgaggtggccgtgcggctgcaggagcccatcgtgctgggccccaggaccctgcaggtgtcctggacagtggatggccctgtgcagctggtgcagggcttccgggtgtcctggagggtggccggccctgagggcggctcctggaccatgctggacctgcagagccccagccagcagagcacagtgctgcggggcctgcccccaggcacccagatccagatcaaggtgcaggcccagggccaggagggcctgggcgctgagagcctgtctgtgaccaggagcatccctgaggaggcccccagcggccccccccagggcgtggccgtggccctgggcggagatggcaacagcagcatcaccgtgtcctgggagccccccctgcccagccagcagaatggagtcatcacagagtaccagatctggtgcctgggcaatgaaagccgcttccacctgaacagatctgctgctggctgggcccggagcgccatgctgcggggcctggtgcccggcctgctgtaccgcaccctggtggccgccgccaccagcgctggggtgggcgtgcccagcgcccctgtgctggtgcagctgcccagccccccagacctggagcccggcctggaggtgggcgccggcctggccgtgcggctggcccgggtgctgcgggagcccgccttcctggccggcagcggggccgcctgtggggccctgctgctgggcctgtgtgccgccctgtactggaggaggaagcagaggaaggagctgagccactacacagccagctttgcctacaccccagctgtgtccttcccccacagcgagggcctgagcggggccagcagccggccccccatgggcctgggccctgccccctacagctggctggccgacagctggccccaccccagccgcagccccagcgcccaggagccccggggcagctgctgccccagcaacccagaccctgatgaccgctactacaatgaagctggcatcagcctgtacctggcccagacagcccggggcacagctgcccctggagagggccctgtgtacagcaccatcgaccctgctggggaggagctgcagaccttccatggaggcttcccccagcaccccagcggggacctgggcccctggagccagtatgcccctcctgagtggagccagggcgacagcggggccaagggcggcaaggtgaagctgctgggcaagcctgtgcagatgcccagcctgaactggccagaggccctgcccccacctccacccagctgtgagctgagctgcctggagggccctgaggaggagctggagggcagcagcgagcctgaggagtggtgcccccccatgcctgagaggagccacctgacagagcccagcagcagcggcggctgcctggtgacccccagccggcgggagacccccagccccacccccagctatggccagcagagcacagccaccctgacccccagccccccagaccccccccagcccccaacagacatgccccacctgcaccagatgccccggcgggtgcccctgggccccagcagccccctgtctgtgtcccagcccatgctgggcatccgggaggcccggcctgctggcctgggcgccggccctgctgccagcccccacctgagccccagccctgcccccagcacagccagcagcgcccctggccgcacctggcagggcaatggagagatgaccccacccctgcagggcccccgggcccgcttcaggaagaagcccaaggccctgccctacagaagagagaacagccctggggacctgcccccaccacccctgcccccacctgaggaggaggcctcctgggccctggagctgcgggccgccggctccatgagcagcctggagcgggagaggtctggagagaggaaggctgtgcaggccgtgcccctggccgcccagagggtgctgcacccagatgaggaggcctggctgccctacagccggcccagcttcctgagccggggccagggcaccagcacctgcagcacagctggcagcaacagcagccggggcagcagcagcagccggggcagccggggccctggccgcagccgcagccgcagccagagccgcagccagagccagaggcctggccagaagagaagagaggagcccaggtag

SEQ ID NO: 168666 - DNA, 4095 bp, Artificial Sequence
  Description of Artificial Sequence: Synthetic coding sequence
atggagaggcctgaggacagcctgagcctgtggagcctgaacctgagcccccagttcccctgcctgaatgccctgcggcaccccctgagccctggcagccgggtgggcccagaagatgccatgccccgcatcgtggagcagcccccagacctgctggtgtccagaggagagcccgccaccctgccctgcagagctgagggccggccccggcccaacatcgagtggtacaagaatggagcccgggtggccaccgtgcgggaggacccccgggcccaccggctgctgctgcccagcggggccctcttcttcccccgcatcgtgcacggccggcgggcccggccagatgaaggagtgtacacctgtgtggccaggaactacctgggcgccgccgccagcagaaatgccagcctggaggtggccgtgctgagagatgacttccggcagagccctggaaatgtggtggtggccgtgggggagcctgctgtgctggagtgtgtgcccccccggggccaccctgagcccagcgtgtcctggaggaaggatggagcccggctgaaggaggaggagggccgcatcaccatccggggcggcaagctgatgatgagccacaccctgaagagtgatgctggcatgtatgtgtgtgtggccagcaacatggccggggagcgggagagcgctgctgctgaggtgatggtgctggagcggcccagcttcctgcggcggcctgtgaaccaggtggtgctggctgatgcccctgtgaccttcctgtgtgaggtgaagggggaccccccaccccggctgcgctggaggaaggaggatggagagctgcccaccggccgctatgagatccgcagtgaccacagcctgtggattggacatgtgtctgcagaagatgagggcacctacacctgtgtggctgaaaattctgtgggccgggcagaggccagcggcagcctgtctgtgcacgtgcccccccagctggtgacccagccccaggaccagatggccgcccctggagagagcgtggccttccagtgtgagaccaagggcaaccccccaccagccatcttctggcagaaggagggcagccaggtgctgctcttccccagccagagcctgcagcccaccggccgcttctctgtgagcccccggggccagctgaacatcacagctgtgcagagaggagatgctggctactacgtgtgccaggccgtgtctgtggccggcagcatcctggccaaggccctgctggagatcaagggggccagcctggatggcctgccccctgtgatcctgcagggccctgccaaccagaccctggtgctgggcagctctgtgtggctgccctgccgggtgactggaaacccccagcccagcgtgcgctggaagaaggatggccagtggctgcagggagatgacctgcagttcaagaccatggccaacggcaccctgtacatcgccaacgtgcaggagatggacatgggcttctacagctgtgtggccaagagcagcactggagaggccacctggagcggctggctgaagatgagggaggactggggcgtgtccccagaccccccaacagagcccagcagccccccaggggcccccagccagcctgtggtgacagagatcaccaagaacagcatcaccctgacctggaagcccaacccccagacaggagctgctgtgaccagctatgtgattgaggccttcagccctgctgctggcaacacctggaggacagtggctgatggagtgcagctggagacccacacagtgtctggcctgcagcccaacaccatctacctgttcctggtgcgggctgtgggcgcctggggcctgtctgagcccagccctgtgtctgagcctgtgaggacccaggacagcagccccagcaggcctgtggaggacccctggaggggccagcagggcctggccgaggtggccgtgcggctgcaggagcccatcgtgctgggccccaggaccctgcaggtgtcctggacagtggatggccctgtgcagctggtgcagggcttccgggtgtcctggagggtggccggccctgagggcggctcctggaccatgctggacctgcagagccccagccagcagagcacagtgctgcggggcctgcccccaggcacccagatccagatcaaggtgcaggcccagggccaggagggcctgggcgctgagagcctgtctgtgaccaggagcatccctgaggaggcccccagcggccccccccagggcgtggccgtggccctgggcggagatggcaacagcagcatcaccgtgtcctgggagccccccctgcccagccagcagaatggagtcatcacagagtaccagatctggtgcctgggcaatgaaagccgcttccacctgaacagatctgctgctggctgggcccggagcgccatgctgcggggcctggtgcccggcctgctgtaccgcaccctggtggccgccgccaccagcgctggggtgggcgtgcccagcgcccctgtgctggtgcagctgcccagccccccagacctggagcccggcctggaggtgggcgccggcctggccgtgcggctggcccgggtgctgcgggagcccgccttcctggccggcagcggggccgcctgtggggccctgctgctgggcctgtgtgccgccctgtactggaggaggaagcagaggaaggagctgagccactacacagccagctttgcctacaccccagctgtgtccttcccccacagcgagggcctgagcggggccagcagccggccccccatgggcctgggccctgccccctacagctggctggccgacagctggccccaccccagccgcagccccagcgcccaggagccccggggcagctgctgccccagcaacccagaccctgatgaccgctactacaatgaagctggcatcagcctgtacctggcccagacagcccggggcacagctgcccctggagagggccctgtgtacagcaccatcgaccctgctggggaggagctgcagaccttccatggaggcttcccccagcaccccagcggggacctgggcccctggagccagtatgcccctcctgagtggagccagggcgacagcggggccaagggcggcaaggtgaagctgctgggcaagcctgtgcagatgcccagcctgaactggccagaggccctgcccccacctccacccagctgtgagctgagctgcctggagggccctgaggaggagctggagggcagcagcgagcctgaggagtggtgcccccccatgcctgagaggagccacctgacagagcccagcagcagcggcggctgcctggtgacccccagccggcgggagacccccagccccacccccagctatggccagcagagcacagccaccctgacccccagccccccagaccccccccagcccccaacagacatgccccacctgcaccagatgccccggcgggtgcccctgggccccagcagccccctgtctgtgtcccagcccatgctgggcatccgggaggcccggcctgctggcctgggcgccggccctgctgccagcccccacctgagccccagccctgcccccagcacagccagcagcgcccctggccgcacctggcagggcaatggagagatgaccccacccctgcagggcccccgggcccgcttcaggaagaagcccaaggccctgccctacagaagagagaacagccctggggacctgcccccaccacccctgcccccacctgaggaggaggcctcctgggccctggagctgcgggccgccggctccatgagcagcctggagcgggagaggtctggagagaggaaggctgtgcaggccgtgcccctggccgcccagagggtgctgcacccagatgaggaggcctggctgccctacagccggcccagcttcctgagccggggccagggcaccagcacctgcagcacagctggcagcaacagcagccggggcagcagcagcagccggggcagccggggccctggccgcagccgcagccgcagccagagccgcagccagagccagaggcctggccagaagagaagagaggagcccaggtag

SEQ ID NO: 168667 - DNA, 450 bp, Artificial Sequence
  Description of Artificial Sequence: Synthetic coding sequence
atgaccccacccctgcagggcccccgggcccgcttcaggaagaagcccaaggccctgccctaccgccgggagaacagccctggggacctgcccccaccacccctgcccccacctgaggaggaggcctcctgggccctggagctgcgggctgctggctccatgagcagcctggagcgggagaggtctggagagaggaaggctgtgcaggccgtgcccctggccgcccagagggtgctgcacccagatgaggaggcctggctgccctacagccggcccagcttcctgagccggggccagggcaccagcacctgcagcacagctggcagcaacagcagccggggcagcagcagcagccggggcagccggggccctggccgcagccgcagccgcagccagagccgcagccagagccagaggcctggccagaagaggcgggaggagcccaggtag

SEQ ID NO: 168668 - DNA, 3024 bp, Artificial Sequence
  Description of Artificial Sequence: Synthetic coding sequence
atgggcagcggcggggacagcctgctgggcggccggggcagcctgcccctgctgctgctgctgatcatgggcggcatggcccaggacagccccccccagatcctggtgcacccccaggaccagctgttccagggccctggccctgccaggatgagctgccaggccagcggccagcccccacccaccatccgctggctgctgaatggccagcccctgtccatggtgcccccagacccccaccacctgctgcctgatggcaccctgctgctgctgcagcccccagcccggggccacgcccatgatggccaggccctgagcacagacctgggcgtgtacacctgtgaggccagcaaccggctgggcacagctgtgtccagaggagcccggctgtctgtggccgtgctgcgggaggacttccagatccagccccgggacatggtggccgtggtgggggagcagttcaccctggagtgtggccccccctggggccaccctgagcccaccgtgtcctggtggaaggatggcaagcccctggccctgcagcccggccgccacacagtgtctgggggcagcctgctgatggcccgggcagagaagagtgatgagggcacctacatgtgtgtggccaccaacagcgctggccaccgggagagccgggccgcccgggtgtccatccaggagccccaggactacacagagcctgtggagctgctggccgtgcgcatccagctggagaatgtgaccctgctgaacccagaccctgctgagggccccaagcccaggcctgctgtgtggctgtcctggaaggtgtctggccctgctgccccagcccagagctacacagccctcttccgcacccagacagcccctgggggccagggcgccccctgggccgaggagctgctggccggctggcagagcgctgagctgggcggcctgcactggggccaggactatgagttcaaggtgcggcccagcagcggccgggcccggggccctgacagcaatgtgctgctgctgcggctgcctgagaaggtgcccagcgccccaccccaggaggtgaccctgaagccaggaaatggcaccgtgtttgtgtcctgggtgcccccacctgctgagaaccacaacggcatcatccggggctaccaggtgtggagcctgggcaacaccagcctgcccccagccaactggacagtggtgggggagcagacccagctggagatcgccacccacatgcctggcagctactgtgtgcaggtggccgctgtgactggagctggggccggggagcccagcaggcctgtgtgcctgctgctggagcaggccatggagcgggccacccaggagcccagcgagcacggcccctggaccctggagcagctgcgggccaccctgaagaggcctgaggtgattgccacctgtggggtggccctgtggctgctgctgctgggcacagctgtgtgcatccacagaagaagaagagcccgggtgcacctgggccctggcctgtaccgctacaccagtgaagatgccatcctgaagcacaggatggaccacagcgacagccagtggctggccgacacctggaggagcaccagcggcagccgggacctgagcagcagcagcagcctgagcagccggctgggcgcagatgcccgggaccccctggactgcagaagaagcctgctgtcctgggacagccgcagccctggggtgcccctgctgcctgacaccagcaccttctacggcagcctgattgctgagctgcccagcagcaccccagcccggcccagcccccaggtgcctgctgtgcggcggctgcccccccagctggcccagctgagcagcccctgcagcagcagtgacagcctgtgcagcagaagaggcctgagcagcccccggctgagcctggccccagctgaggcctggaaggccaagaagaagcaggagctgcagcacgccaacagcagccccctgctgcggggcagccacagcctggagctgcgggcctgtgagctgggcaacagaggcagcaagaacctgagccagagccctggagctgtgccccaggccctggtggcctggagggccctgggccccaagctgctgagcagcagcaatgagctggtgaccaggcacctgcccccagcccccctcttcccccatgagaccccacccacccagagccagcagacccagccccctgtggccccccaggcccccagcagcatcctgctgcctgctgcccccatccccatcctgagcccctgcagcccccccagcccccaggccagcagcctgagcggccccagccctgccagcagccggctgagcagcagcagcctgagcagcctgggggaggaccaggacagcgtgctgaccccagaggaggtggccctgtgcctggagctgtctgagggggaggagacccccaggaacagcgtgagccccatgccccgggcccccagcccccccaccacctacggctacatctctgtgcccacagccagcgagttcacagacatgggccgcactggaggcggcgtgggccccaagggcggcgtgctgctgtgccccccccggccctgcctgacccccaccccatctgagggcagcctggccaacggctggggcagcgccagcgaggacaatgctgccagcgcccgggccagcctggtgagcagcagtgatggcagcttcctggctgatgcccactttgcccgggccctggccgtggccgtggacagctttggatttggcctggagccccgggaggccgactgtgtgttcattgatgccagcagcccccccagccccagagatgagatcttcctgacccccaacctgagcctgcccctgtgggagtggaggccagactggctggaggacatggaggtgagccacacccagaggctgggccggggcatgccaccctggcccccagacagccagatcagcagccagaggagccagctgcactgcaggatgcccaaggccggggccagccctgtggactacagctag

SEQ ID NO: 168669 - DNA, 2106 bp, Artificial Sequence
  Description of Artificial Sequence: Synthetic coding sequence
atgggcagcggcggggacagcctgctgggcggccggggcagcctgcccctgctgctgctgctgatcatggtgctgcgggaggacttccagatccagccccgggacatggtggccgtggtgggggagcagttcaccctggagtgtggccccccctggggccaccctgagcccaccgtgtcctggtggaaggatggcaagcccctggccctgcagcccggccgccacacagtgtctgggggcagcctgctgatggcccgggcagagaagagtgatgagggcacctacatgtgtgtggccaccaacagcgctggccaccgggagagccgggccgcccgggtgtccatccaggagccccaggactacacagagcctgtggagctgctggccgtgcgcatccagctggagaatgtgaccctgctgaacccagaccctgctgagggccccaagcccaggcctgctgtgtggctgtcctggaaggtgtctggccctgctgccccagcccagagctacacagccctcttccgcacccagacagcccctgggggccagggcgccccctgggccgaggagctgctggccggctggcagagcgctgagctgggcggcctgcactggggccaggactatgagttcaaggtgcggcccagcagcggccgggcccggggccctgacagcaatgtgctgctgctgcggctgcctgagaaggtgcccagcgccccaccccaggaggtgaccctgaagccaggaaatggcaccgtgtttgtgtcctgggtgcccccacctgctgagaaccacaacggcatcatccggggctaccaggtgtggagcctgggcaacaccagcctgcccccagccaactggacagtggtgggggagcagacccagctggagatcgccacccacatgcctggcagctactgtgtgcaggtggccgctgtgactggagctggggccggggagcccagcaggcctgtgtgcctgctgctggagcaggccatggagcgggccacccaggagcccagcgagcacggcccctggaccctggagcagctgcgggccaccctgaagaggcctgaggtgattgccacctgtggggtggccctgtggctgctgctgctgggcacagctgtgtgcatccacagaagaagaagagcccgggtgcacctgggccctggcctgtaccgctacaccagtgaagatgccatcctgaagcacaggatggaccacagcgacagccagtggctggccgacacctggaggagcaccagcggcagccgggacctgagcagcagcagcagcctgagcagccggctgggcgcagatgcccgggaccccctggactgcagaagaagcctgctgtcctgggacagccgcagccctggggtgcccctgctgcctgacaccagcaccttctacggcagcctgattgctgagctgcccagcagcaccccagcccggcccagcccccaggtgcctgctgtgcggcggctgcccccccagctggcccagctgagcagcccctgcagcagcagtgacagcctgtgcagcagaagaggcctgagcagcccccggctgagcctggccccagctgaggcctggaaggccaagaagaagcaggagctgcagcacgccaacagcagccccctgctgcggggcagccacagcctggagctgcgggcctgtgagctgggcaacagaggcagcaagaacctgagccagagccctggagctgtgccccaggccctggtggcctggagggccctgggccccaagctgctgagcagcagcaatgagctggtgaccaggcacctgcccccagcccccctcttcccccatgagaccccacccacccagagccagcagacccagccccctgtggccccccaggcccccagcagcatcctgctgcctgctgcccccatccccatcctgagcccctgcagcccccccagcccccaggccagcagcctgagcggccccagccctgccagcagccggctgagcagcagcagcctgagcagcctgggggaggaccaggacagcgtgctgaccccagaggaggtggccctgtgcctggagctgtctgagggggaggagaccccctag

SEQ ID NO: 168670 - DNA, 2589 bp, Artificial Sequence
  Description of Artificial Sequence: Synthetic coding sequence
atggtggccgtggtgggggagcagttcaccctggagtgtggccccccctggggccaccctgagcccaccgtgtcctggtggaaggatggcaagcccctggccctgcagcccggccgccacacagtgtctgggggcagcctgctgatggcccgggcagagaagagtgatgagggcacctacatgtgtgtggccaccaacagcgctggccaccgggagagcagagctgcccgggtgtccatccaggagccccaggactacacagagcctgtggagctgctggccgtgcgcatccagctggagaatgtgaccctgctgaacccagaccctgctgagggccccaagcccaggcctgctgtgtggctgtcctggaaggtgtctggccctgctgccccagcccagagctacacagccctcttccgcacccagacagcccctgggggccagggcgccccctgggccgaggagctgctggccggctggcagagcgctgagctgggcggcctgcactggggccaggactatgagttcaaggtgcggcccagcagcggccgggcccggggccctgacagcaatgtgctgctgctgcggctgcctgagaaggtgcccagcgccccaccccaggaggtgaccctgaagccaggaaatggaacagtgtttgtgtcctgggtgcccccacctgctgagaaccacaacggcatcatccggggctaccaggtgtggagcctgggcaacaccagcctgcccccagccaactggacagtggtgggggagcagacccagctggagatcgccacccacatgcctggcagctactgtgtgcaggtggccgctgtgactggagctggagctggggagcccagcaggcctgtgtgcctgctgctggagcaggccatggagcgggccacccaggagcccagcgagcacggcccctggaccctggagcagctgcgggccaccctgaagaggcctgaggtgattgccacctgtggggtggccctgtggctgctgctgctgggcacagctgtgtgcatccacagaagaagaagagcccgggtgcacctgggccctggcctgtaccgctacaccagtgaagatgccatcctgaagcacaggatggaccacagcgacagccagtggctggccgacacctggaggagcaccagcggcagccgggacctgagcagcagcagcagcctgagcagccggctgggcgcagatgcccgggaccccctggactgccgccgcagcctgctgtcctgggacagccgcagccctggggtgcccctgctgcctgacaccagcaccttctacggcagcctgattgctgagctgcccagcagcaccccagcccggcccagcccccaggtgcctgctgtgcggcggctgcccccccagctggcccagctgagcagcccctgcagcagcagtgacagcctgtgcagccggcggggcctgagcagcccccggctgagcctggccccagctgaggcctggaaggccaagaagaagcaggagctgcagcacgccaacagcagccccctgctgcggggcagccacagcctggagctgcgggcctgtgagctgggcaacagaggcagcaagaacctgagccagagccctggagctgtgccccaggccctggtggcctggagggccctgggccccaagctgctgagcagcagcaatgagctggtgaccaggcacctgcccccagcccccctcttcccccatgagaccccacccacccagagccagcagacccagccccctgtggccccccaggcccccagcagcatcctgctgcctgctgcccccatccccatcctgagcccctgcagcccccccagcccccaggccagcagcctgagcggccccagccctgccagcagccggctgagcagcagcagcctgagcagcctgggggaggaccaggacagcgtgctgaccccagaggaggtggccctgtgcctggagctgtctgagggggaggagaccccaagaaattctgtgagccccatgccccgggcccccagcccccccaccacctacggctacatctctgtgcccacagccagcgagttcacagacatgggccgcactggaggaggagtgggccccaagggcggcgtgctgctgtgccccccccggccctgcctgacccccacccccagcgagggcagcctggccaacggctggggcagcgcctctgaagataatgctgccagcgcccgggccagcctggtgagcagcagtgatggcagcttcctggctgatgcccactttgcccgggccctggccgtggccgtggacagctttggcttcggcctggagccccgggaggccgactgtgtgttcattgatgccagcagcccccccagccccagagatgagatcttcctgacccccaacctgagcctgcccctgtgggagtggaggccagactggctggaggacatggaggtgagccacacccagaggctgggccggggcatgccaccctggcccccagacagccagatcagcagccagaggagccagctgcactgcaggatgcccaaggccggggccagccctgtggactacagctag

SEQ ID NO: 168671 - DNA, 3708 bp, Artificial Sequence
  Description of Artificial Sequence: Synthetic coding sequence
atgagcggccccacagatgaaacagctggggacctgcctgtgaaggacaccggcctgaacctgtttggcatgggcggcctgcaggagaccagcaccaccaggaccatgaagagccggcaggccgtgtcccgggtgtcccgggaggagctggaggaccgcttcctgcggctgcatgatgagaacatcctgctgaagcagcacgccaggaagcaggaggacaagatcaagaggatggccaccaagctgatccggctggtgaatgacaagaagagatatgaaagagtgggcggcggccccaagaggctgggcagagatgtggagatggaggagatgattgagcagctgcaggagaaggtgcatgagctggagaagcagaatgagaccctgaagaacagactcatcagcgccaagcagcagctgcagacccagggctaccggcagaccccctacaacaacgtgcagagccgcatcaacacaggaagaaggaaggccaatgaaaatgccggcctgcaggagtgccccaggaagggcatcaagttccaggatgctgatgtggccgagaccccccaccccatgttcaccaagtatggcaacagcctgctggaggaggcccggggggagatccggaacctggagaatgtcatccagagccagaggggccagatcgaggagctggagcacctggccgagatcctgaagacccagctgcggaggaaagaaaatgaaattgagctgagcctgctgcagctgcgggagcagcaggccacagaccagaggagcaacatccgggacaacgtggagatgatcaagctgcacaagcagctggtggagaagagcaatgccctgagcgccatggagggcaagttcatccagctgcaggagaagcagaggaccctgcgcatcagccatgatgccctgatggccaatggagatgagctgaacatgcagctgaaggagcagaggctgaagtgctgcagcctggagaagcagctgcacagcatgaagttcagcgagaggagaattgaggagctgcaggaccgcatcaatgacctggagaaggagcgggagctgctgaaggagaactatgacaagctgtatgacagcgccttctctgctgcccacgaggagcagtggaagctgaaggagcagcagctgaaggtgcagatcgcccagctggagacagccctgaagagtgacctgacagacaagacagagatcctggaccggctgaagacagagcgggaccagaatgagaagctggtgcaggagaaccgggagctgcagctgcagtacctggagcagaagcagcagctggatgagctgaagaagaggatcaagctgtacaaccaggagaatgacatcaatgctgatgagctgtctgaggccctgctgctgatcaaggcccagaaggagcagaagaatggagacctgtccttcctggtgaaggtggacagcgagatcaacaaggacctggagaggtccatgagggagctgcaggccacccatgctgagaccgtgcaggagctggagaagaccaggaacatgctgatcatgcagcacaagatcaacaaggactaccagatggaggtggaggccgtgaccaggaagatggagaacctgcagcaggactatgagctgaaggtggagcagtatgtgcacctgctggacatccgggccgcccgcatccacaagctggaggcccagctgaaggacatcgcctacggcaccaagcagtacaagttcaagccagagatcatgccagatgacagcgtggatgaatttgatgagaccatccacctggagcggggggagaacctgtttgagatccacatcaacaaggtgaccttcagcagcgaggtgctgcaggccagcggggacaaggagcctgtgaccttctgcacctacgccttctatgactttgagctgcagaccacccctgtggtgcggggcctgcaccctgagtacaacttcaccagccagtacctggtgcacgtgaatgacctcttcctgcagtacatccagaagaacaccatcaccctggaggtgcaccaggcctacagcacagaatatgagaccatcgccgcctgccagctgaagttccacgagatcctggagaagagcggccgcatcttctgcacagccagcctgattggcaccaagggggacatccccaactttggcaccgtggagtactggttccggctgcgggtgcccatggaccaggccatccggctgtaccgggagcgggccaaggccctgggctacatcaccagcaacttcaagggccctgagcacatgcagagcctgagccagcaggcccccaagacagcccagctgagcagcacagacagcacagatggcaacctgaatgagctgcacatcaccatccgctgctgcaaccacctgcagagccgggccagccacctgcagccccacccctacgtggtgtacaagttctttgattttgctgaccatgacacagccatcatccccagcagcaatgacccccagtttgatgaccacatgtacttccctgtgcccatgaacatggacctggaccgctacctgaagtctgagagcctgtccttctacgtgtttgatgacagcgacacccaggagaacatctacatcggcaaggtgaatgtgcccctcatcagcctggcccatgaccgctgcatcagcggcatctttgagctgacagaccaccagaagcaccctgctggcaccatccacgtgatcctgaagtggaagtttgcctacctgccccccagcggcagcatcaccacagaggacctgggcaacttcatccgctctgaggagcctgaggtggtgcagaggctgcccccagccagctctgtgtccaccctggtgctggccccccggcccaagccccggcagaggctgacccctgtggacaagaaggtgtcctttgtggacatcatgccccaccagagtgatgtgtcccaggagggctctgtggatgaggtgaaggagaacacagagaagatgcagcagggcaaggatgatgtgtccctgctgtctgagggccagctggccgagcagagcctggccagcagtgaagatgaaacagagatcacagaggacctggagcctgaggtggaggaggacatgtctgccagtgacagtgatgactgcatcatccctggccccatcagcaagaacatcaagcagcccagcgagaagatcagaattgagatcatcgccctgagcctgaatgacagccaggtgaccatggatgacaccatccagaggctgtttgtggagtgccgcttctacagcctgcctgctgaggagacccctgtgtccctgcccaagcccaagagcggccagtgggtgtactacaactacagcaatgtcatctacgtggacaaggagaacaacaaggccaagagggacatcctgaaggccatcctgcagaagcaggagatgcccaacagaagcctgcgcttcaccgtggtgtctgaccccccagaagatgagcaggacctggagtgtgaagatattggagtggcccacgtggacctggccgacatgttccaggagggccgggacctgattgagcagaacattgatgtgtttgatgcccgggcagatggagagggcatcggcaagctgcgggtgacagtggaggccctgcacgccctgcagagcgtgtacaagcagtacagagatgacctggaggcctag

SEQ ID NO: 168672 - DNA, 3948 bp, Artificial Sequence
  Description of Artificial Sequence: Synthetic coding sequence
atgagcggccccacagatgaaacagctggggacctgcctgtgaaggacaccggcctgaacctgtttggcatgggcggcctgcaggagaccagcaccaccaggaccatgaagagccggcaggccgtgtcccgggtgtcccgggaggagctggaggaccgcttcctgcggctgcatgatgagaacatcctgctgaagcagcacgccaggaagcaggaggacaagatcaagaggatggccaccaagctgatccggctggtgaatgacaagaagagatatgaaagagtgggcggcggccccaagaggctgggcagagatgtggagatggaggagatgattgagcagctgcaggagaaggtgcatgagctggagaagcagaatgagaccctgaagaacagactcatcagcgccaagcagcagctgcagacccagggctaccggcagaccccctacaacaacgtgcagagccgcatcaacacaggaagaaggaaggccaatgaaaatgccggcctgcaggagtgccccaggaagggcatcaagttccaggatgctgatgtggccgagaccccccaccccatgttcaccaagtatggcaacagcctgctggaggaggcccggggggagatccggaacctggagaatgtcatccagagccagaggggccagatcgaggagctggagcacctggccgagatcctgaagacccagctgcggaggaaagaaaatgaaattgagctgagcctgctgcagctgcgggagcagcaggccacagaccagaggagcaacatccgggacaacgtggagatgatcaagctgcacaagcagctggtggagaagagcaatgccctgagcgccatggagggcaagttcatccagctgcaggagaagcagaggaccctgcgcatcagccatgatgccctgatggccaatggagatgagctgaacatgcagctgaaggagcagaggctgaagtgctgcagcctggagaagcagctgcacagcatgaagttcagcgagaggagaattgaggagctgcaggaccgcatcaatgacctggagaaggagcgggagctgctgaaggagaactatgacaagctgtatgacagcgccttctctgctgcccacgaggagcagtggaagctgaaggagcagcagctgaaggtgcagatcgcccagctggagacagccctgaagagtgacctgacagacaagacagagatcctggaccggctgaagacagagcgggaccagaatgagaagctggtgcaggagaaccgggagctgcagctgcagtacctggagcagaagcagcagctggatgagctgaagaagaggatcaagctgtacaaccaggagaatgacatcaatgctgatgagctgtctgaggccctgctgctgatcaaggcccagaaggagcagaagaatggagacctgtccttcctggtgaaggtggacagcgagatcaacaaggacctggagaggtccatgagggagctgcaggccacccatgctgagaccgtgcaggagctggagaagaccaggaacatgctgatcatgcagcacaagatcaacaaggactaccagatggaggtggaggccgtgaccaggaagatggagaacctgcagcaggactatgagctgaaggtggagcagtatgtgcacctgctggacatccgggccgcccgcatccacaagctggaggcccagctgaaggacatcgcctacggcaccaagcagtacaagttcaagccagagatcatgccagatgacagcgtggatgaatttgatgagaccatccacctggagcggggggagaacctgtttgagatccacatcaacaaggtgaccttcagcagcgaggtgctgcaggccagcggggacaaggagcctgtgaccttctgcacctacgccttctatgactttgagctgcagaccacccctgtggtgcggggcctgcaccctgagtacaacttcaccagccagtacctggtgcacgtgaatgacctcttcctgcagtacatccagaagaacaccatcaccctggaggtgcaccaggcctacagcacagaatatgagaccatcgccgcctgccagctgaagttccacgagatcctggagaagagcggccgcatcttctgcacagccagcctgattggcaccaagggggacatccccaactttggcaccgtggagtactggttccggctgcgggtgcccatggaccaggccatccggctgtaccgggagcgggccaaggccctgggctacatcaccagcaacttcaagggccctgagcacatgcagagcctgagccagcaggcccccaagacagcccagctgagcagcacagacagcacagatggcaacctgaatgagctgcacatcaccatccgctgctgcaaccacctgcagagccgggccagccacctgcagccccacccctacgtggtgtacaagttctttgattttgctgaccatgacacagccatcatccccagcagcaatgacccccagtttgatgaccacatgtacttccctgtgcccatgaacatggacctggaccgctacctgaagtctgagagcctgtccttctacgtgtttgatgacagcgacacccaggagaacatctacatcggcaaggtgaatgtgcccctcatcagcctggcccatgaccgctgcatcagcggcatctttgagctgacagaccaccagaagcaccctgctggcaccatccacgtgatcctgaagtggaagtttgcctacctgccccccagcggcagcatcaccacagaggacctgggcaacttcatccgctctgaggagcctgaggtggtgcagaggctgcccccagccagctctgtgtccaccctggtgctggccccccggcccaagccccggcagaggctgacccctgtggacaagaaggtgtcctttgtggacatcatgccccaccagagtgatgagaccagccccccacctgaggacaggaaggagatcagccctgaggtggagcacatccctgagattgagatcaacatgctgactgtgccccacgtgcccaaggtgtcccaggagggctctgtggatgaggtgaaggagaacacagagaagatgcagcagggcaaggatgatgtgtccctgctgtctgagggccagctggccgagcagagcctggccagcagtgaagatgaaacagagatcacagaggacctggagcctgaggtggaggaggacatgtctgccagtgacagtgatgactgcatcatccctggccccatcagcaagaacatcaagcagagcctggccctgagccctggcctgggctgcagcagcgccatcagcgcccactgcaacttccggctgcccggcagcagtgacttccctgccagcgccagccaggtggatggcatcactggagcctgccaccacacccagcccagcgagaagatcagaattgagatcatcgccctgagcctgaatgacagccaggtgaccatggatgacaccatccagaggctgtttgtggagtgccgcttctacagcctgcctgctgaggagacccctgtgtccctgcccaagcccaagagcggccagtgggtgtactacaactacagcaatgtcatctacgtggacaaggagaacaacaaggccaagagggacatcctgaaggccatcctgcagaagcaggagatgcccaacagaagcctgcgcttcaccgtggtgtctgaccccccagaagatgagcaggacctggagtgtgaagatattggagtggcccacgtggacctggccgacatgttccaggagggccgggacctgattgagcagaacattgatgtgtttgatgcccgggcagatggagagggcatcggcaagctgcgggtgacagtggaggccctgcacgccctgcagagcgtgtacaagcagtacagagatgacctggaggcctag

SEQ ID NO: 168673 - DNA, 1956 bp, Artificial Sequence
  Description of Artificial Sequence: Synthetic coding sequence
atggccgcccccctgctgcacacccggctgcctggagatgctgctgccagcagcagcgctgtgaagaagctgggcgccagcaggacaggcatcagcaacatgagggccctggagaatgacttcttcaacagcccccccaggaagacagtgcgctttggaggcaccgtgacagaggtgctgctgaagtacaagaagggggagaccaatgactttgagctgctgaagaaccagctgctggaccctgacatcaaggatgaccagatcatcaactggctgctggagttccgcagcagcatcatgtacctgaccaaggactttgagcagctgatcagcatcatcctgcggctgccctggctgaacagaagccagacagtggtggaggagtacctggccttcctgggcaacctggtgtctgcccagacagtgttcctgcggccctgcctgtccatgattgccagccactttgtgccccccagggtcatcatcaaggagggagatgtggatgtgtctgacagtgatgatgaagatgacaacctgcctgccaactttgacacctgccaccgggccctgcagatcatcgcccgctacgtgcccagcaccccctggttcctgatgcccatcctggtggagaagttcccctttgtgaggaagtctgagaggaccctggagtgctacgtgcacaacctgctgcgcatctctgtgtacttccccaccctgcggcatgagatcctggagctgatcatcgagaagctgctgaagctggatgtgaatgccagccggcagggcattgaagatgctgaggagacagccacccagacctgtggcggcacagacagcacagagggcctcttcaacatggatgaagatgaggagacagagcacgagaccaaggccggccctgagcggctggaccagatggtgcaccctgtggccgagcggctggacatcctgatgagcctggtgctgagctacatgaaggatgtgtgctacgtggatggcaaggtggacaatggcaagaccaaggacctgtacagagacctgatcaacatctttgacaagctgctgctgcccacccacgccagctgccacgtgcagttcttcatgttctacctgtgcagcttcaagctgggctttgctgaggccttcctggagcacctgtggaagaagctgcaggaccccagcaacccagccatcatccggcaggccgccggcaactacatcggcagcttcctggcccgggccaagttcatccccctcatcaccgtgaagagctgcctggacctgctggtgaactggctgcacatctacctgaacaaccaggacagcggcaccaaggccttctgtgatgtggccctgcacggccccttctacagcgcctgccaggccgtgttctacacctttgtgttccgccacaagcagctgctgagcggcaacctgaaggagggcctgcagtacctgcagagcctgaactttgagcgcatcgtgatgagccagctgaaccccctgaagatctgcctgcccagcgtggtgaacttctttgctgccatcaccaacaagtaccagctggtgttctgctacaccatcattgaaagaaacaaccggcagatgctgcccgtcatccgcagcacagctggaggagacagcgtgcagatctgcaccaaccccctggacaccttcttcccctttgacccctgtgtgctgaagaggagcaagaagttcatcgaccccatctaccaggtgtgggaggacatgtctgctgaggagctgcaggagttcaagaagcccatgaagaaggacatcgtggaggatgaagatgatgacttcctgaagggggaggtgccccagaatgacaccgtcatcggcatcacccccagcagctttgacacccacttccgcagccccagcagctctgtgggcagcccccctgtgctgtacatgcagcccagccccctgtag

SEQ ID NO: 168674 - DNA, 1857 bp, Artificial Sequence
  Description of Artificial Sequence: Synthetic coding sequence
atgagggccctggagaatgacttcttcaacagcccccccaggaagacagtgcgctttggaggcaccgtgacagaggtgctgctgaagtacaagaagggggagaccaatgactttgagctgctgaagaaccagctgctggaccctgacatcaaggatgaccagatcatcaactggctgctggagttccgcagcagcatcatgtacctgaccaaggactttgagcagctgatcagcatcatcctgcggctgccctggctgaacagaagccagacagtggtggaggagtacctggccttcctgggcaacctggtgtctgcccagaccgtcttcctgcggccctgcctgtccatgattgccagccactttgtgccccccagggtcatcatcaaggagggagatgtggatgtgtctgacagtgatgatgaagatgacaacctgcctgccaactttgacacctgccaccgggccctgcagatcatcgcccgctacgtgcccagcaccccctggttcctgatgcccatcctggtggagaagttcccctttgtgaggaagtctgagaggaccctggagtgctacgtgcacaacctgctgcgcatctctgtgtacttccccaccctgcggcatgagatcctggagctgatcatcgagaagctgctgaagctggatgtgaatgccagccggcagggcattgaagatgctgaggagacagccacccagacctgtggcggcacagacagcacagagggcctcttcaacatggatgaagatgaggagacagaacatgagaccaaggccggccctgagcggctggaccagatggtgcaccctgtggccgagcggctggacatcctgatgagcctggtgctgagctacatgaaggatgtgtgctacgtggatggcaaggtggacaacgggaagaccaaggacctgtacagagacctgatcaacatctttgacaagctgctgctgcccacccacgccagctgccacgtgcagttcttcatgttctacctgtgcagcttcaagctgggctttgctgaggccttcctggagcacctgtggaagaagctgcaggaccccagcaacccagccatcatccggcaggccgccggcaactacatcggcagcttcctggcccgggccaagttcatccccctcatcaccgtgaagagctgcctggacctgctggtgaactggctgcacatctacctgaacaaccaggacagcggcaccaaggccttctgtgatgtggccctgcacggccccttctacagcgcctgccaggccgtgttctacacctttgtgttccgccacaagcagctgctgagcggcaacctgaaggagggcctgcagtacctgcagagcctgaactttgaaagaattgtgatgagccagctgaaccccctgaagatctgcctgcccagcgtggtgaacttctttgctgccatcaccaacaagtaccagctggtgttctgctacaccatcatcgagaggaacaaccggcagatgctgcctgtgatccgcagcacagctggaggagacagcgtgcagatctgcaccaaccccctggacaccttcttcccctttgacccctgtgtgctgaagaggagcaagaagttcatcgaccccatctaccaggtgtgggaggacatgtctgctgaggagctgcaggagttcaagaagcccatgaagaaggacatcgtggaggatgaagatgatgacttcctgaagggggaggtgccccagaatgacacagtgattggcatcacccccagcagctttgacacccacttccgcagccccagcagctctgtgggcagcccccctgtgctgtacatgcagcccagccccctgtag

SEQ ID NO: 168675 - DNA, 1866 bp, Artificial Sequence
  Description of Artificial Sequence: Synthetic coding sequence
atggccgcccccctgctgcacacccggctgcctggagatgctgctgccagcagcagcgctgtgaagaagctgggcgccagcaggacaggcatcagcaacatgagggccctggagaatgacttcttcaacagcccccccaggaagacagtgcgctttggaggcaccgtgacagaggtgctgctgaagtacaagaagggggagaccaatgactttgagctgctgaagaaccagctgctggaccctgacatcaagaggctgccctggctgaacagaagccagacagtggtggaggagtacctggccttcctgggcaacctggtgtctgcccagacagtgttcctgcggccctgcctgtccatgattgccagccactttgtgccccccagggtcatcatcaaggagggagatgtggatgtgtctgacagtgatgatgaagatgacaacctgcctgccaactttgacacctgccaccgggccctgcagatcatcgcccgctacgtgcccagcaccccctggttcctgatgcccatcctggtggagaagttcccctttgtgaggaagtctgagaggaccctggagtgctacgtgcacaacctgctgcgcatctctgtgtacttccccaccctgcggcatgagatcctggagctgatcatcgagaagctgctgaagctggatgtgaatgccagccggcagggcattgaagatgctgaggagacagccacccagacctgtggcggcacagacagcacagagggcctcttcaacatggatgaagatgaggagacagagcacgagaccaaggccggccctgagcggctggaccagatggtgcaccctgtggccgagcggctggacatcctgatgagcctggtgctgagctacatgaaggatgtgtgctacgtggatggcaaggtggacaatggcaagaccaaggacctgtacagagacctgatcaacatctttgacaagctgctgctgcccacccacgccagctgccacgtgcagttcttcatgttctacctgtgcagcttcaagctgggctttgctgaggccttcctggagcacctgtggaagaagctgcaggaccccagcaacccagccatcatccggcaggccgccggcaactacatcggcagcttcctggcccgggccaagttcatccccctcatcaccgtgaagagctgcctggacctgctggtgaactggctgcacatctacctgaacaaccaggacagcggcaccaaggccttctgtgatgtggccctgcacggccccttctacagcgcctgccaggccgtgttctacacctttgtgttccgccacaagcagctgctgagcggcaacctgaaggagggcctgcagtacctgcagagcctgaactttgagcgcatcgtgatgagccagctgaaccccctgaagatctgcctgcccagcgtggtgaacttctttgctgccatcaccaacaagtaccagctggtgttctgctacaccatcattgaaagaaacaaccggcagatgctgcccgtcatccgcagcacagctggaggagacagcgtgcagatctgcaccaaccccctggacaccttcttcccctttgacccctgtgtgctgaagaggagcaagaagttcatcgaccccatctaccaggtgtgggaggacatgtctgctgaggagctgcaggagttcaagaagcccatgaagaaggacatcgtggaggatgaagatgatgacttcctgaagggggaggtgccccagaatgacaccgtcatcggcatcacccccagcagctttgacacccacttccgcagccccagcagctctgtgggcagcccccctgtgctgtacatgcagcccagccccctgtag

SEQ ID NO: 168676 - DNA, 1410 bp, Artificial Sequence
  Description of Artificial Sequence: Synthetic coding sequence
atgattgccagccactttgtgccccccagggtcatcatcaaggagggagatgtggatgtgtctgacagtgatgatgaagatgacaacctgcctgccaactttgacacctgccaccgggccctgcagatcatcgcccgctacgtgcccagcaccccctggttcctgatgcccatcctggtggagaagttcccctttgtgaggaagtctgagaggaccctggtgaatgccagccggcagggcattgaagatgctgaggagacagccacccagacctgtggcggcacagacagcacagagggcctcttcaacatggatgaagatgaggagacagagcacgagaccaaggccggccctgagcggctggaccagatggtgcaccctgtggccgagcggctggacatcctgatgagcctggtgctgagctacatgaaggatgtgtgctacgtggatggcaaggtggacaatggcaagaccaaggacctgtacagagacctgatcaacatctttgacaagctgctgctgcccacccacgccagctgccacgtgcagttcttcatgttctacctgtgcagcttcaagctgggctttgctgaggccttcctggagcacctgtggaagaagctgcaggaccccagcaacccagccatcatccggcaggccgccggcaactacatcggcagcttcctggcccgggccaagttcatccccctcatcaccgtgaagagctgcctggacctgctggtgaactggctgcacatctacctgaacaaccaggacagcggcaccaaggccttctgtgatgtggccctgcacggccccttctacagcgcctgccaggccgtgttctacacctttgtgttccgccacaagcagctgctgagcggcaacctgaaggagggcctgcagtacctgcagagcctgaactttgagcgcatcgtgatgagccagctgaaccccctgaagatctgcctgcccagcgtggtgaacttctttgctgccatcaccaacaagtaccagctggtgttctgctacaccatcattgaaagaaacaaccggcagatgctgcccgtcatccgcagcacagctggaggagacagcgtgcagatctgcaccaaccccctggacaccttcttcccctttgacccctgtgtgctgaagaggagcaagaagttcatcgaccccatctaccaggtgtgggaggacatgtctgctgaggagctgcaggagttcaagaagcccatgaagaaggacatcgtggaggatgaagatgatgacttcctgaagggggaggtgccccagaatgacaccgtcatcggcatcacccccagcagctttgacacccacttccgcagccccagcagctctgtgggcagcccccctgtgctgtacatgcagcccagccccctgtag

SEQ ID NO: 168677 - DNA, 792 bp, Artificial Sequence
  Description of Artificial Sequence: Synthetic coding sequence
atgaggctgggcctgtgtgtggtggccctggtgctgtcctggacccacctgaccatcagcagccggggcatcaagggcaagaggcagaggcgcatctctgctgagggcagccaggcctgtgccaagggctgtgagctgtgcagcgaggtgaatggctgcctgaagtgcagccccaagctgttcatcctgctggagagaaatgacatccggcaggtgggcgtgtgcctgcccagctgccccccaggctactttgatgccagaaatccagacatgaacaagtgcatcaagtgcaagattgagcactgtgaggcctgcttcagccacaacttctgcaccaagtgcaaggagggcctgtacctgcacaagggccgctgctacccagcctgcccagagggcagcagcgctgccaacggcaccatggagtgcagcagccctgcccagtgtgagatgtctgagtggagcccctggggcccctgcagcaagaagcagcagctgtgtggcttcagaagaggcagcgaggagaggaccaggagagtgctgcacgcccctgtgggggaccacgccgcctgcagcgacaccaaggagacccggcgctgcaccgtgcggcgggtgccctgcccagagggccagaagaggaggaagggcggccagggcagaagagaaaatgccaacagaaacctggccaggaaggagagcaaggaggccggggccggcagcagaagaaggaagggccagcagcagcagcagcagcagggcaccgtgggccccctgaccagcgctggccctgcctag

SEQ ID NO: 168678 - DNA, 792 bp, Artificial Sequence; identical to SEQ ID NO: 168677
  Description of Artificial Sequence: Synthetic coding sequence

SEQ ID NO: 168679 - DNA, 792 bp, Artificial Sequence; identical to SEQ ID NO: 168677
  Description of Artificial Sequence: Synthetic coding sequence

SEQ ID NO: 168680 - DNA, 603 bp, Artificial Sequence
  Description of Artificial Sequence: Synthetic coding sequence
atgaggctgggcctgtgtgtggtggccctggtgctgtcctggacccacctgaccatcagcagccggggcatcaagggcaagaggcagaggcgcatctctgctgagggcagccaggcctgtgccaagggctgtgagctgtgcagcgaggtgaatggctgcctgaagtgcagccccaagctgttcatcctgctggagagaaatgacatccggcaggtgggcgtgtgcctgcccagctgccccccaggctactttgatgccagaaatccagacatgaacaagtgcatcaagtgcaagattgagcactgtgaggcctgcttcagccacaacttctgcaccaagtgcaaggagggcctgtacctgcacaagggccgctgctacccagcctgcccagagggcagcagcgctgccaacggcaccatggagtgcagcagccctggccagaagagaagaaaaggaggccagggccggcgggagaatgccaacagaaacctggccaggaaggagagcaaggaggccggggccggcagcagaagaaggaagggccagcagcagcagcagcagcagggcaccgtgggccccctgaccagcgctggccctgcctag

SEQ ID NO: 168681 - DNA, 711 bp, Artificial Sequence
  Description of Artificial Sequence: Synthetic coding sequence
atgatcttccgggtgtctgctgagggcagccaggcctgtgccaagggctgtgagctgtgcagcgaggtgaatggctgcctgaagtgcagccccaagctgttcatcctgctggagagaaatgacatccggcaggtgggcgtgtgcctgcccagctgccccccaggctactttgatgccaggaacccagacatgaacaagtgcatcaagtgcaagattgagcactgtgaggcctgcttcagccacaacttctgcaccaagtgcaaggagggcctgtacctgcacaagggccgctgctacccagcctgcccagagggcagcagcgctgccaacggcaccatggagtgcagcagccctgcccagtgtgagatgtctgagtggagcccctggggcccctgcagcaagaagcagcagctgtgtggcttccggcggggcagcgaggagaggacccggcgggtgctgcacgcccctgtgggggaccatgctgcctgcagcgacaccaaggagacccggcgctgcaccgtgagaagagtgccctgcccagagggccagaagagaagaaaaggaggccagggccggcgggagaatgccaacagaaacctggccaggaaggagagcaaggaggccggggccggcagcagaagaaggaagggccagcagcagcagcagcagcagggcaccgtgggccccctgaccagcgctggccctgcctag

SEQ ID NO: 168682 - DNA, 732 bp, Artificial Sequence
  Description of Artificial Sequence: Synthetic coding sequence
atgcagttccgcctcttctcctttgccctgatcatcctgaactgcatggactacagccactgccagggcaaccgctggaggaggagcaagagggccagctatgtgagcaaccccatctgcaagggctgcctgagctgcagcaaggacaatggctgcagccgctgccagcagaagctgttcttcttcctgcggcgggagggcatgaggcagtatggagaatgtctgcacagctgccccagcggctactacggccaccgggccccagacatgaacagatgtgcccgctgcagaattgagaactgtgacagctgcttcagcaaggacttctgcaccaagtgcaaggtgggcttctacctgcaccggggccgctgctttgatgaatgtccagatggctttgcccccctggaggagaccatggagtgtgtggagggctgtgaggtgggccactggagcgagtggggcacctgcagcaggaacaacagaacctgtggcttcaagtggggcctggagaccaggacccggcagatcgtgaagaagcctgtgaaggacaccatcctgtgccccaccatcgccgagagccgccgctgcaagatgaccatgaggcactgccctgggggcaagaggacccccaaggccaaggagaagaggaacaagaagaagaagaggaagctgattgagcgggcccaggagcagcacagcgtcttcctggccacagaccgggccaaccagtag

SEQ ID NO: 168683 - DNA, 540 bp, Artificial Sequence
  Description of Artificial Sequence: Synthetic coding sequence
atgcagttccgcctcttctcctttgccctgatcatcctgaactgcatggactacagccactgccagggcaaccgctggaggaggagcaagaggggctgcagaattgagaactgtgacagctgcttcagcaaggacttctgcaccaagtgcaaggtgggcttctacctgcaccggggccgctgctttgatgagtgcccagatggctttgcccccctggaggagaccatggagtgtgtgggctgtgaggtgggccactggagcgagtggggcacctgcagcaggaacaacagaacctgtggcttcaagtggggcctggagaccaggacccggcagatcgtgaagaagcctgtgaaggacaccatcctgtgccccaccatcgccgagagccgccgctgcaagatgaccatgaggcactgccctgggggcaagaggacccccaaggccaaggagaagaggaacaagaagaagaagaggaagctgattgagcgggcccaggagcagcacagcgtcttcctggccacagaccgggccaaccagtag

SEQ ID NO: 168684 - DNA, 540 bp, Artificial Sequence; identical to SEQ ID NO: 168683
  Description of Artificial Sequence: Synthetic coding sequence

SEQ ID NO: 168685 - DNA, 531 bp, Artificial Sequence
  Description of Artificial Sequence: Synthetic coding sequence
atgaggcagtacggggagtgcctgcacagctgccccagcggctactacggccaccgggccccagacatgaacagatgtgcccgctgcagaattgagaactgtgacagctgcttcagcaaggacttctgcaccaagtgcaaggtgggcttctacctgcaccggggccgctgctttgatgagtgcccagatggctttgcccccctggaggagaccatggagtgtgtggagggctgtgaggtgggccactggagcgagtggggcacctgcagcaggaacaacagaacctgtggcttcaagtggggcctggagaccaggacccggcagatcgtgaagaagcctgtgaaggacaccatcctgtgccccaccatcgccgagagccgccgctgcaagatgaccatgaggcactgccctgggggcaagaggacccccaaggccaaggagaagaggaacaagaagaagaagaggaagctgattgaaagagcccaggagcagcacagcgtcttcctggccacagaccgggccaaccagtag

SEQ ID NO: 168686 - DNA, 507 bp, Artificial Sequence
  Description of Artificial Sequence: Synthetic coding sequence
atgaggcagtacggggagtgcctgcacagctgccccagcggctactacggccaccgggccccagacatgaacagatgtgcccgctgcagaattgagaactgtgacagctgcttcagcaaggacttctgcaccaagtgcaaggtgggcttctacctgcaccggggccgctgctttgatgagtgcccagatggctttgcccccctggaggagaccatggagtgtgtggagggctgtgaggtgggccactggagcgagtggggcacctgcagcaggaacaacagaacctgtggcttcaagtggggcctggagaccaggacccggcagatcgtgaagaagcctgtgaaggacaccatcctgtgccccaccatcgccgagagccgccgctgcaagatgaccatgaggcactgccctgggggcaagaggacccccaaggccaaggagaagaggaacaagaagaagaagaggaagctgattgaaagagcccaggagcagcacagcgtcttctag

SEQ ID NO: 168687 - DNA, 270 bp, Artificial Sequence
  Description of Artificial Sequence: Synthetic coding sequence
atgaggcagtacggggagtgcctgcacagctgccccagcggctactacggccaccgggccccagacatgaacagatgtgcccgctgcagaattgagaactgtgacagctgcttcagcaaggacttctgcaccaagtgcaaggtgggcttctacctgcaccggggccgctgctttgatgagtgcccagatggctttgcccccctggaggagaccatggagtgtgtggagggctgtgaggtgggccactggagcgagtggggcacctgctag

SEQ ID NO: 168688 - DNA, 366 bp, Artificial Sequence
  Description of Artificial Sequence: Synthetic coding sequence
atgcagttccgcctcttctcctttgccctgatcatcctgaactgcatggactacagccactgccagggcaaccgctggaggaggagcaagagggccagctatgtgagcaaccccatctgcaagggctgcctgagctgcagcaaggacaatggctgcagccgctgccagcagaagctgttcttcttcctgcggcgggagggcatgaggcagtatggagaatgtctgcacagctgccccagcggctactacggccaccgggccccagacatgaacagatgtgcccgctgcagaattgagaactgtgacagctgcttcagcaaggacttctgcaccaagtgcaaggtgggcttctacctgcacaggtag

SEQ ID NO: 168689 - DNA, 234 bp, Artificial Sequence
  Description of Artificial Sequence: Synthetic coding sequence
atgcagttccgcctcttctcctttgccctgatcatcctgaactgcatggactacagccactgccagggcaaccgctggaggaggagcaagagggccagctatgtgagcaaccccatctgcaagggctgcctgagctgcagcaaggacaatggctgcagccgctgccagcagaagctgttcttcttcctgcggcgggagggcatgaggcagtatggagaatgtctgcacagctag

SEQ ID NO: 168690 - DNA, 1410 bp, Artificial Sequence
  Description of Artificial Sequence: Synthetic coding sequence
atggccttcctgatgcacctgctggtgtgtgtgtttggcatgggctcctgggtgaccatcaatggcctgtgggtggagctgcccctgctggtgatggagctgcctgagggctggtacctgcccagctacctgactgtggtgatccagctggccaacatcggccccctgctggtgaccctgctgcaccacttccggcccagctgcctgtctgaggtgcccatcatcttcaccctgctgggcgtgggcaccgtgacctgcatcatctttgccttcctgtggaacatgacctcctgggtgctggatggccaccacagcatcgccttcctggtgctgaccttcttcctggccctggtggactgcaccagctctgtgaccttcctgcccttcatgagccggctgcccacctactacctgaccaccttctttgtgggggagggcctgagcggcctgctgcctgccctggtggccctggcccagggcagcggcctgaccacctgtgtgaatgtgacagagatcagtgacagcgtgcccagccctgtgcccacccgggagacagacatcgcccagggcgtgccccgggccctggtgtctgccctgcccggcatggaggcccccctgagccacctggagagccgctacctgcctgcccacttcagccccctggtgttcttcctgctgctgagcatcatgatggcctgctgcctggtggccttctttgtgctgcagaggcagccccgctgctgggaggcctctgtggaggacctgctgaatgaccaggtgaccctgcacagcatccggccccgggaggagaatgacctgggccctgctggcaccgtggacagcagccagggccagggctacctggaggagaaggccgccccctgctgcccagcccacctggccttcatctacaccctggtggcctttgtgaatgccctgaccaacggcatgctgcccagcgtgcagacctacagctgcctgtcctatggccctgtggcctaccacctggccgccaccctgagcatcgtggccaaccccctggccagcctggtgtccatgttcctgcccaacagaagcctgctcttcctgggcgtgctgtctgtgctgggcacctgctttggaggctacaacatggccatggctgtgatgagcccctgccccctgctgcagggccactggggcggggaggtgctgattgtggcctcctgggtgctcttcagcggctgcctgtcctatgtgaaggtgatgctgggcgtggtgctgcgggacctgagccgcagcgccctgctgtggtgtggggctgctgtgcagctgggcagcctgctgggcgccctgctgatgttccccctggtgaatgtgctgcggctcttcagcagcgctgacttctgcaacctgcactgcccagcctag

SEQ ID NO: 168691 - DNA, 519 bp, Artificial Sequence
  Description of Artificial Sequence: Synthetic coding sequence
atgagggcccccctgtgcctgctgctgctggtggcccatgctgtggacatgctggccctgaacagaaggaagaagcaggtgggcaccggcctgggcggcaactgcaccggctgcatcatctgcagcgaggagaatggctgcagcacctgccagcagaggctcttcctgttcatcagaagagagggcatccggcagtatggcaagtgcctgcatgactgccccccaggctacttcggcatccggggccaggaggtgaaccgctgcaagaagtgtggggccacctgtgagagctgcttcagccaggacttctgcatccgctgcaagaggcagttctacctgtacaagggcaagtgcctgcccacctgccccccaggcaccctggcccaccagaacacccgggagtgccaggagaggagccctggccagaagaagggcaggaaggacagaagacccaggaaggacaggaagctggaccggcggctggatgtgcggccccggcagcccggcctgcagccctag

SEQ ID NO: 168692 - DNA, 2133 bp, Artificial Sequence
  Description of Artificial Sequence: Synthetic coding sequence
atgaggggccgcctgtgtgtgggccgggctgctgctgctgctgctgctgtggccgtgcccctggccggcggccaggagggcagccctgggggcggcagaagaggcagccggggcaccaccatggtgaagaagaggaagggccgggtggtgattgacagcgacacagaggacagcggcagtgatgagaacctggaccaggagctgctgagcctggccaagaggaagagaagtgacagcgaggagaaggagccccctgtgtcccagcctgctgccagcagtgacagcgagaccagtgacagtgatgatgagtggaccttcggcagcaacaagaacaagaagaagggcaaggccaggaagattgagaagaagggcaccatgaagaagcaggccaacaagacagccagcagcggcagcagtgacaaggacagcagcgctgagagcagcgcccctgaggagggggaggtgtctgacagcgacagcaacagcagcagcagcagcagtgacagcgacagcagcagtgaagatgaggagttccatgatggctacggggaggacctgatgggagatgaagaagatcgggcccggctggagcagatgacagagaaggagcgggagcaggagctgttcaaccgcatcgagaagcgggaggtgctgaagagaagatttgagatcaagaagaagctgaagacagccaagaagaaggagaagaaggagaagaagaagaagcaggaggaggagcaggagaagaagaagctgacccagatccaggagagccaggtgaccagccacaacaaggagaggaggagcaagagagatgagaagctggacaagaagagccaggccatggaggagctgaaggccgagcgggagaagaggaagaacagaacagctgagctgctggccaagaagcagcccctgaagaccagcgaggtgtacagtgatgatgaggaggaggaggaggatgacaagagcagcgagaagagtgacaggagcagcaggaccagcagcagtgatgaggaggaggagaaggaggagatcccccccaagagccagcctgtgtccctgcctgaggagctgaacagagtgcggctgagccgccacaagctggagcgctggtgccacatgcccttctttgccaagacagtgacaggctgctttgtgagaattggaattggcaaccacaacagcaagcctgtgtacagagtggccgagatcaccggggtggtggagacagccaaggtgtaccagctgggcggcaccaggaccaacaagggcctgcagctgcggcacggcaatgaccagagggtcttccggctggagtttgtgagcaaccaggagttcacagagagcgagttcatgaagtggaaggaggccatgttttctgctggcatgcagctgcccaccctggatgagatcaacaagaaggagctgagcatcaaggaggccctgaactacaagttcaatgaccaggacatcgaggagatcgtgaaggagaaggagcgcttcaggaaggccccacccaactatgccatgaagaagacccagctgctgaaggagaaggccatggccgaggacctgggggaccaggacaaggccaagcagatccaggaccagctgaatgagctggaggagcgggcagaggccctggaccggcagaggaccaagaacatcagcgccatctcctacatcaaccagaggaaccgggagtggaacatcgtggagagcgagaaggccctggtggccgagagccacaacatgaagaaccagcagatggaccccttcacccggcggcagtgcaagcccaccatcgtgagcaacagccgggaccctgctgtgcaggccgccatcctggcccagctgaatgccaagtatggcagcggcgtgctgcctgatgcccccaaggagatgagcaagggccagggcaaggacaaggacctgaacagcaagagcgccagtgacctgtctgaggacctcttcaaggtgcatgactttgatgtgaagattgacctgcaggtgcccagcagcgagagcaaggccctggccatcaccagcaaggcccccccagccaaggatggagcccccaggaggagcctgaacctggaggactacaagaagaggcggggcctcatctag

SEQ ID NO: 168693 - DNA, 4551 bp, Artificial Sequence
  Description of Artificial Sequence: Synthetic coding sequence
atggacagcccccccaagctgaccggggagaccctgattgtgcaccacatccccctggtgcactgccaggtgcctgaccggcagtgctgcggcggggccggcggcggcggcggcagcacccggcccaaccccttctgccccccagagctgggcatcacccagcctgaccaggacctgggccaggccgacagcctgctcttcagcagcctgcacagcacccctgggggcacagcccggagcattgacagcaccaagagccgcagcagagatggccggggccctggggcccccaagaggcacaaccccttcctgctgcaggagggcgtgggggagcccggcctgggggacctgtatgatgacagcatcggggacagcgccacccagcagagcttccacctgcacggcaccggccagcccaacttccacctgagcagcttccagctgcccccatctggcccccgggtgggccggccctggggcaccaccaggagccgggccggcgtggtggagggccaggagcaggagcctgtgatgaccctggacacccagcagtgtggcaccagccactgctgcaggcctgagctggaggccgagaccatggagctggatgaatgtggcggccctgggggcagcggcagcggcggcggggccagtgacaccagcggcttctcctttgaccaggagtggaagctgagcagtgatgagagccccaggaaccctggctgcagcggcagcggggaccagcactgccgctgcagcagcaccagcagccagagcgaggccgctgaccagagcatgggctacgtgtctgacagcagctgcaacagcagtgatggagtgctggtgaccttcagcaccctgtacaacaagatgcacggcaccccccgggccaacctgaacagcgccccccagagctgcagcgacagcagcttctgcagccacagcgaccccggggccttctacctggacctgcagcccagcccctttgagagcaagatgtcctatgagagccaccaccctgagagcggcggccgggagggcggctacggctgcccccacgccagcagccctgagctggatgccaactgcaacagctaccggccccactgtgagccctgcccagctgtggccgacctgacagcctgcttccagagccaggcccggctggtggtggccacccagaactactacaagctggtgacctgtgacctgagcagccagagcagccccagccctgctggcagcagcatcaccagctgcagcgaggagcacaccaagatcagccccccacctggccctggccctgaccccggccccagccagcccagcgagtactacctgttccagaagccagaggtgcagcctgaggagcaggaggccgtgagcagcagcacccaggccgctgctgctgtgggccccaccgtgctggagggccaggtgtacaccaacaccagcccccccaacctgagcacaggccggcagaggagccgctcctatgacaggagcctgcagaggagcccccctgtgcggctgggcagcctggagaggatgctgagctgccctgtgcggctgtctgagggccctgctgccatggccggccctggcagccccccaagaagagtgaccagctttgctgagctggccaagggcaggaagaagacaggaggcagcggcagcccccccctgcgggtgtctgtgggggacagcagccaggagttcagccccatccaggaggcccagcaggacagaggagcccccctggatgagggcacctgctgcagccacagcctgccccccatgcccctgggccctggcatggacctgctgggccctgaccccagccccccctggagcacccaggtgtgccagggcccccacagcagcgagatgcctcctgctggcctgcgggccaccggccagggccccctggcccagctgatggaccccggccctgccctgcccggcagccctgccaacagccacacccagagagatgcccgggcccgggcagatggcggcggcacagagagcaggcctgtgctgcgctacagcaaggagcagaggcccaccaccctgcccatccagccctttgtgttccagcaccacttccccaagcagctggccaaggcccgggccctgcacagcctgagccagctgtacagcctgagcggctgcagcaggacccagcagcctgcccccctggccgccccagctgcccaggtgtctgtgcctgcccccagcggggagccccaggccagcaccccccgggccaccggccgcggggccaggaaggccggcagcgagcctgagaccagccggcccagccccctgggcagctacagccccatccgctctgtgggccccttcggccccagcacagacagcagcgccagcaccagctgcagccccccacctgagcagcccacagccacagagagcctgcccccctggagccacagctgccccagcgctgtgcggcctgccaccagccagcagccccagaaggaggaccagaagatcctgaccctgacagagtaccgcctgcatggaacaggcagcctgccccccctgggctcctggaggagcggcctgagcagagctgagagcctggcccggggcggcggggagggctccatggccacccggcccagcaatgccaaccacctgagcccccaggccctgaagtggagggagtacagaaggaagaaccccctgggccccccaggcctgagcggcagcctggaccggcgcagccaggaggcccggctggcccggaggaaccccatctttgagttccctggcagcctgtctgctgccagccacctgaactgccgcctgaatggccaggccgtgaagcccctgcccctgacctgcccagacttccaggaccccttcagcctgacagagaagcccccagctgagttctgcctgagcccagatggcagcagcgaggccatcagcattgacctgctgcagaagaagggcctggtgaaggctgtgaacattgctgtggacctgattgtggcccacttcggcaccagccgggaccccggggtgaaggccaagctgggcaacagctctgtgagccccaacgtgggccacctggtgctgaagtacctgtgcccagctgtgcgggctgtgctggaggatggcctgaaggcctttgtgctggatgtgatcatcggccagaggaagaacatgccctggagcgtggtggaggccagcacccagctgggccccagcaccaaggtgctgcacggcctgtacaacaaggtgtcccagtttcctgagctgaccagccacaccatgaggttcaatgccttcatcctgggcctgctgaacatccgcagcctggagttctggttcaaccacctgtacaaccacgaggacatcatccagacccactaccagccctggggcttcctgtctgctgcccacacagtgtgccccggcctgtttgaggagctgctgctgctgctgcagcccctggccctgctgcccttcagcctggacctgctcttccagcaccggctgctgcagagcggccagcagcagaggcagcacaaggagctgctgcgggtgtcccaggacctgctgctgagcgcccacagcaccctgcagctggcccgggcccggggccaggagggccctggagatgtggacagagctgcccagggcgagcgggtgaagggcgtgggcgccagcgagggcggggaggaggaggaggaggaggaggagacagaggaggtggccgaggccgccggcggcagcggccgggcccgctgggcccggggcggccaggccggctggtggtaccagctgatgcagagcagccaggtgtacattgatggcagcattgagggcagccgcttcccccggggcagcagcaacagcagcagcgagaagaagaagggggccggcggcggcggccccccccaggcccccccaccccgggagggcgtggtggagggcgctgaggcctgcccagccagcgaggaggccctgggccgggagcggggctggcccttctggatgggcagccccccagattctgtgctggccgagctgcggcgcagccgggagcgggagggccctgctgccagccctgcagaaaatgaggagggcgccagcgagcccagccctgggggcatcaagtggggccacctgtttggcagcaggaaggcccagcgggaggcccggcccaccaaccggctgcccagcgactggctgagcctggacaagtccatgttccagctggtggcccagacagtgggcagcagaagagagcctgagcccaaggagagcctgcaggagccccacagccctgccctgcccagcagccccccctgtgaggtgcaggccctgtgccaccacctggccactggacctggccagctgtccttccacaagggggacatcctgcgggtgctgggccgggccggcggggactggctgcgctgcagccggggcccagattctggcctggtgcccctggcctacgtgaccctgacccccacccccagccccaccccaggcagcagccagaactag

SEQ ID NO: 168694 - DNA, 4551 bp, Artificial Sequence; identical to SEQ ID NO: 168693
  Description of Artificial Sequence: Synthetic coding sequence

SEQ ID NO: 168695 - DNA, 2775 bp, Artificial Sequence
  Description of Artificial Sequence: Synthetic coding sequence
atggacagcccccccaagctgaccggggagaccctgattgtgcaccacatccccctggtgcactgccaggtgcctgaccggcagtgctgcggcggggccggcggcggcggcggcagcacccggcccaaccccttctgccccccagagctgggcatcacccagcctgaccaggacctgggccaggccgacagcctgctcttcagcagcctgcacagcacccctgggggcacagcccggagcattgacagcaccaagagccgcagcagagatggccggggccctggggcccccaagaggcacaaccccttcctgctgcaggagggcgtgggggagcccggcctgggggacctgtatgatgacagcatcggggacagcgccacccagcagagcttccacctgcacggcaccggccagcccaacttccacctgagcagcttccagctgcccccatctggcccccgggtgggccggccctggggcaccaccaggagccgggccggcgtggtggagggccaggagcaggagcctgtgatgaccctggacacccagcagtgtggcaccagccactgctgcaggcctgagctggaggccgagaccatggagctggatgaatgtggcggccctgggggcagcggcagcggcggcggggccagtgacaccagcggcttctcctttgaccaggagtggaagctgagcagtgatgagagccccaggaaccctggctgcagcggcagcggggaccagcactgccgctgcagcagcaccagcagccagagcgaggccgctgaccagagcatgggctacgtgtctgacagcagctgcaacagcagtgatggagtgctggtgaccttcagcaccctgtacaacaagatgcacggcaccccccgggccaacctgaacagcgccccccagagctgcagcgacagcagcttctgcagccacagcgaccccggggccttctacctggacctgcagcccagcccctttgagagcaagatgtcctatgagagccaccaccctgagagcggcggccgggagggcggctacggctgcccccacgccagcagccctgagctggatgccaactgcaacagctaccggccccactgtgagccctgcccagctgtggccgacctgacagcctgcttccagagccaggcccggctggtggtggccacccagaactactacaagctggtgacctgtgacctgagcagccagagcagccccagccctgctggcagcagcatcaccagctgcagcgaggagcacaccaagatcagccccccacctggccctggccctgaccccggccccagccagcccagcgagtactacctgttccagaagccagaggtgcagcctgaggagcaggaggccgtgagcagcagcacccaggccgctgctgctgtgggccccaccgtgctggagggccaggtgtacaccaacaccagcccccccaacctgagcacaggccggcagaggagccgctcctatgacaggagcctgcagaggagcccccctgtgcggctgggcagcctggagaggatgctgagctgccctgtgcggctgtctgagggccctgctgccatggccggccctggcagccccccaagaagagtgaccagctttgctgagctggccaagggcaggaagaagacaggaggcagcggcagcccccccctgcgggtgtctgtgggggacagcagccaggagttcagccccatccaggaggcccagcaggacagaggagcccccctggatgagggcacctgctgcagccacagcctgccccccatgcccctgggccctggcatggacctgctgggccctgaccccagccccccctggagcacccaggtgtgccagggcccccacagcagcgagatgcctcctgctggcctgcgggccaccggccagggccccctggcccagctgatggaccccggccctgccctgcccggcagccctgccaacagccacacccagagagatgcccgggcccgggcagatggcggcggcacagagagcaggcctgtgctgcgctacagcaaggagcagaggcccaccaccctgcccatccagccctttgtgttccagcaccacttccccaagcagctggccaaggcccgggccctgcacagcctgagccagctgtacagcctgagcggctgcagcaggacccagcagcctgcccccctggccgccccagctgcccaggtgtctgtgcctgcccccagcggggagccccaggccagcaccccccgggccaccggccgcggggccaggaaggccggcagcgagcctgagaccagccggcccagccccctgggcagctacagccccatccgctctgtgggccccttcggccccagcacagacagcagcgccagcaccagctgcagccccccacctgagcagcccacagccacagagagcctgcccccctggagccacagctgccccagcgctgtgcggcctgccaccagccagcagccccagaaggaggaccagaagatcctgaccctgacagagtaccgcctgcatggaacaggcagcctgccccccctgggctcctggaggagcggcctgagcagagctgagagcctggcccggggcggcggggagggctccatggccacccggcccagcaatgccaaccacctgagcccccaggccctgaagtggagggagtacagaaggaagaaccccctgggccccccaggcctgagcggcagcctggaccggcgcagccaggaggccaggactggatag

SEQ ID NO: 168696 - DNA, 591 bp, Artificial Sequence
  Description of Artificial Sequence: Synthetic coding sequence
atgtccatgctgcggctgcagaagaggctggccagctctgtgctgcgctgtgggaagaagaaggtgtggctggaccccaatgagaccaatgagatcgccaatgccaacagccggcagcagatcaggaagctgatcaaggatggcctcatcatcaggaagcctgtgacagtgcacagccgggcccgctgcaggaagaacaccctggcccggaggaagggccgccacatgggcatcggcaagaggaagggcacagccaatgccaggatgcctgagaaggtgacctggatgaggaggatgaggatcctgcggcggctgctgcggcgctaccgggagagcaagaagattgacagacacatgtaccacagcctgtacctgaaggtgaagggaaatgtgttcaagaacaagaggatcctgatggagcacatccacaagctgaaggctgacaaggccaggaagaagctgctggccgaccaggccgaggcccggcgcagcaagaccaaggaggccaggaagaggcgggaggagcggctgcaggccaagaaggaggagatcatcaagaccctgagcaaggaggaggagaccaagaagtag

SEQ ID NO: 168697 - DNA, 1341 bp, Artificial Sequence
  Description of Artificial Sequence: Synthetic coding sequence
atggaggccagctttgtgcagaccaccatggccctgggcctgagcagcaagaaggccagcagcagaaatgtggccgtggagaggaagaacctgatcaccgtgtgccgcttctctgtgaagaccctgctggagaagtacacagctgagcccattgatgacagcagcgaggagtttgtgaactttgctgccatcctggagcagatcctgagccaccgcttcaaggcctgtgccccagctggccctgtgtcctggttcagcagtgatggccagaggggcttctgggactacatccggctggcctgcagcaaggtgcccaacaactgtgtgagcagcattgagaacatggagaacatcagcacagcccgggccaagggccgggcctggatccgggtggccctgatggagaagaggatgtctgagtacatcaccacagccctgcgggacaccaggaccacccggcgcttctatgacagcggggccatcatgctgagagatgaggccaccatcctgaccggcatgctgattggcctgagcgccatcgacttctccttctgcctgaagggggaggtgctggatggcaagacccctgtggtgattgactacaccccctacctgaagttcacccagagctatgactacctgacagatgaggaggagcggcacagcgctgagagcagcaccagcgaggacaacagccctgagcacccctacctgcccctggtgacagatgaggacagctggtacagcaagtggcacaagatggagcagaagttccgcatcgtgtatgcccagaagggctacctggaggagctggtgcggctgcgggagagccagctgaaggacctggaggctgaaaatagaaggctgcagctgcagctggaggaggccgccgcccagaaccagcgggagaagcgggagctggagggcgtcatcctggagctgcaggagcagctgaccggcctcatccccagcgaccacgcccccctggcccagggcagcaaggagctgaccacccccctggtgaaccagtggcccagcctgggcaccctgaatggagctgagggcgccagcaacagcaagctgtacagaagacacagcttcatgagcacagagcccctgtctgctgaggccagcctgagcagtgacagccagaggctgggggagggcaccagagatgaggagccctggggccccatcggcaaggaccccacccccagcatgctgggcctgtgtggcagcctggccagcatccccagctgcaagagcctggccagcttcaagagcaatgaatgtctggtgtctgacagccctgagggcagccctgccctgagccccagctag

SEQ ID NO: 168698 - DNA, 1371 bp, Artificial Sequence
  Description of Artificial Sequence: Synthetic coding sequence
atgaagattgaggaggtgaagagcaccaccaagacccagagaattgccagccacagccacgtgaagggcctgggcctggatgaaagtggcctggccaagcaggccgccagcggcctggtgggccaggagaatgcccgggaggcctgtggggtcatcgtggagctgatcaagagcaagaagatggccggccgggctgtgctgctggccggccccccaggcaccgggaagacagccctggccctggccatcgcccaggagctgggcagcaaggtgcccttctgccccatggtgggcagcgaggtgtacagcacagagatcaagaagacagaggtgctgatggagaacttcagaagagccatcggcctgcgcatcaaggagaccaaggaggtgtatgaaggagaggtgacagagctgaccccctgtgaaacagagaaccccatgggcggctacggcaagaccatcagccacgtgatcatcggcctgaagacagccaagggcaccaagcagctgaagctggaccccagcatctttgagagcctgcagaaggagcgggtggaggccggagatgtgatctacatcgaggccaacagcggggctgtgaagaggcagggccgctgtgacacctacgccacagaatttgacctggaggccgaggagtatgtgcccctgcccaagggagatgtgcacaagaagaaggagatcatccaggatgtgaccctgcatgacctggatgtggccaatgcccggccccagggcggccaggacatcctgtccatgatgggccagctgatgaagcccaagaagacagagatcacagacaagctgcggggggagatcaacaaggtggtgaacaagtacatcgaccagggcattgctgagctggtgcctggggtgctgtttgtggatgaggtgcacatgctggacatcgagtgcttcacctacctgcaccgggccctggagagcagcatcgcccccatcgtcatctttgccagcaacagaggcaactgtgtgatccggggcacagaggacatcaccagcccccacggcatccccctggacctgctggacagagtgatgatcatccgcaccatgctgtacaccccccaggagatgaagcagatcatcaagatccgggcccagacagagggcatcaacatcagcgaggaggccctgaaccacctgggggagatcggcaccaagaccaccctgcgctacagcgtgcagctgctgaccccagccaacctgctggccaagatcaacgggaaggacagcattgagaaggagcacgtggaggagatcagcgagctgttctatgatgccaagagcagcgccaagatcctggccgaccagcaggacaagtacatgaagtag

SEQ ID NO: 168699 - DNA, 1161 bp, Artificial Sequence
  Description of Artificial Sequence: Synthetic coding sequence
atgaagattgaggaggtgaagagcaccaccaagacccagagaattgccagccacagccacgtgaagggcctgggcctggatgaaagtggcctggccaagcaggccgccagcggcctggtgggccaggagaatgcccgggaggcctgtggggtcatcgtggagctgatcaagagcaagaagatggccggccgggctgtgctgctggccggccccccaggcaccgggaagacagccctggccctggccatcgcccaggagctgggcagcaaggtgcccttctgccccatggtgggcagcgaggtgtacagcacagagatcaagaagacagaggtgctgatggagaacttcagaagagccatcggcctgcgcatcaaggagaccaaggaggtgtatgaaggagaggtgacagagctgaccccctgtgaaacagagaaccccatgggcggctacggcaagaccatcagccacgtgatcatcggcctgaagacagccaagggcaccaagcagctgaagctggaccccagcatctttgagagcctgcagaaggagcgggtggaggccggagatgtgatctacatcgaggccaacagcggggctgtgaagaggcagggccgctgtgacacctacgccacagaatttgacctggaggccgaggagtatgtgcccctgcccaagggagatgtgcacaagaagaaggagatcatccaggatgtgaccctgcatgacctggatgtggccaatgcccggccccagggcggccaggacatcctgtccatgatgggccagctgatgaagcccaagaagacagagatcacagacaagctgcggggggagatcaacaaggtggtgaacaagtacatcgaccagggcattgctgagctggtgcctggggtgctgtttgtggatgaggtgcacatgctggacatcgagtgcttcacctacctgcaccgggccctggagagcagcatcgcccccatcgtcatctttgccagcaacagaggcaactgtgtgatccggggcacagaggacatcaccagcccccacggcatccccctggacctgctggacagagtgatgatcatccgcaccatgctgtacaccccccaggagatgaagcaggtgctgtctgctgctgctgaccccggccagctggcctgctag

SEQ ID NO: 168700 - DNA, 2502 bp, Artificial Sequence; identical to SEQ ID NO: 160204
  Description of Artificial Sequence: Synthetic coding sequence

SEQ ID NO: 168701 - DNA, 1257 bp, Artificial Sequence
  Description of Artificial Sequence: Synthetic coding sequence
atggtgggccagctggccgcccggcgggctgctggggtggtgctggagatgatccgggagggcaagattgctggccgggctgtgctgattgctggccagcccggcaccgggaagacagccatcgccatgggcatggcccaggccctgggccctgacacccccttcaccgccatcgccggcagcgagatcttcagcctggagatgagcaagacagaggccctgacccaggccttcagaagaagcattggagtgcgcatcaaggaggagacagagatcattgaaggagaggtggtggagatccagattgacaggcctgccactggaacaggcagcaaggtgggcaagctgaccctgaagaccacagagatggagaccatctatgacctgggcaccaagatgattgagagcctgaccaaggacaaggtgcaggccggagatgtgatcaccatcgacaaggccaccgggaagatcagcaagctgggccgctccttcacccgggcccgggactatgatgccatgggcagccagaccaagtttgtgcagtgcccagatggagagctgcagaagaggaaggaggtggtgcacacagtgtccctgcacgagattgatgtgatcaacagcaggacccagggcttcctggccctcttcagcggggacaccggggagatcaagtctgaggtgcgggagcagatcaatgccaaggtggccgagtggagggaggagggcaaggccgagatcatccctggggtgctcttcattgatgaggtgcacatgctggacatcgagagcttctccttcctgaacagagccctggagagtgacatggcccctgtgctgatcatggccaccaacagaggcatcacccgcatccggggcaccagctaccagagcccccacggcatccccatcgacctgctggaccggctgctgattgtgtccaccaccccctacagcgagaaggacaccaagcagatcctgcgcatccgctgtgaggaggaggatgtggagatgtctgaagatgcctacacagtgctgacccgcatcggcctggagaccagcctgcgctatgccatccagctgatcacagctgccagcctggtgtgcaggaagaggaagggcacagaggtgcaggtggatgacatcaagagggtgtacagcctcttcctggatgagagccgcagcacccagtacatgaaggagtaccaggatgccttcctgttcaatgagctgaagggggagaccatggacaccagctag

SEQ ID NO: 168702 - DNA, 1392 bp, Artificial Sequence; identical to SEQ ID NO: 151237
  Description of Artificial Sequence: Synthetic coding sequence

SEQ ID NO: 168703 - DNA, 15102 bp, Artificial Sequence
  Description of Artificial Sequence: Synthetic coding sequence
atgggagatgctgaaggagaagatgaggtgcagttcctgaggacagatgatgaggtggtgctgcagtgcagcgccaccgtgctgaaggagcagctgaagctgtgcctggccgctgagggctttggaaaccggctgtgcttcctggagcccaccagcaatgcccagaatgtgcccccagacctggccatctgctgctttgtgctggagcagagcctgtctgtgcgggccctgcaggagatgctggccaacacagtggaggccggcgtggagagcagccagggcggcggccacaggaccctgctgtatggccacgccatcctgctgcggcatgcccacagcaggatgtacctgagctgcctgaccaccagccgctccatgacagacaagctggcctttgatgtgggcctgcaggaggatgccactggagaggcctgctggtggaccatgcacccagccagcaagcagaggtctgagggggagaaggtgcgggtgggagatgacatcatcctggtgtctgtgtcctctgagcgctacctgcacctgagcacagccagcggggagctgcaggtggatgccagcttcatgcagaccctgtggaacatgaaccccatctgcagccgctgtgaggagggctttgtgactggaggccacgtgctgcggctcttccacggccacatggatgagtgcctgaccatcagccctgctgacagtgatgaccagaggcggctggtgtactatgagggcggcgctgtgtgcacccacgcccggagcctgtggaggctggagcccctgcgcatctcctggagcggcagccacctgcgctggggccagcccctgcgggtgagacatgtgaccaccggccagtacctggccctgacagaggaccagggcctggtggtggtggatgccagcaaggcccacaccaaggccaccagcttctgcttccgcatcagcaaggagaagctggatgtggcccccaagagagatgtggagggcatgggccccccagagatcaagtacggggagagcctgtgctttgtgcagcacgtggccagcggcctgtggctgacctatgctgccccagaccccaaggccctgcggctgggcgtgctgaagaagaaggccatgctgcaccaggagggccacatggatgatgccctgagcctgacccgctgccagcaggaggagagccaggccgccaggatgatccacagcaccaacggcctgtacaaccagttcatcaagagcctggacagcttcagcggcaagccccggggcagcggccccccagctggaacagccctgcccattgaaggagtcatcctgagcctgcaggacctgatcatctactttgagcccccatctgaggacctgcagcacgaggagaagcagagcaagctgcggagcctgaggaaccggcagagcctcttccaggaggagggcatgctgtccatggtgctgaactgcatcgaccggctgaatgtgtacaccacagctgcccactttgctgagtttgctggggaggaggccgctgagagctggaaggagatcgtgaacctgctgtatgagctgctggccagcctcatccggggcaacagaagcaactgtgccctcttcagcaccaacctggactggctggtgtccaagctggaccggctggaggccagcagcggcatcctggaggtgctgtactgtgtgctgattgagagccctgaggtgctgaacatcatccaggagaaccacatcaagagcatcatcagcctgctggacaagcacggcaggaaccacaaggtgctggatgtgctgtgcagcctgtgtgtgtgcaatggagtggccgtgcgcagcaaccaggacctgatcacagagaacctgctgcccggccgggagctgctgctgcagaccaacctgatcaactacgtgaccagcatccggcccaacatctttgtgggccgggcagagggcaccacccagtacagcaagtggtactttgaggtgatggtggatgaggtgacccccttcctgacagcccaggccacccacctgcgggtgggctgggccctgacagagggctacaccccctacccaggagctggggagggctggggcggcaatggagtgggagatgacctgtacagctatggctttgatggcctgcacctgtggacaggccacgtggcccggcctgtgaccagccctggccagcacctgctggccccagaagatgtgatcagctgctgcctggacctgtctgtgcccagcatctccttccgcatcaatggctgccctgtgcagggcgtgtttgagagcttcaacctggatggcctcttcttccctgtggtgtccttctctgctggggtgaaggtgcgcttcctgctgggcggccgccacggggagttcaagttcctgcccccacctggctacgccccctgccatgaagctgtgctgccccgggagcggctgcacctggagcccatcaaggagtacagaagagagggcccccggggcccccacctggtgggccccagccgctgcctgagccacacagactttgtgccctgccctgtggacacagtgcagatcgtgctgcccccccacctggagcgcatccgggagaagctggccgagaacatccacgagctgtgggccctgacccgcatcgagcagggctggacctacggccctgtgagagatgacaacaagaggctgcacccctgcctggtggacttccacagcctgcctgagcctgagaggaactacaacctgcagatgtctggagagaccctgaagaccctgctggccctgggctgccacgtgggcatggctgatgagaaggccgaggacaacctgaagaagaccaagctgcccaagacctacatgatgagcaatggctacaagccagcccccctggacctgagccacgtgcggctgaccccagcccagaccaccctggtggaccggctggctgaaaatggccacaacgtgtgggcccgggacagagtgggccagggctggagctacagcgctgtgcaggacatcccagcccggaggaacccccggctggtgccctaccgcctgctggatgaggccaccaagaggagcaacagagacagcctgtgccaggccgtgaggaccctgctgggctacggctacaacatcgagcccccagaccaggagcccagccaggtggagaaccagagccgctgtgacagagtgcgcatcttccgggcagagaagagctacacagtgcagagcggccgctggtactttgaatttgaagctgtgaccaccggggagatgagggtgggctgggcccggcctgagctgcggccagatgtggagctgggcgcagatgagctggcctacgtgttcaacggccaccggggccagcgctggcacctgggcagcgagcccttcggccggccctggcagcctggagatgtggtgggctgcatgattgacctgacagagaacaccatcatcttcaccctgaatggagaggtgctgatgtctgacagcggcagcgagacagccttccgggagattgaaattggagatggcttcctgcctgtgtgcagcctgggccctggccaggtgggccacctgaacctgggccaggatgtgagcagcctgcgcttctttgccatctgtggcctgcaggagggctttgagccctttgccatcaacatgcagaggcctgtgaccacctggttcagcaagggcctgccccagtttgagcctgtgcccctggagcacccccactatgaggtgtcccgggtggatggcaccgtggacaccccaccctgcctgcggctgacccacaggacctggggcagccagaacagcctggtggagatgctgttcctgcggctgagcctgcctgtgcagttccaccagcacttccgctgcacagctggggccacccccctggcccctcctggcctgcagcccccagcagaagatgaggcccgggctgctgagccagaccctgactatgagaacctgcggcgctctgctgggggctggagcgaggctgaaaatggcaaggagggcacagccaaggagggcgcccctgggggcaccccccaggccggcggggaggcccagcctgcccgggcagaaaatgagaaggatgccaccacagagaagaacaagaagaggggcttcctgttcaaggccaagaaggtggccatgatgacccagcccccagccacccccaccctgccccggctgccccatgatgtggtgcctgctgacaacagagatgatcctgagatcatcctgaacaccaccacctactactacagcgtgcgggtgtttgctggccaggagcccagctgtgtgtgggccggctgggtgaccccagactaccaccagcacgacatgagctttgacctgagcaaggtgcgggtggtgacagtgaccatgggagatgagcagggcaatgtgcacagcagcctgaagtgcagcaactgctacatggtgtggggcggggactttgtgtccccaggccagcagggccgcatcagccacacagacctggtgattggctgcctggtggacctggccaccggcctgatgaccttcaccgccaacgggaaggagagcaacaccttcttccaggtggagcccaacaccaagctgtttcctgctgtgtttgtgctgcccacccaccagaatgtcatccagtttgagctgggcaagcagaagaacatcatgcccctgtctgctgccatgttccagagcgagaggaagaacccagccccccagtgccccccccggctggagatgcagatgctgatgcctgtgtcctggagcaggatgcccaaccacttcctgcaggtggagaccaggagagctggggagcggctgggctgggccgtgcagtgccaggagcccctgaccatgatggccctgcacatcccagaagaaaatcgctgcatggacatcctggagctgtctgagcggctggacctgcagcgcttccacagccacaccctgcggctgtacagagctgtgtgtgccctgggcaacaacagagtggcccacgccctgtgcagccacgtggaccaggcccagctgctgcacgccctggaggatgcccacctgcccggccccctgcgggccggctactatgacctgctgatcagcatccacctggagagcgcctgccgcagccgccgctccatgctgtctgagtacatcgtgcccctgaccccagagacccgggccatcaccctcttccccccaggccgcagcacagaaaatggccaccccaggcatggcctgcccggggtgggcgtgaccaccagcctgcggcccccccaccacttcagccccccctgctttgtggccgccctgcctgctgctggagctgctgaggccccagcccggctgagccctgccatccccctggaggccctgcgggacaaggccctgaggatgctgggggaggccgtgagagatggcggccagcacgcccgggaccctgtgggcggctctgtggagttccagtttgtgcctgtgctgaagctggtgtccaccctgctggtgatgggcatctttggagatgaagatgtgaagcagatcctgaagatgattgagcctgaggtgttcacagaggaggaggaggaggaggatgaggaggaggagggggaggaggaggatgaggaggagaaggaggaggatgaggaggagacagcccaggagaaggaggatgaggagaaggaggaggaggaggccgctgagggggagaaggaggagggcctggaggagggcctgctgcagatgaagctgcctgagagcgtgaagctgcagatgtgccacctgctggagtacttctgtgaccaggagctgcagcaccgggtggagagcctggccgcctttgctgagagatatgtggacaagctgcaggccaaccagaggagccgctatggcctgctgatcaaggccttctccatgacagctgctgagacagcccggaggacccgggagttccgcagccccccccaggagcagatcaacatgctgctgcagttcaaggatggaacagatgaggaggactgccccctgcctgaggagatccggcaggacctgctggacttccaccaggacctgctggcccactgcggcatccagctggatggagaggaggaggagcctgaggaggagaccaccctgggcagccggctgatgagcctgctggagaaggtgcggctggtgaagaagaaggaggagaagccagaggaggagaggtctgctgaggagagcaagcccaggagcctgcaggagctggtgagccacatggtggtgcgctgggcccaggaggactttgtgcagagccctgagctggtgcgggccatgttcagcctgctgcaccggcagtatgatggcctgggggagctgctgcgggccctgccccgggcctacaccatcagccccagctctgtggaggacaccatgagcctgctggagtgcctgggccagatccgcagcctgctgattgtgcagatgggcccccaggaggagaacctgatgatccagagcatcggcaacatcatgaacaacaaggtgttctaccagcaccccaacctgatgagggccctgggcatgcatgagaccgtgatggaggtgatggtgaatgtgctgggcggcggggagagcaaggagatccgcttccccaagatggtgaccagctgctgccgcttcctgtgctacttctgccgcatcagccggcagaaccagaggtccatgtttgaccacctgagctacctgctggagaacagcggcatcggcctgggcatgcagggcagcacccccctggatgtggccgccgcctctgtgattgacaacaatgagctggccctggccctgcaggagcaggacctggagaaggtggtgtcctacctggccggctgcggcctgcagagctgccccatgctggtggccaagggctacccagacatcggctggaacccctgtggcggggagcgctacctggacttcctgcgctttgctgtgtttgtgaatggagagagcgtggaggagaatgccaacgtggtggtgcggctgctgatcaggaagccagagtgcttcggccctgccctgcggggggagggcggcagcggcctgctggccgccatcgaggaggccatccgcatcagcgaggaccctgccagagatggccctggcatccggcgggacagaagaagagagcactttggagaggagcccccagaagaaaatagagtgcacctgggccacgccatcatgtccttctatgctgccctgattgacctgctgggccgctgtgcccctgagatgcacctgatccaggccgggaaaggagaggccctgcgcatccgggccatcctgcggagcctggtgcccctggaggacctggtgggcatcatcagcctgcccctgcagatccccaccctgggcaaggatggagccctggtgcagcccaagatgtctgccagctttgtgcctgaccacaaggcctccatggtgctcttcctggacagagtgtatggaattgagaaccaggacttcctgctgcacgtgctggatgtgggcttcctgcctgacatgagagctgctgccagcctggacacagccaccttcagcaccacagagatggccctggccctgaaccgctacctgtgcctggccgtgctgcccctcatcaccaagtgtgcccccctgtttgctggaacagagcaccgggccatcatggtggacagcatgctgcacacagtgtaccgcctgagccggggccgcagcctgaccaaggcccagagagatgtgattgaggactgcctgatgagcctgtgccgctacatccggcccagcatgctgcagcacctgctgcggcggctggtgtttgatgtgcccatcctgaatgaatttgccaagatgcccctgaagctgctgaccaaccactatgagcgctgctggaagtactactgcctgcccaccggctgggccaactttggagtgaccagcgaggaggagctgcacctgaccaggaagctgttctggggcatctttgacagcctggcccacaagaagtatgaccctgagctgtacaggatggccatgccctgcctgtgtgccatcgccggggccctgcccccagactatgtggatgccagctacagcagcaaggccgagaagaaggccaccgtggatgctgagggcaactttgaccccaggcctgtggagaccctgaatgtcatcatccctgagaagctggacagcttcatcaacaagtttgctgagtacacccatgagaagtgggcctttgacaagatccagaacaactggagctatggagaaaatattgatgaggagctgaagacccaccccatgctgcggccctacaagaccttcagcgagaaggacaaggagatctaccgctggcccatcaaggagagcctgaaggccatgattgcctgggagtggaccatcgagaaggcccgggagggggaggaggagaagacagagaagaagaagaccaggaagatcagccagagcgcccagacctatgacccccgggagggctacaacccccagcccccagacctgtctgctgtgaccctgagccgggagctgcaggccatggccgagcagctggccgagaactaccacaacacctggggcaggaagaagaagcaggagctggaggccaagggcggcggcacccaccccctgctggtgccctatgacaccctgacagccaaggagaaggcccgggaccgggagaaggcccaggagctgctgaagttcctgcagatgaatggctatgctgtgacccggggcctgaaggacatggagctggacagcagcagcattgagaagagatttgccttcggcttcctgcagcagctgctgcgctggatggacatcagccaggagttcatcgcccacctggaggccgtggtgagcagcggccgggtggagaagagcccccatgagcaggagatcaagttctttgccaagatcctgctgcccctcatcaaccagtacttcaccaaccactgcctgtacttcctgagcaccccagccaaggtgctgggcagcggcggccacgccagcaacaaggagaaggagatgatcaccagcctcttctgcaagctggccgccctggtgcgccaccgggtgtccctgtttggaacagatgccccagctgtggtgaactgcctgcacatcctggcccggagcctggatgccaggacagtgatgaagagcggccctgagatcgtgaaggccggcctgcggagcttctttgagagcgcctctgaagatattgagaagatggtggagaacctgcggctgggcaaggtgtcccaggcccggacccaggtgaagggcgtgggccagaacctgacctacaccaccgtggccctgctgcctgtgctgaccaccctcttccagcacatcgcccagcaccagtttggagatgatgtgatcctggatgatgtgcaggtgtcctgctaccgcaccctgtgcagcatctacagcctgggcaccaccaagaacacctacgtggagaagctgcggcctgccctgggggagtgcctggcccggctggccgccgccatgcctgtggccttcctggagccccagctgaatgagtacaatgcctgcagcgtgtacaccaccaagagcccccgggagcgggccatcctgggcctgcccaacagcgtggaggagatgtgcccagacatccctgtgctggagcggctgatggctgacattggaggcctggccgagagcggggcccgctacacagagatgccccacgtgattgagatcaccctgcccatgctgtgcagctacctgccccgctggtgggagcggggccctgaggccccacccagcgccctgcctgctggggcccccccaccctgcacagctgtgaccagtgaccacctgaacagcctgctgggcaacatcctgcgcatcatcgtgaacaacctgggcattgatgaggcctcctggatgaagaggctggccgtgtttgcccagcccatcgtgtcccgggcccggcctgagctgctgcagagccacttcatccccaccatcggccgcctgaggaagagagctgggaaggtggtgtctgaggaggagcagctgcggctggaggccaaggccgaggcccaggagggggagctgctggtgagagatgagttctctgtgctgtgccgggacctgtatgccctgtaccccctgctgatccgctacgtggacaacaacagagcccagtggctgacagagcccaaccccagcgctgaggagctgttcaggatggtgggggagatcttcatctactggagcaagagccacaacttcaagcgggaggagcagaactttgtggtgcagaatgagatcaacaacatgtccttcctgacagctgacaacaagagcaagatggccaagagcggcggcagtgaccaggagaggaccaagaagaagagaagaggagaccgctacagcgtgcagaccagcctgattgtggccaccctgaagaagatgctgcccatcggcctgaacatgtgtgcccccacagaccaggacctgatcaccctggccaagaccaggtatgccctgaaggacacagatgaggaggtgcgggagttcctgcacaacaacctgcacctgcagggcaaggtggagggcagccccagcctgcgctggcagatggccctgtacagaggagtgcccggccgggaggaggatgctgatgatcctgagaagatcgtgagaagagtgcaggaggtgtctgctgtgctgtactacctggaccagacagagcacccctacaagagcaagaaggctgtgtggcacaagctgctgagcaagcagaggcggcgggctgtggtggcctgcttcaggatgacccccctgtacaacctgcccacccaccgggcctgcaacatgttcctggagagctacaaggccgcctggatcctgacagaggaccacagctttgaggacaggatgattgatgacctgagcaaggccggggagcaggaggaggaggaggaggaggtggaggagaagaagccagaccccctgcaccagctggtgctgcacttcagcaggacagccctgacagagaagagcaagctggatgaggactacctgtacatggcctatgctgacatcatggccaagagctgccacctggaggagggcggagaaaatggagaggccgaggaggaggtggaggtgtcctttgaggagaagcagatggagaagcagaggctgctgtaccagcaggcccggctgcacaccagaggagctgctgagatggtgctgcagatgatcagcgcctgcaagggggagaccggggccatggtgagcagcaccctgaagctgggcatcagcatcctgaatggaggaaatgctgaggtgcagcagaagatgctggactacctgaaggacaagaaggaggtgggcttcttccagagcatccaggccctgatgcagacctgcagcgtgctggacctgaatgcctttgagcggcagaacaaggccgagggcctgggcatggtgaatgaagatggcaccgtcatcaaccggcagaatggagagaaggtgatggctgatgatgagttcacccaggacctcttccgcttcctgcagctgctgtgtgagggccacaacaatgacttccagaactacctgcggacccagacaggcaacaccaccaccatcaacatcatcatctgcaccgtggactacctgctgcggctgcaggagagcatcagtgacttctactggtactacagcggcaaggatgtgattgaggagcagggcaagaggaacttcagcaaggccatgtctgtggccaagcaggtgttcaacagcctgacagagtacatccagggcccctgcaccggcaaccagcagagcctggcccacagccggctgtgggatgctgtggtgggcttcctgcacgtgtttgcccacatgatgatgaagctggcccaggacagcagccagatcgagctgctgaaggagctgctggacctgcagaaggacatggtggtgatgctgctgagcctgctggagggcaatgtggtgaatggcatgattgcccggcagatggtggacatgctggtggagagcagcagcaatgtggagatgatcctgaagttctttgacatgttcctgaagctgaaggacatcgtgggcagcgaggccttccaggactatgtgacagacccccggggcctcatcagcaagaaggacttccagaaggccatggacagccagaagcagttcagcggccctgagatccagttcctgctgagctgcagcgaggctgatgaaaatgagatgatcaactgtgaggagtttgccaaccgcttccaggagcccgcccgggacatcggcttcaacgtggccgtgctgctgaccaacctgtctgaacatgtgccccatgacccccggctgcacaacttcctggagctggccgagagcatcctggagtacttccggccctacctgggcagaattgagatcatgggcgccagccgccgcatcgagcgcatctactttgagatcagcgagaccaacagagcccagtgggagatgccccaggtgaaggagagcaagaggcagttcatctttgatgtggtgaatgaaggaggagaggccgagaagatggagctgtttgtgtccttctgtgaggacaccatctttgagatgcagattgctgcccagatcagcgagcctgagggggagcctgagacagatgaagatgaaggagctggagctgctgaggccggggctgagggcgctgaggagggcgctgctggcctggagggcacagctgccacagctgctgctggggccacagcccgggtggtggccgccgccggccgggccctgcggggcctgagctaccgcagcctgcggcggcgggtgcggcggctgcggcggctgacagcccgggaggccgccacagctgtggccgccctgctgtgggccgctgtgacccgggccggggctgctggagctggagctgctgctggggccctgggcctgctgtggggcagcctgtttggaggcggcctggtggagggcgccaagaaggtgacagtgacagagctgctggccggcatgccagaccccaccagtgatgaggtgcatggagagcagcctgctggccctggaggagatgctgatggagagggcgccagcgagggcgctggagatgctgctgagggcgctggagatgaggaggaggccgtgcatgaggccggccctgggggcgcagatggagctgtggccgtgacagatggcggccccttccggcctgagggcgctgggggcctgggggacatgggagacaccaccccagctgagccccccaccccagagggcagccccatcctgaagaggaagctgggcgtggatggagtggaggaggagctgcccccagagcctgagcctgagcctgagcctgagctggagcctgagaaggcagatgctgaaaatggagagaaggaggaggtgcctgagcccaccccagagccccccaagaagcaggccccacccagccccccacccaagaaggaggaggccggcggggagttctggggcgagctggaggtgcagagggtgaagttcctgaactacctgagcaggaacttctacaccctgcgcttcctggccctcttcctggcctttgccatcaacttcatcctgctcttctacaaggtgtctgacagccccccaggagaagatgacatggagggcagcgctgctggagatgtgtctggagctggcagcggcggcagcagcggctggggcctgggcgctggggaggaggccgagggagatgaagatgagaacatggtgtactacttcctggaggagagcacaggctacatggagcccgccctgcgctgcctgagcctgctgcacaccctggtggccttcctgtgcatcatcggctacaactgcctgaaggtgcccctggtgatcttcaagcgggagaaggagctggccaggaagctggagtttgatggcctgtacatcacagagcagccagaagatgatgatgtgaagggccagtgggaccggctggtgctgaacacccccagcttccccagcaactactgggacaagtttgtgaagaggaaggtgctggacaagcacggggacatctacggccgggagagaattgctgagctgctgggcatggacctggccaccctggagatcacagcccacaatgaaaggaagcccaaccccccacctggcctgctgacctggctgatgagcattgatgtgaagtaccagatctggaagtttggagtcatcttcacagacaacagcttcctgtacctgggctggtacatggtgatgagcctgctgggccactacaacaacttcttctttgctgcccacctgctggacatcgccatgggcgtgaagaccctgcggaccatcctgagctctgtgacccacaacgggaagcagctggtgatgacagtgggcctgctggccgtggtggtgtacctgtacacagtggtggccttcaacttcttcaggaagttctacaacaagtcagaagatgaagatgagccagacatgaagtgtgatgacatgatgacctgctacctgttccacatgtatgtgggcgtgcgggccggcggcggcattggagatgaaattgaggaccctgctggagatgaatatgagctgtacagagtggtgtttgacatcaccttcttcttctttgtgattgtcatcctgctggccatcatccagggcctcatcattgatgccttcggggagctgcgggaccagcaggagcaggtgaaggaggacatggagaccaagtgcttcatctgtggcattggaagtgactactttgacaccacccctcatggctttgagacccacaccctggaggagcacaacctggccaactacatgttcttcctgatgtacctgatcaacaaggatgaaacagagcacacaggccaggagagctatgtgtggaagatgtaccaggagcgctgctgggacttcttccctgctggggactgcttcaggaagcagtatgaggaccagctgtcctag

SEQ ID NO: 168704 - DNA, 15117 bp, Artificial Sequence
  Description of Artificial Sequence: Synthetic coding sequence
atgggagatgctgaaggagaagatgaggtgcagttcctgaggacagatgatgaggtggtgctgcagtgcagcgccaccgtgctgaaggagcagctgaagctgtgcctggccgctgagggctttggaaaccggctgtgcttcctggagcccaccagcaatgcccagaatgtgcccccagacctggccatctgctgctttgtgctggagcagagcctgtctgtgcgggccctgcaggagatgctggccaacacagtggaggccggcgtggagagcagccagggcggcggccacaggaccctgctgtatggccacgccatcctgctgcggcatgcccacagcaggatgtacctgagctgcctgaccaccagccgctccatgacagacaagctggcctttgatgtgggcctgcaggaggatgccactggagaggcctgctggtggaccatgcacccagccagcaagcagaggtctgagggggagaaggtgcgggtgggagatgacatcatcctggtgtctgtgtcctctgagcgctacctgcacctgagcacagccagcggggagctgcaggtggatgccagcttcatgcagaccctgtggaacatgaaccccatctgcagccgctgtgaggagggctttgtgactggaggccacgtgctgcggctcttccacggccacatggatgagtgcctgaccatcagccctgctgacagtgatgaccagaggcggctggtgtactatgagggcggcgctgtgtgcacccacgcccggagcctgtggaggctggagcccctgcgcatctcctggagcggcagccacctgcgctggggccagcccctgcgggtgagacatgtgaccaccggccagtacctggccctgacagaggaccagggcctggtggtggtggatgccagcaaggcccacaccaaggccaccagcttctgcttccgcatcagcaaggagaagctggatgtggcccccaagagagatgtggagggcatgggccccccagagatcaagtacggggagagcctgtgctttgtgcagcacgtggccagcggcctgtggctgacctatgctgccccagaccccaaggccctgcggctgggcgtgctgaagaagaaggccatgctgcaccaggagggccacatggatgatgccctgagcctgacccgctgccagcaggaggagagccaggccgccaggatgatccacagcaccaacggcctgtacaaccagttcatcaagagcctggacagcttcagcggcaagccccggggcagcggccccccagctggaacagccctgcccattgaaggagtcatcctgagcctgcaggacctgatcatctactttgagcccccatctgaggacctgcagcacgaggagaagcagagcaagctgcggagcctgaggaaccggcagagcctcttccaggaggagggcatgctgtccatggtgctgaactgcatcgaccggctgaatgtgtacaccacagctgcccactttgctgagtttgctggggaggaggccgctgagagctggaaggagatcgtgaacctgctgtatgagctgctggccagcctcatccggggcaacagaagcaactgtgccctcttcagcaccaacctggactggctggtgtccaagctggaccggctggaggccagcagcggcatcctggaggtgctgtactgtgtgctgattgagagccctgaggtgctgaacatcatccaggagaaccacatcaagagcatcatcagcctgctggacaagcacggcaggaaccacaaggtgctggatgtgctgtgcagcctgtgtgtgtgcaatggagtggccgtgcgcagcaaccaggacctgatcacagagaacctgctgcccggccgggagctgctgctgcagaccaacctgatcaactacgtgaccagcatccggcccaacatctttgtgggccgggcagagggcaccacccagtacagcaagtggtactttgaggtgatggtggatgaggtgacccccttcctgacagcccaggccacccacctgcgggtgggctgggccctgacagagggctacaccccctacccaggagctggggagggctggggcggcaatggagtgggagatgacctgtacagctatggctttgatggcctgcacctgtggacaggccacgtggcccggcctgtgaccagccctggccagcacctgctggccccagaagatgtgatcagctgctgcctggacctgtctgtgcccagcatctccttccgcatcaatggctgccctgtgcagggcgtgtttgagagcttcaacctggatggcctcttcttccctgtggtgtccttctctgctggggtgaaggtgcgcttcctgctgggcggccgccacggggagttcaagttcctgcccccacctggctacgccccctgccatgaagctgtgctgccccgggagcggctgcacctggagcccatcaaggagtacagaagagagggcccccggggcccccacctggtgggccccagccgctgcctgagccacacagactttgtgccctgccctgtggacacagtgcagatcgtgctgcccccccacctggagcgcatccgggagaagctggccgagaacatccacgagctgtgggccctgacccgcatcgagcagggctggacctacggccctgtgagagatgacaacaagaggctgcacccctgcctggtggacttccacagcctgcctgagcctgagaggaactacaacctgcagatgtctggagagaccctgaagaccctgctggccctgggctgccacgtgggcatggctgatgagaaggccgaggacaacctgaagaagaccaagctgcccaagacctacatgatgagcaatggctacaagccagcccccctggacctgagccacgtgcggctgaccccagcccagaccaccctggtggaccggctggctgaaaatggccacaacgtgtgggcccgggacagagtgggccagggctggagctacagcgctgtgcaggacatcccagcccggaggaacccccggctggtgccctaccgcctgctggatgaggccaccaagaggagcaacagagacagcctgtgccaggccgtgaggaccctgctgggctacggctacaacatcgagcccccagaccaggagcccagccaggtggagaaccagagccgctgtgacagagtgcgcatcttccgggcagagaagagctacacagtgcagagcggccgctggtactttgaatttgaagctgtgaccaccggggagatgagggtgggctgggcccggcctgagctgcggccagatgtggagctgggcgcagatgagctggcctacgtgttcaacggccaccggggccagcgctggcacctgggcagcgagcccttcggccggccctggcagcctggagatgtggtgggctgcatgattgacctgacagagaacaccatcatcttcaccctgaatggagaggtgctgatgtctgacagcggcagcgagacagccttccgggagattgaaattggagatggcttcctgcctgtgtgcagcctgggccctggccaggtgggccacctgaacctgggccaggatgtgagcagcctgcgcttctttgccatctgtggcctgcaggagggctttgagccctttgccatcaacatgcagaggcctgtgaccacctggttcagcaagggcctgccccagtttgagcctgtgcccctggagcacccccactatgaggtgtcccgggtggatggcaccgtggacaccccaccctgcctgcggctgacccacaggacctggggcagccagaacagcctggtggagatgctgttcctgcggctgagcctgcctgtgcagttccaccagcacttccgctgcacagctggggccacccccctggcccctcctggcctgcagcccccagcagaagatgaggcccgggctgctgagccagaccctgactatgagaacctgcggcgctctgctgggggctggagcgaggctgaaaatggcaaggagggcacagccaaggagggcgcccctgggggcaccccccaggccggcggggaggcccagcctgcccgggcagaaaatgagaaggatgccaccacagagaagaacaagaagaggggcttcctgttcaaggccaagaaggtggccatgatgacccagcccccagccacccccaccctgccccggctgccccatgatgtggtgcctgctgacaacagagatgatcctgagatcatcctgaacaccaccacctactactacagcgtgcgggtgtttgctggccaggagcccagctgtgtgtgggccggctgggtgaccccagactaccaccagcacgacatgagctttgacctgagcaaggtgcgggtggtgacagtgaccatgggagatgagcagggcaatgtgcacagcagcctgaagtgcagcaactgctacatggtgtggggcggggactttgtgtccccaggccagcagggccgcatcagccacacagacctggtgattggctgcctggtggacctggccaccggcctgatgaccttcaccgccaacgggaaggagagcaacaccttcttccaggtggagcccaacaccaagctgtttcctgctgtgtttgtgctgcccacccaccagaatgtcatccagtttgagctgggcaagcagaagaacatcatgcccctgtctgctgccatgttccagagcgagaggaagaacccagccccccagtgccccccccggctggagatgcagatgctgatgcctgtgtcctggagcaggatgcccaaccacttcctgcaggtggagaccaggagagctggggagcggctgggctgggccgtgcagtgccaggagcccctgaccatgatggccctgcacatcccagaagaaaatcgctgcatggacatcctggagctgtctgagcggctggacctgcagcgcttccacagccacaccctgcggctgtacagagctgtgtgtgccctgggcaacaacagagtggcccacgccctgtgcagccacgtggaccaggcccagctgctgcacgccctggaggatgcccacctgcccggccccctgcgggccggctactatgacctgctgatcagcatccacctggagagcgcctgccgcagccgccgctccatgctgtctgagtacatcgtgcccctgaccccagagacccgggccatcaccctcttccccccaggccgcagcacagaaaatggccaccccaggcatggcctgcccggggtgggcgtgaccaccagcctgcggcccccccaccacttcagccccccctgctttgtggccgccctgcctgctgctggagctgctgaggccccagcccggctgagccctgccatccccctggaggccctgcgggacaaggccctgaggatgctgggggaggccgtgagagatggcggccagcacgcccgggaccctgtgggcggctctgtggagttccagtttgtgcctgtgctgaagctggtgtccaccctgctggtgatgggcatctttggagatgaagatgtgaagcagatcctgaagatgattgagcctgaggtgttcacagaggaggaggaggaggaggatgaggaggaggagggggaggaggaggatgaggaggagaaggaggaggatgaggaggagacagcccaggagaaggaggatgaggagaaggaggaggaggaggccgctgagggggagaaggaggagggcctggaggagggcctgctgcagatgaagctgcctgagagcgtgaagctgcagatgtgccacctgctggagtacttctgtgaccaggagctgcagcaccgggtggagagcctggccgcctttgctgagagatatgtggacaagctgcaggccaaccagaggagccgctatggcctgctgatcaaggccttctccatgacagctgctgagacagcccggaggacccgggagttccgcagccccccccaggagcagatcaacatgctgctgcagttcaaggatggaacagatgaggaggactgccccctgcctgaggagatccggcaggacctgctggacttccaccaggacctgctggcccactgcggcatccagctggatggagaggaggaggagcctgaggaggagaccaccctgggcagccggctgatgagcctgctggagaaggtgcggctggtgaagaagaaggaggagaagccagaggaggagaggtctgctgaggagagcaagcccaggagcctgcaggagctggtgagccacatggtggtgcgctgggcccaggaggactttgtgcagagccctgagctggtgcgggccatgttcagcctgctgcaccggcagtatgatggcctgggggagctgctgcgggccctgccccgggcctacaccatcagccccagctctgtggaggacaccatgagcctgctggagtgcctgggccagatccgcagcctgctgattgtgcagatgggcccccaggaggagaacctgatgatccagagcatcggcaacatcatgaacaacaaggtgttctaccagcaccccaacctgatgagggccctgggcatgcatgagaccgtgatggaggtgatggtgaatgtgctgggcggcggggagagcaaggagatccgcttccccaagatggtgaccagctgctgccgcttcctgtgctacttctgccgcatcagccggcagaaccagaggtccatgtttgaccacctgagctacctgctggagaacagcggcatcggcctgggcatgcagggcagcacccccctggatgtggccgccgcctctgtgattgacaacaatgagctggccctggccctgcaggagcaggacctggagaaggtggtgtcctacctggccggctgcggcctgcagagctgccccatgctggtggccaagggctacccagacatcggctggaacccctgtggcggggagcgctacctggacttcctgcgctttgctgtgtttgtgaatggagagagcgtggaggagaatgccaacgtggtggtgcggctgctgatcaggaagccagagtgcttcggccctgccctgcggggggagggcggcagcggcctgctggccgccatcgaggaggccatccgcatcagcgaggaccctgccagagatggccctggcatccggcgggacagaagaagagagcactttggagaggagcccccagaagaaaatagagtgcacctgggccacgccatcatgtccttctatgctgccctgattgacctgctgggccgctgtgcccctgagatgcacctgatccaggccgggaaaggagaggccctgcgcatccgggccatcctgcggagcctggtgcccctggaggacctggtgggcatcatcagcctgcccctgcagatccccaccctgggcaaggatggagccctggtgcagcccaagatgtctgccagctttgtgcctgaccacaaggcctccatggtgctcttcctggacagagtgtatggaattgagaaccaggacttcctgctgcacgtgctggatgtgggcttcctgcctgacatgagagctgctgccagcctggacacagccaccttcagcaccacagagatggccctggccctgaaccgctacctgtgcctggccgtgctgcccctcatcaccaagtgtgcccccctgtttgctggaacagagcaccgggccatcatggtggacagcatgctgcacacagtgtaccgcctgagccggggccgcagcctgaccaaggcccagagagatgtgattgaggactgcctgatgagcctgtgccgctacatccggcccagcatgctgcagcacctgctgcggcggctggtgtttgatgtgcccatcctgaatgaatttgccaagatgcccctgaagctgctgaccaaccactatgagcgctgctggaagtactactgcctgcccaccggctgggccaactttggagtgaccagcgaggaggagctgcacctgaccaggaagctgttctggggcatctttgacagcctggcccacaagaagtatgaccctgagctgtacaggatggccatgccctgcctgtgtgccatcgccggggccctgcccccagactatgtggatgccagctacagcagcaaggccgagaagaaggccaccgtggatgctgagggcaactttgaccccaggcctgtggagaccctgaatgtcatcatccctgagaagctggacagcttcatcaacaagtttgctgagtacacccatgagaagtgggcctttgacaagatccagaacaactggagctatggagaaaatattgatgaggagctgaagacccaccccatgctgcggccctacaagaccttcagcgagaaggacaaggagatctaccgctggcccatcaaggagagcctgaaggccatgattgcctgggagtggaccatcgagaaggcccgggagggggaggaggagaagacagagaagaagaagaccaggaagatcagccagagcgcccagacctatgacccccgggagggctacaacccccagcccccagacctgtctgctgtgaccctgagccgggagctgcaggccatggccgagcagctggccgagaactaccacaacacctggggcaggaagaagaagcaggagctggaggccaagggcggcggcacccaccccctgctggtgccctatgacaccctgacagccaaggagaaggcccgggaccgggagaaggcccaggagctgctgaagttcctgcagatgaatggctatgctgtgacccggggcctgaaggacatggagctggacagcagcagcattgagaagagatttgccttcggcttcctgcagcagctgctgcgctggatggacatcagccaggagttcatcgcccacctggaggccgtggtgagcagcggccgggtggagaagagcccccatgagcaggagatcaagttctttgccaagatcctgctgcccctcatcaaccagtacttcaccaaccactgcctgtacttcctgagcaccccagccaaggtgctgggcagcggcggccacgccagcaacaaggagaaggagatgatcaccagcctcttctgcaagctggccgccctggtgcgccaccgggtgtccctgtttggaacagatgccccagctgtggtgaactgcctgcacatcctggcccggagcctggatgccaggacagtgatgaagagcggccctgagatcgtgaaggccggcctgcggagcttctttgagagcgcctctgaagatattgagaagatggtggagaacctgcggctgggcaaggtgtcccaggcccggacccaggtgaagggcgtgggccagaacctgacctacaccaccgtggccctgctgcctgtgctgaccaccctcttccagcacatcgcccagcaccagtttggagatgatgtgatcctggatgatgtgcaggtgtcctgctaccgcaccctgtgcagcatctacagcctgggcaccaccaagaacacctacgtggagaagctgcggcctgccctgggggagtgcctggcccggctggccgccgccatgcctgtggccttcctggagccccagctgaatgagtacaatgcctgcagcgtgtacaccaccaagagcccccgggagcgggccatcctgggcctgcccaacagcgtggaggagatgtgcccagacatccctgtgctggagcggctgatggctgacattggaggcctggccgagagcggggcccgctacacagagatgccccacgtgattgagatcaccctgcccatgctgtgcagctacctgccccgctggtgggagcggggccctgaggccccacccagcgccctgcctgctggggcccccccaccctgcacagctgtgaccagtgaccacctgaacagcctgctgggcaacatcctgcgcatcatcgtgaacaacctgggcattgatgaggcctcctggatgaagaggctggccgtgtttgcccagcccatcgtgtcccgggcccggcctgagctgctgcagagccacttcatccccaccatcggccgcctgaggaagagagctgggaaggtggtgtctgaggaggagcagctgcggctggaggccaaggccgaggcccaggagggggagctgctggtgagagatgagttctctgtgctgtgccgggacctgtatgccctgtaccccctgctgatccgctacgtggacaacaacagagcccagtggctgacagagcccaaccccagcgctgaggagctgttcaggatggtgggggagatcttcatctactggagcaagagccacaacttcaagcgggaggagcagaactttgtggtgcagaatgagatcaacaacatgtccttcctgacagctgacaacaagagcaagatggccaaggccggggacatccagagcggcggcagtgaccaggagaggaccaagaagaagagaagaggagaccgctacagcgtgcagaccagcctcatcgtggccaccctgaagaagatgctgcccatcggcctgaacatgtgtgcccccacagaccaggacctgatcaccctggccaagaccaggtatgccctgaaggacacagatgaggaggtgcgggagttcctgcacaacaacctgcacctgcagggcaaggtggagggcagccccagcctgcgctggcagatggccctgtaccggggcgtgcccggccgggaggaggatgctgatgatcctgagaagatcgtgcggcgggtgcaggaggtgtctgctgtgctgtactacctggaccagacagagcacccctacaagagcaagaaggctgtgtggcacaagctgctgagcaagcagaggagaagagctgtggtggcctgcttcaggatgacccccctgtacaacctgcccacccaccgggcctgcaacatgttcctggagagctacaaggccgcctggatcctgacagaggaccacagctttgaggacaggatgattgatgacctgagcaaggccggggagcaggaggaggaggaggaggaggtggaggagaagaagccagaccccctgcaccagctggtgctgcacttcagcaggacagccctgacagagaagagcaagctggatgaggactacctgtacatggcctatgctgacatcatggccaagagctgccacctggaggagggcggggagaatggagaggccgaggaggaggtggaggtgtcctttgaggagaagcagatggagaagcagaggctgctgtaccagcaggcccggctgcacaccagaggagctgctgagatggtgctgcagatgatcagcgcctgcaagggggagactggagccatggtgagcagcaccctgaagctgggcatcagcatcctgaatggaggaaatgctgaggtgcagcagaagatgctggactacctgaaggacaagaaggaggtgggcttcttccagagcatccaggccctgatgcagacctgcagcgtgctggacctgaatgcctttgagcggcagaacaaggccgagggcctgggcatggtgaatgaagatggcaccgtcatcaaccggcagaatggagagaaggtgatggctgatgatgagttcacccaggacctcttccgcttcctgcagctgctgtgtgagggccacaacaatgacttccagaactacctgcggacccagacaggcaacaccaccaccatcaacatcatcatctgcaccgtggactacctgctgcggctgcaggagagcatcagtgacttctactggtactacagcggcaaggatgtgattgaggagcagggcaagaggaacttcagcaaggccatgtctgtggccaagcaggtgttcaacagcctgacagagtacatccagggcccctgcaccggcaaccagcagagcctggcccacagccggctgtgggatgctgtggtgggcttcctgcacgtgtttgcccacatgatgatgaagctggcccaggacagcagccagatcgagctgctgaaggagctgctggacctgcagaaggacatggtggtgatgctgctgagcctgctggagggcaatgtggtgaatggcatgattgcccggcagatggtggacatgctggtggagagcagcagcaatgtggagatgatcctgaagttctttgacatgttcctgaagctgaaggacatcgtgggcagcgaggccttccaggactatgtgacagacccccggggcctcatcagcaagaaggacttccagaaggccatggacagccagaagcagttcagcggccctgagatccagttcctgctgagctgcagcgaggctgatgaaaatgagatgatcaactgtgaggagtttgccaaccgcttccaggagcccgcccgggacatcggcttcaacgtggccgtgctgctgaccaacctgtctgagcacgtgccccatgacccccggctgcacaacttcctggagctggccgagagcatcctggagtacttccggccctacctgggccgcatcgagatcatgggcgccagcagaagaattgagcgcatctactttgagatcagcgagaccaacagagcccagtgggagatgccccaggtgaaggagagcaagaggcagttcatctttgatgtggtgaatgaaggaggagaggccgagaagatggagctgtttgtgtccttctgtgaggacaccatctttgagatgcagattgctgcccagatcagcgagcctgagggggagcctgagacagatgaagatgagggcgctggagctgctgaggccggggctgagggcgctgaggagggcgccgccggcctggagggcacagctgccacagctgctgctggggccacagcccgggtggtggccgctgctggccgggccctgcggggcctgagctaccgcagcctgcggaggagagtgcggcggctgcggcggctgacagcccgggaggccgccacagctgtggccgccctgctgtgggccgctgtgaccagggctggagctgctggggccggggctgctgctggggccctgggcctgctgtggggcagcctgtttggaggcggcctggtggagggcgccaagaaggtgacagtgacagagctgctggccggcatgccagaccccaccagtgatgaggtgcacggggagcagcctgctggccctggaggagatgctgatggagagggcgccagcgagggcgctggagatgctgctgagggcgctggagatgaggaggaggccgtgcatgaagctggccctggaggagcagatggagctgtggccgtgacagatggcggccccttccggcctgagggcgccggcggcctgggggacatgggagacaccaccccagctgagccccccaccccagagggcagccccatcctgaagaggaagctgggcgtggatggagtggaggaggagctgcccccagagcctgagcctgagcctgagcctgagctggagcctgagaaggcagatgctgaaaatggagagaaggaggaggtgcctgagcccaccccagagccccccaagaagcaggccccacccagccccccacccaagaaggaggaggccggcggggagttctggggcgagctggaggtgcagagggtgaagttcctgaactacctgagcaggaacttctacaccctgcgcttcctggccctcttcctggcctttgccatcaacttcatcctgctcttctacaaggtgtctgacagccccccaggagaagatgacatggagggcagcgctgctggagatgtgtctggggccggcagcggcggcagcagcggctggggcctgggcgctggggaggaggccgagggagatgaagatgagaacatggtgtactacttcctggaggagagcacaggctacatggagcccgccctgcgctgcctgagcctgctgcacaccctggtggccttcctgtgcatcatcggctacaactgcctgaaggtgcccctggtgatcttcaagcgggagaaggagctggccaggaagctggagtttgatggcctgtacatcacagagcagccagaagatgatgatgtgaagggccagtgggaccggctggtgctgaacacccccagcttccccagcaactactgggacaagtttgtgaagaggaaggtgctggacaagcatggagacatctacggccgggagagaattgctgagctgctgggcatggacctggccaccctggagatcacagcccacaatgaaaggaagcccaaccccccacctggcctgctgacctggctgatgagcattgatgtgaagtaccagatctggaagtttggagtcatcttcacagacaacagcttcctgtacctgggctggtacatggtgatgagcctgctgggccactacaacaacttcttctttgctgcccacctgctggacatcgccatgggcgtgaagaccctgcggaccatcctgagctctgtgacccacaacgggaagcagctggtgatgacagtgggcctgctggccgtggtggtgtacctgtacacagtggtggccttcaacttcttcaggaagttctacaacaagtcagaagatgaagatgagccagacatgaagtgtgatgacatgatgacctgctacctgttccacatgtatgtgggcgtgcgggccggcggcggcattggagatgaaattgaagatcctgctggagatgaatatgagctgtacagagtggtgtttgacatcaccttcttcttcttcgtcatcgtcatcctgctggccatcatccagggcctcatcattgatgcctttggagagctgcgggaccagcaggagcaggtgaaggaggacatggagaccaagtgcttcatctgtggcatcggcagtgactactttgacaccaccccccacggctttgagacccacaccctggaggagcacaacctggccaactacatgttcttcctgatgtacctgatcaacaaggatgaaacagagcacacaggccaggagagctatgtgtggaagatgtaccaggagcgctgctgggacttcttccctgctggggactgcttcaggaagcagtatgaggaccagctgtcctag

SEQ ID NO: 168705 - DNA, 15102 bp, Artificial Sequence
  Description of Artificial Sequence: Synthetic coding sequence
atgggagatgctgaaggagaagatgaggtgcagttcctgaggacagatgatgaggtggtgctgcagtgcagcgccaccgtgctgaaggagcagctgaagctgtgcctggccgctgagggctttggaaaccggctgtgcttcctggagcccaccagcaatgcccagaatgtgcccccagacctggccatctgctgctttgtgctggagcagagcctgtctgtgcgggccctgcaggagatgctggccaacacagtggaggccggcgtggagagcagccagggcggcggccacaggaccctgctgtatggccacgccatcctgctgcggcatgcccacagcaggatgtacctgagctgcctgaccaccagccgctccatgacagacaagctggcctttgatgtgggcctgcaggaggatgccactggagaggcctgctggtggaccatgcacccagccagcaagcagaggtctgagggggagaaggtgcgggtgggagatgacatcatcctggtgtctgtgtcctctgagcgctacctgcacctgagcacagccagcggggagctgcaggtggatgccagcttcatgcagaccctgtggaacatgaaccccatctgcagccgctgtgaggagggctttgtgactggaggccacgtgctgcggctcttccacggccacatggatgagtgcctgaccatcagccctgctgacagtgatgaccagaggcggctggtgtactatgagggcggcgctgtgtgcacccacgcccggagcctgtggaggctggagcccctgcgcatctcctggagcggcagccacctgcgctggggccagcccctgcgggtgagacatgtgaccaccggccagtacctggccctgacagaggaccagggcctggtggtggtggatgccagcaaggcccacaccaaggccaccagcttctgcttccgcatcagcaaggagaagctggatgtggcccccaagagagatgtggagggcatgggccccccagagatcaagtacggggagagcctgtgctttgtgcagcacgtggccagcggcctgtggctgacctatgctgccccagaccccaaggccctgcggctgggcgtgctgaagaagaaggccatgctgcaccaggagggccacatggatgatgccctgagcctgacccgctgccagcaggaggagagccaggccgccaggatgatccacagcaccaacggcctgtacaaccagttcatcaagagcctggacagcttcagcggcaagccccggggcagcggccccccagctggaacagccctgcccattgaaggagtcatcctgagcctgcaggacctgatcatctactttgagcccccatctgaggacctgcagcacgaggagaagcagagcaagctgcggagcctgaggaaccggcagagcctcttccaggaggagggcatgctgtccatggtgctgaactgcatcgaccggctgaatgtgtacaccacagctgcccactttgctgagtttgctggggaggaggccgctgagagctggaaggagatcgtgaacctgctgtatgagctgctggccagcctcatccggggcaacagaagcaactgtgccctcttcagcaccaacctggactggctggtgtccaagctggaccggctggaggccagcagcggcatcctggaggtgctgtactgtgtgctgattgagagccctgaggtgctgaacatcatccaggagaaccacatcaagagcatcatcagcctgctggacaagcacggcaggaaccacaaggtgctggatgtgctgtgcagcctgtgtgtgtgcaatggagtggccgtgcgcagcaaccaggacctgatcacagagaacctgctgcccggccgggagctgctgctgcagaccaacctgatcaactacgtgaccagcatccggcccaacatctttgtgggccgggcagagggcaccacccagtacagcaagtggtactttgaggtgatggtggatgaggtgacccccttcctgacagcccaggccacccacctgcgggtgggctgggccctgacagagggctacaccccctacccaggagctggggagggctggggcggcaatggagtgggagatgacctgtacagctatggctttgatggcctgcacctgtggacaggccacgtggcccggcctgtgaccagccctggccagcacctgctggccccagaagatgtgatcagctgctgcctggacctgtctgtgcccagcatctccttccgcatcaatggctgccctgtgcagggcgtgtttgagagcttcaacctggatggcctcttcttccctgtggtgtccttctctgctggggtgaaggtgcgcttcctgctgggcggccgccacggggagttcaagttcctgcccccacctggctacgccccctgccatgaagctgtgctgccccgggagcggctgcacctggagcccatcaaggagtacagaagagagggcccccggggcccccacctggtgggccccagccgctgcctgagccacacagactttgtgccctgccctgtggacacagtgcagatcgtgctgcccccccacctggagcgcatccgggagaagctggccgagaacatccacgagctgtgggccctgacccgcatcgagcagggctggacctacggccctgtgagagatgacaacaagaggctgcacccctgcctggtggacttccacagcctgcctgagcctgagaggaactacaacctgcagatgtctggagagaccctgaagaccctgctggccctgggctgccacgtgggcatggctgatgagaaggccgaggacaacctgaagaagaccaagctgcccaagacctacatgatgagcaatggctacaagccagcccccctggacctgagccacgtgcggctgaccccagcccagaccaccctggtggaccggctggctgaaaatggccacaacgtgtgggcccgggacagagtgggccagggctggagctacagcgctgtgcaggacatcccagcccggaggaacccccggctggtgccctaccgcctgctggatgaggccaccaagaggagcaacagagacagcctgtgccaggccgtgaggaccctgctgggctacggctacaacatcgagcccccagaccaggagcccagccaggtggagaaccagagccgctgtgacagagtgcgcatcttccgggcagagaagagctacacagtgcagagcggccgctggtactttgaatttgaagctgtgaccaccggggagatgagggtgggctgggcccggcctgagctgcggccagatgtggagctgggcgcagatgagctggcctacgtgttcaacggccaccggggccagcgctggcacctgggcagcgagcccttcggccggccctggcagcctggagatgtggtgggctgcatgattgacctgacagagaacaccatcatcttcaccctgaatggagaggtgctgatgtctgacagcggcagcgagacagccttccgggagattgaaattggagatggcttcctgcctgtgtgcagcctgggccctggccaggtgggccacctgaacctgggccaggatgtgagcagcctgcgcttctttgccatctgtggcctgcaggagggctttgagccctttgccatcaacatgcagaggcctgtgaccacctggttcagcaagggcctgccccagtttgagcctgtgcccctggagcacccccactatgaggtgtcccgggtggatggcaccgtggacaccccaccctgcctgcggctgacccacaggacctggggcagccagaacagcctggtggagatgctgttcctgcggctgagcctgcctgtgcagttccaccagcacttccgctgcacagctggggccacccccctggcccctcctggcctgcagcccccagcagaagatgaggcccgggctgctgagccagaccctgactatgagaacctgcggcgctctgctgggggctggagcgaggctgaaaatggcaaggagggcacagccaaggagggcgcccctgggggcaccccccaggccggcggggaggcccagcctgcccgggcagaaaatgagaaggatgccaccacagagaagaacaagaagaggggcttcctgttcaaggccaagaaggtggccatgatgacccagcccccagccacccccaccctgccccggctgccccatgatgtggtgcctgctgacaacagagatgatcctgagatcatcctgaacaccaccacctactactacagcgtgcgggtgtttgctggccaggagcccagctgtgtgtgggccggctgggtgaccccagactaccaccagcacgacatgagctttgacctgagcaaggtgcgggtggtgacagtgaccatgggagatgagcagggcaatgtgcacagcagcctgaagtgcagcaactgctacatggtgtggggcggggactttgtgtccccaggccagcagggccgcatcagccacacagacctggtgattggctgcctggtggacctggccaccggcctgatgaccttcaccgccaacgggaaggagagcaacaccttcttccaggtggagcccaacaccaagctgtttcctgctgtgtttgtgctgcccacccaccagaatgtcatccagtttgagctgggcaagcagaagaacatcatgcccctgtctgctgccatgttccagagcgagaggaagaacccagccccccagtgccccccccggctggagatgcagatgctgatgcctgtgtcctggagcaggatgcccaaccacttcctgcaggtggagaccaggagagctggggagcggctgggctgggccgtgcagtgccaggagcccctgaccatgatggccctgcacatcccagaagaaaatcgctgcatggacatcctggagctgtctgagcggctggacctgcagcgcttccacagccacaccctgcggctgtacagagctgtgtgtgccctgggcaacaacagagtggcccacgccctgtgcagccacgtggaccaggcccagctgctgcacgccctggaggatgcccacctgcccggccccctgcgggccggctactatgacctgctgatcagcatccacctggagagcgcctgccgcagccgccgctccatgctgtctgagtacatcgtgcccctgaccccagagacccgggccatcaccctcttccccccaggccgcagcacagaaaatggccaccccaggcatggcctgcccggggtgggcgtgaccaccagcctgcggcccccccaccacttcagccccccctgctttgtggccgccctgcctgctgctggagctgctgaggccccagcccggctgagccctgccatccccctggaggccctgcgggacaaggccctgaggatgctgggggaggccgtgagagatggcggccagcacgcccgggaccctgtgggcggctctgtggagttccagtttgtgcctgtgctgaagctggtgtccaccctgctggtgatgggcatctttggagatgaagatgtgaagcagatcctgaagatgattgagcctgaggtgttcacagaggaggaggaggaggaggatgaggaggaggagggggaggaggaggatgaggaggagaaggaggaggatgaggaggagacagcccaggagaaggaggatgaggagaaggaggaggaggaggccgctgagggggagaaggaggagggcctggaggagggcctgctgcagatgaagctgcctgagagcgtgaagctgcagatgtgccacctgctggagtacttctgtgaccaggagctgcagcaccgggtggagagcctggccgcctttgctgagagatatgtggacaagctgcaggccaaccagaggagccgctatggcctgctgatcaaggccttctccatgacagctgctgagacagcccggaggacccgggagttccgcagccccccccaggagcagatcaacatgctgctgcagttcaaggatggaacagatgaggaggactgccccctgcctgaggagatccggcaggacctgctggacttccaccaggacctgctggcccactgcggcatccagctggatggagaggaggaggagcctgaggaggagaccaccctgggcagccggctgatgagcctgctggagaaggtgcggctggtgaagaagaaggaggagaagccagaggaggagaggtctgctgaggagagcaagcccaggagcctgcaggagctggtgagccacatggtggtgcgctgggcccaggaggactttgtgcagagccctgagctggtgcgggccatgttcagcctgctgcaccggcagtatgatggcctgggggagctgctgcgggccctgccccgggcctacaccatcagccccagctctgtggaggacaccatgagcctgctggagtgcctgggccagatccgcagcctgctgattgtgcagatgggcccccaggaggagaacctgatgatccagagcatcggcaacatcatgaacaacaaggtgttctaccagcaccccaacctgatgagggccctgggcatgcatgagaccgtgatggaggtgatggtgaatgtgctgggcggcggggagagcaaggagatccgcttccccaagatggtgaccagctgctgccgcttcctgtgctacttctgccgcatcagccggcagaaccagaggtccatgtttgaccacctgagctacctgctggagaacagcggcatcggcctgggcatgcagggcagcacccccctggatgtggccgccgcctctgtgattgacaacaatgagctggccctggccctgcaggagcaggacctggagaaggtggtgtcctacctggccggctgcggcctgcagagctgccccatgctggtggccaagggctacccagacatcggctggaacccctgtggcggggagcgctacctggacttcctgcgctttgctgtgtttgtgaatggagagagcgtggaggagaatgccaacgtggtggtgcggctgctgatcaggaagccagagtgcttcggccctgccctgcggggggagggcggcagcggcctgctggccgccatcgaggaggccatccgcatcagcgaggaccctgccagagatggccctggcatccggcgggacagaagaagagagcactttggagaggagcccccagaagaaaatagagtgcacctgggccacgccatcatgtccttctatgctgccctgattgacctgctgggccgctgtgcccctgagatgcacctgatccaggccgggaaaggagaggccctgcgcatccgggccatcctgcggagcctggtgcccctggaggacctggtgggcatcatcagcctgcccctgcagatccccaccctgggcaaggatggagccctggtgcagcccaagatgtctgccagctttgtgcctgaccacaaggcctccatggtgctcttcctggacagagtgtatggaattgagaaccaggacttcctgctgcacgtgctggatgtgggcttcctgcctgacatgagagctgctgccagcctggacacagccaccttcagcaccacagagatggccctggccctgaaccgctacctgtgcctggccgtgctgcccctcatcaccaagtgtgcccccctgtttgctggaacagagcaccgggccatcatggtggacagcatgctgcacacagtgtaccgcctgagccggggccgcagcctgaccaaggcccagagagatgtgattgaggactgcctgatgagcctgtgccgctacatccggcccagcatgctgcagcacctgctgcggcggctggtgtttgatgtgcccatcctgaatgaatttgccaagatgcccctgaagctgctgaccaaccactatgagcgctgctggaagtactactgcctgcccaccggctgggccaactttggagtgaccagcgaggaggagctgcacctgaccaggaagctgttctggggcatctttgacagcctggcccacaagaagtatgaccctgagctgtacaggatggccatgccctgcctgtgtgccatcgccggggccctgcccccagactatgtggatgccagctacagcagcaaggccgagaagaaggccaccgtggatgctgagggcaactttgaccccaggcctgtggagaccctgaatgtcatcatccctgagaagctggacagcttcatcaacaagtttgctgagtacacccatgagaagtgggcctttgacaagatccagaacaactggagctatggagaaaatattgatgaggagctgaagacccaccccatgctgcggccctacaagaccttcagcgagaaggacaaggagatctaccgctggcccatcaaggagagcctgaaggccatgattgcctgggagtggaccatcgagaaggcccgggagggggaggaggagaagacagagaagaagaagaccaggaagatcagccagagcgcccagacctatgacccccgggagggctacaacccccagcccccagacctgtctgctgtgaccctgagccgggagctgcaggccatggccgagcagctggccgagaactaccacaacacctggggcaggaagaagaagcaggagctggaggccaagggcggcggcacccaccccctgctggtgccctatgacaccctgacagccaaggagaaggcccgggaccgggagaaggcccaggagctgctgaagttcctgcagatgaatggctatgctgtgacccggggcctgaaggacatggagctggacagcagcagcattgagaagagatttgccttcggcttcctgcagcagctgctgcgctggatggacatcagccaggagttcatcgcccacctggaggccgtggtgagcagcggccgggtggagaagagcccccatgagcaggagatcaagttctttgccaagatcctgctgcccctcatcaaccagtacttcaccaaccactgcctgtacttcctgagcaccccagccaaggtgctgggcagcggcggccacgccagcaacaaggagaaggagatgatcaccagcctcttctgcaagctggccgccctggtgcgccaccgggtgtccctgtttggaacagatgccccagctgtggtgaactgcctgcacatcctggcccggagcctggatgccaggacagtgatgaagagcggccctgagatcgtgaaggccggcctgcggagcttctttgagagcgcctctgaagatattgagaagatggtggagaacctgcggctgggcaaggtgtcccaggcccggacccaggtgaagggcgtgggccagaacctgacctacaccaccgtggccctgctgcctgtgctgaccaccctcttccagcacatcgcccagcaccagtttggagatgatgtgatcctggatgatgtgcaggtgtcctgctaccgcaccctgtgcagcatctacagcctgggcaccaccaagaacacctacgtggagaagctgcggcctgccctgggggagtgcctggcccggctggccgccgccatgcctgtggccttcctggagccccagctgaatgagtacaatgcctgcagcgtgtacaccaccaagagcccccgggagcgggccatcctgggcctgcccaacagcgtggaggagatgtgcccagacatccctgtgctggagcggctgatggctgacattggaggcctggccgagagcggggcccgctacacagagatgccccacgtgattgagatcaccctgcccatgctgtgcagctacctgccccgctggtgggagcggggccctgaggccccacccagcgccctgcctgctggggcccccccaccctgcacagctgtgaccagtgaccacctgaacagcctgctgggcaacatcctgcgcatcatcgtgaacaacctgggcattgatgaggcctcctggatgaagaggctggccgtgtttgcccagcccatcgtgtcccgggcccggcctgagctgctgcagagccacttcatccccaccatcggccgcctgaggaagagagctgggaaggtggtgtctgaggaggagcagctgcggctggaggccaaggccgaggcccaggagggggagctgctggtgagagatgagttctctgtgctgtgccgggacctgtatgccctgtaccccctgctgatccgctacgtggacaacaacagagcccagtggctgacagagcccaaccccagcgctgaggagctgttcaggatggtgggggagatcttcatctactggagcaagagccacaacttcaagcgggaggagcagaactttgtggtgcagaatgagatcaacaacatgtccttcctgacagctgacaacaagagcaagatggccaaggccggggacatccagagcggcggcagtgaccaggagaggaccaagaagaagagaagaggagaccgctacagcgtgcagaccagcctcatcgtggccaccctgaagaagatgctgcccatcggcctgaacatgtgtgcccccacagaccaggacctgatcaccctggccaagaccaggtatgccctgaaggacacagatgaggaggtgcgggagttcctgcacaacaacctgcacctgcagggcaaggtggagggcagccccagcctgcgctggcagatggccctgtaccggggcgtgcccggccgggaggaggatgctgatgatcctgagaagatcgtgcggcgggtgcaggaggtgtctgctgtgctgtactacctggaccagacagagcacccctacaagagcaagaaggctgtgtggcacaagctgctgagcaagcagaggagaagagctgtggtggcctgcttcaggatgacccccctgtacaacctgcccacccaccgggcctgcaacatgttcctggagagctacaaggccgcctggatcctgacagaggaccacagctttgaggacaggatgattgatgacctgagcaaggccggggagcaggaggaggaggaggaggaggtggaggagaagaagccagaccccctgcaccagctggtgctgcacttcagcaggacagccctgacagagaagagcaagctggatgaggactacctgtacatggcctatgctgacatcatggccaagagctgccacctggaggagggcggggagaatggagaggccgaggaggaggtggaggtgtcctttgaggagaagcagatggagaagcagaggctgctgtaccagcaggcccggctgcacaccagaggagctgctgagatggtgctgcagatgatcagcgcctgcaagggggagactggagccatggtgagcagcaccctgaagctgggcatcagcatcctgaatggaggaaatgctgaggtgcagcagaagatgctggactacctgaaggacaagaaggaggtgggcttcttccagagcatccaggccctgatgcagacctgcagcgtgctggacctgaatgcctttgagcggcagaacaaggccgagggcctgggcatggtgaatgaagatggcaccgtgggggagaaggtgatggctgatgatgagttcacccaggacctcttccgcttcctgcagctgctgtgtgagggccacaacaatgacttccagaactacctgcggacccagacaggcaacaccaccaccatcaacatcatcatctgcaccgtggactacctgctgcggctgcaggagagcatcagtgacttctactggtactacagcggcaaggatgtgattgaggagcagggcaagaggaacttcagcaaggccatgtctgtggccaagcaggtgttcaacagcctgacagagtacatccagggcccctgcaccggcaaccagcagagcctggcccacagccggctgtgggatgctgtggtgggcttcctgcacgtgtttgcccacatgatgatgaagctggcccaggacagcagccagatcgagctgctgaaggagctgctggacctgcagaaggacatggtggtgatgctgctgagcctgctggagggcaatgtggtgaatggcatgattgcccggcagatggtggacatgctggtggagagcagcagcaatgtggagatgatcctgaagttctttgacatgttcctgaagctgaaggacatcgtgggcagcgaggccttccaggactatgtgacagacccccggggcctcatcagcaagaaggacttccagaaggccatggacagccagaagcagttcagcggccctgagatccagttcctgctgagctgcagcgaggctgatgaaaatgagatgatcaactgtgaggagtttgccaaccgcttccaggagcccgcccgggacatcggcttcaacgtggccgtgctgctgaccaacctgtctgaacatgtgccccatgacccccggctgcacaacttcctggagctggccgagagcatcctggagtacttccggccctacctgggcagaattgagatcatgggcgccagccgccgcatcgagcgcatctactttgagatcagcgagaccaacagagcccagtgggagatgccccaggtgaaggagagcaagaggcagttcatctttgatgtggtgaatgaaggaggagaggccgagaagatggagctgtttgtgtccttctgtgaggacaccatctttgagatgcagattgctgcccagatcagcgagcctgagggggagcctgagacagatgaagatgaaggagctggagctgctgaggccggggctgagggcgctgaggagggcgctgctggcctggagggcacagctgccacagctgctgctggggccacagcccgggtggtggccgccgccggccgggccctgcggggcctgagctaccgcagcctgcggcggcgggtgcggcggctgcggcggctgacagcccgggaggccgccacagctgtggccgccctgctgtgggccgctgtgacccgggccggggctgctggagctggagctgctgctggggccctgggcctgctgtggggcagcctgtttggaggcggcctggtggagggcgccaagaaggtgacagtgacagagctgctggccggcatgccagaccccaccagtgatgaggtgcatggagagcagcctgctggccctggaggagatgctgatggagagggcgccagcgagggcgctggagatgctgctgagggcgctggagatgaggaggaggccgtgcatgaggccggccctgggggcgcagatggagctgtggccgtgacagatggcggccccttccggcctgagggcgctgggggcctgggggacatgggagacaccaccccagctgagccccccaccccagagggcagccccatcctgaagaggaagctgggcgtggatggagtggaggaggagctgcccccagagcctgagcctgagcctgagcctgagctggagcctgagaaggcagatgctgaaaatggagagaaggaggaggtgcctgagcccaccccagagccccccaagaagcaggccccacccagccccccacccaagaaggaggaggccggcggggagttctggggcgagctggaggtgcagagggtgaagttcctgaactacctgagcaggaacttctacaccctgcgcttcctggccctcttcctggcctttgccatcaacttcatcctgctcttctacaaggtgtctgacagccccccaggagaagatgacatggagggcagcgctgctggagatgtgtctggagctggcagcggcggcagcagcggctggggcctgggcgctggggaggaggccgagggagatgaagatgagaacatggtgtactacttcctggaggagagcacaggctacatggagcccgccctgcgctgcctgagcctgctgcacaccctggtggccttcctgtgcatcatcggctacaactgcctgaaggtgcccctggtgatcttcaagcgggagaaggagctggccaggaagctggagtttgatggcctgtacatcacagagcagccagaagatgatgatgtgaagggccagtgggaccggctggtgctgaacacccccagcttccccagcaactactgggacaagtttgtgaagaggaaggtgctggacaagcacggggacatctacggccgggagagaattgctgagctgctgggcatggacctggccaccctggagatcacagcccacaatgaaaggaagcccaaccccccacctggcctgctgacctggctgatgagcattgatgtgaagtaccagatctggaagtttggagtcatcttcacagacaacagcttcctgtacctgggctggtacatggtgatgagcctgctgggccactacaacaacttcttctttgctgcccacctgctggacatcgccatgggcgtgaagaccctgcggaccatcctgagctctgtgacccacaacgggaagcagctggtgatgacagtgggcctgctggccgtggtggtgtacctgtacacagtggtggccttcaacttcttcaggaagttctacaacaagtcagaagatgaagatgagccagacatgaagtgtgatgacatgatgacctgctacctgttccacatgtatgtgggcgtgcgggccggcggcggcattggagatgaaattgaggaccctgctggagatgaatatgagctgtacagagtggtgtttgacatcaccttcttcttctttgtgattgtcatcctgctggccatcatccagggcctcatcattgatgccttcggggagctgcgggaccagcaggagcaggtgaaggaggacatggagaccaagtgcttcatctgtggcattggaagtgactactttgacaccacccctcatggctttgagacccacaccctggaggagcacaacctggccaactacatgttcttcctgatgtacctgatcaacaaggatgaaacagagcacacaggccaggagagctatgtgtggaagatgtaccaggagcgctgctgggacttcttccctgctggggactgcttcaggaagcagtatgaggaccagctgtcctag

SEQ ID NO: 168706 - DNA, 2031 bp, Artificial Sequence
  Description of Artificial Sequence: Synthetic coding sequence
atgaagagcggccctgagatcgtgaaggccggcctgcggagcttctttgagagcgcctctgaagatattgagaagatggtggagaacctgcggctgggcaaggtgtcccaggcccggacccaggtgaagggcgtgggccagaacctgacctacaccaccgtggccctgctgcctgtgctgaccaccctcttccagcacatcgcccagcaccagtttggagatgatgtgatcctggatgatgtgcaggtgtcctgctaccgcaccctgtgcagcatctacagcctgggcaccaccaagaacacctacgtggagaagctgcggcctgccctgggggagtgcctggcccggctggccgccgccatgcctgtggccttcctggagccccagctgaatgagtacaatgcctgcagcgtgtacaccaccaagagcccccgggagcgggccatcctgggcctgcccaacagcgtggaggagatgtgcccagacatccctgtgctggagcggctgatggctgacattggaggcctggccgagagcggggcccgctacacagagatgccccacgtgattgagatcaccctgcccatgctgtgcagctacctgccccgctggtgggagcggggccctgaggccccacccagcgccctgcctgctggggcccccccaccctgcacagctgtgaccagtgaccacctgaacagcctgctgggcaacatcctgcgcatcatcgtgaacaacctgggcattgatgaggcctcctggatgaagaggctggccgtgtttgcccagcccatcgtgtcccgggcccggcctgagctgctgcagagccacttcatccccaccatcggccgcctgaggaagagagctgggaaggtggtgtctgaggaggagcagctgcggctggaggccaaggccgaggcccaggagggggagctgctggtgagagatgagttctctgtgctgtgccgggacctgtatgccctgtaccccctgctgatccgctacgtggacaacaacagagcccagtggctgacagagcccaaccccagcgctgaggagctgttcaggatggtgggggagatcttcatctactggagcaagagccacaacttcaagcgggaggagcagaactttgtggtgcagaatgagatcaacaacatgtccttcctgacagctgacaacaagagcaagatggccaaggccggggacatccagagcggcggcagtgaccaggagaggaccaagaagaagagaagaggagaccgctacagcgtgcagaccagcctcatcgtggccaccctgaagaagatgctgcccatcggcctgaacatgtgtgcccccacagaccaggacctgatcaccctggccaagaccaggtatgccctgaaggacacagatgaggaggtgcgggagttcctgcacaacaacctgcacctgcagggcaaggtggagggcagccccagcctgcgctggcagatggccctgtaccggggcgtgcccggccgggaggaggatgctgatgatcctgagaagatcgtgcggcgggtgcaggaggtgtctgctgtgctgtactacctggaccagacagagcacccctacaagagcaagaaggctgtgtggcacaagctgctgagcaagcagaggagaagagctgtggtggcctgcttcaggatgacccccctgtacaacctgcccacccaccgggcctgcaacatgttcctggagagctacaaggccgcctggatcctgacagaggaccacagctttgaggacaggatgattgatgacctgagcaaggccggggagcaggaggaggaggaggaggaggtggaggagaagaagccagaccccctgcaccagctggtgctgcacttcagcaggacagccctgacagagaagagcaagctggatgaggactacctgtacatggcctatgctgacatcatggccaagagctgccacctggaggagggcggggagaatggagaggccgaggaggaggtggaggtgtcctttgaggagaagcagtag

SEQ ID NO: 168707 - DNA, 14922 bp, Artificial Sequence
  Description of Artificial Sequence: Synthetic coding sequence
ctgggccccaggagcagcagcaacaagctgagcaacaagaagatgatgaagtggttctgcagcgccccccagcccagcaccaagaacaacagaagctatgcctggcagcagaaggacctggccacagactttgtgtcctggagccccctgcccatccccaggatgtgcccccagaccagccccagcgcccccctgtgctggagcagccccagcctgagcggccgctgccgccgctgctggctgaccccctggaggaaccagaagggccagctggacatcatcaagtggagctttggcctgaagacagcccagggcggcggccacaggaccctgctgtatggccacgccatcctgctgcggcacagctacagcggcatgtacctgtgctgcctgagcaccagccgcagcagcacagacaagctggcctttgatgtgggcctgcaggaggacaccaccggggaggcctgctggtggaccatccacccagccagcaagcagaggtctgagggggagaaggtgcgggtgggagatgacctgatcctggtgtctgtgagcagcgagcgctacctgcacctgtcctatggaaatggcagcctgcacgtggatgctgccttccagcagaccctgtggagcgtggcccccatcagcagcggcagcgaggccgcccagggctacctgattggaggagatgtgctgcggctgctgcacggccacatggatgaatgtctgactgtgcccagcggggagcacggggaggagcagaggagaacagtgcactatgagggcggcgctgtgtctgtgcacgcccggagcctgtggaggctggagaccctgcgggtggcctggagcggcagccacatccgctggggccagcccttccggctgcggcacgtgaccaccgggaagtacctgagcctgatggaggacaagaacctgctgctgatggacaaggagaaggcagatgtgaagagcacagccttcaccttccgcagcagcaaggagaagctggatgtgggcgtgaggaaggaggtggatggcatgggcaccagcgagatcaagtacggggacagcgtgtgctacatccagcacgtggacaccggcctgtggctgacctaccagagcgtggatgtgaagtctgtgaggatgggcagcatccagaggaaggccatcatgcaccacgagggccacatggatgatggcatcagcctgagccgcagccagcacgaggagagcaggacagcccgggtcatccgcagcaccgtcttcctgttcaaccgcttcatccggggcctggatgccctgagcaagaaggccaaggccagcacagtggacctgcccattgaatctgtgtccctgagcctgcaggacctgattggctacttccaccccccagatgagcacctggagcacgaggacaagcagaaccggctgcgggccctgaagaaccggcagaacctcttccaggaggagggcatgatcaacctggtgctggagtgcatcgaccggctgcacgtgtacagcagcgctgcccactttgctgatgtggccggccgggaggccggggagagctggaagagcatcctgaacagcctgtatgagctgctggccgccctgatccggggcaacaggaagaactgtgcccagttcagcggcagcctggactggctgatcagccggctggagcggctggaggccagcagcggcatcctggaggtgctgcactgtgtgctggtggagagccctgaggccctgaacatcatcaaggagggccacatcaagagcatcatcagcctgctggacaagcacggcaggaaccacaaggtgctggatgtgctgtgcagcctgtgtgtgtgccacggcgtggccgtgcgcagcaaccagcacctgatctgtgacaacctgctgcccggccgggacctgctgctgcagacccggctggtgaaccacgtgtcctccatgaggcccaacatcttcctgggcgtgtctgagggcagcgcccagtacaagaagtggtactatgagctgatggtggaccacacagagccctttgtgacagctgaggccacccacctgcgggtgggctgggccagcacagagggctacagcccctacccaggcggcggggaggagtggggcggcaatggagtgggagatgacctcttctcctatggctttgatggcctgcacctgtggagcggctgcatcgccaggacagtgagcagccccaaccagcacctgctgaggacagatgatgtgatcagctgctgcctggacctgagcgcccccagcatctccttccgcatcaatggccagcctgtgcagggcatgtttgagaacttcaacattgatggcctcttcttccctgtggtgtccttctctgctggcatcaaggtgcgcttcctgctgggcggccgccacggggagttcaagttcctgcccccacctggctacgccccctgctatgaagctgtgctgcccaaggagaagctgaaggtggagcacagccgggagtacaagcaggagaggacctacacccgggacctgctgggccccaccgtgtccctgacccaggccgccttcacccccatccctgtggacaccagccagatcgtgctgcccccccacctggagcgcatccgggagaagctggccgagaacatccacgagctgtgggtgatgaacaagattgagctgggctggcagtatggccctgtgagagatgacaacaagaggcagcacccctgcctggtggagttcagcaagctgcctgagcaggagaggaactacaacctgcagatgagcctggagaccctgaagaccctgctggccctgggctgccacgtgggcatcagtgatgagcacgccgaggacaaggtgaagaagatgaagctgcccaagaactaccagctgaccagcggctacaagccagcccccatggacctgtccttcatcaagctgacccccagccaggaggccatggtggacaagctggctgaaaatgcccacaacgtgtgggcccgggaccgcatccggcagggctggacctacggcatccagcaggatgtgaagaacagaagaaacccccggctggtgccctacaccctgctggatgacaggaccaagaagagcaacaaggacagcctgcgggaggccgtgaggaccctgctgggctacggctacaacctggaggccccagaccaggaccacgccgcccgggcagaggtgtgcagcggcactggagagcgcttccgcatcttccgggcagagaagacctatgctgtgaaggccggccgctggtactttgaatttgaaacagtgacagctggggacatgagggtgggctggagccggcccggctgccagcctgaccaggagctgggcagtgatgagcgggcctttgcctttgatggcttcaaggcccagcgctggcaccagggcaatgagcactacggccgctcctggcaggccggagatgtggtgggctgcatggtggacatgaatgagcacaccatgatgttcaccctgaatggagagatcctgctggatgacagcggcagcgagctggccttcaaggactttgatgtgggagatggcttcatccctgtgtgcagcctgggcgtggcccaggtgggccgcatgaactttgggaaggatgtgtccaccctgaagtacttcaccatctgtggcctgcaggagggctatgagccctttgctgtgaacaccaacagagacatcaccatgtggctgagcaagaggctgccccagttcctgcaggtgcccagcaaccacgagcacatcgaggtgaccagaattgatggcaccatcgacagcagcccctgcctgaaggtgacccagaagagctttggcagccagaacagcaacacagacatcatgttctaccgcctgtccatgcccattgaatgtgccgaggtgttcagcaagacagtggccggcggcctgcctggagctggcctgtttggccccaagaatgacctggaggactatgatgctgacagcgactttgaggtgctgatgaagacagcccacggccacctggtgcctgacagagtggacaaggacaaggaggccaccaagccagagttcaacaaccacaaggactatgcccaggagaagcccagccggctgaagcagcgcttcctgctgcggaggaccaagccagactacagcaccagccacagcgcccggctgacagaagatgtgctggctgatgacagagatgattatgacttcctgatgcagaccagcacctactactacagcgtgcgcatcttccctggccaggagcccgccaacgtgtgggtgggctggatcaccagtgacttccaccagtatgacaccggctttgacctggacagagtgaggacagtgacagtgaccctgggagatgagaagggcaaggtgcatgagagcatcaagaggagcaactgctacatggtgtgtgccggggagagcatgagccctggccagggcaggaacaacaacggcctggagatcggctgtgtggtggatgctgccagcggcctgctgaccttcatcgccaacgggaaggagctgagcacctactaccaggtggagcccagcaccaagctgtttcctgctgtgtttgcccaggccaccagccccaacgtgttccagtttgagctgggccgcatcaagaatgtgatgcccctgtctgctggcctcttcaagtctgagcacaagaaccctgtgccccagtgccccccccggctgcacgtgcagttcctgagccacgtgctgtggagcaggatgcccaaccagttcctgaaggtggatgtgagccgcatcagcgagcggcagggctggctggtgcagtgcctggaccccctgcagttcatgagcctgcacatcccagaagaaaatagatctgtggacatcctggagctgacagagcaggaggagctgctgaagttccactaccacaccctgcggctgtacagcgctgtgtgtgccctgggcaaccaccgggtggcccacgccctgtgcagccacgtggatgagccccagctgctgtatgccatcgagaacaagtacatgcctggcctgctgcgggccggctactatgacctgctgattgacatccacctgagcagctatgccacagcccggctgatgatgaacaatgagtacatcgtgcccatgacagaggagaccaagagcatcaccctcttcccagatgagaacaagaagcacggcctgcccggcatcggcctgagcaccagcctgcggcccaggatgcagttcagcagccccagctttgtgtccatcagcaatgaatgctaccagtacagccctgagttccccctggacatcctgaagagcaagaccatccagatgctgacagaggccgtgaaggagggcagcctgcacgcccgggaccctgtgggcggcaccacagagttcctgtttgtgcccctcatcaagctgttctacaccctgctgatcatgggcatcttccacaatgaagacctgaagcacatcctgcagctgattgagcccagcgtcttcaaggaggccgccaccccagaggaggagagtgacaccctggagaaggagctgtctgtggatgatgccaagctgcagggcgctggggaggaggaggccaagggcggcaagaggcccaaggagggcctgctgcagatgaagctgcctgagcctgtgaagctgcagatgtgcctgctgctgcagtacctgtgtgactgccaggtgcgccaccgcatcgaggccatcgtggccttcagtgatgactttgtggccaagctgcaggacaaccagcgcttccgctacaatgaggtgatgcaggccctgaacatgtctgctgccctgacagccaggaagaccaaggagttccgcagccccccccaggagcagatcaacatgctgctgaacttcaaggatgacaagtcagaatgtccctgcccagaggagatccgggaccagctgctggacttccacgaggacctgatgacccactgcggcatcgagctggatgaagatggcagcctggatggcaacagcgacctgaccatccggggccgcctgctgagcctggtggagaaggtgacctacctgaagaagaagcaggccgagaagcctgtggagagtgacagcaagaagagcagcaccctgcagcagctgatcagcgagaccatggtgcgctgggcccaggagagcgtgattgaggaccctgagctggtgcgggccatgtttgtgctgctgcaccggcagtatgatggcattggaggcctggtgcgggccctgcccaagacctacaccatcaatggagtgtctgtggaggacaccatcaacctgctggccagcctgggccagatccgcagcctgctgtctgtgaggatgggcaaggaggaggagaagctgatgatccggggcctgggggacatcatgaacaacaaggtgttctaccagcaccccaacctgatgagggccctgggcatgcatgagaccgtgatggaggtgatggtgaatgtgctgggcggcggggagagcaaggagatcaccttccccaagatggtggccaactgctgccgcttcctgtgctacttctgccgcatcagccggcagaaccagaaggccatgtttgaccacctgagctacctgctggagaacagctctgtgggcctggccagccctgccatgaggggcagcacccccctggatgtggccgccgcctctgtgatggacaacaatgagctggccctggccctgcgggagccagacctggagaaggtggtgcgctacctggccggctgcggcctgcagagctgccagatgctggtgtccaagggctacccagacatcggctggaaccctgtggagggggagcgctacctggacttcctgcgctttgctgtgttctgcaatggagagagcgtggaggagaatgccaacgtggtggtgcggctgctgatccggcggccagaatgttttggacctgccctgcggggggagggcggcaatggcctgctggccgccatggaggaggccatcaagattgctgaggaccccagcagagatggccccagccccaacagcggcagcagcaagaccctggacacagaggaggaggaggatgacaccatccacatgggaaatgccatcatgaccttctacagcgccctgattgacctgctgggccgctgtgcccctgagatgcacctgattcatgctggaaaaggagaggccatccgcatccgcagcatcctgcggagcctcatccccctgggggacctggtgggcgtcatcagcatcgccttccagatgcccaccatcgccaaggatggaaatgtggtggagccagacatgtctgctggcttctgcccagaccacaaggccgccatggtgctcttcctggacagagtgtatggcatcgaggtgcaggacttcctgctgcacctgctggaggtgggcttcctgcctgacctgcgggctgctgccagcctggacacagctgccctgagcgccacagacatggccctggccctgaaccgctacctgtgcacagctgtgctgcccctgctgacccgctgtgcccccctgtttgctggaacagagcaccacgccagcctgattgacagcctgctgcacacagtgtaccgcctgagcaagggctgcagcctgaccaaggcccagagggacagcattgaggtgtgcctgctgagcatctgtggccagctgcggcccagcatgatgcagcacctgctgcggcggctggtgtttgatgtgcccctgctgaatgagcacgccaagatgcccctgaagctgctgaccaaccactatgagcgctgctggaagtactactgcctgcccggcggctggggcaactttggagctgccagcgaggaggagctgcacctgagcaggaagctgttctggggcatctttgatgccctgagccagaagaagtatgagcaggagctgttcaagctggccctgccctgcctgtctgctgtggccggggccctgcccccagactacatggagagcaactacgtgtccatgatggagaagcagagctccatggattctgagggcaacttcaacccccagcctgtggacaccagcaacatcaccatccctgagaagctggagtacttcatcaacaagtatgcagagcacagccatgacaagtggagcatggacaagctggccaacggctggatctatggagagatctacagcgacagcagcaaggtgcagcccctgatgaagccctacaagctgctgtctgagaaggagaaggagatctaccgctggcccatcaaggagagcctgaagaccatgctggcctggggctggagaattgaaagaacccgggagggggacagcatggccctgtacaacagaacaagacgcatcagccagaccagccaggtgtctgtggatgctgcccacggctacagcccccgggccatcgacatgagcaatgtgaccctgagccgggacctgcacgccatggccgagatgatggccgagaactaccacaacatctgggccaagaagaagaagatggagctggagagcaaaggaggcggcaaccaccccctgctggtgccctatgacaccctgacagccaaggagaaggccaaggaccgggagaaggcccaggacatcctgaagttcctgcagatcaatggctatgctgtgtcccggggcttcaaggacctggagctggacacccccagcattgagaagagatttgcctacagcttcctgcagcagctgatccgctacgtggatgaggcccaccagtacatcctggagtttgatggcggcagccggggcaagggggagcacttcccctatgagcaggagatcaagttctttgccaaggtggtgctgcccctgattgaccagtacttcaagaaccaccggctgtacttcctgtctgctgccagccggcccctgtgcagcggcggccacgccagcaacaaggagaaggagatggtgaccagcctcttctgcaagctgggcgtgctggtgcgccaccgcatcagcctgtttggaaatgatgccaccagcatcgtgaactgcctgcacatcctgggccagaccctggatgccaggacagtgatgaagacaggcctggagagcgtgaagagcgccctgcgggccttcctggacaatgctgctgaggacctggagaagaccatggagaacctgaagcagggccagttcacccacaccaggaaccagcccaagggcgtgacccagatcatcaactacaccaccgtggccctgctgcccatgctgagcagcctgtttgagcacatcggccagcaccagtttggagaagatctcatcctggaggatgtgcaggtgtcctgctaccgcatcctgaccagcctgtatgccctgggcaccagcaagagcatctacgtggagcggcagaggtctgccctgggagaatgtctggccgcctttgctggggccttccctgtggccttcctggagacccacctggacaagcacaacatctacagcatctacaacaccaagagcagccgggagagagctgccctgagcctgcccaccaacgtggaggatgtgtgccccaacatccccagcctggagaagctgatggaggagatcgtggagctggccgagagcggcatccgctacacccagatgcctcatgtgatggaggtgatcctgcccatgctgtgcagctacatgagccgctggtgggagcacggccctgagaacaaccctgagagagctgagatgtgctgcacagccctgaacagcgagcacatgaacaccctgctgggcaacatcctgaagatcatctacaacaacctgggcattgatgaaggagcctggatgaagaggctggccgtgttcagccagcccatcatcaacaaggtgaagccccagctgctgaagacccacttcctgcccctgatggagaagctgaagaagaaggccgccaccgtggtgtctgaggaggaccacctgaaggccgaggcccggggggacatgtctgaggccgagctgctgatcctggatgagttcaccaccctggcccgggacctgtatgccttctaccccctgctgatccgctttgtggactacaacagagccaagtggctgaaggagcccaaccctgaggccgaggagctgttcaggatggtggccgaggtgttcatctactggagcaagagccacaacttcaagcgggaggagcagaactttgtggtgcagaatgagatcaacaacatgtccttcctgatcacagacaccaagagcaagatgagcaaggctgctgtgtctgaccaggagaggaagaagatgaagaggaaaggagaccgctacagcatgcagaccagcctcatcgtggccgccctgaagaggctgctgcccatcggcctgaacatctgtgcccctggggaccaggagctgattgccctggccaagaaccgcttcagcctgaaggacacagaagatgaggtgcgggacatcatccgcagcaacatccacctgcagggcaagctggaggaccctgccatccgctggcagatggccctgtacaaggacctgcccaacagaacagatgacaccagtgaccctgagaagacagtggagcgggtgctggacatcgccaacgtgctcttccacctggagcagaagagcaagagggtgggccgccgccactactgcctggtggagcacccccagaggagcaagaaggctgtgtggcacaagctgctgagcaagcagaggaagagagctgtggtggcctgcttcaggatggcccccctgtacaacctgcccaggcacagagctgtgaacctcttcctgcagggctatgagaagtcctggattgaaacagaggagcactactttgaggacaagctgattgaggacctggccaagccaggagctgagcccccagaggaggatgagggcaccaagagggtggaccccctgcaccagctgatcctgctcttcagcaggacagccctgacagagaagtgcaagctggaggaggacttcctgtacatggcctatgctgacatcatggccaagagctgccatgatgaagaagatgatgatggagaggaggaggtgaagagctttgaggtgacaggcagccagaggagcaaggagaaggagatggagaagcagaagctgctgtaccagcaggcccggctgcatgacagaggagctgctgagatggtgctgcagaccatcagcgccagcaagggggagaccggccccatggtggccgccaccctgaagctgggcatcgccatcctgaatggaggcaacagcacagtgcagcagaagatgctggactacctgaaggagaagaaggatgtgggcttcttccagagcctggccggcctgatgcagagctgcagcgtgctggacctgaatgcctttgagcggcagaacaaggccgagggcctgggcatggtgacagaggagggcagcggggagaaggtgctgcaggatgatgagttcacctgtgacctcttccgcttcctgcagctgctgtgtgagggccacaacagcgacttccagaactacctgcggacccagacaggcaacaacaccaccgtgaacatcatcatcagcacagtggactacctgctgcgggtgcaggagagcatcagtgacttctactggtactacagcggcaaggatgtgattgatgagcagggccagaggaacttcagcaaggccatccaggtggccaagcaggtgttcaacaccctgacagagtacatccagggcccctgcaccggcaaccagcagagcctggcccacagccggctgtgggatgctgtggtgggcttcctgcacgtgtttgcccacatgcagatgaagctgagccaggacagcagccagatcgagctgctgaaggagctgatggacctgcagaaggacatggtggtgatgctgctgtccatgctggagggcaatgtggtgaatggcaccatcggcaagcagatggtggacatgctggtggagagcagcaacaacgtggagatgatcctgaagttctttgacatgttcctgaagctgaaggacctgaccagcagtgacaccttcaaggagtatgaccctgatggcaagggcgtcatcagcaagagggacttccacaaggccatggagagccacaagcactacacccagagcgagacagagttcctgctgagctgtgccgagacagatgaaaatgagaccctggactatgaggagtttgtgaagcgcttccacgagcccgccaaggacatcggcttcaacgtggccgtgctgctgaccaacctgtctgagcacatgcccaatgacacccggctgcagaccttcctggagctggccgagagcgtgctgaactacttccagcccttcctgggccgcatcgagatcatgggcagcgccaagagaattgagcgggtgtactttgagatcagcgagagcagcaggacccagtgggagaagccccaggtgaaggagagcaagaggcagttcatctttgatgtggtgaatgaaggaggagagaaggagaagatggagctgtttgtgaacttctgtgaggacaccatctttgagatgcagctggccgcccagatcagcgagagtgacctgaatgaaagaagtgccaacaaggaggagagcgagaaggagaggcctgaggagcagggccccaggatggccttcttcagcatcctgactgtgcgcagcgccctgtttgccctgcgctacaacatcctgaccctgatgaggatgctgagcctgaagagcctgaagaagcagatgaagaaggtgaagaagatgacagtgaaggacatggtgacagccttcttcagcagctactggagcatcttcatgaccctgctgcactttgtggccagcgtcttccggggcttcttccgcatcatctgcagcctgctgctgggcggcagcctggtggagggcgccaagaagatcaaggtggccgagctgctggccaacatgccagaccccacccaggatgaggtgagaggagatggagaggagggggagaggaagcccctggaggccgccctgcccagcgaggacctgacagacctgaaggagctgacagaggagagtgacctgctgagtgacatcttcggcctggacctgaagcgggagggcggccagtacaagctgatcccccacaaccccaatgccggcctgagtgacctgatgagcaaccctgtgcccatgcctgaggtgcaggagaagttccaggagcagaaggccaaggaggaggagaaggaggagaaggaggagaccaagtctgagcctgagaaggccgagggagaagatggagagaaggaggagaaggccaaggaggacaagggcaagcagaagctgcggcagctgcacacccaccgctacggggagcctgaggtgcctgagagcgccttctggaagaagatcatcgcctaccagcagaagctgctgaactactttgccaggaacttctacaacatgaggatgctggccctgtttgtggcctttgccatcaacttcatcctgctcttctacaaggtgtccaccagctctgtggtggagggcaaggagctgcccaccaggagcagcagtgaaaatgccaaggtgaccagcctggacagcagcagccaccgcatcatcgctgtgcactacgtgctggaggagagcagcggctacatggagcccaccctgcgcatcctggccatcctgcacacagtcatctccttcttctgcatcatcggctactactgcctgaaggtgcccctggtgatcttcaagcgggagaaggaggtggccaggaagctggagtttgatggcctgtacatcacagagcagcccagtgaagatgacatcaagggccagtgggaccggctggtgatcaacacccagagcttccccaacaactactgggacaagtttgtgaagaggaaggtgatggacaagtatggagagttctacggccgggaccgcatcagcgagctgctgggcatggacaaggccgccctggacttcagtgatgcccgggagaagaagaagcccaagaaggacagcagcctgtctgctgtgctgaacagcattgatgtgaagtaccagatgtggaagctgggcgtggtgttcacagacaacagcttcctgtacctggcctggtacatgaccatgtctgtgctgggccactacaacaacttcttctttgctgcccacctgctggacatcgccatgggcttcaagaccctgcggaccatcctgagctctgtgacccacaacgggaagcagctggtgctgactgtgggcctgctggccgtggtggtgtacctgtacacagtggtggccttcaacttcttcaggaagttctacaacaagtcagaagatggagacaccccagacatgaagtgtgatgacatgctgacctgctacatgttccacatgtatgtgggcgtgcgggccggcggcggcattggagatgaaattgaggaccctgctggagatgaatatgagatctaccgcatcatctttgacatcaccttcttcttctttgtgattgtcatcctgctggccatcatccagggcctcatcattgatgccttcggggagctgcgggaccagcaggagcaggtgaaggaggacatggagaccaagtgcttcatctgtggcattggaaatgactactttgacacagtgccccacggctttgagacccacaccctgcaggagcacaacctggccaactacctgttcttcctgatgtacctgatcaacaaggatgaaacagagcacacaggccaggagagctatgtgtggaagatgtaccaggagcgctgctgggagttcttccctgctggggactgcttcaggaagcagtatgaggaccagctgaactag

SEQ ID NO: 168708 - DNA, 14904 bp, Artificial Sequence
  Description of Artificial Sequence: Synthetic coding sequence
atggctgatggaggagagggggaggatgagatccagttcctgaggacagatgatgaggtggtgctgcagtgcacagccaccatccacaaggagcagcagaagctgtgcctggccgctgagggcttcggcaaccggctgtgcttcctggagagcaccagcaacagcaagaatgtgcccccagacctgagcatctgcacctttgtgctggagcagagcctgtctgtgcgggccctgcaggagatgctggccaacacagtggagaagtctgagggccaggtggatgtggagaagtggaagttcatgatgaagacagcccagggcggcggccacaggaccctgctgtatggccacgccatcctgctgcggcacagctacagcggcatgtacctgtgctgcctgagcaccagccgcagcagcacagacaagctggcctttgatgtgggcctgcaggaggacaccaccggggaggcctgctggtggaccatccacccagccagcaagcagaggtctgagggggagaaggtgcgggtgggagatgacctgatcctggtgtctgtgagcagcgagcgctacctgcacctgtcctatggaaatggcagcctgcacgtggatgctgccttccagcagaccctgtggagcgtggcccccatcagcagcggcagcgaggccgcccagggctacctgattggaggagatgtgctgcggctgctgcacggccacatggatgaatgtctgactgtgcccagcggggagcacggggaggagcagaggagaacagtgcactatgagggcggcgctgtgtctgtgcacgcccggagcctgtggaggctggagaccctgcgggtggcctggagcggcagccacatccgctggggccagcccttccggctgcggcacgtgaccaccgggaagtacctgagcctgatggaggacaagaacctgctgctgatggacaaggagaaggcagatgtgaagagcacagccttcaccttccgcagcagcaaggagaagctggatgtgggcgtgaggaaggaggtggatggcatgggcaccagcgagatcaagtacggggacagcgtgtgctacatccagcacgtggacaccggcctgtggctgacctaccagagcgtggatgtgaagtctgtgaggatgggcagcatccagaggaaggccatcatgcaccacgagggccacatggatgatggcatcagcctgagccgcagccagcacgaggagagcaggacagcccgggtcatccgcagcaccgtcttcctgttcaaccgcttcatccggggcctggatgccctgagcaagaaggccaaggccagcacagtggacctgcccattgaatctgtgtccctgagcctgcaggacctgattggctacttccaccccccagatgagcacctggagcacgaggacaagcagaaccggctgcgggccctgaagaaccggcagaacctcttccaggaggagggcatgatcaacctggtgctggagtgcatcgaccggctgcacgtgtacagcagcgctgcccactttgctgatgtggccggccgggaggccggggagagctggaagagcatcctgaacagcctgtatgagctgctggccgccctgatccggggcaacaggaagaactgtgcccagttcagcggcagcctggactggctgatcagccggctggagcggctggaggccagcagcggcatcctggaggtgctgcactgtgtgctggtggagagccctgaggccctgaacatcatcaaggagggccacatcaagagcatcatcagcctgctggacaagcacggcaggaaccacaaggtgctggatgtgctgtgcagcctgtgtgtgtgccacggcgtggccgtgcgcagcaaccagcacctgatctgtgacaacctgctgcccggccgggacctgctgctgcagacccggctggtgaaccacgtgtcctccatgaggcccaacatcttcctgggcgtgtctgagggcagcgcccagtacaagaagtggtactatgagctgatggtggaccacacagagccctttgtgacagctgaggccacccacctgcgggtgggctgggccagcacagagggctacagcccctacccaggcggcggggaggagtggggcggcaatggagtgggagatgacctcttctcctatggctttgatggcctgcacctgtggagcggctgcatcgccaggacagtgagcagccccaaccagcacctgctgaggacagatgatgtgatcagctgctgcctggacctgagcgcccccagcatctccttccgcatcaatggccagcctgtgcagggcatgtttgagaacttcaacattgatggcctcttcttccctgtggtgtccttctctgctggcatcaaggtgcgcttcctgctgggcggccgccacggggagttcaagttcctgcccccacctggctacgccccctgctatgaagctgtgctgcccaaggagaagctgaaggtggagcacagccgggagtacaagcaggagaggacctacacccgggacctgctgggccccaccgtgtccctgacccaggccgccttcacccccatccctgtggacaccagccagatcgtgctgcccccccacctggagcgcatccgggagaagctggccgagaacatccacgagctgtgggtgatgaacaagattgagctgggctggcagtatggccctgtgagagatgacaacaagaggcagcacccctgcctggtggagttcagcaagctgcctgagcaggagaggaactacaacctgcagatgagcctggagaccctgaagaccctgctggccctgggctgccacgtgggcatcagtgatgagcacgccgaggacaaggtgaagaagatgaagctgcccaagaactaccagctgaccagcggctacaagccagcccccatggacctgtccttcatcaagctgacccccagccaggaggccatggtggacaagctggctgaaaatgcccacaacgtgtgggcccgggaccgcatccggcagggctggacctacggcatccagcaggatgtgaagaacagaagaaacccccggctggtgccctacaccctgctggatgacaggaccaagaagagcaacaaggacagcctgcgggaggccgtgaggaccctgctgggctacggctacaacctggaggccccagaccaggaccacgccgcccgggcagaggtgtgcagcggcactggagagcgcttccgcatcttccgggcagagaagacctatgctgtgaaggccggccgctggtactttgaatttgaaacagtgacagctggggacatgagggtgggctggagccggcccggctgccagcctgaccaggagctgggcagtgatgagcgggcctttgcctttgatggcttcaaggcccagcgctggcaccagggcaatgagcactacggccgctcctggcaggccggagatgtggtgggctgcatggtggacatgaatgagcacaccatgatgttcaccctgaatggagagatcctgctggatgacagcggcagcgagctggccttcaaggactttgatgtgggagatggcttcatccctgtgtgcagcctgggcgtggcccaggtgggccgcatgaactttgggaaggatgtgtccaccctgaagtacttcaccatctgtggcctgcaggagggctatgagccctttgctgtgaacaccaacagagacatcaccatgtggctgagcaagaggctgccccagttcctgcaggtgcccagcaaccacgagcacatcgaggtgaccagaattgatggcaccatcgacagcagcccctgcctgaaggtgacccagaagagctttggcagccagaacagcaacacagacatcatgttctaccgcctgtccatgcccattgaatgtgccgaggtgttcagcaagacagtggccggcggcctgcctggagctggcctgtttggccccaagaatgacctggaggactatgatgctgacagcgactttgaggtgctgatgaagacagcccacggccacctggtgcctgacagagtggacaaggacaaggaggccaccaagccagagttcaacaaccacaaggactatgcccaggagaagcccagccggctgaagcagcgcttcctgctgcggaggaccaagccagactacagcaccagccacagcgcccggctgacagaagatgtgctggctgatgacagagatgattatgacttcctgatgcagaccagcacctactactacagcgtgcgcatcttccctggccaggagcccgccaacgtgtgggtgggctggatcaccagtgacttccaccagtatgacaccggctttgacctggacagagtgaggacagtgacagtgaccctgggagatgagaagggcaaggtgcatgagagcatcaagaggagcaactgctacatggtgtgtgccggggagagcatgagccctggccagggcaggaacaacaacggcctggagatcggctgtgtggtggatgctgccagcggcctgctgaccttcatcgccaacgggaaggagctgagcacctactaccaggtggagcccagcaccaagctgtttcctgctgtgtttgcccaggccaccagccccaacgtgttccagtttgagctgggccgcatcaagaatgtgatgcccctgtctgctggcctcttcaagtctgagcacaagaaccctgtgccccagtgccccccccggctgcacgtgcagttcctgagccacgtgctgtggagcaggatgcccaaccagttcctgaaggtggatgtgagccgcatcagcgagcggcagggctggctggtgcagtgcctggaccccctgcagttcatgagcctgcacatcccagaagaaaatagatctgtggacatcctggagctgacagagcaggaggagctgctgaagttccactaccacaccctgcggctgtacagcgctgtgtgtgccctgggcaaccaccgggtggcccacgccctgtgcagccacgtggatgagccccagctgctgtatgccatcgagaacaagtacatgcctggcctgctgcgggccggctactatgacctgctgattgacatccacctgagcagctatgccacagcccggctgatgatgaacaatgagtacatcgtgcccatgacagaggagaccaagagcatcaccctcttcccagatgagaacaagaagcacggcctgcccggcatcggcctgagcaccagcctgcggcccaggatgcagttcagcagccccagctttgtgtccatcagcaatgaatgctaccagtacagccctgagttccccctggacatcctgaagagcaagaccatccagatgctgacagaggccgtgaaggagggcagcctgcacgcccgggaccctgtgggcggcaccacagagttcctgtttgtgcccctcatcaagctgttctacaccctgctgatcatgggcatcttccacaatgaagacctgaagcacatcctgcagctgattgagcccagcgtcttcaaggaggccgccaccccagaggaggagagtgacaccctggagaaggagctgtctgtggatgatgccaagctgcagggcgctggggaggaggaggccaagggcggcaagaggcccaaggagggcctgctgcagatgaagctgcctgagcctgtgaagctgcagatgtgcctgctgctgcagtacctgtgtgactgccaggtgcgccaccgcatcgaggccatcgtggccttcagtgatgactttgtggccaagctgcaggacaaccagcgcttccgctacaatgaggtgatgcaggccctgaacatgtctgctgccctgacagccaggaagaccaaggagttccgcagccccccccaggagcagatcaacatgctgctgaacttcaaggatgacaagtcagaatgtccctgcccagaggagatccgggaccagctgctggacttccacgaggacctgatgacccactgcggcatcgagctggatgaagatggcagcctggatggcaacagcgacctgaccatccggggccgcctgctgagcctggtggagaaggtgacctacctgaagaagaagcaggccgagaagcctgtggagagtgacagcaagaagagcagcaccctgcagcagctgatcagcgagaccatggtgcgctgggcccaggagagcgtgattgaggaccctgagctggtgcgggccatgtttgtgctgctgcaccggcagtatgatggcattggaggcctggtgcgggccctgcccaagacctacaccatcaatggagtgtctgtggaggacaccatcaacctgctggccagcctgggccagatccgcagcctgctgtctgtgaggatgggcaaggaggaggagaagctgatgatccggggcctgggggacatcatgaacaacaaggtgttctaccagcaccccaacctgatgagggccctgggcatgcatgagaccgtgatggaggtgatggtgaatgtgctgggcggcggggagagcaaggagatcaccttccccaagatggtggccaactgctgccgcttcctgtgctacttctgccgcatcagccggcagaaccagaaggccatgtttgaccacctgagctacctgctggagaacagctctgtgggcctggccagccctgccatgaggggcagcacccccctggatgtggccgccgcctctgtgatggacaacaatgagctggccctggccctgcgggagccagacctggagaaggtggtgcgctacctggccggctgcggcctgcagagctgccagatgctggtgtccaagggctacccagacatcggctggaaccctgtggagggggagcgctacctggacttcctgcgctttgctgtgttctgcaatggagagagcgtggaggagaatgccaacgtggtggtgcggctgctgatccggcggccagaatgttttggacctgccctgcggggggagggcggcaatggcctgctggccgccatggaggaggccatcaagattgctgaggaccccagcagagatggccccagccccaacagcggcagcagcaagaccctggacacagaggaggaggaggatgacaccatccacatgggaaatgccatcatgaccttctacagcgccctgattgacctgctgggccgctgtgcccctgagatgcacctgattcatgctggaaaaggagaggccatccgcatccgcagcatcctgcggagcctcatccccctgggggacctggtgggcgtcatcagcatcgccttccagatgcccaccatcgccaaggatggaaatgtggtggagccagacatgtctgctggcttctgcccagaccacaaggccgccatggtgctcttcctggacagagtgtatggcatcgaggtgcaggacttcctgctgcacctgctggaggtgggcttcctgcctgacctgcgggctgctgccagcctggacacagctgccctgagcgccacagacatggccctggccctgaaccgctacctgtgcacagctgtgctgcccctgctgacccgctgtgcccccctgtttgctggaacagagcaccacgccagcctgattgacagcctgctgcacacagtgtaccgcctgagcaagggctgcagcctgaccaaggcccagagggacagcattgaggtgtgcctgctgagcatctgtggccagctgcggcccagcatgatgcagcacctgctgcggcggctggtgtttgatgtgcccctgctgaatgagcacgccaagatgcccctgaagctgctgaccaaccactatgagcgctgctggaagtactactgcctgcccggcggctggggcaactttggagctgccagcgaggaggagctgcacctgagcaggaagctgttctggggcatctttgatgccctgagccagaagaagtatgagcaggagctgttcaagctggccctgccctgcctgtctgctgtggccggggccctgcccccagactacatggagagcaactacgtgtccatgatggagaagcagagctccatggattctgagggcaacttcaacccccagcctgtggacaccagcaacatcaccatccctgagaagctggagtacttcatcaacaagtatgcagagcacagccatgacaagtggagcatggacaagctggccaacggctggatctatggagagatctacagcgacagcagcaaggtgcagcccctgatgaagccctacaagctgctgtctgagaaggagaaggagatctaccgctggcccatcaaggagagcctgaagaccatgctggcctggggctggagaattgaaagaacccgggagggggacagcatggccctgtacaacagaacaagacgcatcagccagaccagccaggtgtctgtggatgctgcccacggctacagcccccgggccatcgacatgagcaatgtgaccctgagccgggacctgcacgccatggccgagatgatggccgagaactaccacaacatctgggccaagaagaagaagatggagctggagagcaaaggaggcggcaaccaccccctgctggtgccctatgacaccctgacagccaaggagaaggccaaggaccgggagaaggcccaggacatcctgaagttcctgcagatcaatggctatgctgtgtcccggggcttcaaggacctggagctggacacccccagcattgagaagagatttgcctacagcttcctgcagcagctgatccgctacgtggatgaggcccaccagtacatcctggagtttgatggcggcagccggggcaagggggagcacttcccctatgagcaggagatcaagttctttgccaaggtggtgctgcccctgattgaccagtacttcaagaaccaccggctgtacttcctgtctgctgccagccggcccctgtgcagcggcggccacgccagcaacaaggagaaggagatggtgaccagcctcttctgcaagctgggcgtgctggtgcgccaccgcatcagcctgtttggaaatgatgccaccagcatcgtgaactgcctgcacatcctgggccagaccctggatgccaggacagtgatgaagacaggcctggagagcgtgaagagcgccctgcgggccttcctggacaatgctgctgaggacctggagaagaccatggagaacctgaagcagggccagttcacccacaccaggaaccagcccaagggcgtgacccagatcatcaactacaccaccgtggccctgctgcccatgctgagcagcctgtttgagcacatcggccagcaccagtttggagaagatctcatcctggaggatgtgcaggtgtcctgctaccgcatcctgaccagcctgtatgccctgggcaccagcaagagcatctacgtggagcggcagaggtctgccctgggagaatgtctggccgcctttgctggggccttccctgtggccttcctggagacccacctggacaagcacaacatctacagcatctacaacaccaagagcagccgggagagagctgccctgagcctgcccaccaacgtggaggatgtgtgccccaacatccccagcctggagaagctgatggaggagatcgtggagctggccgagagcggcatccgctacacccagatgcctcatgtgatggaggtgatcctgcccatgctgtgcagctacatgagccgctggtgggagcacggccctgagaacaaccctgagagagctgagatgtgctgcacagccctgaacagcgagcacatgaacaccctgctgggcaacatcctgaagatcatctacaacaacctgggcattgatgaaggagcctggatgaagaggctggccgtgttcagccagcccatcatcaacaaggtgaagccccagctgctgaagacccacttcctgcccctgatggagaagctgaagaagaaggccgccaccgtggtgtctgaggaggaccacctgaaggccgaggcccggggggacatgtctgaggccgagctgctgatcctggatgagttcaccaccctggcccgggacctgtatgccttctaccccctgctgatccgctttgtggactacaacagagccaagtggctgaaggagcccaaccctgaggccgaggagctgttcaggatggtggccgaggtgttcatctactggagcaagagccacaacttcaagcgggaggagcagaactttgtggtgcagaatgagatcaacaacatgtccttcctgatcacagacaccaagagcaagatgagcaaggctgctgtgtctgaccaggagaggaagaagatgaagaggaaaggagaccgctacagcatgcagaccagcctcatcgtggccgccctgaagaggctgctgcccatcggcctgaacatctgtgcccctggggaccaggagctgattgccctggccaagaaccgcttcagcctgaaggacacagaagatgaggtgcgggacatcatccgcagcaacatccacctgcagggcaagctggaggaccctgccatccgctggcagatggccctgtacaaggacctgcccaacagaacagatgacaccagtgaccctgagaagacagtggagcgggtgctggacatcgccaacgtgctcttccacctggagcagaagagcaagagggtgggccgccgccactactgcctggtggagcacccccagaggagcaagaaggctgtgtggcacaagctgctgagcaagcagaggaagagagctgtggtggcctgcttcaggatggcccccctgtacaacctgcccaggcacagagctgtgaacctcttcctgcagggctatgagaagtcctggattgaaacagaggagcactactttgaggacaagctgattgaggacctggccaagccaggagctgagcccccagaggaggatgagggcaccaagagggtggaccccctgcaccagctgatcctgctcttcagcaggacagccctgacagagaagtgcaagctggaggaggacttcctgtacatggcctatgctgacatcatggccaagagctgccatgatgaagaagatgatgatggagaggaggaggtgaagagctttgaggagaaggagatggagaagcagaagctgctgtaccagcaggcccggctgcatgacagaggagctgctgagatggtgctgcagaccatcagcgccagcaagggggagaccggccccatggtggccgccaccctgaagctgggcatcgccatcctgaatggaggcaacagcacagtgcagcagaagatgctggactacctgaaggagaagaaggatgtgggcttcttccagagcctggccggcctgatgcagagctgcagcgtgctggacctgaatgcctttgagcggcagaacaaggccgagggcctgggcatggtgacagaggagggcagcggggagaaggtgctgcaggatgatgagttcacctgtgacctcttccgcttcctgcagctgctgtgtgagggccacaacagcgacttccagaactacctgcggacccagacaggcaacaacaccaccgtgaacatcatcatcagcacagtggactacctgctgcgggtgcaggagagcatcagtgacttctactggtactacagcggcaaggatgtgattgatgagcagggccagaggaacttcagcaaggccatccaggtggccaagcaggtgttcaacaccctgacagagtacatccagggcccctgcaccggcaaccagcagagcctggcccacagccggctgtgggatgctgtggtgggcttcctgcacgtgtttgcccacatgcagatgaagctgagccaggacagcagccagatcgagctgctgaaggagctgatggacctgcagaaggacatggtggtgatgctgctgtccatgctggagggcaatgtggtgaatggcaccatcggcaagcagatggtggacatgctggtggagagcagcaacaacgtggagatgatcctgaagttctttgacatgttcctgaagctgaaggacctgaccagcagtgacaccttcaaggagtatgaccctgatggcaagggcgtcatcagcaagagggacttccacaaggccatggagagccacaagcactacacccagagcgagacagagttcctgctgagctgtgccgagacagatgaaaatgagaccctggactatgaggagtttgtgaagcgcttccacgagcccgccaaggacatcggcttcaacgtggccgtgctgctgaccaacctgtctgagcacatgcccaatgacacccggctgcagaccttcctggagctggccgagagcgtgctgaactacttccagcccttcctgggccgcatcgagatcatgggcagcgccaagagaattgagcgggtgtactttgagatcagcgagagcagcaggacccagtgggagaagccccaggtgaaggagagcaagaggcagttcatctttgatgtggtgaatgaaggaggagagaaggagaagatggagctgtttgtgaacttctgtgaggacaccatctttgagatgcagctggccgcccagatcagcgagagtgacctgaatgaaagaagtgccaacaaggaggagagcgagaaggagaggcctgaggagcagggccccaggatggccttcttcagcatcctgactgtgcgcagcgccctgtttgccctgcgctacaacatcctgaccctgatgaggatgctgagcctgaagagcctgaagaagcagatgaagaaggtgaagaagatgacagtgaaggacatggtgacagccttcttcagcagctactggagcatcttcatgaccctgctgcactttgtggccagcgtcttccggggcttcttccgcatcatctgcagcctgctgctgggcggcagcctggtggagggcgccaagaagatcaaggtggccgagctgctggccaacatgccagaccccacccaggatgaggtgagaggagatggagaggagggggagaggaagcccctggaggccgccctgcccagcgaggacctgacagacctgaaggagctgacagaggagagtgacctgctgagtgacatcttcggcctggacctgaagcgggagggcggccagtacaagctgatcccccacaaccccaatgccggcctgagtgacctgatgagcaaccctgtgcccatgcctgaggtgcaggagaagttccaggagcagaaggccaaggaggaggagaaggaggagaaggaggagaccaagtctgagcctgagaaggccgagggagaagatggagagaaggaggagaaggccaaggaggacaagggcaagcagaagctgcggcagctgcacacccaccgctacggggagcctgaggtgcctgagagcgccttctggaagaagatcatcgcctaccagcagaagctgctgaactactttgccaggaacttctacaacatgaggatgctggccctgtttgtggcctttgccatcaacttcatcctgctcttctacaaggtgtccaccagctctgtggtggagggcaaggagctgcccaccaggagcagcagtgaaaatgccaaggtgaccagcctggacagcagcagccaccgcatcatcgctgtgcactacgtgctggaggagagcagcggctacatggagcccaccctgcgcatcctggccatcctgcacacagtcatctccttcttctgcatcatcggctactactgcctgaaggtgcccctggtgatcttcaagcgggagaaggaggtggccaggaagctggagtttgatggcctgtacatcacagagcagcccagtgaagatgacatcaagggccagtgggaccggctggtgatcaacacccagagcttccccaacaactactgggacaagtttgtgaagaggaaggtgatggacaagtatggagagttctacggccgggaccgcatcagcgagctgctgggcatggacaaggccgccctggacttcagtgatgcccgggagaagaagaagcccaagaaggacagcagcctgtctgctgtgctgaacagcattgatgtgaagtaccagatgtggaagctgggcgtggtgttcacagacaacagcttcctgtacctggcctggtacatgaccatgtctgtgctgggccactacaacaacttcttctttgctgcccacctgctggacatcgccatgggcttcaagaccctgcggaccatcctgagctctgtgacccacaacgggaagcagctggtgctgactgtgggcctgctggccgtggtggtgtacctgtacacagtggtggccttcaacttcttcaggaagttctacaacaagtcagaagatggagacaccccagacatgaagtgtgatgacatgctgacctgctacatgttccacatgtatgtgggcgtgcgggccggcggcggcattggagatgaaattgaggaccctgctggagatgaatatgagatctaccgcatcatctttgacatcaccttcttcttctttgtgattgtcatcctgctggccatcatccagggcctcatcattgatgccttcggggagctgcgggaccagcaggagcaggtgaaggaggacatggagaccaagtgcttcatctgtggcattggaaatgactactttgacacagtgccccacggctttgagacccacaccctgcaggagcacaacctggccaactacctgttcttcctgatgtacctgatcaacaaggatgaaacagagcacacaggccaggagagctatgtgtggaagatgtaccaggagcgctgctgggagttcttccctgctggggactgcttcaggaagcagtatgaggaccagctgaactag

SEQ ID NO: 168709 - DNA, 987 bp, Artificial Sequence
  Description of Artificial Sequence: Synthetic coding sequence
atggagcccaccctgcgcatcctggccatcctgcacacagtcatctccttcttctgcatcatcggctactactgcctgaaggtgcccctggtgatcttcaagcgggagaaggaggtggccaggaagctggagtttgatggcctgtacatcacagagcagcccagtgaagatgacatcaagggccagtgggaccggctggtgatcaacacccagagcttccccaacaactactgggacaagtttgtgaagaggaaggtgatggacaagtacggggagttctacggccgggaccgcatcagcgagctgctgggcatggacaaggccgccctggacttcagtgatgcccgggagaagaagaagcccaagaaggacagcagcctgtctgctgtgctgaacagcattgatgtgaagtaccagatgtggaagctgggcgtggtgttcacagacaacagcttcctgtacctggcctggtacatgaccatgtctgtgctgggccactacaacaacttcttctttgctgcccacctgctggacatcgccatgggcttcaagaccctgcggaccatcctgagctctgtgacccacaacgggaagcagctggtgctgactgtgggcctgctggccgtggtggtgtacctgtacacagtggtggccttcaacttcttcaggaagttctacaacaagtcagaagatggagacaccccagacatgaagtgtgatgacatgctgacctgctacatgttccacatgtatgtgggcgtgcgggccggcggcggcattggagatgaaattgaagatcctgctggagatgaatatgagatctaccgcatcatctttgacatcaccttcttcttcttcgtcatcgtcatcctgctggccatcatccagggcctcatcattgatgcctttggagagctgcgggaccagcaggagcaggtgaaggaggacatggaggtgttcagtgatgtgtcctacaagcagaggtag

SEQ ID NO: 168710 - DNA, 645 bp, Artificial Sequence
  Description of Artificial Sequence: Synthetic coding sequence
agcctcttctgcaagctgggcgtgctggtgcgccaccgcatcagcctgtttggaaatgatgccaccagcatcgtgaactgcctgcacatcctgggccagaccctggatgccaggacagtgatgaagacaggcctggagagcgtgaagagcgccctgcgggccttcctggacaatgctgctgaggacctggagaagaccatggagaacctgaagcagggccagttcacccacaccaggaaccagcccaagggcgtgacccagatcatcaactacaccaccgtggccctgctgcccatgctgagcagcctgtttgagcacatcggccagcaccagtttggagaggacctgatcctggaggatgtgcaggtgtcctgctaccgcatcctgaccagcctgtatgccctgggcaccagcaagagcatctacgtggagcggcagaggtctgccctgggggagtgcctggccgcctttgctggggccttccctgtggccttcctggagacccacctggacaagcacaacatctacagcatctacaacaccaagagcagccgggagcgggccgccctgagcctgcccaccaacgtggaggatgtgtgccccaacatccccagcctggagaagctgatggaggagatcgtgtag

SEQ ID NO: 168711 - DNA, 4266 bp, Artificial Sequence
  Description of Artificial Sequence: Synthetic coding sequence
atgaagacaggcctggagagcgtgaagagcgccctgcgggccttcctggacaatgctgctgaggacctggagaagaccatggagaacctgaagcagggccagttcacccacaccaggaaccagcccaagggcgtgacccagatcatcaactacaccaccgtggccctgctgcccatgctgagcagcctgtttgagcacatcggccagcaccagtttggagaggacctgatcctggaggatgtgcaggtgtcctgctaccgcatcctgaccagcctgtatgccctgggcaccagcaagagcatctacgtggagcggcagaggtctgccctgggggagtgcctggccgcctttgctggggccttccctgtggccttcctggagacccacctggacaagcacaacatctacagcatctacaacaccaagagcagccgggagcgggccgccctgagcctgcccaccaacgtggaggatgtgtgccccaacatccccagcctggagaagctgatggaggagatcgtggagctggccgagagcggcatccgctacacccagatgccccacgtgatggaggtgatcctgcccatgctgtgcagctacatgagccgctggtgggagcacggccctgagaacaaccctgagcgggcagagatgtgctgcacagccctgaacagcgagcacatgaacaccctgctgggcaacatcctgaagatcatctacaacaacctgggcattgatgagggcgcctggatgaagaggctggccgtgttcagccagcccatcatcaacaaggtgaagccccagctgctgaagacccacttcctgcccctgatggagaagctgaagaagaaggccgccaccgtggtgtctgaggaggaccacctgaaggccgaggcccggggggacatgtctgaggccgagctgctgatcctggatgagttcaccaccctggcccgggacctgtatgccttctaccccctgctgatccgctttgtggactacaacagagccaagtggctgaaggagcccaaccctgaggccgaggagctgttcaggatggtggccgaggtgttcatctactggagcaagagccacaacttcaagcgggaggagcagaactttgtggtgcagaatgagatcaacaacatgtccttcctgatcacagacaccaagagcaagatgagcaaggctgctgtgtctgaccaggagaggaagaagatgaagaggaagggggaccgctacagcatgcagaccagcctgattgtggccgccctgaagaggctgctgcccatcggcctgaacatctgtgcccctggggaccaggagctgattgccctggccaagaaccgcttcagcctgaaggacacagaagatgaggtgcgggacatcatccgcagcaacatccacctgcagggcaagctggaggaccctgccatccgctggcagatggccctgtacaaggacctgcccaacagaacagatgacaccagtgaccctgagaagacagtggagcgggtgctggacatcgccaacgtgctcttccacctggagcagaagagcaagagggtgggcagaagacactactgcctggtggagcacccccagaggagcaagaaggctgtgtggcacaagctgctgagcaagcagaggaagagagctgtggtggcctgcttcaggatggcccccctgtacaacctgcccaggcacagagctgtgaacctcttcctgcagggctatgagaagtcctggattgaaacagaggagcactactttgaggacaagctgattgaggacctggccaagccaggagctgagcccccagaagaagatgagggcaccaagagggtggaccccctgcaccagctgatcctgctcttcagcaggacagccctgacagagaagtgcaagctggaggaggacttcctgtacatggcctatgctgacatcatggccaagagctgccatgatgaggaggatgatgatggagaggaggaggtgaagagctttgaacatgacatcatcaaggacctgaggaacaagtttgccagcctgggggagaacagcctggagaaggagatggagaagcagaagctgctgtaccagcaggcccggctgcatgacagaggagctgctgagatggtgctgcagaccatcagcgccagcaagggggagaccggccccatggtggccgccaccctgaagctgggcatcgccatcctgaatggaggcaacagcacagtgcagcagaagatgctggactacctgaaggagaagaaggatgtgggcttcttccagagcctggccggcctgatgcagagctgcagcgtgctggacctgaatgcctttgagcggcagaacaaggccgagggcctgggcatggtgacagaggagggcagcggggagaaggtgctgcaggatgatgagttcacctgtgacctcttccgcttcctgcagctgctgtgtgagggccacaacagcgacttccagaactacctgcggacccagacaggcaacaacaccaccgtgaacatcatcatcagcacagtggactacctgctgcgggtgcaggagagcatcagtgacttctactggtactacagcggcaaggatgtgattgatgagcagggccagaggaacttcagcaaggccatccaggtggccaagcaggtgttcaacaccctgacagagtacatccagggcccctgcaccggcaaccagcagagcctggcccacagccggctgtgggatgctgtggtgggcttcctgcacgtgtttgcccacatgcagatgaagctgagccaggacagcagccagatcgagctgctgaaggagctgatggacctgcagaaggacatggtggtgatgctgctgtccatgctggagggcaatgtggtgaatggcaccatcggcaagcagatggtggacatgctggtggagagcagcaacaacgtggagatgatcctgaagttctttgacatgttcctgaagctgaaggacctgaccagcagtgacaccttcaaggagtatgaccctgatggcaagggcgtcatcagcaagagggacttccacaaggccatggagagccacaagcactacacccagagcgagacagagttcctgctgagctgtgccgagacagatgaaaatgagaccctggactatgaggagtttgtgaagcgcttccacgagcccgccaaggacatcggcttcaacgtggccgtgctgctgaccaacctgtctgagcacatgcccaatgacacccggctgcagaccttcctggagctggccgagagcgtgctgaactacttccagcccttcctgggccgcatcgagatcatgggcagcgccaagagaattgagcgggtgtactttgagatcagcgagagcagcaggacccagtgggagaagccccaggtgaaggagagcaagaggcagttcatctttgatgtggtgaatgaaggaggagagaaggagaagatggagctgtttgtgaacttctgtgaggacaccatctttgagatgcagctggccgcccagatcagcgagagtgacctgaatgaaagaagtgccaacaaggaggagagcgagaaggagaggcctgaggagcagggccccaggatggccttcttcagcatcctgactgtgcgcagcgccctgtttgccctgcgctacaacatcctgaccctgatgaggatgctgagcctgaagagcctgaagaagcagatgaagaaggtgaagaagatgacagtgaaggacatggtgacagccttcttcagcagctactggagcatcttcatgaccctgctgcactttgtggccagcgtcttccggggcttcttccgcatcatctgcagcctgctgctgggcggcagcctggtggagggcgccaagaagatcaaggtggccgagctgctggccaacatgccagaccccacccaggatgaggtgagaggagatggagaggagggggagaggaagcccctggaggccgccctgcccagcgaggacctgacagacctgaaggagctgacagaggagagtgacctgctgagtgacatcttcggcctggacctgaagcgggagggcggccagtacaagctgatcccccacaaccccaatgccggcctgagtgacctgatgagcaaccctgtgcccatgcctgaggtgcaggagaagttccaggagcagaaggccaaggaggaggagaaggaggagaaggaggagaccaagtctgagcctgagaaggccgagggagaagatggatag

SEQ ID NO: 168712 - DNA, 14856 bp, Artificial Sequence
  Description of Artificial Sequence: Synthetic coding sequence
gatgatgaggtggtgctgcagtgcacagccaccatccacaaggagcagcagaagctgtgcctggccgctgagggcttcggcaaccggctgtgcttcctggagagcaccagcaacagcaagaatgtgcccccagacctgagcatctgcacctttgtgctggagcagagcctgtctgtgcgggccctgcaggagatgctggccaacacagtggagaagtctgagggccaggtggatgtggagaagtggaagttcatgatgaagacagcccagggcggcggccacaggaccctgctgtatggccacgccatcctgctgcggcacagctacagcggcatgtacctgtgctgcctgagcaccagccgcagcagcacagacaagctggcctttgatgtgggcctgcaggaggacaccaccggggaggcctgctggtggaccatccacccagccagcaagcagaggtctgagggggagaaggtgcgggtgggagatgacctgatcctggtgtctgtgagcagcgagcgctacctgcacctgtcctatggaaatggcagcctgcacgtggatgctgccttccagcagaccctgtggagcgtggcccccatcagcagcggcagcgaggccgcccagggctacctgattggaggagatgtgctgcggctgctgcacggccacatggatgaatgtctgactgtgcccagcggggagcacggggaggagcagaggagaacagtgcactatgagggcggcgctgtgtctgtgcacgcccggagcctgtggaggctggagaccctgcgggtggcctggagcggcagccacatccgctggggccagcccttccggctgcggcacgtgaccaccgggaagtacctgagcctgatggaggacaagaacctgctgctgatggacaaggagaaggcagatgtgaagagcacagccttcaccttccgcagcagcaaggagaagctggatgtgggcgtgaggaaggaggtggatggcatgggcaccagcgagatcaagtacggggacagcgtgtgctacatccagcacgtggacaccggcctgtggctgacctaccagagcgtggatgtgaagtctgtgaggatgggcagcatccagaggaaggccatcatgcaccacgagggccacatggatgatggcatcagcctgagccgcagccagcacgaggagagcaggacagcccgggtcatccgcagcaccgtcttcctgttcaaccgcttcatccggggcctggatgccctgagcaagaaggccaaggccagcacagtggacctgcccattgaatctgtgtccctgagcctgcaggacctgattggctacttccaccccccagatgagcacctggagcacgaggacaagcagaaccggctgcgggccctgaagaaccggcagaacctcttccaggaggagggcatgatcaacctggtgctggagtgcatcgaccggctgcacgtgtacagcagcgctgcccactttgctgatgtggccggccgggaggccggggagagctggaagagcatcctgaacagcctgtatgagctgctggccgccctgatccggggcaacaggaagaactgtgcccagttcagcggcagcctggactggctgatcagccggctggagcggctggaggccagcagcggcatcctggaggtgctgcactgtgtgctggtggagagccctgaggccctgaacatcatcaaggagggccacatcaagagcatcatcagcctgctggacaagcacggcaggaaccacaaggtgctggatgtgctgtgcagcctgtgtgtgtgccacggcgtggccgtgcgcagcaaccagcacctgatctgtgacaacctgctgcccggccgggacctgctgctgcagacccggctggtgaaccacgtgtcctccatgaggcccaacatcttcctgggcgtgtctgagggcagcgcccagtacaagaagtggtactatgagctgatggtggaccacacagagccctttgtgacagctgaggccacccacctgcgggtgggctgggccagcacagagggctacagcccctacccaggcggcggggaggagtggggcggcaatggagtgggagatgacctcttctcctatggctttgatggcctgcacctgtggagcggctgcatcgccaggacagtgagcagccccaaccagcacctgctgaggacagatgatgtgatcagctgctgcctggacctgagcgcccccagcatctccttccgcatcaatggccagcctgtgcagggcatgtttgagaacttcaacattgatggcctcttcttccctgtggtgtccttctctgctggcatcaaggtgcgcttcctgctgggcggccgccacggggagttcaagttcctgcccccacctggctacgccccctgctatgaagctgtgctgcccaaggagaagctgaaggtggagcacagccgggagtacaagcaggagaggacctacacccgggacctgctgggccccaccgtgtccctgacccaggccgccttcacccccatccctgtggacaccagccagatcgtgctgcccccccacctggagcgcatccgggagaagctggccgagaacatccacgagctgtgggtgatgaacaagattgagctgggctggcagtatggccctgtgagagatgacaacaagaggcagcacccctgcctggtggagttcagcaagctgcctgagcaggagaggaactacaacctgcagatgagcctggagaccctgaagaccctgctggccctgggctgccacgtgggcatcagtgatgagcacgccgaggacaaggtgaagaagatgaagctgcccaagaactaccagctgaccagcggctacaagccagcccccatggacctgtccttcatcaagctgacccccagccaggaggccatggtggacaagctggctgaaaatgcccacaacgtgtgggcccgggaccgcatccggcagggctggacctacggcatccagcaggatgtgaagaacagaagaaacccccggctggtgccctacaccctgctggatgacaggaccaagaagagcaacaaggacagcctgcgggaggccgtgaggaccctgctgggctacggctacaacctggaggccccagaccaggaccacgccgcccgggcagaggtgtgcagcggcactggagagcgcttccgcatcttccgggcagagaagacctatgctgtgaaggccggccgctggtactttgaatttgaaacagtgacagctggggacatgagggtgggctggagccggcccggctgccagcctgaccaggagctgggcagtgatgagcgggcctttgcctttgatggcttcaaggcccagcgctggcaccagggcaatgagcactacggccgctcctggcaggccggagatgtggtgggctgcatggtggacatgaatgagcacaccatgatgttcaccctgaatggagagatcctgctggatgacagcggcagcgagctggccttcaaggactttgatgtgggagatggcttcatccctgtgtgcagcctgggcgtggcccaggtgggccgcatgaactttgggaaggatgtgtccaccctgaagtacttcaccatctgtggcctgcaggagggctatgagccctttgctgtgaacaccaacagagacatcaccatgtggctgagcaagaggctgccccagttcctgcaggtgcccagcaaccacgagcacatcgaggtgaccagaattgatggcaccatcgacagcagcccctgcctgaaggtgacccagaagagctttggcagccagaacagcaacacagacatcatgttctaccgcctgtccatgcccattgaatgtgccgaggtgttcagcaagacagtggccggcggcctgcctggagctggcctgtttggccccaagaatgacctggaggactatgatgctgacagcgactttgaggtgctgatgaagacagcccacggccacctggtgcctgacagagtggacaaggacaaggaggccaccaagccagagttcaacaaccacaaggactatgcccaggagaagcccagccggctgaagcagcgcttcctgctgcggaggaccaagccagactacagcaccagccacagcgcccggctgacagaagatgtgctggctgatgacagagatgattatgacttcctgatgcagaccagcacctactactacagcgtgcgcatcttccctggccaggagcccgccaacgtgtgggtgggctggatcaccagtgacttccaccagtatgacaccggctttgacctggacagagtgaggacagtgacagtgaccctgggagatgagaagggcaaggtgcatgagagcatcaagaggagcaactgctacatggtgtgtgccggggagagcatgagccctggccagggcaggaacaacaacggcctggagatcggctgtgtggtggatgctgccagcggcctgctgaccttcatcgccaacgggaaggagctgagcacctactaccaggtggagcccagcaccaagctgtttcctgctgtgtttgcccaggccaccagccccaacgtgttccagtttgagctgggccgcatcaagaatgtgatgcccctgtctgctggcctcttcaagtctgagcacaagaaccctgtgccccagtgccccccccggctgcacgtgcagttcctgagccacgtgctgtggagcaggatgcccaaccagttcctgaaggtggatgtgagccgcatcagcgagcggcagggctggctggtgcagtgcctggaccccctgcagttcatgagcctgcacatcccagaagaaaatagatctgtggacatcctggagctgacagagcaggaggagctgctgaagttccactaccacaccctgcggctgtacagcgctgtgtgtgccctgggcaaccaccgggtggcccacgccctgtgcagccacgtggatgagccccagctgctgtatgccatcgagaacaagtacatgcctggcctgctgcgggccggctactatgacctgctgattgacatccacctgagcagctatgccacagcccggctgatgatgaacaatgagtacatcgtgcccatgacagaggagaccaagagcatcaccctcttcccagatgagaacaagaagcacggcctgcccggcatcggcctgagcaccagcctgcggcccaggatgcagttcagcagccccagctttgtgtccatcagcaatgaatgctaccagtacagccctgagttccccctggacatcctgaagagcaagaccatccagatgctgacagaggccgtgaaggagggcagcctgcacgcccgggaccctgtgggcggcaccacagagttcctgtttgtgcccctcatcaagctgttctacaccctgctgatcatgggcatcttccacaatgaagacctgaagcacatcctgcagctgattgagcccagcgtcttcaaggaggccgccaccccagaggaggagagtgacaccctggagaaggagctgtctgtggatgatgccaagctgcagggcgctggggaggaggaggccaagggcggcaagaggcccaaggagggcctgctgcagatgaagctgcctgagcctgtgaagctgcagatgtgcctgctgctgcagtacctgtgtgactgccaggtgcgccaccgcatcgaggccatcgtggccttcagtgatgactttgtggccaagctgcaggacaaccagcgcttccgctacaatgaggtgatgcaggccctgaacatgtctgctgccctgacagccaggaagaccaaggagttccgcagccccccccaggagcagatcaacatgctgctgaacttcaaggatgacaagtcagaatgtccctgcccagaggagatccgggaccagctgctggacttccacgaggacctgatgacccactgcggcatcgagctggatgaagatggcagcctggatggcaacagcgacctgaccatccggggccgcctgctgagcctggtggagaaggtgacctacctgaagaagaagcaggccgagaagcctgtggagagtgacagcaagaagagcagcaccctgcagcagctgatcagcgagaccatggtgcgctgggcccaggagagcgtgattgaggaccctgagctggtgcgggccatgtttgtgctgctgcaccggcagtatgatggcattggaggcctggtgcgggccctgcccaagacctacaccatcaatggagtgtctgtggaggacaccatcaacctgctggccagcctgggccagatccgcagcctgctgtctgtgaggatgggcaaggaggaggagaagctgatgatccggggcctgggggacatcatgaacaacaaggtgttctaccagcaccccaacctgatgagggccctgggcatgcatgagaccgtgatggaggtgatggtgaatgtgctgggcggcggggagagcaaggagatcaccttccccaagatggtggccaactgctgccgcttcctgtgctacttctgccgcatcagccggcagaaccagaaggccatgtttgaccacctgagctacctgctggagaacagctctgtgggcctggccagccctgccatgaggggcagcacccccctggatgtggccgccgcctctgtgatggacaacaatgagctggccctggccctgcgggagccagacctggagaaggtggtgcgctacctggccggctgcggcctgcagagctgccagatgctggtgtccaagggctacccagacatcggctggaaccctgtggagggggagcgctacctggacttcctgcgctttgctgtgttctgcaatggagagagcgtggaggagaatgccaacgtggtggtgcggctgctgatccggcggccagaatgttttggacctgccctgcggggggagggcggcaatggcctgctggccgccatggaggaggccatcaagattgctgaggaccccagcagagatggccccagccccaacagcggcagcagcaagaccctggacacagaggaggaggaggatgacaccatccacatgggaaatgccatcatgaccttctacagcgccctgattgacctgctgggccgctgtgcccctgagatgcacctgattcatgctggaaaaggagaggccatccgcatccgcagcatcctgcggagcctcatccccctgggggacctggtgggcgtcatcagcatcgccttccagatgcccaccatcgccaaggatggaaatgtggtggagccagacatgtctgctggcttctgcccagaccacaaggccgccatggtgctcttcctggacagagtgtatggcatcgaggtgcaggacttcctgctgcacctgctggaggtgggcttcctgcctgacctgcgggctgctgccagcctggacacagctgccctgagcgccacagacatggccctggccctgaaccgctacctgtgcacagctgtgctgcccctgctgacccgctgtgcccccctgtttgctggaacagagcaccacgccagcctgattgacagcctgctgcacacagtgtaccgcctgagcaagggctgcagcctgaccaaggcccagagggacagcattgaggtgtgcctgctgagcatctgtggccagctgcggcccagcatgatgcagcacctgctgcggcggctggtgtttgatgtgcccctgctgaatgagcacgccaagatgcccctgaagctgctgaccaaccactatgagcgctgctggaagtactactgcctgcccggcggctggggcaactttggagctgccagcgaggaggagctgcacctgagcaggaagctgttctggggcatctttgatgccctgagccagaagaagtatgagcaggagctgttcaagctggccctgccctgcctgtctgctgtggccggggccctgcccccagactacatggagagcaactacgtgtccatgatggagaagcagagctccatggattctgagggcaacttcaacccccagcctgtggacaccagcaacatcaccatccctgagaagctggagtacttcatcaacaagtatgcagagcacagccatgacaagtggagcatggacaagctggccaacggctggatctatggagagatctacagcgacagcagcaaggtgcagcccctgatgaagccctacaagctgctgtctgagaaggagaaggagatctaccgctggcccatcaaggagagcctgaagaccatgctggcctggggctggagaattgaaagaacccgggagggggacagcatggccctgtacaacagaacaagacgcatcagccagaccagccaggtgtctgtggatgctgcccacggctacagcccccgggccatcgacatgagcaatgtgaccctgagccgggacctgcacgccatggccgagatgatggccgagaactaccacaacatctgggccaagaagaagaagatggagctggagagcaaaggaggcggcaaccaccccctgctggtgccctatgacaccctgacagccaaggagaaggccaaggaccgggagaaggcccaggacatcctgaagttcctgcagatcaatggctatgctgtgtcccggggcttcaaggacctggagctggacacccccagcattgagaagagatttgcctacagcttcctgcagcagctgatccgctacgtggatgaggcccaccagtacatcctggagtttgatggcggcagccggggcaagggggagcacttcccctatgagcaggagatcaagttctttgccaaggtggtgctgcccctgattgaccagtacttcaagaaccaccggctgtacttcctgtctgctgccagccggcccctgtgcagcggcggccacgccagcaacaaggagaaggagatggtgaccagcctcttctgcaagctgggcgtgctggtgcgccaccgcatcagcctgtttggaaatgatgccaccagcatcgtgaactgcctgcacatcctgggccagaccctggatgccaggacagtgatgaagacaggcctggagagcgtgaagagcgccctgcgggccttcctggacaatgctgctgaggacctggagaagaccatggagaacctgaagcagggccagttcacccacaccaggaaccagcccaagggcgtgacccagatcatcaactacaccaccgtggccctgctgcccatgctgagcagcctgtttgagcacatcggccagcaccagtttggagaagatctcatcctggaggatgtgcaggtgtcctgctaccgcatcctgaccagcctgtatgccctgggcaccagcaagagcatctacgtggagcggcagaggtctgccctgggagaatgtctggccgcctttgctggggccttccctgtggccttcctggagacccacctggacaagcacaacatctacagcatctacaacaccaagagcagccgggagagagctgccctgagcctgcccaccaacgtggaggatgtgtgccccaacatccccagcctggagaagctgatggaggagatcgtggagctggccgagagcggcatccgctacacccagatgcctcatgtgatggaggtgatcctgcccatgctgtgcagctacatgagccgctggtgggagcacggccctgagaacaaccctgagagagctgagatgtgctgcacagccctgaacagcgagcacatgaacaccctgctgggcaacatcctgaagatcatctacaacaacctgggcattgatgaaggagcctggatgaagaggctggccgtgttcagccagcccatcatcaacaaggtgaagccccagctgctgaagacccacttcctgcccctgatggagaagctgaagaagaaggccgccaccgtggtgtctgaggaggaccacctgaaggccgaggcccggggggacatgtctgaggccgagctgctgatcctggatgagttcaccaccctggcccgggacctgtatgccttctaccccctgctgatccgctttgtggactacaacagagccaagtggctgaaggagcccaaccctgaggccgaggagctgttcaggatggtggccgaggtgttcatctactggagcaagagccacaacttcaagcgggaggagcagaactttgtggtgcagaatgagatcaacaacatgtccttcctgatcacagacaccaagagcaagatgagcaaggctgctgtgtctgaccaggagaggaagaagatgaagaggaaaggagaccgctacagcatgcagaccagcctcatcgtggccgccctgaagaggctgctgcccatcggcctgaacatctgtgcccctggggaccaggagctgattgccctggccaagaaccgcttcagcctgaaggacacagaagatgaggtgcgggacatcatccgcagcaacatccacctgcagggcaagctggaggaccctgccatccgctggcagatggccctgtacaaggacctgcccaacagaacagatgacaccagtgaccctgagaagacagtggagcgggtgctggacatcgccaacgtgctcttccacctggagcagaagagcaagagggtgggccgccgccactactgcctggtggagcacccccagaggagcaagaaggctgtgtggcacaagctgctgagcaagcagaggaagagagctgtggtggcctgcttcaggatggcccccctgtacaacctgcccaggcacagagctgtgaacctcttcctgcagggctatgagaagtcctggattgaaacagaggagcactactttgaggacaagctgattgaggacctggccaagccaggagctgagcccccagaggaggatgagggcaccaagagggtggaccccctgcaccagctgatcctgctcttcagcaggacagccctgacagagaagtgcaagctggaggaggacttcctgtacatggcctatgctgacatcatggccaagagctgccatgatgaagaagatgatgatggagaggaggaggtgaagagctttgaggagaaggagatggagaagcagaagctgctgtaccagcaggcccggctgcatgacagaggagctgctgagatggtgctgcagaccatcagcgccagcaagggggagaccggccccatggtggccgccaccctgaagctgggcatcgccatcctgaatggaggcaacagcacagtgcagcagaagatgctggactacctgaaggagaagaaggatgtgggcttcttccagagcctggccggcctgatgcagagctgcagcgtgctggacctgaatgcctttgagcggcagaacaaggccgagggcctgggcatggtgacagaggagggcagcggggagaaggtgctgcaggatgatgagttcacctgtgacctcttccgcttcctgcagctgctgtgtgagggccacaacagcgacttccagaactacctgcggacccagacaggcaacaacaccaccgtgaacatcatcatcagcacagtggactacctgctgcgggtgcaggagagcatcagtgacttctactggtactacagcggcaaggatgtgattgatgagcagggccagaggaacttcagcaaggccatccaggtggccaagcaggtgttcaacaccctgacagagtacatccagggcccctgcaccggcaaccagcagagcctggcccacagccggctgtgggatgctgtggtgggcttcctgcacgtgtttgcccacatgcagatgaagctgagccaggacagcagccagatcgagctgctgaaggagctgatggacctgcagaaggacatggtggtgatgctgctgtccatgctggagggcaatgtggtgaatggcaccatcggcaagcagatggtggacatgctggtggagagcagcaacaacgtggagatgatcctgaagttctttgacatgttcctgaagctgaaggacctgaccagcagtgacaccttcaaggagtatgaccctgatggcaagggcgtcatcagcaagagggacttccacaaggccatggagagccacaagcactacacccagagcgagacagagttcctgctgagctgtgccgagacagatgaaaatgagaccctggactatgaggagtttgtgaagcgcttccacgagcccgccaaggacatcggcttcaacgtggccgtgctgctgaccaacctgtctgagcacatgcccaatgacacccggctgcagaccttcctggagctggccgagagcgtgctgaactacttccagcccttcctgggccgcatcgagatcatgggcagcgccaagagaattgagcgggtgtactttgagatcagcgagagcagcaggacccagtgggagaagccccaggtgaaggagagcaagaggcagttcatctttgatgtggtgaatgaaggaggagagaaggagaagatggagctgtttgtgaacttctgtgaggacaccatctttgagatgcagctggccgcccagatcagcgagagtgacctgaatgaaagaagtgccaacaaggaggagagcgagaaggagaggcctgaggagcagggccccaggatggccttcttcagcatcctgactgtgcgcagcgccctgtttgccctgcgctacaacatcctgaccctgatgaggatgctgagcctgaagagcctgaagaagcagatgaagaaggtgaagaagatgacagtgaaggacatggtgacagccttcttcagcagctactggagcatcttcatgaccctgctgcactttgtggccagcgtcttccggggcttcttccgcatcatctgcagcctgctgctgggcggcagcctggtggagggcgccaagaagatcaaggtggccgagctgctggccaacatgccagaccccacccaggatgaggtgagaggagatggagaggagggggagaggaagcccctggaggccgccctgcccagcgaggacctgacagacctgaaggagctgacagaggagagtgacctgctgagtgacatcttcggcctggacctgaagcgggagggcggccagtacaagctgatcccccacaaccccaatgccggcctgagtgacctgatgagcaaccctgtgcccatgcctgaggtgcaggagaagttccaggagcagaaggccaaggaggaggagaaggaggagaaggaggagaccaagtctgagcctgagaaggccgagggagaagatggagagaaggaggagaaggccaaggaggacaagggcaagcagaagctgcggcagctgcacacccaccgctacggggagcctgaggtgcctgagagcgccttctggaagaagatcatcgcctaccagcagaagctgctgaactactttgccaggaacttctacaacatgaggatgctggccctgtttgtggcctttgccatcaacttcatcctgctcttctacaaggtgtccaccagctctgtggtggagggcaaggagctgcccaccaggagcagcagtgaaaatgccaaggtgaccagcctggacagcagcagccaccgcatcatcgctgtgcactacgtgctggaggagagcagcggctacatggagcccaccctgcgcatcctggccatcctgcacacagtcatctccttcttctgcatcatcggctactactgcctgaaggtgcccctggtgatcttcaagcgggagaaggaggtggccaggaagctggagtttgatggcctgtacatcacagagcagcccagtgaagatgacatcaagggccagtgggaccggctggtgatcaacacccagagcttccccaacaactactgggacaagtttgtgaagaggaaggtgatggacaagtatggagagttctacggccgggaccgcatcagcgagctgctgggcatggacaaggccgccctggacttcagtgatgcccgggagaagaagaagcccaagaaggacagcagcctgtctgctgtgctgaacagcattgatgtgaagtaccagatgtggaagctgggcgtggtgttcacagacaacagcttcctgtacctggcctggtacatgaccatgtctgtgctgggccactacaacaacttcttctttgctgcccacctgctggacatcgccatgggcttcaagaccctgcggaccatcctgagctctgtgacccacaacgggaagcagctggtgctgactgtgggcctgctggccgtggtggtgtacctgtacacagtggtggccttcaacttcttcaggaagttctacaacaagtcagaagatggagacaccccagacatgaagtgtgatgacatgctgacctgctacatgttccacatgtatgtgggcgtgcgggccggcggcggcattggagatgaaattgaggaccctgctggagatgaatatgagatctaccgcatcatctttgacatcaccttcttcttctttgtgattgtcatcctgctggccatcatccagggcctcatcattgatgccttcggggagctgcgggaccagcaggagcaggtgaaggaggacatggagaccaagtgcttcatctgtggcattggaaatgactactttgacacagtgccccacggctttgagacccacaccctgcaggagcacaacctggccaactacctgttcttcctgatgtacctgatcaacaaggatgaaacagagcacacaggccaggagagctatgtgtggaagatgtaccaggagcgctgctgggagttcttccctgctggggactgcttcaggaagcagtatgaggaccagctgaactag

SEQ ID NO: 168713 - DNA, 14601 bp, Artificial Sequence
  Description of Artificial Sequence: Synthetic coding sequence
atggccgagctgggcggcggcggggaggaggatgcccgctggtacaggaaggaggatgaggtggtgctgcagtgcatcgccaccatccacaaggagcagaggaagttctgcctggccgctgagggcctgggcaaccggctgtgcttcctggagcccaccagcgaggccaagtacatccccccagacctgtgtgtgtgcaactttgtgctggagcagagcctgtctgtgcgggccctgcaggagatgctggccaacacaggagaaaatggaggagagggcgccgcccagggcggcggccacaggaccctgctgtatggccatgctgtgctgctgcggcacagcttcagcggcatgtacctgacctgcctgaccaccagccgcagccagacagacaagctggcctttgatgtgggcctgcgggagcacgccaccggggaggcctgctggtggaccatccacccagccagcaagcagaggtctgagggggagaaggtgagaattggagatgacctgatcctggtgtctgtgagcagcgagcgctacctgcacctgtctgtgtccaatggaaacatccaggtggatgccagcttcatgcagaccctgtggaatgtgcaccccacctgcagcggcagcagcattgaggagggctacctgctgggcggccacgtggtgcggctcttccacggccatgatgagtgcctgaccatccccagcacagaccagaatgacagccagcaccggcgcatcttctatgaagctggaggagctggcacccgggcccggagcctgtggagggtggagcccctgcgcatctcctggagcggcagcaacatccgctggggccaggccttccggctgcggcacctgaccaccggccactacctggccctgacagaggaccagggcctcatcctgcaggaccgggccaagagtgacaccaagagcacagccttctccttccgggccagcaaggagctgaaggagaagctggacagcagccacaagagggacatcgagggcatgggcgtgcctgagatcaagtacggggacagcgtgtgctttgtgcagcacatcgccagcggcctgtgggtgacctacaaggcccaggatgccaagaccagccggctgggccccctgaagaggaaggtgatcctgcaccaggagggccacatggatgatggcctgaccctgcagcgctgccagcgggaggagagccaggccgcccgcatcatccggaacaccacagccctcttcagccagtttgtgtctggcaacaacagaacagctgcccccatcaccctgcccatcgaggaggtgctgcagaccctgcaggacctgattgcctacttccagcccccagaggaggagatgagacatgaggacaagcagaacaagctgcggagcctgaagaaccggcagaacctcttcaaggaggagggcatgctggccctggtgctgaactgcatcgaccggctgaatgtgtacaacagcgtggcccactttgctggcatcgcccgggaggagagcggcatggcctggaaggagatcctgaacctgctgtacaagctgctggccgccctgatccggggcaacagaaacaactgtgcccagttcagcaacaacctggactggctgatcagcaagctggaccggctggagagcagcagcggcatcctggaggtgctgcactgcatcctgacagagagccctgaggccctgaacctgattgctgagggccacatcaagagcatcatcagcctgctggacaagcatggaagaaaccacaaggtgctggacatcctgtgcagcctgtgcctgtgcaatggagtggccgtgcgggccaaccagaacctgatctgtgacaacctgctgcccaggaggaacctgctgctgcagaccaggctcatcaatgatgtgaccagcatccggcccaacatcttcctgggcgtggccgagggcagcgcccagtacaagaagtggtactttgagctgatcatcgaccaggtggaccccttcctgacagctgagcccacccacctgcgggtgggctgggccagcagcagcggctacgccccctacccaggcggcggggagggctggggcggcaatggagtgggagatgacctgtacagctatggctttgatggcctgcacctgtggagcggccgcatccccagggctgtggccagcatcaaccagcacctgctgcggagtgatgatgtggtgtcctgctgcctggacctgggcgtgcccagcatctccttccgcatcaatggccagcctgtgcagggcatgtttgagaacttcaacacagatggcctcttcttccctgtgatgtccttctctgctggggtgaaggtgcgcttcctgatgggcggcagacatggagagttcaagttcctgccccccagcggctacgccccctgctatgaggccctgctgcccaaggagaagatgaggctggagcctgtgaaggagtacaagagagatgctgatggcatccgggacctgctgggcaccacccagttcctgagccaggccagcttcatcccctgccctgtggacaccagccaggtgatcctgcccccccacctggagaagatccgggaccggctggccgagaacatccacgagctgtggggcatgaacaagattgagctgggctggaccttcggcaagatcagagatgacaacaagaggcagcacccctgcctggtggagttcagcaagctgcctgagacagagaagaactacaacctgcagatgagcacagagaccctgaagaccctgctggccctgggctgccacatcgcccacgtgaacccagctgctgaggaggacctgaagaaggtgaagctgcccaagaactacatgatgagcaatggctacaagccagcccccctggacctgagtgatgtgaagctgctgcccccccaggagatcctggtggacaagctggccgagaatgcccacaacgtgtgggccaaggaccgcatcaagcagggctggacctacggcatccagcaggacctgaagaacaagaggaacccccggctggtgccctatgccctgctggatgagaggaccaagaagagcaacagagacagcctgcgggaggccgtgaggacctttgtgggctacggctacaacatcgagcccagcgaccaggagctggccgacagcgctgtggagaaggtgtccattgacaagatccgcttcttccgggtggagaggagctatgctgtgcgcagcggcaagtggtactttgaatttgaggtggtgactggaggagacatgagggtgggctgggcccggcccggctgcaggccagatgtggagctgggcgcagatgaccaggcctttgtgtttgagggcaacagaggccagcgctggcaccagggcagcggctacttcggccgcacctggcagcctggagatgtggtgggctgcatgatcaacctggatgatgcctccatgatcttcaccctgaatggagagctgctgatcaccaacaagggcagcgagctggcctttgctgactatgaaattgaaaatggatttgtgcccatctgctgcctgggcctgagccagatcggccgcatgaacctgggcacagatgccagcaccttcaagttctacaccatgtgtggcctgcaggagggctttgagccctttgctgtgaacatgaacagagatgtggccatgtggttcagcaagaggctgcccacctttgtgaatgtgcccaaggaccacccccacatcgaggtgatgagaattgatggcaccatggacagccccccctgcctgaaggtgacccacaagaccttcggcacccagaacagcaatgctgacatgatctactgccgcctgtccatgcctgtggagtgccacagcagcttcagccacagcccctgcctggacagcgaggccttccagaagaggaagcagatgcaggagatcctgagccacaccaccacccagtgctactatgccatccgcatctttgctggccaggaccccagctgtgtgtgggtgggctgggtgaccccagactaccacctgtacagcgagaagtttgacctgaacaagaactgcaccgtgacagtgaccctgggagatgagcggggccgggtgcatgaatctgtgaagaggagcaactgctacatggtgtggggcggggacatcgtggccagcagccagaggagcaacagaagcaatgtggacctggagatcggctgcctggtggacctggccatgggcatgctgtccttcagcgccaacgggaaggagctgggcacctgctaccaggtggagcccaacaccaaggtgtttcctgctgtgttcctgcagcccaccagcaccagcctcttccagtttgagctgggcaagctgaagaatgccatgcccctgtctgctgccatcttccgctctgaggagaagaaccctgtgccccagtgccccccccggctggatgtgcagaccatccagcctgtgctgtggagcaggatgcccaacagcttcctgaaggtggagacagagcgggtgtctgaaagacatggctgggtggtgcagtgcctggagcccctgcagatgatggccctgcacatcccagaagaaaatagatgtgtggacatcctggagctgtgtgagcaggaggacctgatgaggttccactaccacaccctgcggctgtacagcgctgtgtgtgccctgggcaacagccgggtggcctatgccctgtgcagccacgtggacctgagccagctgttctacgccatcgacaacaagtacctgcccggcctgctgcggagcggcttctatgacctgctgatcagcatccacctggccagcgccaaggagaggaagctgatgatgaagaatgagtacatcatccccatcaccagcaccaccaggaacatccgcctcttcccagatgagagcaagagacatggcctgcccggggtgggcctgcggacctgcctgaagccaggcttccgcttcagcaccccctgctttgtggtgactggagaggaccaccagaagcagagccctgagatccccctggagagcctgcggaccaaggccctgtccatgctgacagaggccgtgcagtgcagcggggcccacatccgggaccctgtgggcggctctgtggagttccagtttgtgcctgtgctgaagctgattggcaccctgctggtgatgggcgtgtttgatgatgatgatgtgcggcagatcctgctgctgattgaccccagcgtgtttggagagcacagcgctggaacagaggagggcgctgagaaggaggaggtgacccaggtggaggagaaggctgtggaggccggggagaaggccggcaaggaggcccctgtgaagggcctgctgcagacccggctgcctgagagcgtgaagctgcagatgtgtgagctgctgagctacctgtgtgactgtgagctgcagcaccgggtggaggccatcgtggcctttggagacatctacgtgtccaagctgcaggccaaccagaagttccgctacaatgagctgatgcaggccctgaacatgtctgctgccctgacagccaggaagaccaaggagttccgcagccccccccaggagcagatcaacatgctgctgaacttccagctgggggagaactgcccctgcccagaggagatccgggaggagctgtatgacttccacgaggacctgctgctgcactgcggcgtgcccctggaggaggaggaggaggaggaggaggacacctcctggacaggcaagctgtgtgccctggtgtacaagatcaagggcccccccaagccagagaaggagcagcccacagaggaggaggagcgctgccccaccaccctgaaggagctgatcagccagaccatgatctgctgggcccaggaggaccagatccaggacagcgagctggtgaggatgatgttcaacctgctgcggcggcagtatgacagcattggagagctgctgcaggccctgaggaagacctacaccatcagccacacctctgtgtctgacaccatcaacctgctggccgccctgggccagatccgcagcctgctgtctgtgaggatgggcaaggaggaggagctgctgatgatcaatggcctgggggacatcatgaacaacaaggtgttctaccagcaccccaacctgatgagggtgctgggcatgcatgagaccgtgatggaggtgatggtgaatgtgctgggcacagagaagagccagatcgccttccccaagatggtggccagctgctgccgcttcctgtgctacttctgccgcatcagccggcagaaccagaaggccatgtttgagcacctgagctacctgctggagaacagctctgtgggcctggccagccccagcatgaggggcagcacccccctggatgtggccgccagctctgtgatggacaacaatgagctggccctgagcctggaggagccagacctggagaaggtggtgacctacctggccggctgcggcctgcagagctgccccatgctgctggccaagggctacccagatgtgggctggaaccccatcgagggggagcgctacctgtccttcctgcgctttgctgtgtttgtgaacagcgagagcgtggaggagaatgcctctgtggtggtgaagctgctgatcagaagacctgagtgcttcggccctgccctgcggggggagggcggcaatggcctgctggccgccatgcagggcgccatcaagatcagcgagaacccagccctggacctgcccagccagggctacaagcgggaggtgtccactggagatgatgaggaggaggaggagatcgtgcacatgggaaatgccatcatgtccttctacagcgccctgattgacctgctgggccgctgtgcccctgagatgcacctgatccagacaggcaagggggaggccatccgcatccgcagcatcctgcggagcctggtgcccacagaggacctggtgggcatcatcagcatccccctgaagctgcccagcctgaacaaggatggctctgtgtctgagccagacatggccgccaacttctgcccagaccacaaggcccccatggtgctcttcctggacagagtgtatggcatcaaggaccagaccttcctgctgcacctgctggaggtgggcttcctgcctgacctgcgggccagcgccagcctggacacagtgtccctgagcaccacagaagctgccctggccctgaaccgctacatctgcagcgctgtgctgcccctgctgacccgctgtgcccccctgtttgctggaacagagcactgcaccagcctgattgacagcaccctgcagaccatctaccgcctgagcaagggccgcagcctgaccaaggcccagagggacaccatcgaggagtgcctgctggccatctgcaaccacctgcggcccagcatgctgcagcagctgctgcggcggctggtgtttgatgtgccccagctgaatgagtactgcaagatgcccctgaagctgctgaccaaccactatgagcagtgctggaagtactactgcctgcccagcggctggggcagctatggcctggccgtggaggaggagctgcacctgacagagaagctgttctggggcatctttgacagcctgagccacaagaagtatgaccctgacctcttcaggatggccctgccctgcctgagcgccatcgccggggccctgcccccagactacctggacacccgcatcacagccaccctggagaagcagatctctgtggatgctgatggcaactttgaccccaagcccatcaacaccatgaacttcagcctgcctgagaagctggagtacatcgtgaccaagtatgcagagcacagccatgacaagtgggcctgtgacaagagccagagcggctggaagtatggcatcagcctggatgaaaatgtgaagacccaccccctcatccggcccttcaagaccctgacagagaaggagaaggagatctaccgctggccagcccgggagagcctgaagaccatgctggccgtgggctggacagtggagaggaccaaggagggggaggccctggtgcagcagcgggagaatgagaagctgcggtctgtgtcccaggccaaccagggcaacagctacagccctgcccccctggacctgagcaatgtggtgctgagccgggagctgcagggcatggtggaggtggtggccgagaactaccacaacatctgggccaagaagaagaagctggagctggagagcaagggcggcggcagccaccccctgctggtgccctatgacaccctgacagccaaggagaagttcaaggaccgggagaaggcccaggacctcttcaagttcctgcaggtgaatggcatcatcgtgtcccggggcatgaaggacatggagctggatgccagctccatggagaagagatttgcctacaagttcctgaagaagatcctgaagtatgtggacagcgcccaggagttcatcgcccacctggaggccatcgtgagcagcggcaagacagagaagagcccccgggaccaggagatcaagttctttgccaaggtgctgctgcccctggtggaccagtacttcaccagccactgcctgtacttcctgagcagccccctgaagcccctgagcagcagcggctacgccagccacaaggagaaggagatggtggccggcctcttctgcaagctggccgccctggtgcgccaccgcatcagcctgtttggaagtgacagcaccaccatggtgtcctgcctgcacatcctggcccagaccctggacaccaggacagtgatgaagagcggcagcgagctggtgaaggccggcctgcgggccttctttgaaaatgctgctgaggacctggagaagaccagcgagaacctgaagctgggcaagttcacccacagcaggacccagatcaagggcgtgtcccagaacatcaactacaccaccgtggccctgctgcccatcctgaccagcatctttgaacatgtgacccagcaccagtttggcatggacctgctgctgggagatgtgcagatcagctgctaccacatcctgtgcagcctgtacagcctgggcaccgggaagaacatctacgtggagcggcagaggcctgccctgggagaatgtctggccagcctggccgccgccatccctgtggccttcctggagcccaccctgaaccgctacaaccccctgagcgtcttcaacaccaagaccccccgggagaggagcatcctgggcatgccagacacagtggaggacatgtgcccagacatcccccagctggagggcctgatgaaggagatcaatgacctggccgagagcggggcccgctacacagagatgcctcatgtgattgaagtcatcctgcccatgctgtgcaactacctgagctactggtgggagcggggccctgagaacctgccccccagcacaggcccctgctgcaccaaggtgaccagcgagcacctgagcctcatcctgggcaacatcctgaagatcatcaacaacaacctgggcattgatgaggcctcctggatgaagagaattgctgtgtatgcccagcccatcatcagcaaggcccggccagacctgctgcggagccacttcatccccaccctggagaagctgaagaagaaggctgtgaagacagtgcaggaggaggagcagctgaaggcagatggaaaaggagacacccaggaggccgagctgctgatcctggatgaatttgctgtgctgtgccgggacctgtatgccttctaccccatgctgatccgctacgtggacaacaacagaagcaactggctgaagagcccagatgctgacagcgaccagctgttcaggatggtggccgaggtgttcatcctgtggtgcaagagccacaacttcaagcgggaggagcagaactttgtgatccagaatgagatcaacaacctggccttcctgaccggggacagcaagagcaagatgagcaagagcggcggccaggaccaggagaggaagaagaccaagagaagaggagacctgtacagcatccagaccagcctcatcgtggccgccctgaagaagatgctgcccatcggcctgaacatgtgcacccctggggaccaggagctgatcagcctggccaagagccgctacagccaccgggacacagatgaggaggtgcgggagcacctgaggaacaacctgcacctgcaggagaagagtgatgatcctgctgtgaagtggcagctgaacctgtacaaggatgtgctgaagtctgaggagcccttcaaccctgagaagacagtggagcgggtgcagaggatctctgctgctgtgttccacctggagcaggtggagcagcccctgcggagcaagaaggctgtgtggcacaagctgctgagcaagcagaggaagagagctgtggtggcctgcttcaggatggcccccctgtacaacctgcccaggcacaggagcatcaacctcttcctgcacggctaccagcgcttctggattgaaacagaggagtacagctttgaggagaagctggtgcaggacctggccaagagccccaaggtggaggaggaggaggaggaggagacagagaagcagcctgaccccctgcaccagatcatcctgtacttcagcagaaatgccctgacagagaggagcaagctggaggatgaccccctgtacaccagctacagctccatgatggccaagagctgccagagcggagaagatgaggaggaggatgaggacaaggagaagacctttgaggagaaggagatggagaagcagaagaccctgtaccagcaggcccggctgcacgagagaggagctgctgagatggtgctgcagatgatcagcgccagcaaaggagagatgagccccatggtggtggagaccctgaagctgggcatcgccatcctgaatggaggaaatgctggggtgcagcagaagatgctggactacctgaaggagaagaaggatgctggcttcttccagagcctgagcggcctgatgcagagctgccgctctgtgctggacctgaatgcctttgagcggcagaacaaggccgagggcctgggcatggtgacagaggagggcaccctgattgtgcgggagcggggggagaaggtgctgcagaatgatgagttcacccgggacctcttccgcttcctgcagctgctgtgtgagggccacaacagcgacttccagaacttcctgcggacccagatgggcaacaccaccaccgtgaatgtcatcatcagcacagtggactacctgctgcggctgcaggagagcatcagtgacttctactggtactacagcggcaaggacatcattgatgaaagtggccagcacaacttcagcaaggccctggccgtgaccaagcagatcttcaacagcctgacagagtacatccagggcccctgcatcggcaaccagcagagcctggcccacagccggctgtgggatgctgtggtgggcttcctgcacgtgtttgccaacatgcagatgaagctgagccaggacagcagccagatcgagctgctgaaggagctgctggacctgctgcaggacatggtggtgatgctgctgagcctgctggagggcaatgtggtgaatggcaccatcggcaagcagatggtggacaccctggtggagagcagcaccaacgtggagatgatcctgaagttctttgacatgttcctgaagctgaaggacctgaccagcagtgacaccttcaaggagtatgaccctgatggcaagggcatcatcagcaagaaggagttccagaaggccatggagggccagaagcagtacacccagagcgagattgacttcctgctgagctgtgccgaggctgatgaaaatgacatgttcaactacgtggactttgtggaccgcttccacgagcccgccaaggacatcggcttcaacgtggccgtgctgctgaccaacctgtctgagcacatgcccaatgacagccggctgaagtgcctgctggaccctgctgagagcgtgctgaactactttgagccctacctgggccgcatcgagatcatgggcggggccaagaagattgagcgggtgtactttgagatcagcgagagcagcaggacccagtgggagaagccccaggtgaaggagagcaagaggcagttcatctttgatgtggtgaatgaaggaggagagcaggagaagatggagctgtttgtgaacttctgtgaggacaccatctttgagatgcagctggccagccagatcagcgagagtgacagcgctgacaggcctgaggaggaggaggaggatgaggacagcagctatgtgctggagattgctggggaggaggaggaggatggcagcctggagcccgccagcgcctttgccatggcctgtgcctctgtgaagagaaatgtgacagacttcctgaagagggccaccctgaagaacctgaggaagcagtacagaaatgtgaagaagatgacagccaaggagctggtgaaggtgctcttctccttcttctggatgctgtttgtgggcctcttccagctgctcttcaccatcctgggcggcatcttccagatcctgtggagcacagtgtttggaggcggcctggtggagggcgccaagaacatccgggtgaccaagatcctgggggacatgccagaccccacccagtttggcatccatgatgacaccatggaggccgagagagctgaggtgatggagcccggcatcaccacagagctggtgcacttcatcaagggggagaagggggacacagacatcatgtctgacctgtttggcctgcaccccaagaaggagggcagcctgaagcacggccctgaggtgggcctgggggacctgtctgagatcatcggcaaggatgagccccccaccctggagagcacagtgcagaagaagaggaaggcccaggccgctgagatgaaggccgccaatgaggccgagggcaaggtggagagcgagaaggctgacatggaggatggagagaaggaggacaaggacaaggaggaggagcaggccgagtacctgtggacagaggtgaccaagaagaagaagagaagatgtggccagaaggtggagaagccagaggccttcaccgccaacttcttcaagggcctggagatctaccagaccaagctgctgcactacctggccaggaacttctacaacctgcgcttcctggccctgtttgtggcctttgccatcaacttcatcctgctcttctacaaggtgacagaggagcccctggaggaggagacagaagatgtggccaacctgtggaacagcttcaatgatgaggaggaggaggaggccatggtgttctttgtgctgcaggagagcacaggctacatggcccccaccctgcgggccctggccatcatccacaccatcatcagcctggtgtgtgtggtgggctactactgcctgaaggtgcccctggtggtgttcaagcgggagaaggagatcgccaggaagctggagtttgatggcctgtacatcacagagcagcccagtgaagatgacatcaagggccagtgggaccggctggtgatcaacacccccagcttccccaacaactactgggacaagtttgtgaagaggaaggtgatcaacaagtacggggacctgtatggagctgagagaattgctgagctgctgggcctggacaagaatgccctggacttcagccctgtggaggagaccaaggccgaggccgccagcctggtgtcctggctgagcagcattgacatgaagtaccacatctggaagctgggcgtggtgttcacagacaacagcttcctgtacctggcctggtacaccaccatgtctgtgctgggccactacaacaacttcttctttgctgcccacctgctggacatcgccatgggcttcaagaccctgcggaccatcctgagctctgtgacccacaacgggaagcagctggtgctgactgtgggcctgctggccgtggtggtgtacctgtacacagtggtggccttcaacttcttcaggaagttctacaacaagtcagaagatgatgatgagccagacatgaagtgtgatgacatgatgacctgctacctgttccacatgtatgtgggcgtgcgggccggcggcggcattggagatgaaattgaagatcctgctggggacccctatgagatgtacagaattgtgtttgacatcaccttcttcttcttcgtcatcgtcatcctgctggccatcatccagggcctcatcattgatgcctttggagagctgcgggaccagcaggagcaggtgcgggaggacatggagaccaagtgcttcatctgtggcattggaaatgactactttgacaccaccccccacggctttgagacccacaccctgcaggagcacaacctggccaactacctgttcttcctgatgtacctgatcaacaaggatgaaacagagcacacaggccaggagagctatgtgtggaagatgtaccaggagcgctgctgggacttcttccctgctggggactgcttcaggaagcagtatgaggaccagctgggctag

SEQ ID NO: 168714 - DNA, 14613 bp, Artificial Sequence
  Description of Artificial Sequence: Synthetic coding sequence
atggccgagggcggggagggcggagaagatgagatccagttcctgaggacagaagatgaggtggtgctgcagtgcatcgccaccatccacaaggagcagaggaagttctgcctggccgctgagggcctgggcaaccggctgtgcttcctggagcccaccagcgaggccaagtacatccccccagacctgtgtgtgtgcaactttgtgctggagcagagcctgtctgtgcgggccctgcaggagatgctggccaacacaggagaaaatggaggagagggcgccgcccagggcggcggccacaggaccctgctgtatggccatgctgtgctgctgcggcacagcttcagcggcatgtacctgacctgcctgaccaccagccgcagccagacagacaagctggcctttgatgtgggcctgcgggagcacgccaccggggaggcctgctggtggaccatccacccagccagcaagcagaggtctgagggggagaaggtgagaattggagatgacctgatcctggtgtctgtgagcagcgagcgctacctgcacctgtctgtgtccaatggaaacatccaggtggatgccagcttcatgcagaccctgtggaatgtgcaccccacctgcagcggcagcagcattgaggagggctacctgctgggcggccacgtggtgcggctcttccacggccatgatgagtgcctgaccatccccagcacagaccagaatgacagccagcaccggcgcatcttctatgaagctggaggagctggcacccgggcccggagcctgtggagggtggagcccctgcgcatctcctggagcggcagcaacatccgctggggccaggccttccggctgcggcacctgaccaccggccactacctggccctgacagaggaccagggcctcatcctgcaggaccgggccaagagtgacaccaagagcacagccttctccttccgggccagcaaggagctgaaggagaagctggacagcagccacaagagggacatcgagggcatgggcgtgcctgagatcaagtacggggacagcgtgtgctttgtgcagcacatcgccagcggcctgtgggtgacctacaaggcccaggatgccaagaccagccggctgggccccctgaagaggaaggtgatcctgcaccaggagggccacatggatgatggcctgaccctgcagcgctgccagcgggaggagagccaggccgcccgcatcatccggaacaccacagccctcttcagccagtttgtgtctggcaacaacagaacagctgcccccatcaccctgcccatcgaggaggtgctgcagaccctgcaggacctgattgcctacttccagcccccagaggaggagatgagacatgaggacaagcagaacaagctgcggagcctgaagaaccggcagaacctcttcaaggaggagggcatgctggccctggtgctgaactgcatcgaccggctgaatgtgtacaacagcgtggcccactttgctggcatcgcccgggaggagagcggcatggcctggaaggagatcctgaacctgctgtacaagctgctggccgccctgatccggggcaacagaaacaactgtgcccagttcagcaacaacctggactggctgatcagcaagctggaccggctggagagcagcagcggcatcctggaggtgctgcactgcatcctgacagagagccctgaggccctgaacctgattgctgagggccacatcaagagcatcatcagcctgctggacaagcatggaagaaaccacaaggtgctggacatcctgtgcagcctgtgcctgtgcaatggagtggccgtgcgggccaaccagaacctgatctgtgacaacctgctgcccaggaggaacctgctgctgcagaccaggctcatcaatgatgtgaccagcatccggcccaacatcttcctgggcgtggccgagggcagcgcccagtacaagaagtggtactttgagctgatcatcgaccaggtggaccccttcctgacagctgagcccacccacctgcgggtgggctgggccagcagcagcggctacgccccctacccaggcggcggggagggctggggcggcaatggagtgggagatgacctgtacagctatggctttgatggcctgcacctgtggagcggccgcatccccagggctgtggccagcatcaaccagcacctgctgcggagtgatgatgtggtgtcctgctgcctggacctgggcgtgcccagcatctccttccgcatcaatggccagcctgtgcagggcatgtttgagaacttcaacacagatggcctcttcttccctgtgatgtccttctctgctggggtgaaggtgcgcttcctgatgggcggcagacatggagagttcaagttcctgccccccagcggctacgccccctgctatgaggccctgctgcccaaggagaagatgaggctggagcctgtgaaggagtacaagagagatgctgatggcatccgggacctgctgggcaccacccagttcctgagccaggccagcttcatcccctgccctgtggacaccagccaggtgatcctgcccccccacctggagaagatccgggaccggctggccgagaacatccacgagctgtggggcatgaacaagattgagctgggctggaccttcggcaagatcagagatgacaacaagaggcagcacccctgcctggtggagttcagcaagctgcctgagacagagaagaactacaacctgcagatgagcacagagaccctgaagaccctgctggccctgggctgccacatcgcccacgtgaacccagctgctgaggaggacctgaagaaggtgaagctgcccaagaactacatgatgagcaatggctacaagccagcccccctggacctgagtgatgtgaagctgctgcccccccaggagatcctggtggacaagctggccgagaatgcccacaacgtgtgggccaaggaccgcatcaagcagggctggacctacggcatccagcaggacctgaagaacaagaggaacccccggctggtgccctatgccctgctggatgagaggaccaagaagagcaacagagacagcctgcgggaggccgtgaggacctttgtgggctacggctacaacatcgagcccagcgaccaggagctggccgacagcgctgtggagaaggtgtccattgacaagatccgcttcttccgggtggagaggagctatgctgtgcgcagcggcaagtggtactttgaatttgaggtggtgactggaggagacatgagggtgggctgggcccggcccggctgcaggccagatgtggagctgggcgcagatgaccaggcctttgtgtttgagggcaacagaggccagcgctggcaccagggcagcggctacttcggccgcacctggcagcctggagatgtggtgggctgcatgatcaacctggatgatgcctccatgatcttcaccctgaatggagagctgctgatcaccaacaagggcagcgagctggcctttgctgactatgaaattgaaaatggatttgtgcccatctgctgcctgggcctgagccagatcggccgcatgaacctgggcacagatgccagcaccttcaagttctacaccatgtgtggcctgcaggagggctttgagccctttgctgtgaacatgaacagagatgtggccatgtggttcagcaagaggctgcccacctttgtgaatgtgcccaaggaccacccccacatcgaggtgatgagaattgatggcaccatggacagccccccctgcctgaaggtgacccacaagaccttcggcacccagaacagcaatgctgacatgatctactgccgcctgtccatgcctgtggagtgccacagcagcttcagccacagcccctgcctggacagcgaggccttccagaagaggaagcagatgcaggagatcctgagccacaccaccacccagtgctactatgccatccgcatctttgctggccaggaccccagctgtgtgtgggtgggctgggtgaccccagactaccacctgtacagcgagaagtttgacctgaacaagaactgcaccgtgacagtgaccctgggagatgagcggggccgggtgcatgaatctgtgaagaggagcaactgctacatggtgtggggcggggacatcgtggccagcagccagaggagcaacagaagcaatgtggacctggagatcggctgcctggtggacctggccatgggcatgctgtccttcagcgccaacgggaaggagctgggcacctgctaccaggtggagcccaacaccaaggtgtttcctgctgtgttcctgcagcccaccagcaccagcctcttccagtttgagctgggcaagctgaagaatgccatgcccctgtctgctgccatcttccgctctgaggagaagaaccctgtgccccagtgccccccccggctggatgtgcagaccatccagcctgtgctgtggagcaggatgcccaacagcttcctgaaggtggagacagagcgggtgtctgaaagacatggctgggtggtgcagtgcctggagcccctgcagatgatggccctgcacatcccagaagaaaatagatgtgtggacatcctggagctgtgtgagcaggaggacctgatgaggttccactaccacaccctgcggctgtacagcgctgtgtgtgccctgggcaacagccgggtggcctatgccctgtgcagccacgtggacctgagccagctgttctacgccatcgacaacaagtacctgcccggcctgctgcggagcggcttctatgacctgctgatcagcatccacctggccagcgccaaggagaggaagctgatgatgaagaatgagtacatcatccccatcaccagcaccaccaggaacatccgcctcttcccagatgagagcaagagacatggcctgcccggggtgggcctgcggacctgcctgaagccaggcttccgcttcagcaccccctgctttgtggtgactggagaggaccaccagaagcagagccctgagatccccctggagagcctgcggaccaaggccctgtccatgctgacagaggccgtgcagtgcagcggggcccacatccgggaccctgtgggcggctctgtggagttccagtttgtgcctgtgctgaagctgattggcaccctgctggtgatgggcgtgtttgatgatgatgatgtgcggcagatcctgctgctgattgaccccagcgtgtttggagagcacagcgctggaacagaggagggcgctgagaaggaggaggtgacccaggtggaggagaaggctgtggaggccggggagaaggccggcaaggaggcccctgtgaagggcctgctgcagacccggctgcctgagagcgtgaagctgcagatgtgtgagctgctgagctacctgtgtgactgtgagctgcagcaccgggtggaggccatcgtggcctttggagacatctacgtgtccaagctgcaggccaaccagaagttccgctacaatgagctgatgcaggccctgaacatgtctgctgccctgacagccaggaagaccaaggagttccgcagccccccccaggagcagatcaacatgctgctgaacttccagctgggggagaactgcccctgcccagaggagatccgggaggagctgtatgacttccacgaggacctgctgctgcactgcggcgtgcccctggaggaggaggaggaggaggaggaggacacctcctggacaggcaagctgtgtgccctggtgtacaagatcaagggcccccccaagccagagaaggagcagcccacagaggaggaggagcgctgccccaccaccctgaaggagctgatcagccagaccatgatctgctgggcccaggaggaccagatccaggacagcgagctggtgaggatgatgttcaacctgctgcggcggcagtatgacagcattggagagctgctgcaggccctgaggaagacctacaccatcagccacacctctgtgtctgacaccatcaacctgctggccgccctgggccagatccgcagcctgctgtctgtgaggatgggcaaggaggaggagctgctgatgatcaatggcctgggggacatcatgaacaacaaggtgttctaccagcaccccaacctgatgagggtgctgggcatgcatgagaccgtgatggaggtgatggtgaatgtgctgggcacagagaagagccagatcgccttccccaagatggtggccagctgctgccgcttcctgtgctacttctgccgcatcagccggcagaaccagaaggccatgtttgagcacctgagctacctgctggagaacagctctgtgggcctggccagccccagcatgaggggcagcacccccctggatgtggccgccagctctgtgatggacaacaatgagctggccctgagcctggaggagccagacctggagaaggtggtgacctacctggccggctgcggcctgcagagctgccccatgctgctggccaagggctacccagatgtgggctggaaccccatcgagggggagcgctacctgtccttcctgcgctttgctgtgtttgtgaacagcgagagcgtggaggagaatgcctctgtggtggtgaagctgctgatcagaagacctgagtgcttcggccctgccctgcggggggagggcggcaatggcctgctggccgccatgcagggcgccatcaagatcagcgagaacccagccctggacctgcccagccagggctacaagcgggaggtgtccactggagatgatgaggaggaggaggagatcgtgcacatgggaaatgccatcatgtccttctacagcgccctgattgacctgctgggccgctgtgcccctgagatgcacctgatccagacaggcaagggggaggccatccgcatccgcagcatcctgcggagcctggtgcccacagaggacctggtgggcatcatcagcatccccctgaagctgcccagcctgaacaaggatggctctgtgtctgagccagacatggccgccaacttctgcccagaccacaaggcccccatggtgctcttcctggacagagtgtatggcatcaaggaccagaccttcctgctgcacctgctggaggtgggcttcctgcctgacctgcgggccagcgccagcctggacacagtgtccctgagcaccacagaagctgccctggccctgaaccgctacatctgcagcgctgtgctgcccctgctgacccgctgtgcccccctgtttgctggaacagagcactgcaccagcctgattgacagcaccctgcagaccatctaccgcctgagcaagggccgcagcctgaccaaggcccagagggacaccatcgaggagtgcctgctggccatctgcaaccacctgcggcccagcatgctgcagcagctgctgcggcggctggtgtttgatgtgccccagctgaatgagtactgcaagatgcccctgaagctgctgaccaaccactatgagcagtgctggaagtactactgcctgcccagcggctggggcagctatggcctggccgtggaggaggagctgcacctgacagagaagctgttctggggcatctttgacagcctgagccacaagaagtatgaccctgacctcttcaggatggccctgccctgcctgagcgccatcgccggggccctgcccccagactacctggacacccgcatcacagccaccctggagaagcagatctctgtggatgctgatggcaactttgaccccaagcccatcaacaccatgaacttcagcctgcctgagaagctggagtacatcgtgaccaagtatgcagagcacagccatgacaagtgggcctgtgacaagagccagagcggctggaagtatggcatcagcctggatgaaaatgtgaagacccaccccctcatccggcccttcaagaccctgacagagaaggagaaggagatctaccgctggccagcccgggagagcctgaagaccatgctggccgtgggctggacagtggagaggaccaaggagggggaggccctggtgcagcagcgggagaatgagaagctgcggtctgtgtcccaggccaaccagggcaacagctacagccctgcccccctggacctgagcaatgtggtgctgagccgggagctgcagggcatggtggaggtggtggccgagaactaccacaacatctgggccaagaagaagaagctggagctggagagcaagggcggcggcagccaccccctgctggtgccctatgacaccctgacagccaaggagaagttcaaggaccgggagaaggcccaggacctcttcaagttcctgcaggtgaatggcatcatcgtgtcccggggcatgaaggacatggagctggatgccagctccatggagaagagatttgcctacaagttcctgaagaagatcctgaagtatgtggacagcgcccaggagttcatcgcccacctggaggccatcgtgagcagcggcaagacagagaagagcccccgggaccaggagatcaagttctttgccaaggtgctgctgcccctggtggaccagtacttcaccagccactgcctgtacttcctgagcagccccctgaagcccctgagcagcagcggctacgccagccacaaggagaaggagatggtggccggcctcttctgcaagctggccgccctggtgcgccaccgcatcagcctgtttggaagtgacagcaccaccatggtgtcctgcctgcacatcctggcccagaccctggacaccaggacagtgatgaagagcggcagcgagctggtgaaggccggcctgcgggccttctttgaaaatgctgctgaggacctggagaagaccagcgagaacctgaagctgggcaagttcacccacagcaggacccagatcaagggcgtgtcccagaacatcaactacaccaccgtggccctgctgcccatcctgaccagcatctttgaacatgtgacccagcaccagtttggcatggacctgctgctgggagatgtgcagatcagctgctaccacatcctgtgcagcctgtacagcctgggcaccgggaagaacatctacgtggagcggcagaggcctgccctgggagaatgtctggccagcctggccgccgccatccctgtggccttcctggagcccaccctgaaccgctacaaccccctgagcgtcttcaacaccaagaccccccgggagaggagcatcctgggcatgccagacacagtggaggacatgtgcccagacatcccccagctggagggcctgatgaaggagatcaatgacctggccgagagcggggcccgctacacagagatgcctcatgtgattgaagtcatcctgcccatgctgtgcaactacctgagctactggtgggagcggggccctgagaacctgccccccagcacaggcccctgctgcaccaaggtgaccagcgagcacctgagcctcatcctgggcaacatcctgaagatcatcaacaacaacctgggcattgatgaggcctcctggatgaagagaattgctgtgtatgcccagcccatcatcagcaaggcccggccagacctgctgcggagccacttcatccccaccctggagaagctgaagaagaaggctgtgaagacagtgcaggaggaggagcagctgaaggcagatggaaaaggagacacccaggaggccgagctgctgatcctggatgaatttgctgtgctgtgccgggacctgtatgccttctaccccatgctgatccgctacgtggacaacaacagaagcaactggctgaagagcccagatgctgacagcgaccagctgttcaggatggtggccgaggtgttcatcctgtggtgcaagagccacaacttcaagcgggaggagcagaactttgtgatccagaatgagatcaacaacctggccttcctgaccggggacagcaagagcaagatgagcaaggccatgcaggtgaagagcggcggccaggaccaggagaggaagaagaccaagagaagaggagacctgtacagcatccagaccagcctgattgtggccgccctgaagaagatgctgcccatcggcctgaacatgtgcacccctggggaccaggagctgatcagcctggccaagagccgctacagccaccgggacacagatgaggaggtgcgggagcacctgaggaacaacctgcacctgcaggagaagagtgatgatcctgctgtgaagtggcagctgaacctgtacaaggatgtgctgaagtctgaggagcccttcaaccctgagaagacagtggagcgggtgcagaggatctctgctgctgtgttccacctggagcaggtggagcagcccctgcggagcaagaaggctgtgtggcacaagctgctgagcaagcagaggaagagagctgtggtggcctgcttcaggatggcccccctgtacaacctgcccaggcacaggagcatcaacctcttcctgcacggctaccagcgcttctggattgaaacagaggagtacagctttgaggagaagctggtgcaggacctggccaagagccccaaggtggaggaggaggaggaggaggagacagagaagcagcctgaccccctgcaccagatcatcctgtacttcagcagaaatgccctgacagagaggagcaagctggaggatgaccccctgtacaccagctacagctccatgatggccaagagctgccagagcggggaggatgaggaggaggatgaggacaaggagaagacctttgaggagaaggagatggagaagcagaagaccctgtaccagcaggcccggctgcacgagagaggagctgctgagatggtgctgcagatgatcagcgccagcaagggggagatgagccccatggtggtggagaccctgaagctgggcatcgccatcctgaatggaggaaatgccggcgtgcagcagaagatgctggactacctgaaggagaagaaggatgctggcttcttccagagcctgagcggcctgatgcagagctgcagcgtgctggacctgaatgcctttgagcggcagaacaaggccgagggcctgggcatggtgacagaggagggcaccctgattgtgcgggagcggggggagaaggtgctgcagaatgatgagttcacccgggacctcttccgcttcctgcagctgctgtgtgagggccacaacagcgacttccagaacttcctgcggacccagatgggcaacaccaccaccgtgaatgtcatcatcagcacagtggactacctgctgcggctgcaggagagcatcagtgacttctactggtactacagcggcaaggacatcattgatgaaagtggccagcacaacttcagcaaggccctggccgtgaccaagcagatcttcaacagcctgacagagtacatccagggcccctgcatcggcaaccagcagagcctggcccacagccggctgtgggatgctgtggtgggcttcctgcacgtgtttgccaacatgcagatgaagctgagccaggacagcagccagatcgagctgctgaaggagctgctggacctgctgcaggacatggtggtgatgctgctgagcctgctggagggcaatgtggtgaatggcaccatcggcaagcagatggtggacaccctggtggagagcagcaccaacgtggagatgatcctgaagttctttgacatgttcctgaagctgaaggacctgaccagcagtgacaccttcaaggagtatgaccctgatggcaagggcatcatcagcaagaaggagttccagaaggccatggagggccagaagcagtacacccagagcgagattgacttcctgctgagctgtgccgaggctgatgaaaatgacatgttcaactacgtggactttgtggaccgcttccacgagcccgccaaggacatcggcttcaacgtggccgtgctgctgaccaacctgtctgagcacatgcccaatgacagccggctgaagtgcctgctggaccctgctgagagcgtgctgaactactttgagccctacctgggccgcatcgagatcatgggcggggccaagaagattgagcgggtgtactttgagatcagcgagagcagcaggacccagtgggagaagccccaggtgaaggagagcaagaggcagttcatctttgatgtggtgaatgaaggaggagagcaggagaagatggagctgtttgtgaacttctgtgaggacaccatctttgagatgcagctggccagccagatcagcgagagtgacagcgctgacaggcctgaggaggaggaggaggatgaggacagcagctatgtgctggagattgctggggaggaggaggaggatggcagcctggagcccgccagcgcctttgccatggcctgtgcctctgtgaagagaaatgtgacagacttcctgaagagggccaccctgaagaacctgaggaagcagtacagaaatgtgaagaagatgacagccaaggagctggtgaaggtgctcttctccttcttctggatgctgtttgtgggcctcttccagctgctcttcaccatcctgggcggcatcttccagatcctgtggagcacagtgtttggaggcggcctggtggagggcgccaagaacatccgggtgaccaagatcctgggggacatgccagaccccacccagtttggcatccatgatgacaccatggaggccgagagagctgaggtgatggagcccggcatcaccacagagctggtgcacttcatcaagggggagaagggggacacagacatcatgtctgacctgtttggcctgcaccccaagaaggagggcagcctgaagcacggccctgaggtgggcctgggggacctgtctgagatcatcggcaaggatgagccccccaccctggagagcacagtgcagaagaagaggaaggcccaggccgctgagatgaaggccgccaatgaggccgagggcaaggtggagagcgagaaggctgacatggaggatggagagaaggaggacaaggacaaggaggaggagcaggccgagtacctgtggacagaggtgaccaagaagaagaagagaagatgtggccagaaggtggagaagccagaggccttcaccgccaacttcttcaagggcctggagatctaccagaccaagctgctgcactacctggccaggaacttctacaacctgcgcttcctggccctgtttgtggcctttgccatcaacttcatcctgctcttctacaaggtgacagaggagcccctggaggaggagacagaagatgtggccaacctgtggaacagcttcaatgatgaggaggaggaggaggccatggtgttctttgtgctgcaggagagcacaggctacatggcccccaccctgcgggccctggccatcatccacaccatcatcagcctggtgtgtgtggtgggctactactgcctgaaggtgcccctggtggtgttcaagcgggagaaggagatcgccaggaagctggagtttgatggcctgtacatcacagagcagcccagtgaagatgacatcaagggccagtgggaccggctggtgatcaacacccccagcttccccaacaactactgggacaagtttgtgaagaggaaggtgatcaacaagtacggggacctgtatggagctgagagaattgctgagctgctgggcctggacaagaatgccctggacttcagccctgtggaggagaccaaggccgaggccgccagcctggtgtcctggctgagcagcattgacatgaagtaccacatctggaagctgggcgtggtgttcacagacaacagcttcctgtacctggcctggtacaccaccatgtctgtgctgggccactacaacaacttcttctttgctgcccacctgctggacatcgccatgggcttcaagaccctgcggaccatcctgagctctgtgacccacaacgggaagcagctggtgctgactgtgggcctgctggccgtggtggtgtacctgtacacagtggtggccttcaacttcttcaggaagttctacaacaagtcagaagatgatgatgagccagacatgaagtgtgatgacatgatgacctgctacctgttccacatgtatgtgggcgtgcgggccggcggcggcattggagatgaaattgaagatcctgctggggacccctatgagatgtacagaattgtgtttgacatcaccttcttcttcttcgtcatcgtcatcctgctggccatcatccagggcctcatcattgatgcctttggagagctgcgggaccagcaggagcaggtgcgggaggacatggagaccaagtgcttcatctgtggcattggaaatgactactttgacaccaccccccacggctttgagacccacaccctgcaggagcacaacctggccaactacctgttcttcctgatgtacctgatcaacaaggatgaaacagagcacacaggccaggagagctatgtgtggaagatgtaccaggagcgctgctgggacttcttccctgctggggactgcttcaggaagcagtatgaggaccagctgggctag

SEQ ID NO: 168715 - DNA, 14598 bp, Artificial Sequence
  Description of Artificial Sequence: Synthetic coding sequence
atggccgagggcggggagggcggagaagatgagatccagttcctgaggacagaagatgaggtggtgctgcagtgcatcgccaccatccacaaggagcagaggaagttctgcctggccgctgagggcctgggcaaccggctgtgcttcctggagcccaccagcgaggccaagtacatccccccagacctgtgtgtgtgcaactttgtgctggagcagagcctgtctgtgcgggccctgcaggagatgctggccaacacaggagaaaatggaggagagggcgccgcccagggcggcggccacaggaccctgctgtatggccatgctgtgctgctgcggcacagcttcagcggcatgtacctgacctgcctgaccaccagccgcagccagacagacaagctggcctttgatgtgggcctgcgggagcacgccaccggggaggcctgctggtggaccatccacccagccagcaagcagaggtctgagggggagaaggtgagaattggagatgacctgatcctggtgtctgtgagcagcgagcgctacctgcacctgtctgtgtccaatggaaacatccaggtggatgccagcttcatgcagaccctgtggaatgtgcaccccacctgcagcggcagcagcattgaggagggctacctgctgggcggccacgtggtgcggctcttccacggccatgatgagtgcctgaccatccccagcacagaccagaatgacagccagcaccggcgcatcttctatgaagctggaggagctggcacccgggcccggagcctgtggagggtggagcccctgcgcatctcctggagcggcagcaacatccgctggggccaggccttccggctgcggcacctgaccaccggccactacctggccctgacagaggaccagggcctcatcctgcaggaccgggccaagagtgacaccaagagcacagccttctccttccgggccagcaaggagctgaaggagaagctggacagcagccacaagagggacatcgagggcatgggcgtgcctgagatcaagtacggggacagcgtgtgctttgtgcagcacatcgccagcggcctgtgggtgacctacaaggcccaggatgccaagaccagccggctgggccccctgaagaggaaggtgatcctgcaccaggagggccacatggatgatggcctgaccctgcagcgctgccagcgggaggagagccaggccgcccgcatcatccggaacaccacagccctcttcagccagtttgtgtctggcaacaacagaacagctgcccccatcaccctgcccatcgaggaggtgctgcagaccctgcaggacctgattgcctacttccagcccccagaggaggagatgagacatgaggacaagcagaacaagctgcggagcctgaagaaccggcagaacctcttcaaggaggagggcatgctggccctggtgctgaactgcatcgaccggctgaatgtgtacaacagcgtggcccactttgctggcatcgcccgggaggagagcggcatggcctggaaggagatcctgaacctgctgtacaagctgctggccgccctgatccggggcaacagaaacaactgtgcccagttcagcaacaacctggactggctgatcagcaagctggaccggctggagagcagcagcggcatcctggaggtgctgcactgcatcctgacagagagccctgaggccctgaacctgattgctgagggccacatcaagagcatcatcagcctgctggacaagcatggaagaaaccacaaggtgctggacatcctgtgcagcctgtgcctgtgcaatggagtggccgtgcgggccaaccagaacctgatctgtgacaacctgctgcccaggaggaacctgctgctgcagaccaggctcatcaatgatgtgaccagcatccggcccaacatcttcctgggcgtggccgagggcagcgcccagtacaagaagtggtactttgagctgatcatcgaccaggtggaccccttcctgacagctgagcccacccacctgcgggtgggctgggccagcagcagcggctacgccccctacccaggcggcggggagggctggggcggcaatggagtgggagatgacctgtacagctatggctttgatggcctgcacctgtggagcggccgcatccccagggctgtggccagcatcaaccagcacctgctgcggagtgatgatgtggtgtcctgctgcctggacctgggcgtgcccagcatctccttccgcatcaatggccagcctgtgcagggcatgtttgagaacttcaacacagatggcctcttcttccctgtgatgtccttctctgctggggtgaaggtgcgcttcctgatgggcggcagacatggagagttcaagttcctgccccccagcggctacgccccctgctatgaggccctgctgcccaaggagaagatgaggctggagcctgtgaaggagtacaagagagatgctgatggcatccgggacctgctgggcaccacccagttcctgagccaggccagcttcatcccctgccctgtggacaccagccaggtgatcctgcccccccacctggagaagatccgggaccggctggccgagaacatccacgagctgtggggcatgaacaagattgagctgggctggaccttcggcaagatcagagatgacaacaagaggcagcacccctgcctggtggagttcagcaagctgcctgagacagagaagaactacaacctgcagatgagcacagagaccctgaagaccctgctggccctgggctgccacatcgcccacgtgaacccagctgctgaggaggacctgaagaaggtgaagctgcccaagaactacatgatgagcaatggctacaagccagcccccctggacctgagtgatgtgaagctgctgcccccccaggagatcctggtggacaagctggccgagaatgcccacaacgtgtgggccaaggaccgcatcaagcagggctggacctacggcatccagcaggacctgaagaacaagaggaacccccggctggtgccctatgccctgctggatgagaggaccaagaagagcaacagagacagcctgcgggaggccgtgaggacctttgtgggctacggctacaacatcgagcccagcgaccaggagctggccgacagcgctgtggagaaggtgtccattgacaagatccgcttcttccgggtggagaggagctatgctgtgcgcagcggcaagtggtactttgaatttgaggtggtgactggaggagacatgagggtgggctgggcccggcccggctgcaggccagatgtggagctgggcgcagatgaccaggcctttgtgtttgagggcaacagaggccagcgctggcaccagggcagcggctacttcggccgcacctggcagcctggagatgtggtgggctgcatgatcaacctggatgatgcctccatgatcttcaccctgaatggagagctgctgatcaccaacaagggcagcgagctggcctttgctgactatgaaattgaaaatggatttgtgcccatctgctgcctgggcctgagccagatcggccgcatgaacctgggcacagatgccagcaccttcaagttctacaccatgtgtggcctgcaggagggctttgagccctttgctgtgaacatgaacagagatgtggccatgtggttcagcaagaggctgcccacctttgtgaatgtgcccaaggaccacccccacatcgaggtgatgagaattgatggcaccatggacagccccccctgcctgaaggtgacccacaagaccttcggcacccagaacagcaatgctgacatgatctactgccgcctgtccatgcctgtggagtgccacagcagcttcagccacagcccctgcctggacagcgaggccttccagaagaggaagcagatgcaggagatcctgagccacaccaccacccagtgctactatgccatccgcatctttgctggccaggaccccagctgtgtgtgggtgggctgggtgaccccagactaccacctgtacagcgagaagtttgacctgaacaagaactgcaccgtgacagtgaccctgggagatgagcggggccgggtgcatgaatctgtgaagaggagcaactgctacatggtgtggggcggggacatcgtggccagcagccagaggagcaacagaagcaatgtggacctggagatcggctgcctggtggacctggccatgggcatgctgtccttcagcgccaacgggaaggagctgggcacctgctaccaggtggagcccaacaccaaggtgtttcctgctgtgttcctgcagcccaccagcaccagcctcttccagtttgagctgggcaagctgaagaatgccatgcccctgtctgctgccatcttccgctctgaggagaagaaccctgtgccccagtgccccccccggctggatgtgcagaccatccagcctgtgctgtggagcaggatgcccaacagcttcctgaaggtggagacagagcgggtgtctgaaagacatggctgggtggtgcagtgcctggagcccctgcagatgatggccctgcacatcccagaagaaaatagatgtgtggacatcctggagctgtgtgagcaggaggacctgatgaggttccactaccacaccctgcggctgtacagcgctgtgtgtgccctgggcaacagccgggtggcctatgccctgtgcagccacgtggacctgagccagctgttctacgccatcgacaacaagtacctgcccggcctgctgcggagcggcttctatgacctgctgatcagcatccacctggccagcgccaaggagaggaagctgatgatgaagaatgagtacatcatccccatcaccagcaccaccaggaacatccgcctcttcccagatgagagcaagagacatggcctgcccggggtgggcctgcggacctgcctgaagccaggcttccgcttcagcaccccctgctttgtggtgactggagaggaccaccagaagcagagccctgagatccccctggagagcctgcggaccaaggccctgtccatgctgacagaggccgtgcagtgcagcggggcccacatccgggaccctgtgggcggctctgtggagttccagtttgtgcctgtgctgaagctgattggcaccctgctggtgatgggcgtgtttgatgatgatgatgtgcggcagatcctgctgctgattgaccccagcgtgtttggagagcacagcgctggaacagaggagggcgctgagaaggaggaggtgacccaggtggaggagaaggctgtggaggccggggagaaggccggcaaggaggcccctgtgaagggcctgctgcagacccggctgcctgagagcgtgaagctgcagatgtgtgagctgctgagctacctgtgtgactgtgagctgcagcaccgggtggaggccatcgtggcctttggagacatctacgtgtccaagctgcaggccaaccagaagttccgctacaatgagctgatgcaggccctgaacatgtctgctgccctgacagccaggaagaccaaggagttccgcagccccccccaggagcagatcaacatgctgctgaacttccagctgggggagaactgcccctgcccagaggagatccgggaggagctgtatgacttccacgaggacctgctgctgcactgcggcgtgcccctggaggaggaggaggaggaggaggaggacacctcctggacaggcaagctgtgtgccctggtgtacaagatcaagggcccccccaagccagagaaggagcagcccacagaggaggaggagcgctgccccaccaccctgaaggagctgatcagccagaccatgatctgctgggcccaggaggaccagatccaggacagcgagctggtgaggatgatgttcaacctgctgcggcggcagtatgacagcattggagagctgctgcaggccctgaggaagacctacaccatcagccacacctctgtgtctgacaccatcaacctgctggccgccctgggccagatccgcagcctgctgtctgtgaggatgggcaaggaggaggagctgctgatgatcaatggcctgggggacatcatgaacaacaaggtgttctaccagcaccccaacctgatgagggtgctgggcatgcatgagaccgtgatggaggtgatggtgaatgtgctgggcacagagaagagccagatcgccttccccaagatggtggccagctgctgccgcttcctgtgctacttctgccgcatcagccggcagaaccagaaggccatgtttgagcacctgagctacctgctggagaacagctctgtgggcctggccagccccagcatgaggggcagcacccccctggatgtggccgccagctctgtgatggacaacaatgagctggccctgagcctggaggagccagacctggagaaggtggtgacctacctggccggctgcggcctgcagagctgccccatgctgctggccaagggctacccagatgtgggctggaaccccatcgagggggagcgctacctgtccttcctgcgctttgctgtgtttgtgaacagcgagagcgtggaggagaatgcctctgtggtggtgaagctgctgatcagaagacctgagtgcttcggccctgccctgcggggggagggcggcaatggcctgctggccgccatgcagggcgccatcaagatcagcgagaacccagccctggacctgcccagccagggctacaagcgggaggtgtccactggagatgatgaggaggaggaggagatcgtgcacatgggaaatgccatcatgtccttctacagcgccctgattgacctgctgggccgctgtgcccctgagatgcacctgatccagacaggcaagggggaggccatccgcatccgcagcatcctgcggagcctggtgcccacagaggacctggtgggcatcatcagcatccccctgaagctgcccagcctgaacaaggatggctctgtgtctgagccagacatggccgccaacttctgcccagaccacaaggcccccatggtgctcttcctggacagagtgtatggcatcaaggaccagaccttcctgctgcacctgctggaggtgggcttcctgcctgacctgcgggccagcgccagcctggacacagtgtccctgagcaccacagaagctgccctggccctgaaccgctacatctgcagcgctgtgctgcccctgctgacccgctgtgcccccctgtttgctggaacagagcactgcaccagcctgattgacagcaccctgcagaccatctaccgcctgagcaagggccgcagcctgaccaaggcccagagggacaccatcgaggagtgcctgctggccatctgcaaccacctgcggcccagcatgctgcagcagctgctgcggcggctggtgtttgatgtgccccagctgaatgagtactgcaagatgcccctgaagctgctgaccaaccactatgagcagtgctggaagtactactgcctgcccagcggctggggcagctatggcctggccgtggaggaggagctgcacctgacagagaagctgttctggggcatctttgacagcctgagccacaagaagtatgaccctgacctcttcaggatggccctgccctgcctgagcgccatcgccggggccctgcccccagactacctggacacccgcatcacagccaccctggagaagcagatctctgtggatgctgatggcaactttgaccccaagcccatcaacaccatgaacttcagcctgcctgagaagctggagtacatcgtgaccaagtatgcagagcacagccatgacaagtgggcctgtgacaagagccagagcggctggaagtatggcatcagcctggatgaaaatgtgaagacccaccccctcatccggcccttcaagaccctgacagagaaggagaaggagatctaccgctggccagcccgggagagcctgaagaccatgctggccgtgggctggacagtggagaggaccaaggagggggaggccctggtgcagcagcgggagaatgagaagctgcggtctgtgtcccaggccaaccagggcaacagctacagccctgcccccctggacctgagcaatgtggtgctgagccgggagctgcagggcatggtggaggtggtggccgagaactaccacaacatctgggccaagaagaagaagctggagctggagagcaagggcggcggcagccaccccctgctggtgccctatgacaccctgacagccaaggagaagttcaaggaccgggagaaggcccaggacctcttcaagttcctgcaggtgaatggcatcatcgtgtcccggggcatgaaggacatggagctggatgccagctccatggagaagagatttgcctacaagttcctgaagaagatcctgaagtatgtggacagcgcccaggagttcatcgcccacctggaggccatcgtgagcagcggcaagacagagaagagcccccgggaccaggagatcaagttctttgccaaggtgctgctgcccctggtggaccagtacttcaccagccactgcctgtacttcctgagcagccccctgaagcccctgagcagcagcggctacgccagccacaaggagaaggagatggtggccggcctcttctgcaagctggccgccctggtgcgccaccgcatcagcctgtttggaagtgacagcaccaccatggtgtcctgcctgcacatcctggcccagaccctggacaccaggacagtgatgaagagcggcagcgagctggtgaaggccggcctgcgggccttctttgaaaatgctgctgaggacctggagaagaccagcgagaacctgaagctgggcaagttcacccacagcaggacccagatcaagggcgtgtcccagaacatcaactacaccaccgtggccctgctgcccatcctgaccagcatctttgaacatgtgacccagcaccagtttggcatggacctgctgctgggagatgtgcagatcagctgctaccacatcctgtgcagcctgtacagcctgggcaccgggaagaacatctacgtggagcggcagaggcctgccctgggagaatgtctggccagcctggccgccgccatccctgtggccttcctggagcccaccctgaaccgctacaaccccctgagcgtcttcaacaccaagaccccccgggagaggagcatcctgggcatgccagacacagtggaggacatgtgcccagacatcccccagctggagggcctgatgaaggagatcaatgacctggccgagagcggggcccgctacacagagatgcctcatgtgattgaagtcatcctgcccatgctgtgcaactacctgagctactggtgggagcggggccctgagaacctgccccccagcacaggcccctgctgcaccaaggtgaccagcgagcacctgagcctcatcctgggcaacatcctgaagatcatcaacaacaacctgggcattgatgaggcctcctggatgaagagaattgctgtgtatgcccagcccatcatcagcaaggcccggccagacctgctgcggagccacttcatccccaccctggagaagctgaagaagaaggctgtgaagacagtgcaggaggaggagcagctgaaggcagatggaaaaggagacacccaggaggccgagctgctgatcctggatgaatttgctgtgctgtgccgggacctgtatgccttctaccccatgctgatccgctacgtggacaacaacagaagcaactggctgaagagcccagatgctgacagcgaccagctgttcaggatggtggccgaggtgttcatcctgtggtgcaagagccacaacttcaagcgggaggagcagaactttgtgatccagaatgagatcaacaacctggccttcctgaccggggacagcaagagcaagatgagcaagagcggcggccaggaccaggagaggaagaagaccaagagaagaggagacctgtacagcatccagaccagcctcatcgtggccgccctgaagaagatgctgcccatcggcctgaacatgtgcacccctggggaccaggagctgatcagcctggccaagagccgctacagccaccgggacacagatgaggaggtgcgggagcacctgaggaacaacctgcacctgcaggagaagagtgatgatcctgctgtgaagtggcagctgaacctgtacaaggatgtgctgaagtctgaggagcccttcaaccctgagaagacagtggagcgggtgcagaggatctctgctgctgtgttccacctggagcaggtggagcagcccctgcggagcaagaaggctgtgtggcacaagctgctgagcaagcagaggaagagagctgtggtggcctgcttcaggatggcccccctgtacaacctgcccaggcacaggagcatcaacctcttcctgcacggctaccagcgcttctggattgaaacagaggagtacagctttgaggagaagctggtgcaggacctggccaagagccccaaggtggaggaggaggaggaggaggagacagagaagcagcctgaccccctgcaccagatcatcctgtacttcagcagaaatgccctgacagagaggagcaagctggaggatgaccccctgtacaccagctacagctccatgatggccaagagctgccagagcggagaagatgaggaggaggatgaggacaaggagaagacctttgaggagaaggagatggagaagcagaagaccctgtaccagcaggcccggctgcacgagagaggagctgctgagatggtgctgcagatgatcagcgccagcaaaggagagatgagccccatggtggtggagaccctgaagctgggcatcgccatcctgaatggaggaaatgctggggtgcagcagaagatgctggactacctgaaggagaagaaggatgctggcttcttccagagcctgagcggcctgatgcagagctgcagcgtgctggacctgaatgcctttgagcggcagaacaaggccgagggcctgggcatggtgacagaggagggcaccctcatcgtgcgggagcggggggagaaggtgctgcagaatgatgagttcacccgggacctcttccgcttcctgcagctgctgtgtgagggccacaacagcgacttccagaacttcctgcggacccagatgggcaacaccaccaccgtgaatgtcatcatcagcacagtggactacctgctgcggctgcaggagagcatcagtgacttctactggtactacagcggcaaggacatcattgatgagagcggccagcacaacttcagcaaggccctggccgtgaccaagcagatcttcaacagcctgacagagtacatccagggcccctgcatcggcaaccagcagagcctggcccacagccggctgtgggatgctgtggtgggcttcctgcacgtgtttgccaacatgcagatgaagctgagccaggacagcagccagatcgagctgctgaaggagctgctggacctgctgcaggacatggtggtgatgctgctgagcctgctggagggcaatgtggtgaatggcaccatcggcaagcagatggtggacaccctggtggagagcagcaccaacgtggagatgatcctgaagttctttgacatgttcctgaagctgaaggacctgaccagcagtgacaccttcaaggagtatgaccctgatggcaagggcatcatcagcaagaaggagttccagaaggccatggagggccagaagcagtacacccagagcgagattgacttcctgctgagctgtgccgaggctgatgaaaatgacatgttcaactacgtggactttgtggaccgcttccacgagcccgccaaggacatcggcttcaacgtggccgtgctgctgaccaacctgtctgagcacatgcccaatgacagccggctgaagtgcctgctggaccctgctgagagcgtgctgaactactttgagccctacctgggcagaattgagatcatgggcggggccaagaagattgaaagagtgtactttgagatcagcgagagcagcaggacccagtgggagaagccccaggtgaaggagagcaagaggcagttcatctttgatgtggtgaatgaaggaggagagcaggagaagatggagctgtttgtgaacttctgtgaggacaccatctttgagatgcagctggccagccagatcagcgagagtgacagcgctgacaggcctgaggaggaggaggaggatgaggacagcagctatgtgctggagattgctggggaggaggaggaggatggcagcctggagcccgccagcgcctttgccatggcctgtgcctctgtgaagagaaatgtgacagacttcctgaagagggccaccctgaagaacctgaggaagcagtacagaaatgtgaagaagatgacagccaaggagctggtgaaggtgctcttctccttcttctggatgctgtttgtgggcctcttccagctgctcttcaccatcctgggcggcatcttccagatcctgtggagcacagtgtttggaggcggcctggtggagggcgccaagaacatccgggtgaccaagatcctgggggacatgccagaccccacccagtttggcatccatgatgacaccatggaggccgagcgggcagaggtgatggagcccggcatcaccacagagctggtgcacttcatcaagggggagaagggggacacagacatcatgtctgacctgtttggcctgcaccccaagaaggagggcagcctgaagcacggccctgaggtgggcctgggggacctgtctgagatcatcggcaaggatgagccccccaccctggagagcacagtgcagaagaagaggaaggcccaggccgctgagatgaaggccgccaatgaagctgagggcaaggtggagagcgagaaggctgacatggaggatggagagaaggaggacaaggacaaggaggaggagcaggccgagtacctgtggacagaggtgaccaagaagaagaagaggcgctgtggccagaaggtggagaagccagaggccttcaccgccaacttcttcaagggcctggagatctaccagaccaagctgctgcactacctggccaggaacttctacaacctgcgcttcctggccctgtttgtggcctttgccatcaacttcatcctgctcttctacaaggtgacagaggagcccctggaggaggagacagaagatgtggccaacctgtggaacagcttcaatgatgaggaggaggaggaggccatggtgttctttgtgctgcaggagagcacaggctacatggcccccaccctgcgggccctggccatcatccacaccatcatcagcctggtgtgtgtggtgggctactactgcctgaaggtgcccctggtggtgttcaagcgggagaaggagatcgccaggaagctggagtttgatggcctgtacatcacagagcagcccagtgaagatgacatcaagggccagtgggaccggctggtgatcaacacccccagcttccccaacaactactgggacaagtttgtgaagaggaaggtgatcaacaagtatggagacctgtatggagctgagagaattgctgagctgctgggcctggacaagaatgccctggacttcagccctgtggaggagaccaaggccgaggccgccagcctggtgtcctggctgagcagcattgacatgaagtaccacatctggaagctgggcgtggtgttcacagacaacagcttcctgtacctggcctggtacaccaccatgtctgtgctgggccactacaacaacttcttctttgctgcccacctgctggacatcgccatgggcttcaagaccctgcggaccatcctgagctctgtgacccacaacgggaagcagctggtgctgactgtgggcctgctggccgtggtggtgtacctgtacacagtggtggccttcaacttcttcaggaagttctacaacaagtcagaagatgatgatgagccagacatgaagtgtgatgacatgatgacctgctacctgttccacatgtatgtgggcgtgcgggccggcggcggcattggagatgaaattgaggaccctgctggggacccctatgagatgtaccgcatcgtgtttgacatcaccttcttcttctttgtgattgtcatcctgctggccatcatccagggcctcatcattgatgccttcggggagctgcgggaccagcaggagcaggtgcgggaggacatggagaccaagtgcttcatctgtggcattggaaatgactactttgacaccacccctcatggctttgagacccacaccctgcaggagcacaacctggccaactacctgttcttcctgatgtacctgatcaacaaggatgaaacagagcacacaggccaggagagctatgtgtggaagatgtaccaggagcgctgctgggacttcttccctgctggggactgcttcaggaagcagtatgaggaccagctgggctag

SEQ ID NO: 168716 - DNA, 285 bp, Artificial Sequence
  Description of Artificial Sequence: Synthetic coding sequence
atgggcagcgagctggagacagccatggagaccctcatcaacgtgttccacgcccacagcggcaaggagggggacaagtacaagctgagcaagaaggagctgaaggagctgctgcagacagagctgagcggcttcctggatgcccagaaggatgtggatgctgtggacaaggtgatgaaggagctggatgaaaatggagatggagaggtggacttccaggagtatgtggtgctggtggccgccctgactgtggcctgcaacaacttcttctgggagaacagctag

SEQ ID NO: 168717 - DNA, 162 bp, Artificial Sequence
  Description of Artificial Sequence: Synthetic coding sequence
atgggcagcgagctggagacagccatggagaccctcatcaacgtgttccacgcccacagcggcaaggagggggacaagtacaagctgagcaagaaggagctgaaggagctgctgcagacagagctgagcggcttcctggatgtgaaggagctgatgctgtag

SEQ ID NO: 168718 - DNA, 444 bp, Artificial Sequence
  Description of Artificial Sequence: Synthetic coding sequence
atggaggagccccagaccaagacccccagcgctgagttccccccctaccgggcccagcctgcccagcctgccacagccccagctgccacctttgccaccctggccatctgcccagagcccgcccccaccagcggccctggccagccctgcacagctgccatgggcagcgagctggagacagccatggagaccctcatcaacgtgttccacgcccacagcggcaaggagggggacaagtacaagctgagcaagaaggagctgaaggagctgctgcagacagagctgagcggcttcctggatgcccagaaggatgtggatgctgtggacaaggtgatgaaggagctggatgaaaatggagatggagaggtggacttccaggagtatgtggtgctggtggccgccctgactgtggcctgcaacaacttcttctgggagaacagctag

SEQ ID NO: 168719 - DNA, 105 bp, Artificial Sequence
  Description of Artificial Sequence: Synthetic coding sequence
atgggcagcgagctggagacagccatggagaccctcatcaacgtgttccacgcccacagcggcaaggagggggacaagtacaagctgagcaagaaggagctgtag

SEQ ID NO: 168720 - DNA, 294 bp, Artificial Sequence
  Description of Artificial Sequence: Synthetic coding sequence
atgcccagccagatggagcacgccatggagaccatgatgttcaccttccacaagtttgctggggacaagggctacctgaccaaggaggacctgcgggtgctgatggagaaggagttccctggcttcctggagaaccagaaggaccccctggccgtggacaagatcatgaaggacctggaccagtgcagagatggcaaggtgggcttccagagcttcttcagcctgattgctggcctgaccatcgcctgcaatgactactttgtggtgcacatgaagcagaagggcaagaagtag

SEQ ID NO: 168721 - DNA, 294 bp, Artificial Sequence; identical to SEQ ID NO: 168720
  Description of Artificial Sequence: Synthetic coding sequence

SEQ ID NO: 168722 - DNA, 318 bp, Artificial Sequence
  Description of Artificial Sequence: Synthetic coding sequence
atggccaagatcagcagccccacagaaacagagcgctgcatcgagagcctgattgctgtgttccagaagtatgccggcaaggatggctacaactacaccctgagcaagacagagttcctgtccttcatgaacacagagctggccgccttcaccaagaaccagaaggaccccggggtgctggacaggatgatgaagaagctggacaccaacagtgatggccagctggacttcagcgagttcctgaacctgattggaggcctggccatggcctgccacgacagcttcctgaaggctgtgcccagccagaagaggacatag

SEQ ID NO: 168723 - DNA, 252 bp, Artificial Sequence
  Description of Artificial Sequence: Synthetic coding sequence
gctgggaagatgaccaagctggaggagcacctggagggcatcgtgaacatcttccaccagtacagcgtgaggaagggccactttgacaccctgagcaaaggagagctgaagcagctgctgaccaaggagctggccaacaccatcaagaggcccaagaagggcagctctgtgattgatgagatcttccagggcctggatgccaaccaggatgagcaggtggacttccaggagttcatcagcctggtggcctag

SEQ ID NO: 168724 - DNA, 279 bp, Artificial Sequence
  Description of Artificial Sequence: Synthetic coding sequence
atgaccaagctggaggagcacctggagggcatcgtgaacatcttccaccagtacagcgtgaggaagggccactttgacaccctgagcaagggggagctgaagcagctgctgaccaaggagctggccaacaccatcaagaacatcaaggacaaggctgtgattgatgagatcttccagggcctggatgccaaccaggatgagcaggtggacttccaggagttcatcagcctggtggccatcgccctgaaggccgcccactaccacacccacaaggagtag

SEQ ID NO: 168725 - DNA, 297 bp, Artificial Sequence
  Description of Artificial Sequence: Synthetic coding sequence
atggctgctgagcccctgacagagctggaggagagcattgaaacagtggtgaccaccttcttcacctttgcccggcaggagggcaggaaggacagcctgtctgtgaatgagttcaaggagctggtgacccagcagctgccccacctgctgaaggatgtgggcagcctggatgagaagatgaagagcctggatgtgaaccaggacagcgagctgaagttcaatgagtactggaggctcatcggggagctggccaaggagatcaggaagaagaaggacctgaagatcaggaagaagtag

SEQ ID NO: 168726 - DNA, 297 bp, Artificial Sequence; identical to SEQ ID NO: 168725
  Description of Artificial Sequence: Synthetic coding sequence

SEQ ID NO: 168727 - DNA, 297 bp, Artificial Sequence; identical to SEQ ID NO: 168725
  Description of Artificial Sequence: Synthetic coding sequence

SEQ ID NO: 168728 - DNA, 297 bp, Artificial Sequence; identical to SEQ ID NO: 168725
  Description of Artificial Sequence: Synthetic coding sequence

SEQ ID NO: 168729 - DNA, 297 bp, Artificial Sequence; identical to SEQ ID NO: 168725
  Description of Artificial Sequence: Synthetic coding sequence

SEQ ID NO: 168730 - DNA, 315 bp, Artificial Sequence
  Description of Artificial Sequence: Synthetic coding sequence
atgggccagtgccgcagcgccaatgcagaagatgcccaggagttcagtgatgtggagcgggccatcgagaccctcatcaagaacttccaccagtacagcgtggagggcggcaaggagaccctgacccccagcgagctgcgggacctggtgacccagcagctgccccacctgatgcccagcaactgtggcctggaggagaagatcgccaacctgggcagctgcaatgacagcaagctggagttccgctccttctgggagctgattggagaggccgccaagtctgtgaagctggagaggcctgtgcggggccactag

SEQ ID NO: 168731 - DNA, 315 bp, Artificial Sequence; identical to SEQ ID NO: 168730
  Description of Artificial Sequence: Synthetic coding sequence

SEQ ID NO: 168732 - DNA, 315 bp, Artificial Sequence; identical to SEQ ID NO: 168730
  Description of Artificial Sequence: Synthetic coding sequence

SEQ ID NO: 168733 - DNA, 315 bp, Artificial Sequence; identical to SEQ ID NO: 168730
  Description of Artificial Sequence: Synthetic coding sequence

SEQ ID NO: 168734 - DNA, 417 bp, Artificial Sequence
  Description of Artificial Sequence: Synthetic coding sequence
atgtgcagcagcctggagcaggccctggccgtgctggtgaccaccttccacaagtacagctgccaggagggggacaagttcaagctgagcaaaggagagatgaaggagctgctgcacaaggagctgcccagctttgtgggccacagccgggagccctgtgctgtgcgggccttccgggtgcacctgttcaaccctgtgattggagacctgaggaaccagagccctgagggcaagagtgactgccccaagatcacccagcactgggagaaggtggatgaggagggcctgaagaagctgatgggcagcctggatgaaaattctgaccagcaggtggacttccaggagtatgctgtgttcctggccctgatcaccgtgatgtgcaatgacttcttccagggctgcccagaccggccctag

SEQ ID NO: 168735 - DNA, 294 bp, Artificial Sequence
  Description of Artificial Sequence: Synthetic coding sequence
atgtgcagcagcctggagcaggccctggccgtgctggtgaccaccttccacaagtacagctgccaggagggggacaagttcaagctgagcaaaggagagatgaaggagctgctgcacaaggagctgcccagctttgtgggggagaaggtggatgaggagggcctgaagaagctgatgggcagcctggatgagaacagcgaccagcaggtggacttccaggagtatgctgtgttcctggccctgatcaccgtgatgtgcaatgacttcttccagggctgcccagaccggccctag

SEQ ID NO: 168736 - DNA, 294 bp, Artificial Sequence; identical to SEQ ID NO: 168735
  Description of Artificial Sequence: Synthetic coding sequence

SEQ ID NO: 168737 - DNA, 294 bp, Artificial Sequence; identical to SEQ ID NO: 168735
  Description of Artificial Sequence: Synthetic coding sequence

SEQ ID NO: 168738 - DNA, 306 bp, Artificial Sequence
  Description of Artificial Sequence: Synthetic coding sequence
atggcccggcccctggagcaggccgtggccgccatcgtgtgcaccttccaggagtatgccggccgctgtggggacaagtacaagctgtgccaggccgagctgaaggagctgctgcagaaggagctggccacctggacccccacagagttccgggagtgtgactacaacaagttcatgtctgtgctggacaccaacaaggactgtgaggtggactttgtggagtatgtgcgcagcctggcctgcctgtgcctgtactgccacgagtacttcaaggactgccccagcgagcccccctgcagccagtag

SEQ ID NO: 168739 - DNA, 306 bp, Artificial Sequence; identical to SEQ ID NO: 168738
  Description of Artificial Sequence: Synthetic coding sequence

SEQ ID NO: 168740 - DNA, 306 bp, Artificial Sequence
  Description of Artificial Sequence: Synthetic coding sequence
atggcctgccccctggagaaggccctggatgtgatggtgtccaccttccacaagtacagcggcaaggagggggacaagttcaagctgaacaagtctgagctgaaggagctgctgacccgggagctgcccagcttcctgggcaagaggacagatgaagctgccttccagaagctgatgagcaacctggacagcaacagagacaatgaggtggacttccaggagtactgtgtgttcctgagctgcatcgccatgatgtgcaatgagttctttgagggcttcccagacaagcagcccaggaagaagtag

SEQ ID NO: 168741 - DNA, 306 bp, Artificial Sequence; identical to SEQ ID NO: 168740
  Description of Artificial Sequence: Synthetic coding sequence

SEQ ID NO: 168742 - DNA, 306 bp, Artificial Sequence; identical to SEQ ID NO: 168740
  Description of Artificial Sequence: Synthetic coding sequence

SEQ ID NO: 168743 - DNA, 306 bp, Artificial Sequence; identical to SEQ ID NO: 168740
  Description of Artificial Sequence: Synthetic coding sequence

SEQ ID NO: 168744 - DNA, 273 bp, Artificial Sequence
  Description of Artificial Sequence: Synthetic coding sequence
atggtgtccaccttccacaagtacagcggcaaggagggggacaagttcaagctgaacaagtctgagctgaaggagctgctgacccgggagctgcccagcttcctgggcaagaggacagatgaggccgccttccagaagctgatgagcaacctggacagcaacagagacaatgaggtggacttccaggagtactgtgtgttcctgagctgcatcgccatgatgtgcaatgagttctttgagggcttcccagacaagcagcccaggaagaagtag

SEQ ID NO: 168745 - DNA, 333 bp, Artificial Sequence
  Description of Artificial Sequence: Synthetic coding sequence
atgcctgctgcctggatcctgtgggcccacagccacagcgagctgcacacagtgatggagacccccctggagaaggccctgaccaccatggtgaccaccttccacaagtacagcggccgggagggcagcaagctgaccctgagcaggaaggagctgaaggagctgatcaagaaggagctgtgcctgggggagatgaaggagagcagcattgatgacctgatgaagagcctggacaagaacagcgaccaggagattgacttcaaggagtacagcgtcttcctgaccatgctgtgcatggcctacaatgacttcttcctggaggacaacaagtag

SEQ ID NO: 168746 - DNA, 279 bp, Artificial Sequence
  Description of Artificial Sequence: Synthetic coding sequence
atggagacccccctggagaaggccctgaccaccatggtgaccaccttccacaagtacagcggccgggagggcagcaagctgaccctgagcaggaaggagctgaaggagctgatcaagaaggagctgtgcctgggggagatgaaggagagcagcattgatgacctgatgaagagcctggacaagaacagcgaccaggagattgacttcaaggagtacagcgtcttcctgaccatgctgtgcatggcctacaatgacttcttcctggaggacaacaagtag

SEQ ID NO: 168747 - DNA, 279 bp, Artificial Sequence; identical to SEQ ID NO: 168746
  Description of Artificial Sequence: Synthetic coding sequence

SEQ ID NO: 168748 - DNA, 273 bp, Artificial Sequence
  Description of Artificial Sequence: Synthetic coding sequence
atggcctgccccctggaccaggccatcggcctgctggtggccatcttccacaagtacagcggccgggagggggacaagcacaccctgagcaagaaggagctgaaggagctgatccagaaggagctgaccatcggcagcaagctgcaggatgctgagatcgcccggctgatggaggacctggacaggaacaaggaccaggaggtgaacttccaggagtatgtgaccttcctgggcgccctggccctgatctacaatgaggccctgaagggctag

SEQ ID NO: 168749 - DNA, 273 bp, Artificial Sequence; identical to SEQ ID NO: 168748
  Description of Artificial Sequence: Synthetic coding sequence

SEQ ID NO: 168750 - DNA, 306 bp, Artificial Sequence
  Description of Artificial Sequence: Synthetic coding sequence
atgagcaacacccaggccgagaggagcatcatcggcatgattgacatgttccacaagtacaccaggagagatgacaagattgagaagcccagcctgctgaccatgatgaaggagaacttccccaacttcctgagcgcctgtgacaagaagggcaccaactacctggctgatgtgtttgagaagaaggacaagaatgaagacaagaagattgacttcagcgagttcctgagcctgctgggggacatcgccacagactaccacaagcagagccatggagctgccccctgcagcggcggcagccagtag

SEQ ID NO: 168751 - DNA, 306 bp, Artificial Sequence; identical to SEQ ID NO: 168750
  Description of Artificial Sequence: Synthetic coding sequence

SEQ ID NO: 168752 - DNA, 282 bp, Artificial Sequence
  Description of Artificial Sequence: Synthetic coding sequence
atgctgacagagctggagaaggccctgaacagcatcattgatgtgtaccacaagtacagcctcatcaagggcaacttccacgctgtgtacagagatgacctgaagaagctgctggagacagaatgtccccagtacatcaggaagaagggagcagatgtgtggttcaaggagctggacatcaacacagatggagctgtgaacttccaggagttcctgatcctggtgatcaagatgggcgtggccgcccacaagaagagccatgaggagagccacaaggagtag

SEQ ID NO: 168753 - DNA, 282 bp, Artificial Sequence; identical to SEQ ID NO: 168752
  Description of Artificial Sequence: Synthetic coding sequence

SEQ ID NO: 168754 - DNA, 345 bp, Artificial Sequence
  Description of Artificial Sequence: Synthetic coding sequence
atgacctgcaagatgagccagctggagaggaacatcgagaccatcatcaacaccttccaccagtacagcgtgaagctgggccacccagacaccctgaaccagggcgagttcaaggagctggtgaggaaggacctgcagaacttcctgaagaaggagaacaagaatgagaaggtgattgagcacatcatggaggacctggacaccaatgctgacaagcagctgagctttgaggagttcatcatgctgatggcccggctgacctgggccagccatgagaagatgcatgaaggagatgagggccctggccaccaccacaagccaggcctgggggagggcaccccctag

SEQ ID NO: 168755 - DNA, 279 bp, Artificial Sequence
  Description of Artificial Sequence: Synthetic coding sequence
atgtctgagctggagaaggccatggtggccctgattgatgtgttccaccagtacagcggccgggagggggacaagcacaagctgaagaagtctgagctgaaggagctgatcaacaatgagctgagccacttcctggaggagatcaaggagcaggaggtggtggacaaggtgatggagaccctggacaatgatggagatggagaatgtgacttccaggagttcatggcctttgtggccatggtgaccacagcctgccacgagttctttgaacatgaatag

SEQ ID NO: 168756 - DNA, 279 bp, Artificial Sequence; identical to SEQ ID NO: 168755
  Description of Artificial Sequence: Synthetic coding sequence

SEQ ID NO: 168757 - DNA, 288 bp, Artificial Sequence
  Description of Artificial Sequence: Synthetic coding sequence
atgacagagctggagacagccatgggcatgatcattgatgtgttcagccgctacagcggcagcgagggcagcacccagaccctgaccaagggggagctgaaggtgctgatggagaaggagctgcccggcttcctgcagagcggcaaggacaaggatgctgtggacaagctgctgaaggacctggatgccaatggagatgcccaggtggacttcagcgagttcatcgtgtttgtggccgccatcaccagcgcctgccacaagtactttgagaaggccggcctgaagtag

SEQ ID NO: 168758 - DNA, 300 bp, Artificial Sequence
  Description of Artificial Sequence: Synthetic coding sequence
atgcccacccagctggagatggccatggacaccatgatccgcatcttccaccgctacagcggcaaggagaggaagcgcttcaagctgagcaaaggagagctgaagctgctgctgcagcgggagctgacagagttcctgagctgccagaaggagacccagctggtggacaagatcgtgcaggacctggatgccaacaaggacaatgaggtggacttcaatgaatttgtggtgatggtggccgccctgactgtggcctgcaatgactactttgtggagcagctgaagaagaagggcaagtag

SEQ ID NO: 168759 - DNA, 300 bp, Artificial Sequence; identical to SEQ ID NO: 168758
  Description of Artificial Sequence: Synthetic coding sequence

SEQ ID NO: 168760 - DNA, 1029 bp, Artificial Sequence
  Description of Artificial Sequence: Synthetic coding sequence
atgatgtgcagccgggtgcccagcgagcagagcagcggcaccagcctgctgcccaaggatggagcccccttctcctgggacagcctggatgaagatggcctggatgacagcctgctggagctgtctgagggggaggaggatgatggagatgtgaactacacagaggaggagattgatgccctgctgaaggaggatgaccccagctatgagcagagcagtggagaagatgatggcggccacgtggagaagggggagcggggcagccagatcctgctggacaccccccgggagaagaacagcagctacagcctgggccctgtggccgagaccccagacctcttcaagctgccccagctgagcaccagcagcggccacggccctgcccacaccaagcccctgaacagaagatctgtgctggagaagaacctgatcaaggtgacagtggcccccttcaaccccaccgtgtgtgatgccctgctggacaaggatgaaacagacagcagcaaggacacagagaagctgagcagcctgggggaggagatgagagaagatggcctgagccccaatgaaagcaagctgtgcacagaaagtgagggcatcagccccaacaacagcgcctggaatggcccccagctgagcagcagcaacaacaacttccagcagacagtgtctgacaagaacatgccagattctgagaaccccaccagcgtcttcagccgcatcagtgaccacagcgagacccccaacatggagctgagctgcagaaatggaggcagccacaagagcagctgtgagatgaggagcctggtggtgtccaccagcagcaacaagcaggatgtgctgaacaaggacagcggcaagatgaagggccatgaaagaaggctgggcaaggtgattcctgtgctgcagaccaagaccaggaccaacgtgcccaccttcagccagagcaacctggagcagcagaagcagctgtacctgcggagcgtcatcgcccacatcgaggaccctgaggacaccaaccagggctag

SEQ ID NO: 168761 - DNA, 1227 bp, Artificial Sequence
  Description of Artificial Sequence: Synthetic coding sequence
atgatgtgcagccgggtgcccagcgagcagagcagcggcaccagcctgctgcccaaggatggagcccccttctcctgggacagcctggatgaagatggcctggatgacagcctgctggagctgtctgagggggaggaggatgatggagatgtgaactacacagaggaggagattgatgccctgctgaaggaggatgaccccagctatgagcagagcagtggagaagatgatggcggccacgtggagaagggggagcggggcagccagatcctgctggacaccccccgggagaagaacagcagctacagcctgggccctgtggccgagaccccagacctcttcaagctgccccagctgagcaccagcagcggccacggccctgcccacaccaagcccctgaacagaagatctgtgctggagaagaacctgatcaaggtgacagtggcccccttcaaccccaccgtgtgtgatgccctgctggacaaggatgaaacagacagcagcaaggacacagagaagctgagcagcctgggggaggagatgagagaagatggcctgagccccaatgaaagcaagctgtgcacagaaagtgagggcatcagccccaacaacagcgcctggaatggcccccagctgagcagcagcaacaacaacttccagcagacagtgtctgacaagaacatgccagattctgagaaccccaccagcgtcttcagccgcatcagtgaccacagcgagacccccaacatggagctgagctgcagaaatggaggcagccacaagagcagctgtgagatgaggagcctggtggtgtccaccagcagcaacaagcaggatgtgctgaacaaggacagcggcaagatgaagggccatgaaagaaggctgggcaaggtgattcctgtgctgcagaccaagaccaggaccaacgtgcccaccttcagccagagcaacctggagcagcagaagcagctgtacctgcggagcgtcatcgcccacatcgaggaccctgaggacaccaaccagggcatcagcggggagctgtgtgccctgatggaccaggtgcaccacatgcagcacagcaagtggcagcaccccagcgacctgaccaccagaaattatgcccggcggcagaagcacctgcagcgctacagcctgacccagtgggtggacaggaacatgaggagccaccaccgcttccagaggctgcctgacttctcctacagctag

SEQ ID NO: 168762 - DNA, 1227 bp, Artificial Sequence; identical to SEQ ID NO: 168761
  Description of Artificial Sequence: Synthetic coding sequence

SEQ ID NO: 168763 - DNA, 1026 bp, Artificial Sequence
  Description of Artificial Sequence: Synthetic coding sequence
atgatgtgcagccgggtgcccagcgagcagagcagcggcaccagcctgctgcccaaggatggagcccccttctcctgggacagcctggatgaagatggcctggatgacagcctgctggagctgtctgagggggaggaggatgatggagatgtgaactacacagaggaggagattgatgccctgctgaaggaggatgaccccagctatgagcagagcagtggagaagatgatggcggccacgtggagaagggggagcggggcagccagatcctgctggacaccccccgggagaagaacagcagctacagcctgggccctgtggccgagaccccagacctcttcaagctgccccagctgagcaccagcagcggccacggccctgcccacaccaagcccctgaacagaagatctgtgctggagaagaacctgatcaaggtgacagtggcccccttcaaccccaccgtgtgtgatgccctgctggacaaggatgaaacagacagcagcaaggacacagagaagctgagcagcctgggggaggagatgagagaagatggcctgagccccaatgaaagcaagctgtgcacagaaagtgagggcatcagccccaacaacagcgcctggaatggcccccagctgagcagcagcaacaacaacttccagcagacagtgtctgacaagaacatgccagattctgagaaccccaccagcgtcttcagccgcatcagtgaccacagcgagacccccaacatggagctgagctgcagaaatggaggcagccacaagagcagctgtgagatgaggagcctggtggtgtccaccagcagcaacaaggatgtgctgaacaaggacagcggcaagatgaagggccacgagcggcggctgggcaaggtgattcctgtgctgcagaccaagaccaggaccaacgtgcccaccttcagccagagcaacctggagcagcagaagcagctgtacctgcggtctgtgattgcccacattgaagatcctgaggacaccaaccagggctag

SEQ ID NO: 168764 - DNA, 441 bp, Artificial Sequence
  Description of Artificial Sequence: Synthetic coding sequence
atgatgtgcagccgggtgcccagcgagcagagcagcggcaccagcctgctgcccaaggatggagcccccttctcctgggacagcctggatgaagatggcctggatgacagcctgctggagctgtctgagggggaggaggatgatggagatgtgaactacacagaggaggagattgatgccctgctgaaggaggatgaccccagctatgagcagagcagtggagaagatgatggcggccacgtggagaagggggagcggggcagccagatcctgctggacaccccccgggagaagaacagcagctacagcctgggccctgtggccgagaccccagacctcttcaagctgccccagctgagcaccagcagcggccacggccctgcccacaccaagcccctgaacagaagatctgtgctggagaagaacctgatcaaggtgtag

SEQ ID NO: 168765 - DNA, 363 bp, Artificial Sequence
  Description of Artificial Sequence: Synthetic coding sequence
atgatgtgcagccgggtgcccagcgagcagagcagcggcaccagcctgctgcccaaggatggagcccccttctcctgggacagcctggatgaagatggcctggatgacagcctgctggagctgtctgagggggaggaggatgatggagatgtgaactacacagaggaggagattgatgccctgctgaaggaggatgaccccagctatgagcagagcagtggagaagatgatggcggccacgtggagaagggggagcggggcagccagatcctgctggacaccccccgggagaagaacagcagctacagcctgggccctgtggccgagaccccagacctcttcaagctgccccagctgtcctag

SEQ ID NO: 168766 - DNA, 126 bp, Artificial Sequence
  Description of Artificial Sequence: Synthetic coding sequence
atgatgtgcagccgggtgcccagcgagcagagcagcggcaccagcctgctgcccaaggatggagcccccttctcctgggacagcctggatgaagatggcctggatgacagcctgctggagctgtag

SEQ ID NO: 168767 - DNA, 18 bp, Artificial Sequence
  Description of Artificial Sequence: Synthetic coding sequence
atgatgtgcagcaggtag

SEQ ID NO: 168768 - DNA, 393 bp, Artificial Sequence
  Description of Artificial Sequence: Synthetic coding sequence
atgatgtgcagccgggtgcccagcgagcagagcagcggcaccagcctgctgcccaaggatggagcccccttctcctgggacagcctggatgaagatggcctggatgacagcctgctggagctgtctgagggggaggaggatgatggagatgtgaactacacagaggaggagattgatgccctgctgaaggaggatgaccccagctatgagcagagcagtggagaagatgatggcggccacgtggagaagggggagcggggcagccagatcctgctggacaccccccgggagaagaacagcagctacagcctgggccctgtggccgagaccccagacctcttcaagctgccccagctgagcaccagcagcggccacggccctgcccacacctag

SEQ ID NO: 168769 - DNA, 1026 bp, Artificial Sequence; identical to SEQ ID NO: 168763
  Description of Artificial Sequence: Synthetic coding sequence

SEQ ID NO: 168770 - DNA, 516 bp, Artificial Sequence
  Description of Artificial Sequence: Synthetic coding sequence
atgatgtgcagccgggtgcccagcgagcagagcagcggcaccagcctgctgcccaaggatggagcccccttctcctgggacagcctggatgaagatggcctggatgacagcctgctggagctgtctgagggggaggaggatgatggagatgtgaactacacagaggaggagattgatgccctgctgaaggaggatgaccccagctatgagcagagcagtggagaagatgatggcggccacgtggagaagggggagcggggcagccagatcctgctggacaccccccgggagaagaacagcagctacagcctgggccctgtggccgagaccccagacctcttcaagctgccccagctgagcaccagcagcggccacggccctgcccacaccaagcccctgaacagaagatctgtgctggagaagaacctgatcaaggtgacagtggcccccttcaaccccaccgtgtgtgatgccctgctggacaaggatgaaacagacagcagcaaggacacctag

SEQ ID NO: 168771 - DNA, 1764 bp, Artificial Sequence
  Description of Artificial Sequence: Synthetic coding sequence
atggccacagctgcctatgagcagctgaagctgcacatcaccccagagaagttctacgtggaggcctgtgatgatggagcagatgatgtgctgaccatcgacagagtgtccacagaggtgaccctggccgtgaagaaggatgtgcccccatctgctgtgacccggcccatcttcggcatcctgggcaccatccacctggtggccggcaactacctgattgtcatcaccaagaagatcaaggtgggggagttcttcagccacgtggtgtggaaggccacagactttgatgtgctgagctacaagaagaccatgctgcacctgacagacatccagctgcaggacaacaagaccttcctggccatgctgaaccacgtgctgaatgtggatggcttctacttcagcaccacctatgacctgacccacaccctgcagaggctgagcaacaccagccctgagttccaggagatgagcctgctggagagagctgaccagagatttgtgtggaatggccacctgctgcgggagctgagcgcccagcctgaggtgcacagatttgccctgcctgtgctgcacggcttcatcaccatgcacagctgcagcatcaacgggaagtactttgactggatcctgatcagcagaagaagctgcttccgggccggcgtgcgctactacgtgcggggcatcgacagcgagggccacgccgccaactttgtggagacagagcagatcgtgcactacaacggcagcaaggccagctttgtgcagacccggggcagcatccctgtgttctggagccagaggcccaacctgaagtacaagcccctgccccagatcagcaaggtggccaaccacatggatggcttccagaggcactttgacagccaggtgatcatctacggcaagcaggtgatcatcaacctgatcaaccagaagggcagcgagaagcccctggagcagacctttgccaccatggtgagcagcctgggcagcggcatgatgagatacatcgcctttgacttccacaaggagtgcaagaacatgcgctgggaccggctgagcatcctgctggaccaggtggccgagatgcaggatgagctgagctacttcctggtggacagcgctggccaggtggtggccaaccaggagggcgtcttccgcagcaactgcatggactgcctggacaggaccaacgtcatccagagcctgctggcccggcgcagcctgcaggcccagctgcagaggctgggcgtgctgcacgtgggccagaagctggaggagcaggatgaatttgagaagatctacaagaatgcctgggccgacaatgccaatgcctgtgccaagcagtatgccggcaccggggccctgaagacagacttcaccaggacaggcaagaggacccacctgggcctcatcatggatggctggaacagcatgatccgctactacaagaacaacttcagtgatggcttccggcaggacagcattgacctcttcctgggcaactacagcgtggatgagctggagagccacagccccctgtctgtgccccgggactggaagttcctggccctgcccatcatcatggtggtggccttctccatgtgcatcatctgcctgctgatggccggggacacctggacagagaccctggcctacgtgctcttctggggcgtggccagcatcggcaccttcttcatcatcctgtacaacgggaaggactttgtggatgccccccggctggtgcagaaggagaagattgattag

SEQ ID NO: 168772 - DNA, 1581 bp, Artificial Sequence
  Description of Artificial Sequence: Synthetic coding sequence
atgtggaagctggtgatgatggagcagatgacctacctgcccctgactgtgtgcccccagaggctgcccctgcagagcaggaagatgttcctgctgcagctgagccaggaccagtacctggtgtactgggcccagagcatctggtggcagctgcaggacaacaagaccttcctggccatgctgaaccacgtgctgaatgtggatggcttctacttcagcaccacctatgacctgacccacaccctgcagaggctgagcaacaccagccctgagttccaggagatgagcctgctggagagagctgaccagagatttgtgtggaatggccacctgctgcgggagctgagcgcccagcctgaggtgcacagatttgccctgcctgtgctgcacggcttcatcaccatgcacagctgcagcatcaatggcaagtactttgactggatcctgatcagccgccgcagctgcttccgggccggcgtgcgctactacgtgcggggcattgattctgagggccatgctgccaactttgtggagacagagcagatcgtgcactacaacggcagcaaggccagctttgtgcagacccggggcagcatccctgtgttctggagccagaggcccaacctgaagtacaagcccctgccccagatcagcaaggtggccaaccacatggatggcttccagaggcactttgacagccaggtgatcatctacggcaagcaggtgatcatcaacctgatcaaccagaagggcagcgagaagcccctggagcagacctttgccaccatggtgagcagcctgggcagcggcatgatgagatacatcgcctttgacttccacaaggagtgcaagaacatgcgctgggaccggctgagcatcctgctggaccaggtggccgagatgcaggatgagctgagctacttcctggtggacagcgctggccaggtggtggccaaccaggagggcgtcttccgcagcaactgcatggactgcctggacaggaccaacgtcatccagagcctgctggcccggcgcagcctgcaggcccagctgcagaggctgggcgtgctgcacgtgggccagaagctggaggagcaggatgaatttgagaagatctacaagaatgcctgggccgacaatgccaatgcctgtgccaagcagtatgccggcactggagccctgaagacagacttcaccaggacaggcaagaggacccacctgggcctcatcatggatggctggaacagcatgatccgctactacaagaacaacttcagtgatggcttccggcaggacagcattgacctcttcctgggcaactacagcgtggatgagctggagagccacagccccctgtctgtgccccgggactggaagttcctggccctgcccatcatcatggtggtggccttctccatgtgcatcatctgcctgctgatggccggggacacctggacagagaccctggcctacgtgctcttctggggcgtggccagcatcggcaccttcttcatcatcctgtacaacgggaaggactttgtggatgccccccggctggtgcagaaggagaagattgattag

SEQ ID NO: 168773 - DNA, 2901 bp, Artificial Sequence
  Description of Artificial Sequence: Synthetic coding sequence
atgttctggaagtttgacctgaacaccaccagccacgtggacaagctgctggacaaggagcacgtgaccctgcaggagctgatggatgaagatgacatcctgcaggagtgcaaggcccagaaccagaagctgctggacttcctgtgccggcagcagtgcatggaggagctggtgtccctcatcacccaggacccccccctggacatggaggagaaggtgcgcttcaagtaccccaacacagcctgtgagctgctgacctgtgatgtgccccagatcagtgaccggctgggcggagatgagagcctgctgagcctgctgtatgacttcctggaccacgagccccccctgaaccccctgctggccagcttcttcagcaagaccatcggcaacctgattgccaggaagacagagcaggtgatcaccttcctgaagaagaaggacaagttcatcagcctggtgctgaagcacatcggcaccagcgccctgatggacctgctgctgcggctggtgtcctgtgtggagcccgccggcctgcggcaggatgtgctgcactggctgaatgaggagaaggtgatccagaggctggtggagctgatccaccccagccaggatgaagatcggcagagcaatgccagccagaccctgtgtgacatcgtgcggctgggccgggaccagggcagccagctgcaggaggccctggagccagaccccctgctgacagccctggagagccaggactgtgtggagcagctgctgaagaacatgtttgatggagacagaacagagagctgcctggtgtctggcacccaggtgctgctgaccctgctggagaccaggagagtgggcacagagggcctggtggacagcttcagccagggcctggagaggagctatgctgtgagcagctctgtgctgcacggcatcgagccccggctgaaggacttccaccagctgctgctgaacccccccaagaagaaggccatcctgaccaccatcggcgtgctggaggagcccctgggcaatgcccggctgcatggagcccggctgatggccgccctgctgcacaccaacacccccagcatcaaccaggagctgtgccgcctgaacaccatggacctgctgctggacctcttcttcaagtacacctggaacaacttcctgcacttccaggtggagctgtgcatcgccgccatcctgagccacgccgcccgggaggagaggacagaggccagcggcagcgagagccgggtggagccccctcatgaaaatggaaacagaagcctggagaccccccagcctgctgccagcctgcctgacaacaccatggtgacccacctgttccagaagtgctgcctggtgcagaggatcctggaggcctgggaggccaatgaccacacccaggccgccggcggcatgagaagaggcaacatgggccacctgaccagaattgccaatgctgtggtgcagaacctggagcggggccctgtgcagacccacatcagcgaggtgatccggggcctgcctgctgactgccggggccgctgggagagctttgtggaggagaccctgacagagaccaacagaagaaacacagtggacctggtgtccacccaccacctgcacagcagcagtgaagatgaagatattgaaggagccttccccaatgagctgagcctgcagcaggccttcagtgactaccagatccagcagatgacagccaactttgtggaccagtttggcttcaatgatgaggagtttgctgaccaggatgacaacatcaatgccccctttgacagaattgctgagatcaacttcaacattgatgctgatgaggacagccccagcgctgccctgtttgaggcctgctgcagcgaccgcatccagccctttgatgatgatgaagatgaggacatctgggaggacagcgacacccgctgtgccgcccgggtgatggcccggcccaggtttggagccccccacgccagcgagagctgcagcaagaatggacctgagcggggcggccaggacggcaaggccagcctggaggcccacagagatgcccctggggccggggcccccccagcccctgggaagaaggaggcccctcctgtggagggggacagcgagggcgccatgtggacagctgtgtttgatgagcccgccaacagcacccccacagcccctggggtggtgagagatgtgggcagctctgtgtgggccgccggcaccagcgcccctgaggagaagggctgggccaagttcacagacttccagcccttctgctgcagcgagagcggcccccgctgcagcagccctgtggacacagagtgcagccacgccgagggcagccgcagccagggccctgagaaggccagccaggccagctactttgctgtgtccccagccagcccctgtgcctggaatgtgtgtgtgaccaggaaggcccccctgctggccagtgacagcagcagcagcggcggcagccacagtgaagatggagaccagaaggccgccagcgccatggatgctgtgtcccggggccctggccgggaggccccacccctgcccaccgtggccaggacagaggaggccgtgggccgggtgggctgtgccgacagccggctgctgagccctgcctgcccagcccccaaggaggtgacagctgccccagctgtggccgtgcccccagaggccaccgtggccatcaccacagccctgagcaaggccggccctgccatccccaccccagctgtgagcagcgccctggccgtggccgtgcccctgggccccatcatggctgtgacagctgccccagccatggtggccaccctgggcaccgtgaccaaggatggcaagacagatgcccctcctgagggcgccgccctgaatggacctgtgtag

SEQ ID NO: 168774 - DNA, 2217 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactggggcgaggacctgcgggtgagaagaagaagaggaactggaggcagcgagagcagccgggccagcggcctggtgggcaggaaggccacagaggacttcctgggcagcagcagcggctacagcagtgaagatgattatgtggaggacagcgagggccggggcagcaaggtgacagaaacagagcctgtgtcctccttccctgctggctacagtgatgtggaccagcagagcagcagcagccggctgcggtctgctgtgtccagagctggcagcctgctgtggatggtggccaccagccctggccgcctcttccggctgctgtactggtgggccggcaccacctggtaccgcctgaccacagctgccagcctgctggatgtgtttgtgctgacccggcgcttcagcagcctgaagaccttcctgtggttcctgctgcccctgctgctgctgacctgcctgacctatggagcctggtacttctacccctacggcctgcagaccttccacccagccctggtgtcctggtgggccgccaaggacagccggcggccagatgagggctgggaggcccgggacagcagcccccacttccaggccgagcagagggtgatgagccgggtgcacagcctggagcggcggctggaggccctggccgctgagttcagcagcaactggcagaaggaggccatgaggctggagcggctggagctgcggcagggcgcccctggccagggcggcggcggcggcctgagccatgaggacaccctggccctgctggagggcctggtgtccagaagagaggccgccctgaaggaggacttcagaagagaaacagctgcccgcatccaggaggagctgagcgccctgcgggcagagcaccagcaggacagcgaggacctcttcaagaagatcgtgcgggccagccaggagagcgaggcccgcatccagcagctgaagtctgagtggcagagcatgacccaggagagcttccaggagagctctgtgaaggagctgcggcggctggaggaccagctggccggcctgcagcaggagctggccgccctggccctgaagcagagctctgtggccgaggaggtgggcctgctgccccagcagatccaggccgtgagagatgatgtggagagccagtttcctgcctggatcagccagttcctggcccggggcggcggcggccgggtgggcctgctgcagcgggaggagatgcaggcccagctgcgggagctggagagcaagatcctgacccacgtggccgagatgcagggcaagagcgcccgggaggccgccgccagcctgagcctgaccctgcagaaggagggcgtcatcggcgtgacagaggagcaggtgcaccacatcgtgaagcaggccctgcagcgctacagcgaggacagaattggcctggccgactatgccctggagagcggcggggccagcgtcatcagcacccgctgcagcgagacctatgagaccaagacagccctgctgagcctgtttggcatccccctgtggtaccacagccagagccccagggtcatcctgcagccagatgtgcaccctggcaactgctgggccttccagggcccccagggctttgctgtggtgcggctgagcgcccgcatccggcccacagctgtgaccctggagcacgtgcccaaggccctgagccccaacagcaccatcagcagcgcccccaaggactttgccatcttcggctttgatgaggacctgcagcaggagggcaccctgctgggcaagttcacctatgaccaggatggagagcccatccagaccttccacttccaggcccccaccatggccacctaccaggtggtggagctgcgcatcctgaccaactggggccaccctgagtacacctgcatctaccgcttccgggtgcatggagagcccgcccactag

SEQ ID NO: 168775 - DNA, 2154 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactggggcgaggacctgcgggtgagaagaagaagaggaactggaggcagcgagagcagccgggccagcggcctggtgggcaggaaggccacagaggacttcctgggcagcagcagcggctacagcagtgaagatgattatgtgggctacagtgatgtggaccagcagagcagcagcagccggctgcggtctgctgtgtcccgggccggcagcctgctgtggatggtggccaccagccctggccgcctcttccggctgctgtactggtgggccggcaccacctggtaccgcctgaccacagctgccagcctgctggatgtgtttgtgctgacccggcgcttcagcagcctgaagaccttcctgtggttcctgctgcccctgctgctgctgacctgcctgacctacggggcctggtacttctacccctacggcctgcagaccttccacccagccctggtgtcctggtgggccgccaaggacagcagaagaccagatgagggctgggaggcccgggacagcagcccccacttccaggccgagcagagggtgatgagccgggtgcacagcctggagcggcggctggaggccctggccgctgagttcagcagcaactggcagaaggaggccatgaggctggagcggctggagctgcggcagggcgcccctggccagggcggcggcggcggcctgagccatgaggacaccctggccctgctggagggcctggtgtcccggcgggaggccgccctgaaggaggacttccggcgggagacagctgcccgcatccaggaggagctgagcgccctgcgggcagagcaccagcaggacagtgaagatctcttcaagaagatcgtgcgggccagccaggagagcgaggcccgcatccagcagctgaagtctgagtggcagagcatgacccaggagagcttccaggagagctctgtgaaggagctgcggcggctggaggaccagctggccggcctgcagcaggagctggccgccctggccctgaagcagagctctgtggccgaggaggtgggcctgctgccccagcagatccaggccgtgagagatgatgtggagagccagtttcctgcctggatcagccagttcctggcccggggcggcggcggccgggtgggcctgctgcagcgggaggagatgcaggcccagctgcgggagctggagagcaagatcctgacccacgtggccgagatgcagggcaagagcgcccgggaggccgccgccagcctgagcctgaccctgcagaaggagggcgtgattggagtgacagaggagcaggtgcaccacatcgtgaagcaggccctgcagcgctacagtgaagatcgcatcggcctggccgactatgccctggagagcggcggggccagcgtcatcagcacccgctgcagcgagacctatgagaccaagacagccctgctgagcctgtttggcatccccctgtggtaccacagccagagccccagggtcatcctgcagccagatgtgcaccctggcaactgctgggccttccagggcccccagggctttgctgtggtgcggctgagcgcccgcatccggcccacagctgtgaccctggagcacgtgcccaaggccctgagccccaacagcaccatcagcagcgcccccaaggactttgccatctttggatttgatgaggacctgcagcaggagggcaccctgctgggcaagttcacctatgaccaggatggagagcccatccagaccttccacttccaggcccccaccatggccacctaccaggtggtggagctgcgcatcctgaccaactggggccaccctgagtacacctgcatctaccgcttccgggtgcacggggagcccgcccactag

SEQ ID NO: 168776 - DNA, 2154 bp, Artificial Sequence; identical to SEQ ID NO: 168775
  Description of Artificial Sequence: Synthetic coding sequence

SEQ ID NO: 168777 - DNA, 2121 bp, Artificial Sequence
  Description of Artificial Sequence: Synthetic coding sequence
atggtgagcccccccagcgctggccagaggctgcggggcgtgcctgtgtgggccgccggggccttccgcttcagcagcggggaggagagcaccagccacctgatcatgagccgccgcagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttcccccccaggagcagcctggaggagctgcatggagatgccaactggggctacagtgatgtggaccagcagagcagcagcagccggctgcggtctgctgtgtccagagctggcagcctgctgtggatggtggccaccagccctggccgcctcttccggctgctgtactggtgggccggcaccacctggtaccgcctgaccacagctgccagcctgctggatgtgtttgtgctgacccggcgcttcagcagcctgaagaccttcctgtggttcctgctgcccctgctgctgctgacctgcctgacctatggagcctggtacttctacccctacggcctgcagaccttccacccagccctggtgtcctggtgggccgccaaggacagccggcggccagatgagggctgggaggcccgggacagcagcccccacttccaggccgagcagagggtgatgagccgggtgcacagcctggagcggcggctggaggccctggccgctgagttcagcagcaactggcagaaggaggccatgaggctggagcggctggagctgcggcagggcgcccctggccagggcggcggcggcggcctgagccatgaggacaccctggccctgctggagggcctggtgtccagaagagaggccgccctgaaggaggacttcagaagagaaacagctgcccgcatccaggaggagctgagcgccctgcgggcagagcaccagcaggacagcgaggacctcttcaagaagatcgtgcgggccagccaggagagcgaggcccgcatccagcagctgaagtctgagtggcagagcatgacccaggagagcttccaggagagctctgtgaaggagctgcggcggctggaggaccagctggccggcctgcagcaggagctggccgccctggccctgaagcagagctctgtggccgaggaggtgggcctgctgccccagcagatccaggccgtgagagatgatgtggagagccagtttcctgcctggatcagccagttcctggcccggggcggcggcggccgggtgggcctgctgcagcgggaggagatgcaggcccagctgcgggagctggagagcaagatcctgacccacgtggccgagatgcagggcaagagcgcccgggaggccgccgccagcctgagcctgaccctgcagaaggagggcgtcatcggcgtgacagaggagcaggtgcaccacatcgtgaagcaggccctgcagcgctacagcgaggacagaattggcctggccgactatgccctggagagcggcggggccagcgtcatcagcacccgctgcagcgagacctatgagaccaagacagccctgctgagcctgtttggcatccccctgtggtaccacagccagagccccagggtcatcctgcagccagatgtgcaccctggcaactgctgggccttccagggcccccagggctttgctgtggtgcggctgagcgcccgcatccggcccacagctgtgaccctggagcacgtgcccaaggccctgagccccaacagcaccatcagcagcgcccccaaggactttgccatcttcggctttgatgaggacctgcagcaggagggcaccctgctgggcaagttcacctatgaccaggatggagagcccatccagaccttccacttccaggcccccaccatggccacctaccaggtggtggagctgcgcatcctgaccaactggggccaccctgagtacacctgcatctaccgcttccgggtgcatggagagcccgcccactag

SEQ ID NO: 168778 - DNA, 375 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactgggaccccaccttccagaagctgctggaggcccagaagagcccctggttcttccctgcccaggtgaggacctgtggctgcggcggcggctag

SEQ ID NO: 168779 - DNA, 384 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactggggctacagtgatgtggaccagcagagcagcagcagccggctgcggtctgctgtgtcccgggccggcagcctgctgtggatggtggccaccagcccctag

SEQ ID NO: 168780 - DNA, 333 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactggggcgaggacctgcgggtgagaagaagaagaggaactggaggcagctag

SEQ ID NO: 168781 - DNA, 675 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactggggctacagtgatgtggaccagcagagcagcagcagccggctgcggtctgctgtgtcccgggccggcagcctgctgtggatggtggccaccagccctggccgcctcttccggctgctgtactggtgggccggcaccacctggtaccgcctgaccacagctgccagcctgctggatgtgtttgtgctgacccggcgcttcagcagcctgaagaccttcctgtggttcctgctgcccctgctgctgctgacctgcctgacctacggggcctggtacttctacccctacggcctgcagaccttccacccagccctggtgtcctggtgggccgccaaggacagcagaagaccagatgagggctgggaggcccgggacagcagcccccacttctag

SEQ ID NO: 168782 - DNA, 306 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactggggcgaggacctgcgggtgtag

SEQ ID NO: 168783 - DNA, 435 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactggggcgaggacctgcgggtgagaagaagaagaggaactggaggcagcgagagcagccgggccagcggcctggtgggcaggaaggccacagaggacttcctgggcagcagcagcggctacagcagtgaagatgattatgtgggcagaagatag

SEQ ID NO: 168784 - DNA, 618 bp, Artificial Sequence
  Description of Artificial Sequence: Synthetic coding sequence
atgagcagaagaagccagaggctgacccgctacagccagggagatgatgatggcagcagcagcagcggcggcagctctgtggccggcagccagagcaccctcttcaaggacagccccctgcggaccctgaagaggaagagcagcaacatgaagaggctgagccctgccccccagctgggccccagcagtgatgcccacaccagctactacagcgagagcctggtgcatgagagctggttccccccaagaagcagcctggaggagctgcatggagatgccaactggggcgaggacctgcgggtgagaagaagaagaggaactggaggcagcgagagcagccgggccagcggcctggtgggcaggaaggccacagaggacttcctgggcagcagcagcggctacagcagtgaagatgattatgtgggctacagtgatgtggaccagcagagcagcagcagccggctgcggtctgctgtgtcccgggccggcagcctgctgtggatggtggccaccagccctggccgcctcttccggctgctgtactggtgggccggcaccacctggtaccgcctgaccacagctgccagcctgctggatgtgtttgtgctgaccaggtag

SEQ ID NO: 168785 - DNA, 1140 bp, Artificial Sequence
  Description of Artificial Sequence: Synthetic coding sequence
atgcccaggagcagccgcagccctggggaccccggggccctgctggaggatgtggcccacaacccccggcccaggagaattgcccagaggggcaggaacaccagcaggatggccgaggacaccagccccaacatgaatgacaacatcctgctgcctgtgaggaacaatgaccaggccctgggcctgacccagtgcatgctgggctgtgtgtcctggttcacctgctttgcctgcagcctgcggacccaggcccagcaggtgctcttcaacacctgccgctgcaagctgctgtgccagaagctgatggagaagacaggcatcctgctgctgtgtgccttcggcttctggatgttcagcatccacctgcccagcaagatgaaggtgtggcaggatgacagcatcaatggccccctgcagagcctgcggctgtaccaggagaaggtgcgccaccacagcggggagatccaggacctgcggggctccatgaaccagctgattgccaagctgcaggagatggaggccatgtctgatgagcagaagatggcccagaagatcatgaagatgatccacggggactacatcgagaagccagactttgccctgaagagcatcggggccagcattgactttgagcacacctctgtgacctacaaccacgagaaggcccacagctactggaactggatccagctgtggaactatgcccagcccccagatgtgatcctggagcccaacgtgaccccaggcaactgctgggcctttgaaggagaccggggccaggtgaccatccagctggcccagaaggtgtacctgagcaacctgaccctgcagcacatccccaagaccatcagcctgagcggcagcctggacacagcccccaaggactttgtgatctacggcatggagggcagccccaaggaggaggtgttcctgggcgccttccagttccagcctgagaacatcatccagatgttccccctgcagaaccagcctgcccgggccttctctgctgtgaaggtgaagatcagcagcaactggggcaaccctggcttcacctgcctgtacagagtgcgggtgcacggctctgtggccccaccccgggagcagccccaccagaacccctaccccaagagggactag

SEQ ID NO: 168786 - DNA, 369 bp, Artificial Sequence
  Description of Artificial Sequence: Synthetic coding sequence
atgcccaggagcagccgcagccctggggaccccggggccctgctggaggatgtggcccacaacccccggcccaggagaattgcccagaggggcaggaacaccagcaggatggccgaggacaccagccccaacatgaatgacaacatcctgctgcctgtgaggaacaatgaccaggccctgggcctgacccagtgcatgctgggctgtgtgtatgccagctgctgtgcccggagctcctggaggcggcaggccttctgcagctctgtgctgtctgtgtgcccccgggccctgcccagcccccgctggagatacccctgggccctggccctgatcatcggccactgggcccggcactgcacagccacctag

SEQ ID NO: 168787 - DNA, 1065 bp, Artificial Sequence
  Description of Artificial Sequence: Synthetic coding sequence
atgcccaggagcagccgcagccctggggaccccggggccctgctggaggatgtggcccacaacccccggcccaggagaattgcccagaggggcaggaacaccagcaggatggccgaggacaccagccccaacatgacctggttcacctgctttgcctgcagcctgcggacccaggcccagcaggtgctcttcaacacctgccgctgcaagctgctgtgccagaagctgatggagaagacaggcatcctgctgctgtgtgccttcggcttctggatgttcagcatccacctgcccagcaagatgaaggtgtggcaggatgacagcatcaatggccccctgcagagcctgcggctgtaccaggagaaggtgcgccaccacagcggggagatccaggacctgcggggctccatgaaccagctgattgccaagctgcaggagatggaggccatgtctgatgagcagaagatggcccagaagatcatgaagatgattcatggagactacatcgagaagccagactttgccctgaagagcattggagccagcattgactttgagcacacctctgtgacctacaaccacgagaaggcccacagctactggaactggatccagctgtggaactatgcccagcccccagatgtgatcctggagcccaacgtgaccccaggcaactgctgggcctttgaaggagaccggggccaggtgaccatccagctggcccagaaggtgtacctgagcaacctgaccctgcagcacatccccaagaccatcagcctgagcggcagcctggacacagcccccaaggactttgtgatctacggcatggagggcagccccaaggaggaggtgttcctgggcgccttccagttccagcctgagaacatcatccagatgttccccctgcagaaccagcctgcccgggccttctctgctgtgaaggtgaagatcagcagcaactggggcaaccctggcttcacctgcctgtacagagtgcgggtgcacggctctgtggccccaccccgggagcagccccaccagaacccctaccccaagagggactag

SEQ ID NO: 168788 - DNA, 459 bp, Artificial Sequence
  Description of Artificial Sequence: Synthetic coding sequence
ggggccctgctggaggatgtggcccacaacccccggccccggcgcatcgcccagagaggaagaaacaccagcaggatggccgaggacaccagccccaacatgaatgacaacatcctgctgcctgtgagaaataatgaccaggccctgggcctgacccagtgcatgctgggctgtgtgtcctggttcacctgctttgcctgcagcctgcggacccaggcccagcaggtgctcttcaacacctgccgctgcaagctgctgtgccagaagctgatggagaagacaggcatcctgctgctgtgtgccttcggcgtgtcccagggccctgcccagagccaggtggaggtgtccctgggccctggaacagactaccgcaccctgggcaagaccctgcactgccacgtgacccagttcccccacctgcctgatggctgctgctgtgaaaattatgagatgaagtag

SEQ ID NO: 168789 - DNA, 387 bp, Artificial Sequence
  Description of Artificial Sequence: Synthetic coding sequence
atgtctgagggcggcggccaggtgtcctgcatctttgctgcccccacccggctgtgccgctggccagccctgattgaatgtggggtgaacctgacccagcccctgtgtgagtggatgatccaggtggcccgggacaggaccctgagcctggcctgggaggtggccagcctgctgaccctgagcagcagcgaggtgggcctggagggcgtgggcaccatctggcccagcagctacagcagcgaggagagcagcagaaatggagctgagcagggccggcagctgagcattgagggccccttccagggccagaactgccccagccaccctgctgctgccctgcccctgcccatgagaggagagagccaggccaccagctgccaggtgtag

SEQ ID NO: 168790 - DNA, 3975 bp, Artificial Sequence
  Description of Artificial Sequence: Synthetic coding sequence
atgagcaggaggaagcaggccaagccccagcacttccagagcgaccctgaggtggccagcctgcccaggagagatggagacacagagaagggccagcccagccggcccaccaagagcaaggatgcccacgtgtgtggccgctgctgtgccgagttctttgagctgagtgacctgctgctgcacaagaagaactgcaccaagaaccagctggtgctgattgtgaatgaaaatcctgccagccccccagagaccttcagccccagccccccaccagacaacccagatgagcagatgaatgacacagtgaacaagacagaccaggtggactgcagcgacctgtctgagcacaacggcctggaccgggaggagagcatggaggtggaggcccctgtggccaacaagagcggcagcggcaccagcagcggcagccacagcagcacagcccccagcagcagcagcagcagcagcagcagcagcggcggcggcggcagcagcagcacaggcaccagcgccatcaccaccagcctgccccagctgggggacctgaccaccctgggcaacttcagcgtcatcaacagcaatgtcatcatcgagaacctgcagagcaccaaggtggccgtggcccagttcagccaggaggcccgctgtggcggggccagcggcggcaagctggccgtgcctgccctgatggagcagctgctggccctgcagcagcagcagatccaccagctgcagctgattgagcagatccgccaccagatcctgctgctggccagccagaatgctgacctgcccaccagcagcagccccagccagggcaccctgcggaccagcgccaaccccctgagcaccctgagcagccacctgagccagcagctggccgctgctgctggcctggcccagagcctggccagccagagcgccagcatctctggagtgaagcagctgccccccatccagctgccccagagcagcagcggcaacaccatcatccccagcaacagcggcagcagccccaacatgaacatcctggccgctgctgtgaccacccccagcagcgagaaggtggccagcagcgctggggccagccacgtgagcaacccagctgtgagcagcagcagcagccctgcctttgccatcagcagcctgctgagccctgccagcaaccccctgctgccccagcaggccagcgccaacagcgtcttccccagccccctgcccaacatcggcaccacagctgaggacctgaacagcctgagcgccctggcccagcagaggaagagcaagccacccaacgtgacagcctttgaggccaagagcaccagtgatgaggccttcttcaagcacaagtgccgcttctgtgccaaggtgtttggaagtgacagcgccctgcagatccacctgcggagccacactggagagcggcccttcaagtgcaacatctgtggcaaccgcttcagcaccaagggcaacctgaaggtgcacttccagaggcacaaggagaagtacccccacatccagatgaacccctaccctgtgcctgagcacctggacaacatccccaccagcacaggcatcccctacggcatgagcatccccccagagaagcctgtgacctcctggctggacaccaagcctgtgctgcccaccctgaccacctctgtgggcctgcccctgccccccaccctgcccagcctcatccccttcatcaagacagaggagcccgcccccatccccatcagccacagcgccaccagccccccaggctctgtgaagagtgacagcggcggccctgagagcgccaccaggaacctgggcggcctgcctgaggaggccgagggcagcaccctgccccccagcggcggcaagtctgaggagagcggcatggtgaccaacagcgtgcccacagccagcagctctgtgctgagcagccctgctgctgactgtggccctgctggcagcgccaccaccttcaccaaccccctgctgcccctgatgtctgagcagttcaaggccaagttcccctttggaggcctgctggacagcgcccaggccagcgagaccagcaagctgcagcagctggtggagaacatcgacaagaaggccacagaccccaatgaatgcatcatctgccaccgggtgctgagctgccagagcgccctgaagatgcactaccgcacccacactggagagcggcccttcaagtgcaagatctgtggccgggccttcaccaccaagggcaacctgaagacccactacagcgtgcaccgggccatgccacccctgcgggtgcagcacagctgccccatctgccagaagaagttcaccaatgctgtggtgctgcagcagcacatccgcatgcacatgggcggccagatccccaacacccctgtgcctgacagctacagcgagagcatggagagtgacaccggcagctttgatgagaagaactttgatgacctggacaacttcagtgatgagaacatggaggactgcccagagggcagcatcccagacacccccaagtctgcagatgccagccaggacagcctgagcagcagccccctgcccctggagatgagcagcattgctgccctggagaaccagatgaagatgatcaatgccggcctggccgagcagctgcaggccagcctgaagtctgtggagaatggcagcattgaaggagatgtgctgaccaatgacagcagctctgtgggcggggacatggagagccagagcgctggcagccctgccatcagcgagagcaccagctccatgcaggccctgagccccagcaacagcacccaggagttccacaagagccccagcattgaggagaagccccagagagctgtgcccagcgagtttgccaacggcctgagccccacccctgtgaatggaggagccctggacctgaccagcagccatgctgagaagatcatcaaggaggacagcctgggcatcctcttccccttccgggaccggggcaagttcaagaacacagcctgtgacatctgtgggaagacctttgcctgccagagcgccctggacatccactaccgcagccacaccaaggagcggcccttcatctgcaccgtgtgcaacagaggcttcagcaccaagggcaacctgaagcagcacatgctgacccaccagatgagggacctgcccagccagctgtttgagcccagcagcaacctgggccccaaccagaacagcgctgtgatcccagccaacagcctgagcagcctcatcaagacagaggtgaatggatttgtgcacgtgagcccccaggacagcaaggacacccccaccagccacgtgcccagcggccccctgagcagcagcgccaccagccctgtgctgctgcctgccctgcccaggaggacccccaagcagcactactgcaacacctgtgggaagaccttcagcagcagcagcgccctgcagatccacgagaggacccacactggagagaagccctttgcctgcaccatctgtggccgggccttcaccaccaagggcaacctgaaggtgcacatgggcacccacatgtggaacagcaccccagcccggcggggccgccgcctgtctgtggatggccccatgaccttcctgggcggcaaccctgtgaagtttcctgagatgttccagaaggacctggccgcccggagcggcagcggggaccccagcagcttctggaaccagtatgctgctgccctgagcaatggcctggccatgaaggccaatgagatcagcgtcatccagaatggaggcatcccccccatccctggcagcctgggcagcggcaacagcagccctgtgtctggcctgactggaaacctggagcggctgcagaacagcgagcccaatgcccccctggccggcctggagaagatggccagcagtgaaaatggcaccaacttccgcttcaccaggtttgtggaggacagcaaggagatcgtgaccagctag

SEQ ID NO: 168791 - DNA, 3684 bp, Artificial Sequence
  Description of Artificial Sequence: Synthetic coding sequence
atgaatgacacagtgaacaagacagaccaggtggactgcagcgacctgtctgagcacaacggcctggaccgggaggagagcatggaggtggaggcccctgtggccaacaagagcggcagcggcaccagcagcggcagccacagcagcacagcccccagcagcagcagcagcagcagcagcagcagcggcggcggcggcagcagcagcacaggcaccagcgccatcaccaccagcctgccccagctgggggacctgaccaccctgggcaacttcagcgtcatcaacagcaatgtcatcatcgagaacctgcagagcaccaaggtggccgtggcccagttcagccaggaggcccgctgtggcggggccagcggcggcaagctggccgtgcctgccctgatggagcagctgctggccctgcagcagcagcagatccaccagctgcagctgattgagcagatccgccaccagatcctgctgctggccagccagaatgctgacctgcccaccagcagcagccccagccagggcaccctgcggaccagcgccaaccccctgagcaccctgagcagccacctgagccagcagctggccgctgctgctggcctggcccagagcctggccagccagagcgccagcatcagcggcgtgaagcagctgccccccatccagctgccccagagcagcagcggcaacaccatcatccccagcaacagcggcagcagccccaacatgaacatcctggccgctgctgtgaccacccccagcagcgagaaggtggccagcagcgctggggccagccacgtgagcaacccagctgtgagcagcagcagcagccctgcctttgccatcagcagcctgctgagccctgccagcaaccccctgctgccccagcaggccagcgccaacagcgtcttccccagccccctgcccaacatcggcaccacagctgaggacctgaacagcctgagcgccctggcccagcagaggaagagcaagcccccaaatgtgacagcctttgaggccaagagcaccagtgatgaggccttcttcaagcacaagtgccgcttctgtgccaaggtgtttggaagtgacagcgccctgcagatccacctgcggagccacactggagagcggcccttcaagtgcaacatctgtggcaaccgcttcagcaccaagggcaacctgaaggtgcacttccagaggcacaaggagaagtacccccacatccagatgaacccctaccctgtgcctgagcacctggacaacatccccaccagcacaggcatcccctacggcatgagcatccccccagagaagcctgtgacctcctggctggacaccaagcctgtgctgcccaccctgaccacctctgtgggcctgcccctgccccccaccctgcccagcctcatccccttcatcaagacagaggagcccgcccccatccccatcagccacagcgccaccagccccccaggctctgtgaagagtgacagcggcggccctgagagcgccaccaggaacctgggcggcctgcctgaggaggccgagggcagcaccctgcccccatctgggggcaagtctgaggagagcggcatggtgaccaacagcgtgcccacagccagcagctctgtgctgagcagccctgctgctgactgtggccctgctggcagcgccaccaccttcaccaaccccctgctgcccctgatgtctgagcagttcaaggccaagttcccctttggaggcctgctggacagcgcccaggccagcgagaccagcaagctgcagcagctggtggagaacatcgacaagaaggccacagaccccaatgaatgcatcatctgccaccgggtgctgagctgccagagcgccctgaagatgcactaccgcacccacactggagagcggcccttcaagtgcaagatctgtggccgggccttcaccaccaagggcaacctgaagacccactacagcgtgcaccgggccatgccacccctgcgggtgcagcacagctgccccatctgccagaagaagttcaccaatgctgtggtgctgcagcagcacatccgcatgcacatgggcggccagatccccaacacccctgtgcctgacagctacagcgagagcatggagagtgacaccggcagctttgatgagaagaactttgatgacctggacaacttcagtgatgagaacatggaggactgcccagagggcagcatcccagacacccccaagtctgcagatgccagccaggacagcctgagcagcagccccctgcccctggagatgagcagcattgctgccctggagaaccagatgaagatgatcaatgccggcctggccgagcagctgcaggccagcctgaagtctgtggagaatggcagcattgaaggagatgtgctgaccaatgacagcagctctgtgggcggggacatggagagccagagcgctggcagccctgccatcagcgagagcaccagctccatgcaggccctgagccccagcaacagcacccaggagttccacaagagccccagcattgaggagaagccccagagagctgtgcccagcgagtttgccaacggcctgagccccacccctgtgaatggaggagccctggacctgaccagcagccacgccgagaagatcatcaaggaggacagcctgggcatcctcttccccttccgggaccggggcaagttcaagaacacagcctgtgacatctgtgggaagacctttgcctgccagagcgccctggacatccactaccgcagccacaccaaggagcggcccttcatctgcaccgtgtgcaacagaggcttcagcaccaagggcaacctgaagcagcacatgctgacccaccagatgagggacctgcccagccagctgtttgagcccagcagcaacctgggccccaaccagaacagcgctgtgatcccagccaacagcctgagcagcctcatcaagacagaggtgaatggatttgtgcacgtgagcccccaggacagcaaggacacccccaccagccacgtgcccagcggccccctgagcagcagcgccaccagccctgtgctgctgcctgccctgcccaggaggacccccaagcagcactactgcaacacctgtgggaagaccttcagcagcagcagcgccctgcagatccacgagaggacccacactggagagaagccctttgcctgcaccatctgtggccgggccttcaccaccaagggcaacctgaaggtgcacatgggcacccacatgtggaacagcaccccagcccggcggggccggcggctgtctgtggatggccccatgaccttcctgggcggcaaccctgtgaagtttcctgagatgttccagaaggacctggccgcccggagcggcagcggggaccccagcagcttctggaaccagtatgctgctgccctgagcaatggcctggccatgaaggccaatgagatcagcgtcatccagaatggaggcatcccccccatccctggcagcctgggcagcggcaacagcagccctgtgtctggcctgaccggcaacctggagcggctgcagaacagcgagcccaatgcccccctggccggcctggagaagatggccagcagtgaaaatggcaccaacttccgcttcaccaggtttgtggaggacagcaaggagatcgtgaccagctag

SEQ ID NO: 168792 - DNA, 3867 bp, Artificial Sequence
  Description of Artificial Sequence: Synthetic coding sequence
atgagcaggaggaagcaggccaagccccagcacttccagagcgaccctgaggtggccagcctgcccaggagagatggagacacagagaagggccagcccagccggcccaccaagagcaaggatgcccacgtgtgtggccgctgctgtgccgagttctttgagctgagtgacctgctgctgcacaagaagaactgcaccaagaaccagctggtgctgattgtgaatgaaaatcctgccagccccccagagaccttcagccccagccccccaccagacaacccagatgagcagatgaatgacacagtgaacaagacaggcagccacagcagcacagcccccagcagcagcagcagcagcagcagcagcagcggcggcggcggcagcagcagcacaggcaccagcgccatcaccaccagcctgccccagctgggggacctgaccaccctgggcaacttcagcgtcatcaacagcaatgtcatcatcgagaacctgcagagcaccaaggtggccgtggcccagttcagccaggaggcccgctgtggcggggccagcggcggcaagctggccgtgcctgccctgatggagcagctgctggccctgcagcagcagcagatccaccagctgcagctgattgagcagatccgccaccagatcctgctgctggccagccagaatgctgacctgcccaccagcagcagccccagccagggcaccctgcggaccagcgccaaccccctgagcaccctgagcagccacctgagccagcagctggccgctgctgctggcctggcccagagcctggccagccagagcgccagcatctctggagtgaagcagctgccccccatccagctgccccagagcagcagcggcaacaccatcatccccagcaacagcggcagcagccccaacatgaacatcctggccgctgctgtgaccacccccagcagcgagaaggtggccagcagcgctggggccagccacgtgagcaacccagctgtgagcagcagcagcagccctgcctttgccatcagcagcctgctgagccctgccagcaaccccctgctgccccagcaggccagcgccaacagcgtcttccccagccccctgcccaacatcggcaccacagctgaggacctgaacagcctgagcgccctggcccagcagaggaagagcaagccacccaacgtgacagcctttgaggccaagagcaccagtgatgaggccttcttcaagcacaagtgccgcttctgtgccaaggtgtttggaagtgacagcgccctgcagatccacctgcggagccacactggagagcggcccttcaagtgcaacatctgtggcaaccgcttcagcaccaagggcaacctgaaggtgcacttccagaggcacaaggagaagtacccccacatccagatgaacccctaccctgtgcctgagcacctggacaacatccccaccagcacaggcatcccctacggcatgagcatccccccagagaagcctgtgacctcctggctggacaccaagcctgtgctgcccaccctgaccacctctgtgggcctgcccctgccccccaccctgcccagcctcatccccttcatcaagacagaggagcccgcccccatccccatcagccacagcgccaccagccccccaggctctgtgaagagtgacagcggcggccctgagagcgccaccaggaacctgggcggcctgcctgaggaggccgagggcagcaccctgccccccagcggcggcaagtctgaggagagcggcatggtgaccaacagcgtgcccacagccagcagctctgtgctgagcagccctgctgctgactgtggccctgctggcagcgccaccaccttcaccaaccccctgctgcccctgatgtctgagcagttcaaggccaagttcccctttggaggcctgctggacagcgcccaggccagcgagaccagcaagctgcagcagctggtggagaacatcgacaagaaggccacagaccccaatgaatgcatcatctgccaccgggtgctgagctgccagagcgccctgaagatgcactaccgcacccacactggagagcggcccttcaagtgcaagatctgtggccgggccttcaccaccaagggcaacctgaagacccactacagcgtgcaccgggccatgccacccctgcgggtgcagcacagctgccccatctgccagaagaagttcaccaatgctgtggtgctgcagcagcacatccgcatgcacatgggcggccagatccccaacacccctgtgcctgacagctacagcgagagcatggagagtgacaccggcagctttgatgagaagaactttgatgacctggacaacttcagtgatgagaacatggaggactgcccagagggcagcatcccagacacccccaagtctgcagatgccagccaggacagcctgagcagcagccccctgcccctggagatgagcagcattgctgccctggagaaccagatgaagatgatcaatgccggcctggccgagcagctgcaggccagcctgaagtctgtggagaatggcagcattgaaggagatgtgctgaccaatgacagcagctctgtgggcggggacatggagagccagagcgctggcagccctgccatcagcgagagcaccagctccatgcaggccctgagccccagcaacagcacccaggagttccacaagagccccagcattgaggagaagccccagagagctgtgcccagcgagtttgccaacggcctgagccccacccctgtgaatggaggagccctggacctgaccagcagccatgctgagaagatcatcaaggaggacagcctgggcatcctcttccccttccgggaccggggcaagttcaagaacacagcctgtgacatctgtgggaagacctttgcctgccagagcgccctggacatccactaccgcagccacaccaaggagcggcccttcatctgcaccgtgtgcaacagaggcttcagcaccaagggcaacctgaagcagcacatgctgacccaccagatgagggacctgcccagccagctgtttgagcccagcagcaacctgggccccaaccagaacagcgctgtgatcccagccaacagcctgagcagcctcatcaagacagaggtgaatggatttgtgcacgtgagcccccaggacagcaaggacacccccaccagccacgtgcccagcggccccctgagcagcagcgccaccagccctgtgctgctgcctgccctgcccaggaggacccccaagcagcactactgcaacacctgtgggaagaccttcagcagcagcagcgccctgcagatccacgagaggacccacactggagagaagccctttgcctgcaccatctgtggccgggccttcaccaccaagggcaacctgaaggtgcacatgggcacccacatgtggaacagcaccccagcccggcggggccgccgcctgtctgtggatggccccatgaccttcctgggcggcaaccctgtgaagtttcctgagatgttccagaaggacctggccgcccggagcggcagcggggaccccagcagcttctggaaccagtatgctgctgccctgagcaatggcctggccatgaaggccaatgagatcagcgtcatccagaatggaggcatcccccccatccctggcagcctgggcagcggcaacagcagccctgtgtctggcctgactggaaacctggagcggctgcagaacagcgagcccaatgcccccctggccggcctggagaagatggccagcagtgaaaatggcaccaacttccgcttcaccaggtttgtggaggacagcaaggagatcgtgaccagctag

SEQ ID NO: 168793 - DNA, 444 bp, Artificial Sequence
  Description of Artificial Sequence: Synthetic coding sequence
atggtgcacatgggcacccacatgtggaacagcaccccagcccggcggggccggcggctgtctgtggatggccccatgaccttcctgggcggcaaccctgtgaagtttcctgagatgttccagaaggacctggccgcccggagcggcagcggggaccccagcagcttctggaaccagtatgctgctgccctgagcaatggcctggccatgaaggccaatgagatcagcgtcatccagaatggaggcatcccccccatccctggcagcctgggcagcggcaacagcagccctgtgtctggcctgaccggcaacctggagcggctgcagaacagcgagcccaatgcccccctggccggcctggagaagatggccagcagtgaaaatggcaccaacttccgcttcaccaggtttgtggaggacagcaaggagatcgtgaccagctag

SEQ ID NO: 168794 - DNA, 3024 bp, Artificial Sequence
  Description of Artificial Sequence: Synthetic coding sequence
atgagcaggaggaagcagaggaagccccagcagctgatcagtgactgtgagggccccagcgcctctgaaaatggagatgccagcgaggaggaccacccccaggtgtgtgccaagtgctgtgcccagttcacagaccccacagagttcctggcccaccagaatgcctgcagcacagacccccctgtgatggtgatcatcggcggccaggagaaccccaacaacagcagcgccagcagcgagcccaggcctgagggccacaacaacccccaggtgatggacacagagcacagcaaccccccagacagcggcagctctgtgcccacagaccccacctggggccctgagcggcggggggaggagagccctggccacttcctggtggccgccaccggcacagctgctgggggcggcggcggcctcatcctggccagccccaagctgggcgccacccccctgcccccagagagcaccccagcccctcctcctcctcctcctcctcctcctcctcctggggtgggcagcggccacctgaacatccccctcatcctggaggagctgcgggtgctgcagcagaggcagatccaccagatgcagatgacagagcagatctgccggcaggtgctgctgctgggcagcctgggccagacagtgggcgccccagccagccccagcgagctgcccggcactggaacagccagcagcaccaagcccctgctgcccctcttcagccccatcaagcctgtgcagaccagcaagaccctggccagcagcagcagcagcagcagcagcagcagtggagctgagacccccaagcaggccttcttccacctgtaccaccccctgggcagccagcaccccttctctgctggaggagtgggccgcagccacaagcccaccccagcccccagccctgccctgcccggcagcacagaccagctgattgccagcccccacctggccttccccagcaccaccggcctgctggccgcccagtgcctgggcgccgcccggggcctggaggccacagccagccctggcctgctgaagcccaagaatggcagcggggagctgtcctatggagaggtgatgggccccctggagaagccaggcggccgccacaagtgccgcttctgtgccaaggtgtttggaagtgacagcgccctgcagatccacctgcggagccacactggagagcggccctacaagtgcaatgtgtgtggcaaccgcttcaccacccggggcaacctgaaggtgcacttccaccgccaccgggagaagtacccccacgtgcagatgaacccccaccctgtgcctgagcacctggactatgtgatcaccagcagcggcctgccctacggcatgtctgtgcccccagagaaggccgaggaggaggccgccacccctgggggcggcgtggagaggaagcccctggtggccagcaccacagccctgagcgccacagagagcctgaccctgctgagcaccagcgctggaacagccacagcccctggcctgcctgccttcaacaagtttgtgctgatgaaggctgtggagcccaagaacaaggcagatgagaacaccccacctggcagcgagggcagcgccatctctggagtggccgagagcagcacagccaccaggatgcagctgagcaagctggtgaccagcctgcccagctgggccctgctgaccaaccacttcaagagcacaggcagcttccccttcccctacgtgctggagcccctgggcgccagccccagcgagaccagcaagctgcagcagctggtggagaagattgaccggcagggcgctgtggccgtgaccagcgctgccagcggggcccccaccaccagcgccccagcccccagcagcagcgccagcagcggccccaaccagtgtgtgatctgcctgcgggtgctgagctgcccccgggccctgcggctgcactacggccagcacggcggggagcggcccttcaagtgcaaggtgtgtggccgggccttcagcacccggggcaacctgcgggcccactttgtgggccacaaggccagccctgctgcccgggcccagaacagctgccccatctgccagaagaagttcaccaatgctgtgaccctgcagcagcacgtgaggatgcacctgggcggccagatccccaacggcggcacagccctgcctgagggcggcggggccgcccaggagaatggaagtgagcagagcacagtgtctggagctggcagcttcccccagcagcagagccagcagcccagccctgaggaggagctgtctgaggaggaggaggaggaggatgaggaggaggaggaggatgtgacagatgaggacagcctggccggccggggcagcgagagcggcggggagaaggccatctctgtgcggggggacagcgaggaggccagcggggctgaggaggaggtgggcaccgtggccgccgccgccacagctgggaaggagatggacagcaatgagaagaccacccagcagagcagcctgcccccacctcctcctccagacagcctggaccagccccagcccatggagcagggcagcagtggagtgctgggcggcaaggaggagggcggcaagccagagaggagcagcagccctgccagcgccctgaccccagagggggaggccacctctgtgaccctggtggaggagctgagcctgcaggaggccatgaggaaggagcccggggagagcagcagcaggaaggcctgtgaggtgtgtggccaggccttccccagccaggccgccctggaggagcaccagaagacccaccccaaggagggccccctcttcacctgtgtgttctgccggcagggcttcctggagcgggccaccctgaagaagcacatgctgctggcccaccaccaggtgcagccctttgccccccacggcccccagaacattgctgccctgagcctggtgcccggctgcagccccagcatcaccagcacaggcctgagccccttccccaggaaggatgaccccaccatcccctag

SEQ ID NO: 168795 - DNA, 1827 bp, Artificial Sequence
  Description of Artificial Sequence: Synthetic coding sequence
atgagcaggaggaagcagaggaagccccagcagctgatcagtgactgtgagggccccagcgcctctgaaaatggagatgccagcgaggaggaccacccccaggtgtgtgccaagtgctgtgcccagttcacagaccccacagagttcctggcccaccagaatgcctgcagcacagacccccctgtgatggtgatcatcggcggccaggagaaccccaacaacagcagcgccagcagcgagcccaggcctgagggccacaacaacccccaggtgatggacacagagcacagcaaccccccagacagcggcagctctgtgcccacagaccccacctggggccctgagcggcggggggaggagagccctggccacttcctggtggccgccaccggcacagctgctgggggcggcggcggcctcatcctggccagccccaagctgggcgccacccccctgcccccagagagcaccccagcccctcctcctcctcctcctcctcctcctcctcctggggtgggcagcggccacctgaacatccccctcatcctggaggagctgcgggtgctgcagcagaggcagatccaccagatgcagatgacagagcagatctgccggcaggtgctgctgctgggcagcctgggccagacagtgggcgccccagccagccccagcgagctgcccggcactggaacagccagcagcaccaagcccctgctgcccctcttcagccccatcaagcctgtgcagaccagcaagaccctggccagcagcagcagcagcagcagcagcagcagtggagctgagacccccaagcaggccttcttccacctgtaccaccccctgggcagccagcaccccttctctgctggaggagtgggccgcagccacaagcccaccccagcccccagccctgccctgcccggcagcacagaccagctgattgccagcccccacctggccttccccagcaccaccggcctgctggccgcccagtgcctgggcgccgcccggggcctggaggccacagccagccctggcctgctgaagcccaagaatggcagcggggagctgtcctatggagaggtgatgggccccctggagaagccaggcggccgccacaagtgccgcttctgtgccaaggtgtttggaagtgacagcgccctgcagatccacctgcggagccacactggagagcggccctacaagtgcaatgtgtgtggcaaccgcttcaccacccggggcaacctgaaggtgcacttccaccgccaccgggagaagtacccccacgtgcagatgaacccccaccctgtgcctgagcacctggactatgtgatcaccagcagcggcctgccctacggcatgtctgtgcccccagagaaggccgaggaggaggccgccacccctgggggcggcgtggagaggaagcccctggtggccagcaccacagccctgagcgccacagagagcctgaccctgctgagcaccagcgctggaacagccacagcccctggcctgcctgccttcaacaagtttgtgctgatgaaggctgtggagcccaagaacaaggcagatgagaacaccccacctggcagcgagggcagcgccatctctggagtggccgagagcagcacagccaccaggatgcagctgagcaagctggtgaccagcctgcccagctgggccctgctgaccaaccacttcaagagcacaggcagcttccccttcccctacgtgcctgaggaggtgcaccagtgctgccacagcgctgctgcctgcccagatgcccctgggggccctgacccccagcgctggtactgcaccccctag

SEQ ID NO: 168796 - DNA, 3687 bp, Artificial Sequence
  Description of Artificial Sequence: Synthetic coding sequence
atgagcaggaggaagcaggccaagccccagcacctgaagagtgatgaggagctgctgcccccagatggagcccctgagcacgccgcccctggagagggcgcagaagatgctgacagcggccctgagagccgctctggaggagaggagacctctgtgtgtgagaagtgctgtgccgagttcttcaagtgggccgacttcctggagcaccagaggagctgcaccaagctgccccctgtgctgattgtgcatgaagatgccccagcccctcctcctgaggacttccctgagcccagccctgccagcagccccagcgagagagctgagagcgaggccgctgaggaggccggggctgagggcgctgagggggaggcccggcctgtggagaaggaggccgagcccatggatgctgagcctgctggggacacccgggcccccaggcctcctcctgctgccccagccccacccaccccagcctatggagcccccagcaccaacgtgaccctggaggccctgctgagcaccaaggtggccgtggcccagttcagccagggcgcccgggccgccggcggcagcggggccggcggcggcgtggccgctgctgctgtgcccctcatcctggagcagctgatggccctgcagcagcagcagatccaccagctgcagctgattgagcagatccgcagccaggtggccctgatgcagaggcccccaccccggcccagcctgagccctgctgctgcccccagcgcccctggccctgcccccagccagctgcccggcctggccgccctgcccctgtctgctggggccccagctgctgccatcgccggcagcggccctgctgccccagctgcctttgagggcgcccagcccctgagcaggcctgagagcggggccagcacccctgggggccctgctgagcccagcgccccagctgcccccagcgctgccccagccccagctgccccagccccagccccagccccccagagcgctgccagcagccagccccagagcgccagcaccccaccagccctggcccctggcagcctgctgggcgccgcccctggcctgcccagccccctgctgccccagaccagcgccagcggggtcatcttccccaaccccctggtgtccattgctgccacagccaatgccctggaccccctgagcgccctgatgaagcacaggaagggcaagcccccaaatgtgtctgtgtttgagcccaaggccagcgctgaggaccccttcttcaagcacaagtgccgcttctgtgccaaggtgtttggaagtgacagcgccctgcagatccacctgcggagccacactggagagcggcccttcaagtgcaacatctgtggcaaccgcttcagcaccaagggcaacctgaaggtgcacttccagaggcacaaggagaagtacccccacatccagatgaacccctaccctgtgcctgagtacctggacaacgtgcccacctgcagcggcatcccctacggcatgagcctgcccccagagaagcctgtgaccacctggctggacagcaagcctgtgctgcccaccgtgcccacctctgtgggcctgcagctgcccccaacagtgcctggggcccacggctatgctgacagccccagcgccaccccagccagccgcagcccccagaggcccagccctgccagcagtgaatgtgccagcctgagccctggcctgaaccacgtggagagcggcgtgtctgccacagctgagagcccccagagcctgctgggcggcccccccctgaccaaggccgagcctgtgtccctgccctgcaccaatgcccgggctggagatgcccctgtgggcgcccaggccagcgctgcccccacctctgtggatggagcccccaccagcctgggcagccctggcctgcctgctgtgtctgagcagttcaaggcccagttcccctttggaggcctgctggacagcatgcagaccagcgagaccagcaagctgcagcagctggtggagaacatcgacaagaagatgacagaccccaaccagtgtgtgatctgccaccgggtgctgagctgccagagcgccctgaagatgcactaccgcacccacactggagagcggcccttcaagtgcaagatctgtggccgggccttcaccaccaagggcaacctgaagacccactttggagtgcaccgggccaagccacccctgcgggtgcagcacagctgccccatctgccagaagaagttcaccaatgctgtggtgctgcagcagcacatccgcatgcacatgggcggccagatccccaacacccccctgcctgagggcttccaggatgccatggattctgagctggcctatgatgacaagaatgctgagaccctgagcagctatgatgatgacatggatgagaacagcatggaggatgatgctgagctgaaggatgctgccacagatcctgccaagcccctgctgtcctatgccggcagctgcccccccagccccccatctgtcatcagcagcattgctgccctggagaaccagatgaagatgattgacagcgtgatgagctgccagcagctgaccggcctgaagtctgtggagaatggaagtggagagagtgaccggctgagcaatgacagcagcagcgctgtgggggacctggagagccgctctgctggcagccctgccctgtctgagagcagcagcagccaggccctgagccctgcccccagcaatggagagagcttccgcagcaagagccctggcctgggcgcccctgaggagccccaggagatccccctgaagacagagaggccagacagccctgctgctgcccctggcagcggcggggcccctggccgggccggcatcaaggaggaggcccccttcagcctgctcttcctgagccgggagcggggccccagccagagcacccccagcctcatcagcagcgctgcccccaccatgatcaagatggaggtgaatggccacggcaaggccatggccctgggggagggcccccccctgcctgctggggtgcaggtgcctgctggcccccagacagtgatgggccctggcctggcccccatgctggcccccccacccaggaggacccccaagcagcacaactgccagagctgtgggaagaccttcagcagcgccagcgccctgcagatccacgagaggacccacactggagagaagcccttcggctgcaccatctgtggccgggccttcaccaccaagggcaacctgaaggtgcacatgggcacccacatgtggaacaatgccccagcccggcggggccggcggctgtctgtggagaaccccatggccctgctgggcggagatgccctgaagttcagcgagatgttccagaaggacctggccgcccgggccatgaatgtggaccccagcttctggaaccagtatgctgctgccatcaccaacggcctggccatgaagaacaatgagatcagcgtcatccagaatggaggcatcccccagctgcctgtgtccctgggcggcagcgccctgccccccctgggctccatggccagcggcatggacaaggccaggacaggcagcagcccccccatcgtgtccctggacaaggccagcagcgagacagctgccagccggcccttcacccgcttcatcgaggacaacaaggagatcggcatcaactag

SEQ ID NO: 168797 - DNA, 3903 bp, Artificial Sequence
  Description of Artificial Sequence: Synthetic coding sequence
atgagcaggaggaagcaggccaagccccagcacctgaagagtgatgaggagctgctgcccccagatggagcccctgagcacgccgcccctggagagggcgcagaagatgctgacagcggccctgagagccgctctggaggagaggagacctctgtgtgtgagaagtgctgtgccgagttcttcaagtgggccgacttcctggagcaccagaggagctgcaccaagctgccccctgtgctgattgtgcatgaagatgccccagcccctcctcctgaggacttccctgagcccagccctgccagcagccccagcgagagagctgagagcgaggccgctgaggaggccggggctgagggcgctgagggggaggcccggcctgtggagaaggaggccgagcccatggatgctgagcctgctggggacacccgggcccccaggcctcctcctgctgccccagccccacccaccccagcctatggagcccccagcaccaacgtgaccctggaggccctgctgagcaccaaggtggccgtggcccagttcagccagggcgcccgggccgccggcggcagcggggccggcggcggcgtggccgctgctgctgtgcccctcatcctggagcagctgatggccctgcagcagcagcagatccaccagctgcagctgattgagcagatccgcagccaggtggccctgatgcagaggcccccaccccggcccagcctgagccctgctgctgcccccagcgcccctggccctgcccccagccagctgcccggcctggccgccctgcccctgtctgctggggccccagctgctgccatcgccggcagcggccctgctgccccagctgcctttgagggcgcccagcccctgagcaggcctgagagcggggccagcacccctgggggccctgctgagcccagcgccccagctgcccccagcgctgccccagccccagctgccccagccccagccccagccccccagagcgctgccagcagccagccccagagcgccagcaccccaccagccctggcccctggcagcctgctgggcgccgcccctggcctgcccagccccctgctgccccagaccagcgccagcggggtcatcttccccaaccccctggtgtccattgctgccacagccaatgccctggaccccctgagcgccctgatgaagcacaggaagggcaagcccccaaatgtgtctgtgtttgagcccaaggccagcgctgaggaccccttcttcaagcacaagtgccgcttctgtgccaaggtgtttggaagtgacagcgccctgcagatccacctgcggagccacactggagagcggcccttcaagtgcaacatctgtggcaaccgcttcagcaccaagggcaacctgaaggtgcacttccagaggcacaaggagaagtacccccacatccagatgaacccctaccctgtgcctgagtacctggacaacgtgcccacctgcagcggcatcccctacggcatgagcctgcccccagagaagcctgtgaccacctggctggacagcaagcctgtgctgcccaccgtgcccacctctgtgggcctgcagctgcccccaacagtgcctggggcccacggctatgctgacagccccagcgccaccccagccagccgcagcccccagaggcccagccctgccagcagtgaatgtgccagcctgagccctggcctgaaccacgtggagagcggcgtgtctgccacagctgagagcccccagagcctgctgggcggcccccccctgaccaaggccgagcctgtgtccctgccctgcaccaatgcccgggctggagatgcccctgtgggcgcccaggccagcgctgcccccacctctgtggatggagcccccaccagcctgggcagccctggcctgcctgctgtgtctgagcagttcaaggcccagttcccctttggaggcctgctggacagcatgcagaccagcgagaccagcaagctgcagcagctggtggagaacatcgacaagaagatgacagaccccaaccagtgtgtgatctgccaccgggtgctgagctgccagagcgccctgaagatgcactaccgcacccacactggagagcggcccttcaagtgcaagatctgtggccgggccttcaccaccaagggcaacctgaagacccactttggagtgcaccgggccaagccacccctgcgggtgcagcacagctgccccatctgccagaagaagttcaccaatgctgtggtgctgcagcagcacatccgcatgcacatgggcggccagatccccaacacccccctgcctgagggcttccaggatgccatggattctgagctggcctatgatgacaagaatgctgagaccctgagcagctatgatgatgacatggatgagaacagcatggaggatgatgctgagctgaaggatgctgccacagatcctgccaagcccctgctgtcctatgccggcagctgcccccccagccccccatctgtcatcagcagcattgctgccctggagaaccagatgaagatgattgacagcgtgatgagctgccagcagctgaccggcctgaagtctgtggagaatggaagtggagagagtgaccggctgagcaatgacagcagcagcgctgtgggggacctggagagccgctctgctggcagccctgccctgtctgagagcagcagcagccaggccctgagccctgcccccagcaatggagagagcttccgcagcaagagccctggcctgggcgcccctgaggagccccaggagatccccctgaagacagagaggccagacagccctgctgctgcccctggcagcggcggggcccctggccgggccggcatcaaggaggaggcccccttcagcctgctcttcctgagccgggagcggggcaaatgtcccagcacagtgtgtggggtgtgtgggaagccctttgcctgcaagagcgccctggagatccactaccgcagccacaccaaggagcggccctttgtgtgtgccctgtgcagaagaggctgcagcaccatgggcaacctgaagcagcacctgctgacccaccggctgaaggagctgcccagccagctgtttgaccccaactttgccctgggccccagccagagcacccccagcctcatcagcagcgctgcccccaccatgatcaagatggaggtgaatggccacggcaaggccatggccctgggggagggcccccccctgcctgctggggtgcaggtgcctgctggcccccagacagtgatgggccctggcctggcccccatgctggcccccccacccaggaggacccccaagcagcacaactgccagagctgtgggaagaccttcagcagcgccagcgccctgcagatccacgagaggacccacactggagagaagcccttcggctgcaccatctgtggccgggccttcaccaccaagggcaacctgaaggtgcacatgggcacccacatgtggaacaatgccccagcccggcggggccggcggctgtctgtggagaaccccatggccctgctgggcggagatgccctgaagttcagcgagatgttccagaaggacctggccgcccgggccatgaatgtggaccccagcttctggaaccagtatgctgctgccatcaccaacggcctggccatgaagaacaatgagatcagcgtcatccagaatggaggcatcccccagctgcctgtgtccctgggcggcagcgccctgccccccctgggctccatggccagcggcatggacaaggccaggacaggcagcagcccccccatcgtgtccctggacaaggccagcagcgagacagctgccagccggcccttcacccgcttcatcgaggacaacaaggagatcggcatcaactag

SEQ ID NO: 168798 - DNA, 2883 bp, Artificial Sequence
  Description of Artificial Sequence: Synthetic coding sequence
atgagcaggaggaagcaggccaagccccagcacctgaagagtgatgaggagctgctgcccccagatggagcccctgagcacgccgcccctggagagggcgcagaagatgctgacagcggccctgagagccgctctggaggagaggagacctctgtgtgtgagaagtgctgtgccgagttcttcaagtgggccgacttcctggagcaccagaggagctgcaccaagctgccccctgtgctgattgtgcatgaagatgcccctcctggcctgcccagccccctgctgccccagaccagcgccagcggggtcatcttccccaaccccctggtgtccattgctgccacagccaatgccctggaccccctgagcgccctgatgaagcacaggaagggcaagcccccaaatgtgtctgtgtttgagcccaaggccagcgctgaggaccccttcttcaagcacaagtgccgcttctgtgccaaggtgtttggaagtgacagcgccctgcagatccacctgcggagccacactggagagcggcccttcaagtgcaacatctgtggcaaccgcttcagcaccaagggcaacctgaaggtgcacttccagaggcacaaggagaagtacccccacatccagatgaacccctaccctgtgcctgagtacctggacaacgtgcccacctgcagcggcatcccctacggcatgagcctgcccccagagaagcctgtgaccacctggctggacagcaagcctgtgctgcccaccgtgcccacctctgtgggcctgcagctgcccccaacagtgcctggggcccacggctatgctgacagccccagcgccaccccagccagccgcagcccccagaggcccagccctgccagcagtgaatgtgccagcctgagccctggcctgaaccacgtggagagcggcgtgtctgccacagctgagagcccccagagcctgctgggcggcccccccctgaccaaggccgagcctgtgtccctgccctgcaccaatgcccgggctggagatgcccctgtgggcgcccaggccagcgctgcccccacctctgtggatggagcccccaccagcctgggcagccctggcctgcctgctgtgtctgagcagttcaaggcccagttcccctttggaggcctgctggacagcatgcagaccagcgagaccagcaagctgcagcagctggtggagaacatcgacaagaagatgacagaccccaaccagtgtgtgatctgccaccgggtgctgagctgccagagcgccctgaagatgcactaccgcacccacactggagagcggcccttcaagtgcaagatctgtggccgggccttcaccaccaagggcaacctgaagacccactttggagtgcaccgggccaagccacccctgcgggtgcagcacagctgccccatctgccagaagaagttcaccaatgctgtggtgctgcagcagcacatccgcatgcacatgggcggccagatccccaacacccccctgcctgagggcttccaggatgccatggattctgagctggcctatgatgacaagaatgctgagaccctgagcagctatgatgatgacatggatgagaacagcatggaggatgatgctgagctgaaggatgctgccacagatcctgccaagcccctgctgtcctatgccggcagctgcccccccagccccccatctgtcatcagcagcattgctgccctggagaaccagatgaagatgattgacagcgtgatgagctgccagcagctgaccggcctgaagtctgtggagaatggaagtggagagagtgaccggctgagcaatgacagcagcagcgctgtgggggacctggagagccgctctgctggcagccctgccctgtctgagagcagcagcagccaggccctgagccctgcccccagcaatggagagagcttccgcagcaagagccctggcctgggcgcccctgaggagccccaggagatccccctgaagacagagaggccagacagccctgctgctgcccctggcagcggcggggcccctggccgggccggcatcaaggaggaggcccccttcagcctgctcttcctgagccgggagcggggccccagccagagcacccccagcctcatcagcagcgctgcccccaccatgatcaagatggaggtgaatggccacggcaaggccatggccctgggggagggcccccccctgcctgctggggtgcaggtgcctgctggcccccagacagtgatgggccctggcctggcccccatgctggcccccccacccaggaggacccccaagcagcacaactgccagagctgtgggaagaccttcagcagcgccagcgccctgcagatccacgagaggacccacactggagagaagcccttcggctgcaccatctgtggccgggccttcaccaccaagggcaacctgaaggtgcacatgggcacccacatgtggaacaatgccccagcccggcggggccggcggctgtctgtggagaaccccatggccctgctgggcggagatgccctgaagttcagcgagatgttccagaaggacctggccgcccgggccatgaatgtggaccccagcttctggaaccagtatgctgctgccatcaccaacggcctggccatgaagaacaatgagatcagcgtcatccagaatggaggcatcccccagctgcctgtgtccctgggcggcagcgccctgccccccctgggctccatggccagcggcatggacaaggccaggacaggcagcagcccccccatcgtgtccctggacaaggccagcagcgagacagctgccagccggcccttcacccgcttcatcgaggacaacaaggagatcggcatcaactag

SEQ ID NO: 168799 - DNA, 516 bp, Artificial Sequence
  Description of Artificial Sequence: Synthetic coding sequence
atggtgcggccccctgtggtgccccggcggcccccagcccacatcagctctgtgcggcaggccagcacccaggtgcccaggacagtgccccacacccagagggtggccaacatcggcacccagaccaccggccccagcggcgtgggctgctgcaccccaggccggcccctgctgccctgcaagtgcagcagcgctgcccacagcacctacagagtgcaggagcctgctgtgcacatccctggccaggagcccctgacagcctccatgctggccgccgcccccctgcacgagcagaagcagatgattggagagcggctgtaccccctcatccatgatgtgcacacccagctggccggcaagatcaccggcatgctgctggagattgacaacagcgagctgctgctgatgctggagagccctgagagcctgcacgccaagaagaggaagagcagcctgccctggctgcccaagggccagtgcttctggctgagcgccctgcggccctgcaagctgtag

SEQ ID NO: 168800 - DNA, 831 bp, Artificial Sequence
  Description of Artificial Sequence: Synthetic coding sequence
atgagcaggaggaagcaggccaagccccagcacatcaacagcgaggaggaccagggcgagcagcagccccagcagcagaccccagagtttgctgatgctgccccagctgccccagctgctggggagctgggccgcagcagcctgcccagcaccttcatccgggccccacccacctacgtgaaggtggaggtgcccggcacctttgtgggccccagcaccctgagccctggcatgacccccctgctggccgcccagccccggcggcaggccaagcagcacggctgcacccgctgtgggaagaacttcagcagcgccagcgccctgcagatccacgagaggacccacactggagagaagccctttgtgtgcaacatctgtggccgggccttcaccaccaagggcaacctgaaggtgcactacatgacccatggagccaacaacaacagcgcccggcggggcaggaagctggccatcgagaacaccatggccctgctgggcacagatggcaagagggtgtctgagatcttccccaaggagatcctggcccccagcgtgaatgtggaccctgtggtgtggaaccagtacacctccatgctgaatggaggcctggccgtgaagaccaatgagatcagcgtcatccagagcggaggagtgcccaccctgcctgtgtccctgggcgccacctctgtggtgaacaatgccaccgtgtccaagatggatggcagccagagcggcatctctgcagatgtggagaagcccagcgccacagatggagtgcccaagcaccagttcccccacttcctggaggagaacaagattgctgtgtcctag

SEQ ID NO: 168801 - DNA, 1851 bp, Artificial Sequence
  Description of Artificial Sequence: Synthetic coding sequence
atgagcaggaggaagcaggccaagccccagcacatcaacagcgaggaggaccagggcgagcagcagccccagcagcagaccccagagtttgctgatgctgccccagctgccccagctgctggggagctgggcgcccctgtgaaccaccctggaaatgatgaggtggcctctgaagatgaggccaccgtgaagaggctgcggcgggaggagacccacgtgtgtgagaagtgctgtgccgagttcttcagcatcagcgagttcctggagcacaagaagaactgcaccaagaacccccctgtgctgatcatgaatgacagcgagggccctgtgcccagcgaggacttcagcggggctgtgctgagccaccagcccaccagccctggcagcaaggactgccacagagaaaatggaggcagcagcgaggacatgaaggagaagccagatgctgagagcgtggtgtacctgaagacagaaacagccctgccccccaccccccaggacatctcctacctggccaagggcaaggtggccaacaccaacgtgaccctgcaggccctgcggggcaccaaggtggccgtgaaccagaggtctgcagatgccctgcctgcccctgtgcctggggccaacagcatcccctgggtgctggagcagatcctgtgcctgcagcagcagcagctgcagcagatccagctgacagagcagatccgcatccaggtgaacatgtgggccagccacgccctgcacagcagcggggccggggctgacaccctgaagaccctgggcagccacatgagccagcaggtgtctgctgctgtggccctgctgagccagaaggccggcagccagggcctgagcctggatgccctgaagcaggccaagctgccccacgccaacatccccagcgccaccagcagcctgagccctggcctggcccccttcaccctgaagccagatggcaccagggtgctgcccaacgtgatgagccggctgcccagcgccctgctgccccaggcccctggctctgtgctcttccagagccccttcagcacagtggccctggacaccagcaagaagggcaagggcaagccacccaacatctctgctgtggatgtgaagcccaaggatgaagctgccctgtacaagcacaagtgccgcagcagcctgcccagcaccttcatccgggccccacccacctacgtgaaggtggaggtgcccggcacctttgtgggccccagcaccctgagccctggcatgacccccctgctggccgcccagccccggcggcaggccaagcagcacggctgcacccgctgtgggaagaacttcagcagcgccagcgccctgcagatccacgagaggacccacactggagagaagccctttgtgtgcaacatctgtggccgggccttcaccaccaagggcaacctgaaggtgcactacatgacccatggagccaacaacaacagcgcccggcggggcaggaagctggccatcgagaacaccatggccctgctgggcacagatggcaagagggtgtctgagatcttccccaaggagatcctggcccccagcgtgaatgtggaccctgtggtgtggaaccagtacacctccatgctgaatggaggcctggccgtgaagaccaatgagatcagcgtcatccagagcggaggagtgcccaccctgcctgtgtccctgggcgccacctctgtggtgaacaatgccaccgtgtccaagatggatggcagccagagcggcatctctgcagatgtggagaagcccagcgccacagatggagtgcccaagcaccagttcccccacttcctggaggagaacaagattgctgtgtcctag

SEQ ID NO: 168802 - DNA, 2781 bp, Artificial Sequence
  Description of Artificial Sequence: Synthetic coding sequence
atggtgatggctgatggccccaggcacctgcagaggggccctgtgcgggtgggcttctatgacatcgagggcaccctgggcaagggcaactttgctgtggtgaagctgggccgccaccgcatcaccaagacagaggtggccatcaagatcatcgacaagagccagctggatgctgtgaacctggagaagatctaccgggaggtgcagatcatgaagatgctggaccacccccacatcatcaagctgtaccaggtgatggagaccaagtccatgctgtacctggtgacagaatatgccaagaatggagagatctttgactacctggccaaccacggccgcctgaatgaaagtgaggcccggaggaagttctggcagatcctgtctgctgtggactactgccacggcaggaagatcgtgcaccgggacctgaaggccgagaacctgctgctggacaacaacatgaacatcaagattgctgactttggatttggaaacttcttcaagtctggagagctgctggccacctggtgtggcagccccccctatgctgcccctgaggtgtttgagggccagcagtatgagggcccccagctggacatctggagcatgggcgtggtgctgtatgtgctggtgtgtggggccctgccctttgatggccccaccctgcccatcctgcggcagagggtgctggagggccgcttccgcatcccctacttcatgtctgaggactgtgagcacctgatccggaggatgctggtgctggaccccagcaagaggctgaccatcgcccagatcaaggagcacaagtggatgctgattgaggtgcctgtgcagaggcctgtgctgtacccccaggagcaggagaatgagcccagcattggagagttcaatgagcaggtgctgcggctgatgcacagcctgggcatcgaccagcagaagaccatcgagagcctgcagaacaagagctacaaccactttgctgccatctacttcctgctggtggagcggctgaagagccacaggagcagcttccctgtggagcagaggctggatggccggcagaggcggcccagcaccatcgccgagcagacagtggccaaggcccagacagtgggcctgcctgtgaccatgcacagccccaacatgaggctgctgcggagcgccctgctgccccaggccagcaatgtggaggccttctccttccctgccagcggctgccaggccgaggccgccttcatggaggaggagtgtgtggacacccccaaggtgaatggctgcctgctggaccctgtgccccctgtgctggtgaggaagggctgccagagcctgcccagcaacatgatggagaccagcattgatgagggcctggagacagaaggagaggccgaggaggaccctgcccacgcctttgaggccttccagagcaccaggagcggccagaggaggcacaccctgtctgaggtgaccaaccagctggtggtgatgcctggggccggcaagatcttctccatgaatgacagccccagcctggacagcgtggacagtgaatatgacatgggctctgtgcagagggacctgaacttcctggaggacaaccccagcctgaaggacatcatgctggccaaccagcccagccccaggatgaccagccccttcatcagcctgcggcccaccaacccagccatgcaggccctgagcagccagaagcgggaggtgcacaacagaagccctgtgtccttccgggagggccggcgggccagtgacaccagcctgacccagggcatcgtggccttccggcagcacctgcagaacctggcccggaccaagggcatcctggagctgaacaaggtgcagctgctgtatgagcagatcggccctgaggccgaccccaacctggccccagctgccccccagctgcaggacctggccagcagctgcccccaggaggaggtgtcccagcagcaggagagcgtgtccaccctgcctgcctctgtgcacccccagctgagcccccggcagagcctggagacccagtacctgcagcaccggctgcagaagcccagcctgctgagcaaggcccagaacacctgccagctgtactgcaaggagccccccaggagcctggagcagcagctgcaggagcaccggctgcagcagaagaggctcttcctgcagaagcagagccagctgcaggcctacttcaaccagatgcagattgctgagagcagctacccccagcccagccagcagctgcccctgccccggcaggagaccccaccacccagccagcaggccccacccttcagcctgacccagcccctgagccctgtgctggagcccagcagcgagcagatgcagtacagccccttcctgagccagtaccaggagatgcagctgcagcccctgcccagcaccagcggcccccgggccgccccacccctgcccacccagctgcagcagcagcagcccccacctcctcctcctcctcctccaccccggcagcctggagctgccccagcccccctgcagttctcctaccagacctgtgagctgcccagcgctgccagccctgccccagactaccccaccccctgccagtaccctgtggatggagcccagcagagcgacctgaccggccctgactgccccaggagccctggcctgcaggaggcccccagcagctatgaccccctggccctgtctgagctgcccggcctgtttgactgtgagatgctggatgctgtggacccccagcacaacggctacgtgctggtgaactag

SEQ ID NO: 168803 - DNA, 1881 bp, Artificial Sequence
  Description of Artificial Sequence: Synthetic coding sequence
atgcagagagctgacagcgagcagcccagcaagaggccccgctgtgatgacagccccaggacccccagcaacaccccatctgctgaggccgactggagccctggcctggagctgcacccagactacaagacctggggccctgagcaggtgtgcagcttcctgcggcggggcggctttgaggagcctgtgctgctgaagaacatccgggagaatgagatcaccggggccctgctgccctgcctggatgagagcagatttgagaacctgggcgtgagcagcctgggggagaggaagaagctgctgagctacatccagaggctggtgcagatccacgtggacaccatgaaggtgatcaatgaccccatccacggccacatcgagctgcaccccctgctggtgcgcatcatcgacaccccccagttccagaggctgcgctacatcaagcagctgggcggcggctactacgtgtttcctggggccagccacaacagatttgagcacagcctgggcgtgggctacctggccggctgcctggtgcacgccctgggggagaagcagcctgagctgcagatcagcgagagagatgtgctgtgtgtgcagattgctggcctgtgccacgacctgggccacggccccttcagccacatgtttgatggccgcttcatccccctggcccggcctgaggtgaagtggacccatgagcagggctctgtgatgatgtttgagcacctgatcaacagcaatggcatcaagcctgtgatggagcagtatggcctcatccctgaggaggacatctgcttcatcaaggagcagatcgtgggccccctggagagccctgtggaggacagcctgtggccctacaagggccggcctgagaacaagagcttcctgtatgagatcgtgagcaacaagagaaatggaattgatgtggacaagtgggactactttgcccgggactgccaccacctgggcatccagaacaactttgactacaagcgcttcatcaagtttgcccgggtgtgtgaggtggacaatgagctgcgcatctgtgcccgggacaaggaggtgggcaacctgtatgacatgttccacaccaggaacagcctgcacagaagagcctaccagcacaaggtgggcaacatcatcgacaccatgatcacagatgccttcctgaaggcagatgactacatcgagatcaccggggccggcggcaagaagtaccgcatcagcacagccattgatgacatggaggcctacaccaagctgacagacaacatcttcctggagatcctgtacagcacagaccccaagctgaaggatgcccgggagatcctgaagcagatcgagtacagaaacctcttcaagtatgtgggggagacccagcccaccggccagatcaagatcaagagagaagattatgagagcctgcccaaggaggtggccagcgccaagcccaaggtgctgctggatgtgaagctgaaggccgaggacttcatcgtggatgtgatcaacatggactatggcatgcaggagaagaaccccatcgaccacgtgtccttctactgcaagacagcccccaacagagccatccgcatcaccaagaaccaggtgtcccagctgctgcctgagaagtttgctgagcagctgatccgggtgtactgcaagaaggtggacaggaagagcctgtatgctgcccggcagtactttgtgcagtggtgtgccgacaggaacttcaccaagccccaggatggagatgtgattgcccccctcatcaccccccagaagaaggagtggaatgacagcacctctgtgcagaaccccacccggctgcgggaggccagcaagagccgggtgcagctgttcaaggatgaccccatgtag

SEQ ID NO: 168804 - DNA, 513 bp, Artificial Sequence
  Description of Artificial Sequence: Synthetic coding sequence
atgtttgatggccgcttcatccccctggcccggcctgaggtgaagtggacccatgagcagggctctgtgatgatgtttgagcacctgatcaacagcaatggcatcaagcctgtgatggagcagtatggcctcatccctgaggaggacatctgcttcatcaaggagcagatcgtgggccccctggagagccctgtggaggacagcctgtggccctacaagggccggcctgagaacaagagcttcctgtatgaaattgtgagcaacaagagaaatggaattgatgtggacaagtgggactactttgcccgggactgccaccacctgggcatccagaacaactttgactacaagcgcttcatcaagtttgcccgggtgtgtgaggtggacaatgagctgcgcatctgtgcccgggacaaggaggtgggcaacctgtatgacatgttccacaccaggaacagcctgcaccggcgggcctaccagcacaaggtgggcaacatcatcgacaccatgtag

SEQ ID NO: 168805 - DNA, 1326 bp, Artificial Sequence
  Description of Artificial Sequence: Synthetic coding sequence
atggagatccggctggacaccctgagcgccagcctgggccgcagcagcaccctgaacaactgcaacctggaggacaagctggcctggtatgaaggagaggcctacatgtggcaccactggaagcccttccctgagaaccccctgtggacctgcctggacttccagatcgcccaggtgggcccctgggaccactgcagcagctgcatccgccacacccggctgaagagcagctgcagcgacatggacctgctgcacagctggaggagcagcagctttggaaactttgaccgcttcaggaacaacagcctgagcaagccagatgacagcacagaggcccatgaaggagaccccaccaatggaagtggagagcagagcaagaccagcaacaacggcggcggcctgggcaagaagatgagggccatctcctggaccatgaagaagaaggtgggcaagaagtacatcaaggccctgtctgaggagaaggatgaggaggatggagaaaatgcccacccctacagaaacagcgaccctgtgattggcacccacacagagaaggtgtccctgaaggccagtgacagcatggacagcctgtacagcggccagagcagcagcagcggcatcaccagctgcagtgatggcaccagcaacagagacagcttccggctggatgatgatggcccctacagcggccccttctgtggccgggcccgggtgcacacagacttcacccccagcccctatgacacagacagcctgaagatcaagaagggggacatcatcgacatcatctgcaagacccccatgggcatgtggacaggcatgctgaacaacaaggtgggcaacttcaagttcatctacgtggatgtgatcagcgaggaggaggccgcccccaagaagatcaaggccaacagaagaagcaacagcaagaagagcaagaccctgcaggagttcctggagcgcatccacctgcaggagtacaccagcaccctgctgctgaatggctatgagaccctggaggacctgaaggacatcaaggagagccacctgattgagctgaacattgaaaatccagatgacagaagaaggctgctgtctgctgctgagaacttcctggaggaggagatcatccaggagcaggagaatgaacctgagcccctgagcctgagcagtgacatcagcctgaacaagagccagctggatgactgcccccgggacagcggctgctacatcagcagcggcaacagcgacaatggcaaggaggacctggagagcgagaacctgagtgacatggtgcacaagatcatcatcacagagcccagcgactag

SEQ ID NO: 168806 - DNA, 618 bp, Artificial Sequence
  Description of Artificial Sequence: Synthetic coding sequence
atgctgaagaggaagcccagcaatgtgtctgagaaggagaagcaccagaagcccaagaagggggacatcatcgacatcatctgcaagacccccatgggcatgtggacaggcatgctgaacaacaaggtgggcaacttcaagttcatctacgtggatgtgatcagcgaggaggaggccgcccccaagaagatcaaggccaacagaagaagcaacagcaagaagagcaagaccctgcaggagttcctggagcgcatccacctgcaggagtacaccagcaccctgctgctgaatggctatgagaccctggaggacctgaaggacatcaaggagagccacctgattgagctgaacattgaaaatccagatgacagaagaaggctgctgtctgctgctgagaacttcctggaggaggagatcatccaggagcaggagaatgaacctgagcccctgagcctgagcagtgacatcagcctgaacaagagccagctggatgactgcccccgggacagcggctgctacatcagcagcggcaacagcgacaatggcaaggaggacctggagagcgagaacctgagtgacatggtgcacaagatcatcatcacagagcccagcgactag

SEQ ID NO: 168807 - DNA, 1122 bp, Artificial Sequence
  Description of Artificial Sequence: Synthetic coding sequence
atgctgaagaggaagcccagcaatgtgtctgagaaggagaagcaccagaagcccaagaggagcagcagctttggaaactttgaccgcttcaggaacaacagcctgagcaagccagatgacagcacagaggcccatgaaggagaccccaccaatggaagtggagagcagagcaagaccagcaacaacggcggcggcctgggcaagaagatgagggccatctcctggaccatgaagaagaaggtgggcaagaagtacatcaaggccctgtctgaggagaaggatgaggaggatggagaaaatgcccacccctacagaaacagcgaccctgtgattggcacccacacagagaaggtgtccctgaaggccagtgacagcatggacagcctgtacagcggccagagcagcagcagcggcatcaccagctgcagtgatggcaccagcaacagagacagcttccggctggatgatgatggcccctacagcggccccttctgtggccgggcccgggtgcacacagacttcacccccagcccctatgacacagacagcctgaagatcaagaagggggacatcatcgacatcatctgcaagacccccatgggcatgtggacaggcatgctgaacaacaaggtgggcaacttcaagttcatctacgtggatgtgatcagcgaggaggaggccgcccccaagaagatcaaggccaacagaagaagcaacagcaagaagagcaagaccctgcaggagttcctggagcgcatccacctgcaggagtacaccagcaccctgctgctgaatggctatgagaccctggaggacctgaaggacatcaaggagagccacctgattgagctgaacattgaaaatccagatgacagaagaaggctgctgtctgctgctgagaacttcctggaggaggagatcatccaggagcaggagaatgaacctgagcccctgagcctgagcagtgacatcagcctgaacaagagccagctggatgactgcccccgggacagcggctgctacatcagcagcggcaacagcgacaatggcaaggaggacctggagagcgagaacctgagtgacatggtgcacaagatcatcatcacagagcccagcgactag

SEQ ID NO: 168808 - DNA, 1008 bp, Artificial Sequence
  Description of Artificial Sequence: Synthetic coding sequence
atgggcagcgccagccctggcctgagctctgtgagccccagccacctgctgctgcccccagacacagtgtccaggacaggcctggagaaggctgctgctggagctgtgggcctggagcggcgggactggagccccagccccccagccaccccagagcagggcctgagcgccttctacctgagctactttgacatgctgtacccagaggacagctcctgggccgccaaggcccctggggccagcagccgggaggagcccccagaggagcctgagcagtgccctgtgattgacagccaggccccagctggcagcctggacctggtgcctgggggcctgaccctggaggagcacagcctggagcaggtgcagagcatggtggtgggggaggtgctgaaggacatcgagacagcctgcaagctgctgaacatcacagctgaccccatggactggagccccagcaatgtgcagaagtggctgctgtggacagagcaccagtaccgcctgccccccatgggcaaggccttccaggagctggccggcaaggagctgtgtgccatgtctgaggagcagttccggcagaggagccccctgggcggagatgtgctgcacgcccacctggacatctggaagtctgctgcctggatgaaggagaggaccagccctggggccatccactactgtgccagcaccagcgaggagagctggacagacagcgaggtggacagcagctgcagcggccagcccatccacctgtggcagttcctgaaggagctgctgctgaagccccacagctatggccgcttcatccgctggctgaacaaggagaagggcatcttcaagattgaggacagcgcccaggtggcccggctgtggggcatcaggaagaacagacctgccatgaactatgacaagctgagccgcagcatccggcagtactacaagaagggcatcatcaggaagccagacatcagccagaggctggtgtaccagtttgtgcaccccatctag

SEQ ID NO: 168809 - DNA, 960 bp, Artificial Sequence
  Description of Artificial Sequence: Synthetic coding sequence
atgggcagcgccagccctggcctgagctctgtgagccccagccacctgctgctgcccccagacacagtgtccaggacaggcctggagaaggctgctgctggagctgtgggcctggagcggcgggactggagccccagccccccagccaccccagagcagggcctgagcgccttctacctgagctactttgacatgctgtacccagaggacagctcctgggccgccaaggcccctggggccagcagccgggaggagcccccagaggagcctgagcagtgccctgtgattgacagccaggccccagctggcagcctggacctggtgcctgggggcctgaccctggaggagcacagcctggagcaggtgcagagcatggtggtgggggaggtgctgaaggacatcgagacagcctgcaagctgctgaacatcacagctgaccccatggactggagccccagcaatgtgcagaagtggctgctgtggacagagcaccagtaccgcctgccccccatgggcaaggccttccaggagctggccggcaaggagctgtgtgccatgtctgaggagcagttccggcagaggagccccctgggcggagatgtgctgcacgcccacctggacatctggaagagcgccagcaccagcgaggagagctggacagacagcgaggtggacagcagctgcagcggccagcccatccacctgtggcagttcctgaaggagctgctgctgaagccccacagctatggccgcttcatccgctggctgaacaaggagaagggcatcttcaagattgaggacagcgcccaggtggcccggctgtggggcatcaggaagaacagacctgccatgaactatgacaagctgagccgcagcatccggcagtactacaagaagggcatcatcaggaagccagacatcagccagaggctggtgtaccagtttgtgcaccccatctag

SEQ ID NO: 168810 - DNA, 1218 bp, Artificial Sequence
  Description of Artificial Sequence: Synthetic coding sequence
atggccgccagcggcaagaccagcaagtctgagcccaaccacgtgatcttcaagaagatcagccgggacaagtctgtgaccatctacctgggcaacagagactacatcgaccacgtgtcccaggtgcagcctgtggatggagtggtgctggtggaccctgacctggtgaagggcaagaaggtgtatgtgaccctgacctgtgccttccgctatggccaggaggacattgatgtgattggcctgaccttccggcgggacctgtacttcagccgggtgcaggtgtacccacctgtgggcgccgccagcacccccaccaagctgcaggagagcctgctgaagaagctgggcagcaacacctaccccttcctgctgaccttcccagactacctgccctgcagcgtgatgctgcagcctgccccccaggacagcggcaagagctgtggggtggactttgaggtgaaggcctttgccacagacagcacagatgctgaggaggacaagatccccaagaagagctctgtgcggctgctgatcaggaaggtgcagcacgcccccctggagatgggcccccagcccagggctgaggccgcctggcagttcttcatgtctgacaagcccctgcacctggccgtgtccctgaacaaggagatctacttccacggggagcccatccctgtgacagtgacagtgaccaacaacacagagaagacagtgaagaagatcaaggcctttgtggagcaggtggccaacgtggtgctgtacagcagtgactactacgtgaagcctgtggccatggaggaggcccaggagaaggtgccccccaacagcaccctgaccaagaccctgaccctgctgcccctgctggccaacaaccgggagcggcggggcatcgccctggatggcaagatcaagcatgaggacaccaacctggccagcagcaccatcatcaaggagggcatcgacagaacagtgctgggcatcctggtgtcctaccagatcaaggtgaagctgactgtgtctggcatgacaggccggcagaaggccagcgaggtggccacagaggtgcccttccggctgatgcacccccagccagaagatcctggccagttctcctaccaggatgccaacctggtgtttgaggagtttgcccggcacaacctgaaggatgctggggaggccgaggagggcaagagggacaagaatgatgtggatgaatag

SEQ ID NO: 168811 - DNA, 1218 bp, Artificial Sequence
  Description of Artificial Sequence: Synthetic coding sequence
atggccgccagcggcaagaccagcaagtctgagcccaaccacgtgatcttcaagaagatcagccgggacaagtctgtgaccatctacctgggcaacagagactacatcgaccacgtgtcccaggtgcagcctgtggatggagtggtgctggtggaccctgacctggtgaagggcaagaaggtgtatgtgaccctgacctgtgccttccgctatggccaggaggacattgatgtgattggcctgaccttccggcgggacctgtacttcagccgggtgcaggtgtacccacctgtgggcgccgccagcacccccaccaagctgcaggagagcctgctgaagaagctgggcagcaacacctaccccttcctgctgaccttcccagactacctgccctgcagcgtgatgctgcagcctgccccccaggacagcggcaagagctgtggggtggactttgaggtgaaggcctttgccacagacagcacagatgctgaggaggacaagatccccaagaagagctctgtgcggctgctgatcaggaaggtgcagcacgcccccctggagatgggcccccagcccagggctgaggccgcctggcagttcttcatgtctgacaagcccctgcacctggccgtgtccctgaacaaggagatctacttccacggggagcccatccctgtgacagtgacagtgaccaacaacacagagaagacagtgaagaagatcaaggcctttgtggagcaggtggccaacgtggtgctgtacagcagtgactactacgtgaagcctgtggccatggaggaggcccaggagaaggtgccccccaacagcaccctgaccaagaccctgaccctgctgcccctgctggccaacaaccgggagcggcggggcatcgccctggatggcaagatcaagcatgaggacaccaacctggccagcagcaccatcatcaaggagggcatcgacagaacagtgctgggcatcctggtgtcctaccagatcaaggtgaagctgactgtgtctggcttcctgggggagctgaccagcagcgaggtggccacagaggtgcccttccggctgatgcacccccagccagaagatcctgccaaggagagctaccaggatgccaacctggtgtttgaggagtttgcccggcacaacctgaaggatgctggggaggccgaggagggcaagagggacaagaatgatgtggatgaatag

SEQ ID NO: 168812 - DNA, 510 bp, Artificial Sequence
  Description of Artificial Sequence: Synthetic coding sequence
atggccgccagcggcaagaccagcaagtctgagcccaaccacgtgatcttcaagaagatcagccgggacaagtctgtgaccatctacctgggcaacagagactacatcgaccacgtgtcccaggtgcagcctgtggatggagtggtgctggtggaccctgacctggtgaagggcaagaaggtgtatgtgaccctgacctgtgccttccgctatggccaggaggacattgatgtgattggcctgaccttccggcgggacctgtacttcagccgggtgcaggtgtacccacctgtgggcgccgccagcacccccaccaagctgcaggagagcctgctgaagaagctgggcagcaacacctaccccttcctgctgaccttcccagactacctgccctgcagcgtgatgctgcagcctgccccccaggacagcggcaagagctgtggggtggactttgaggtgaaggcctttgccacagacagcacagatgctgaggaggacaagatcccctag

SEQ ID NO: 168813 - DNA, 708 bp, Artificial Sequence
  Description of Artificial Sequence: Synthetic coding sequence
atgctgcagcctgccccccaggacagcggcaagagctgtggggtggactttgaggtgaaggcctttgccacagacagcacagatgctgaggaggacaagatccccaagaagagctctgtgcggctgctgatcaggaaggtgcagcacgcccccctggagatgggcccccagcccagggctgaggccgcctggcagttcttcatgtctgacaagcccctgcacctggccgtgtccctgaacaaggagatctacttccacggggagcccatccctgtgacagtgacagtgaccaacaacacagagaagacagtgaagaagatcaaggcctttgtggagcaggtggccaacgtggtgctgtacagcagtgactactacgtgaagcctgtggccatggaggaggcccaggagaaggtgccccccaacagcaccctgaccaagaccctgaccctgctgcccctgctggccaacaaccgggagcggcggggcatcgccctggatggcaagatcaagcatgaggacaccaacctggccagcagcaccatcatcaaggagggcatcgacagaacagtgctgggcatcctggtgtcctaccagatcaaggtgaagctgactgtgtctggcttcctgggggagctgaccagcagcgaggtggccacagaggtgcccttccggctgatgcacccccagccagaagatcctgggaagtag

SEQ ID NO: 168814 - DNA, 204 bp, Artificial Sequence
  Description of Artificial Sequence: Synthetic coding sequence
atggccgccagcggcaagaccagcaagtctgagcccaaccacgtgatcttcaagaagatcagccgggacaagtctgtgtctggggcccaggtgaccatctacctgggcaacagagactacatcgaccacgtgtcccaggtgcagcctgtggatggagtggtgctggtggaccctgacctggtgaagggcaagaaggtgtcctag

SEQ ID NO: 168815 - DNA, 633 bp, Artificial Sequence
  Description of Artificial Sequence: Synthetic coding sequence
atggccacagaaacagtggagctgcacaagctgaagctggccgagctgaagcaggagtgcctggcccggggcctggagaccaagggcatcaagcaggacctgatccaccggctgcaggcctacctggaggagcacgccgaggaggaggccaatgaagaagatgtgctgggagatgaaacagaggaggaggagaccaagcccatcgagctgcctgtgaaggaggaggagcccccagagaagacagtggatgtggccgctgagaagaaggtggtgaagatcaccagcgagatcccccagacagagaggatgcagaagagagctgagcgcttcaacgtgcctgtgtccctggagagcaagaaggccgcccgggccgccaggtttggcatcagctctgtgcccaccaagggcctgagcagtgacaacaagcccatggtgaacctggacaagctgaaggagcgggcccagagatttggcctgaatgtgagcagcatcagcaggaagtcagaagatgatgagaagctgaagaagaggaaggagagatttggaattgtgaccagcagcgctggcaccggcaccacagaggacacagaggccaagaagaggaagagagctgagagatttggaattgcctag

SEQ ID NO: 168816 - DNA, 453 bp, Artificial Sequence
  Description of Artificial Sequence: Synthetic coding sequence
atggaggaggagaccaagcccatcgagctgcctgtgaaggaggaggagcccccagagaagacagtggatgtggccgctgagaagaaggtggtgaagatcaccagcgagatcccccagacagagaggatgcagaagagagctgagcgcttcaacgtgcctgtgtccctggagagcaagaaggccgcccgggccgccaggtttggcatcagctctgtgcccaccaagggcctgagcagtgacaacaagcccatggtgaacctggacaagctgaaggagcgggcccagagatttggcctgaatgtgagcagcatcagcaggaagtcagaagatgatgagaagctgaagaagaggaaggagagatttggaattgtgaccagcagcgctggcaccggcaccacagaggacacagaggccaagaagaggaagagagctgagagatttggaattgcctag

SEQ ID NO: 168817 - DNA, 633 bp, Artificial Sequence; identical to SEQ ID NO: 168815
  Description of Artificial Sequence: Synthetic coding sequence

SEQ ID NO: 168818 - DNA, 879 bp, Artificial Sequence
  Description of Artificial Sequence: Synthetic coding sequence
atggccggcaagaagaatgtgctgagcagcctggccgtgtatgcagaggacagcgagcctgagagtgatggagaggccggcatcgaggccgtgggcagcgctgctgaggagaagggcggcctggtgtctgatgcctacggggaggatgacttcagccggctgggcggagatgaagatggctatgaggaggaggaggatgagaacagccggcagagcgacaacacagaagctgagaagagggacccccaggagctggtggccagcttcagcgagcgggtgaggaacatgagcccagatgagatcaagatccccccagagcccccaggccgctgcagcaaccacctgcaggacaagatccagaagctgtatgaaaggaagatcaaggagggcatggacatgaactacatcatccagaggaagaaggagttcaggaaccccagcatctatgagaagctgatccagttctgtgccattgatgagctgggcaccaactaccccaaggacatgtttgacccccacggctggagcgaagattcctactatgaggccctggccaaggcccagaagattgagatggacaagctggagaaggccaagaaggagaggaccaagattgaatttgtgacaggcaccaagaagggcaccaccaccaatgccaccagcaccaccaccaccacagccagcacagctgtggctgatgcccagaagaggaagagcaagtgggacagcgccatccctgtgaccaccatcgcccagcccaccatcctgaccaccacagccaccctgcctgctgtggtgacagtgaccaccagcgccagcggcagcaagaccaccgtcatctctgctgtgggcaccatcgtgaagaaggccaagcagtag

SEQ ID NO: 168819 - DNA, 927 bp, Artificial Sequence
  Description of Artificial Sequence: Synthetic coding sequence
atggccggcaagaagaatgtgctgagcagcctggccgtgtatgcagaggacagcgagcctgagagtgatggagaggccggcatcgaggccgtgggcagcgctgctgaggagaagggcggcctggtgtctgatgcctacggggaggatgacttcagccggctgggcggagatgaagatggctatgaggaggaggaggatgagaacagccggcagagtgaagatgatgattctgaaacagagaagccagaggctgatgaccccaaggacaacacagaagctgagaagagggacccccaggagctggtggccagcttcagcgagcgggtgaggaacatgagcccagatgagatcaagatccccccagagcccccaggccgctgcagcaaccacctgcaggacaagatccagaagctgtatgaaaggaagatcaaggagggcatggacatgaactacatcatccagaggaagaaggagttcaggaaccccagcatctatgagaagctgatccagttctgtgccattgatgagctgggcaccaactaccccaaggacatgtttgacccccacggctggagcgaagattcctactatgaggccctggccaaggcccagaagattgagatggacaagctggagaaggccaagaaggagaggaccaagattgaatttgtgacaggcaccaagaagggcaccaccaccaatgccaccagcaccaccaccaccacagccagcacagctgtggctgatgcccagaagaggaagagcaagtgggacagcgccatccctgtgaccaccatcgcccagcccaccatcctgaccaccacagccaccctgcctgctgtggtgacagtgaccaccagcgccagcggcagcaagaccaccgtcatctctgctgtgggcaccatcgtgaagaaggccaagcagtag

SEQ ID NO: 168820 - DNA, 507 bp, Artificial Sequence
  Description of Artificial Sequence: Synthetic coding sequence
atggccggcaagaagaatgtgctgagcagcctggccgtgtatgcagaggacagcgagcctgagagtgatggagaggccggcatcgaggccgtgggcagcgctgctgaggagaagggcggcctggtgtctgatgcctacggggaggatgacttcagccggctgggcggagatgaagatggctatgaggaggaggaggatgagaacagccggcagagtgaagatgatgattctgaaacagagaagccagaggctgatgaccccaaggacaacacagaagctgagaagagggacccccaggagctggtggccagcttcagcgagcgggtgaggaacatgagcccagatgagatcaagatccccccagagcccccaggccgctgcagcaaccacctgcaggacaagatccagaagctgtatgaaaggaagatcaaggagggcatggacatgaactacatcatccagaggaagaaggagttcaggaaccccagccagggcccagaaaattag

SEQ ID NO: 168821 - DNA, 927 bp, Artificial Sequence; identical to SEQ ID NO: 168819
  Description of Artificial Sequence: Synthetic coding sequence

SEQ ID NO: 168822 - DNA, 366 bp, Artificial Sequence
  Description of Artificial Sequence: Synthetic coding sequence
atgtccttcatctttgagtggatctacaacggcttcagctctgtgctgcagttcctgggcctgtacaagaagagcggcaagctggtgttcctgggcctggacaatgctgggaagaccaccctgctgcacatgctgaaggatgaccggctgggccagcacgtgcccaccctgcaccccaccagcgaggagctgaccatcgccggcatgaccttcaccacctttgacctgggcggccacgagcaggccaggagagtgtggaagaactacctgcctgccatcaatggcatcgtgttcctggtggactgtgccgaccacagccggctggtggagagcaaggtggagctgaatgtgtgctttgtgctgtag

SEQ ID NO: 168823 - DNA, 597 bp, Artificial Sequence
  Description of Artificial Sequence: Synthetic coding sequence
atgtccttcatctttgagtggatctacaacggcttcagctctgtgctgcagttcctgggcctgtacaagaagagcggcaagctggtgttcctgggcctggacaatgctgggaagaccaccctgctgcacatgctgaaggatgaccggctgggccagcacgtgcccaccctgcaccccaccagcgaggagctgaccatcgccggcatgaccttcaccacctttgacctgggcggccacgagcaggccaggagagtgtggaagaactacctgcctgccatcaatggcatcgtgttcctggtggactgtgccgaccacagccggctggtggagagcaaggtggagctgaatgccctgatgacagatgagaccatcagcaatgtgcccatcctgatcctgggcaacaagattgacagaacagatgccatcagcgaggagaagctgcgggagatcttcggcctgtatggccagaccactggaaaaggaaatgtgaccctgaaggagctgaatgcccggcccatggaggtgttcatgtgcagcgtgctgaagaggcagggctacggggagggcttccgctggctgagccagtacattgattag

SEQ ID NO: 168824 - DNA, 597 bp, Artificial Sequence; identical to SEQ ID NO: 168823
  Description of Artificial Sequence: Synthetic coding sequence

SEQ ID NO: 168825 - DNA, 597 bp, Artificial Sequence; identical to SEQ ID NO: 168823
  Description of Artificial Sequence: Synthetic coding sequence

SEQ ID NO: 168826 - DNA, 597 bp, Artificial Sequence; identical to SEQ ID NO: 168823
  Description of Artificial Sequence: Synthetic coding sequence

SEQ ID NO: 168827 - DNA, 354 bp, Artificial Sequence
  Description of Artificial Sequence: Synthetic coding sequence
atgggcctgtccttctggtggacagtgcagatcatcctggcctcctggaaccccaagctgagcctgatgatctactgcagcagcctgctgaccctggccccaaatgccctgatgacagatgagaccatcagcaatgtgcccatcctgatcctgggcaacaagattgacagaacagatgccatcagcgaggagaagctgcgggagatcttcggcctgtatggccagaccactggaaaaggaaatgtgaccctgaaggagctgaatgcccggcccatggaggtgttcatgtgcagcgtgctgaagaggcagggctatggagagggcttccgctggctgagccagtacatcgactag

SEQ ID NO: 168828 - DNA, 597 bp, Artificial Sequence; identical to SEQ ID NO: 168823
  Description of Artificial Sequence: Synthetic coding sequence

SEQ ID NO: 168829 - DNA, 348 bp, Artificial Sequence
  Description of Artificial Sequence: Synthetic coding sequence
tgaagcttctggtggacagtgcagatcatcctggcctcctggaaccccaagctgagcctgatgatctactgcagcagcctgctgaccctggccccaaatgccctgatgacagatgagaccatcagcaatgtgcccatcctgatcctgggcaacaagattgacagaacagatgccatcagcgaggagaagctgcgggagatcttcggcctgtatggccagaccactggaaaaggaaatgtgaccctgaaggagctgaatgcccggcccatggaggtgttcatgtgcagcgtgctgaagaggcagggctatggagagggcttccgctggctgagccagtacatcgactag

SEQ ID NO: 168830 - DNA, 468 bp, Artificial Sequence
  Description of Artificial Sequence: Synthetic coding sequence
atgctgaaggatgaccggctgggccagcacgtgcccaccctgcaccccaccagcgaggagctgaccatcgccggcatgaccttcaccacctttgacctgggcggccacgagcaggcccggcgggtgtggaagaactacctgcctgccatcaatggaattgtgttcctggtggactgtgccgaccacagccggctggtggagagcaaggtggagctgaatgccctgatgacagatgagaccatcagcaatgtgcccatcctgatcctgggcaacaagattgacagaacagatgccatcagcgaggagaagctgcgggagatcttcggcctgtatggccagaccactggaaaaggaaatgtgaccctgaaggagctgaatgcccggcccatggaggtgttcatgtgcagcgtgctgaagaggcagggctatggagagggcttccgctggctgagccagtacatcgactag

SEQ ID NO: 168831 - DNA, 393 bp, Artificial Sequence
  Description of Artificial Sequence: Synthetic coding sequence
atgaccttcaccacctttgacctgggcggccacgtgcaggccaggagagtgtggaagaactacctgcctgccatcaatggcatcgtgttcctggtggactgtgccgaccacgagcggctgctggagagcaaggaggagctggacagcctgatgacagatgagaccatcgccaacgtgcccatcctgatcctgggcaacaagattgacaggcctgaggccatcagcgaggagcggctgcgggagatgtttggcctgtatggccagaccaccgggaagggcagcatcagcctgaaggagctgaatgcccggcccctggaggtgttcatgtgcagcgtgctgaagaggcagggctacggggagggcttccgctggatggcccagtacattgattag

SEQ ID NO: 168832 - DNA, 597 bp, Artificial Sequence
  Description of Artificial Sequence: Synthetic coding sequence
atgtccttcatctttgactggatctacagcggcttcagctctgtgctgcagttcctgggcctgtacaagaagacaggcaagctggtgttcctgggcctggacaatgctgggaagaccaccctgctgcacatgctgaaggatgaccggctgggccagcacgtgcccaccctgcaccccaccagcgaggagctgaccatcgccggcatgaccttcaccacctttgacctgggcggccacgtgcaggccaggagagtgtggaagaactacctgcctgccatcaatggcatcgtgttcctggtggactgtgccgaccacgagcggctgctggagagcaaggaggagctggacagcctgatgacagatgagaccatcgccaacgtgcccatcctgatcctgggcaacaagattgacaggcctgaggccatcagcgaggagcggctgcgggagatgtttggcctgtatggccagaccaccgggaagggcagcatcagcctgaaggagctgaatgcccggcccctggaggtgttcatgtgcagcgtgctgaagaggcagggctacggggagggcttccgctggatggcccagtacattgattag

SEQ ID NO: 168833 - DNA, 597 bp, Artificial Sequence; identical to SEQ ID NO: 168832
  Description of Artificial Sequence: Synthetic coding sequence

SEQ ID NO: 168834 - DNA, 312 bp, Artificial Sequence
  Description of Artificial Sequence: Synthetic coding sequence
atgtccttcatctttgactggatctacagcggcttcagctctgtgctgcagttcctgggcctgtacaagaagacaggcaagctggtgttcctgggcctggacaatgctgggaagaccaccctgctgcacatgctgaaggatgaccggctgggccagcacgtgcccaccctgcaccccaccagcgaggagctgaccatcgccggcatgaccttcaccacctttgacctgggcggccacgtgcaggccaggagagtgtggaagaactacctgcctgccatcaatggcatcgtgttcctggtggactgtgcctag

SEQ ID NO: 168835 - DNA, 393 bp, Artificial Sequence; identical to SEQ ID NO: 168831
  Description of Artificial Sequence: Synthetic coding sequence

SEQ ID NO: 168836 - DNA, 513 bp, Artificial Sequence
  Description of Artificial Sequence: Synthetic coding sequence
atgtccttcatctttgactggatctacagcggcttcagctctgtgctgcagttcctgggcctgtacaagaagacaggcaagctggtgttcctgggcctggacaatgctgggaagaccaccctgctgcacatgctgaaggatgaccggctgggccagcacgtgcccaccctgcaccccaccagcgaggagctgaccatcgccggcatgaccttcaccacctttgacctgggcggccacgtgcaggccaggagagtgtggaagaactacctgcctgccatcaatggcatcgtgttcctggtggactgtgccgaccacgagcggctgctggagagcaaggaggagctggacagcctgatgacagatgagaccatcgccaacgtgcccatcctgatcctgggcaacaagattgacaggcctgaggccatcagcgaggagcggctgcgggagatgtttggcctgtatggccagaccaccgggaagggcagcatcagcctgaaggagctgaatgcctag

SEQ ID NO: 168837 - DNA, 393 bp, Artificial Sequence; identical to SEQ ID NO: 168831
  Description of Artificial Sequence: Synthetic coding sequence

SEQ ID NO: 168838 - DNA, 393 bp, Artificial Sequence; identical to SEQ ID NO: 168831
  Description of Artificial Sequence: Synthetic coding sequence

SEQ ID NO: 168839 - DNA, 2796 bp, Artificial Sequence
  Description of Artificial Sequence: Synthetic coding sequence
atgagggccctggtgctgctgggctgcctgctggccagcctgctcttcagcggccaggccgagctgcaggtgtctgccagcggcggcacagaagatgtgggcaacctgctggagaaccacttctctgctggagatgccagcctggaggagaaggagcgggccctgtatgctgacacagccccccaggacaagaagctgctgctgcactacccagatggccgggaggccgagagccccaagaagaccccagccagcgctgccagcgctggccctgaccctgaggccagcctgagcaatgccagcgccacagagagccccccacctggagagagagatgacagagatgctgctggccctggagaggagaagaatggcccccctgtggccagcgccctgcccccaggaggagccaagggccctgtggaggaggagtggccagagcccagcagcggggagggccagggcgaggaggagactggatttggcctgcccacagagggcacagccagcggggaggccggcggccaggccggcggccacgagctgcctgaggaggtgcaggaggtgcagggcgacagcctggtgcagggcgctgtggccggcacagctgagcccaaggccgagggcgccagcccccacagtgaaggagatggagtgggccccctgaatgctgaggccgagggcagccctggccctggagaggagcctgctgtgcctgagggcgccccagatgtggccgctgtgggcggggagagcgagccagacatcgacacccaggccagcgagggcacagaggaccagggcgagcccggccctgctgctgaggccagcgctgagcccggcggggcccagagcgtgaaggccggggacacagaggagaaccagagccctgagatgacagaggaggatgctgatgaggccagcagcgaggaggagagcggagatggcagcggcagcgaggaggagggcggcgtgcccagcgaggaggagagtgaagaagattctggagatggagccagcagcgaggaggccgagggcgccagcgaggaggccacagagccccaggaggccggggagccccaggaggcccgggagccccaggagggcggggacctgcaggaggccgaggagagccaggagggcggggacccccaggaggccgaggagccccaggagggcggggccccccaggagggcggggagccccaggagggcggggacccccaggaggcccgggagccccaggaggcccgggagccccaggagggcgctgagctgcctgaggccaccggcaccaccagccaccgggacagaggagcccagcccggccctgaggagctgaacacagagagcatgggcagcgagaccctggacatgaaggccgaggagcctgaggagggccaccagcgggagagccccatcatcgtggcccaggaggagacagaagatgccaatgaggaggcccccctgcgggacaggagccacatcgagaagaccctgatgctgaatgaagacaagcccagtgatgactacagcgctgtgctgcagaggctgaggaagatctaccacagcagcatcaagcccctggagcagagctacaagtacaatgagctgcggcagcacgagatcacagatggagagatcaccagcaagcccatggtgctcttcctgggcccctggagcgtgggcaagagcaccatgatcaactacctgctgggcctggagaacacccgctaccagctgtacacaggagctgagcccaccaccagcgagttcaccgtgctgatgcacggccccaagctgaagaccatcgagggcatcgtgatggctgctgacagcgcccggagcttcagccccctggagaagtttggccagaacttcctggagaagctgattggcatcgaggtgccccacaagctgctggagcgggtgacctttgtggacaccccaggcatcatcgagaacaggaagcagcaggagcggggctaccccttcaatgatgtgtgccagtggttcatcgacagagctgacctgatctttgtggtgtttgaccccaccaagctggatgtgggcctggagctggagatgctgttccggcagctgaagggccgggagagccagatccgcatcatcctgaacaaggctgacaacctggccacccagatgctgatgagggtgtatggagccctcttctggagcctggcccccctcatcaacgtgacagagcccccccgggtgtatgtgagcagcttctggccccaggagtacaagccagacacccaccaggagctgttcctgcaggaggagatcagcctgctggaggacctgaaccaggtgattgaaaatcggctggagaacaagatcgccttcatccggcagcacgccatccgggtgcgcatccacgccctgctggtggaccgctacctgcagacctacaaggacaagatgaccttcttcagtgatggagagctggtgttcaaggacatcgtggaggaccctgacaagttctacatcttcaagaccatcctggccaagaccaacgtgtccaagtttgacctgcccaaccgggaggcctacaaggacttcttcggcatcaaccccatcagcagcttcaagctgctgagccagcagtgcagctacatgggcggctgcttcctggagaagattgagcgggccatcacccaggagctgcccggcctgctgggcagcctgggcctgggcaagaaccctggggccctgaactgtgacaagacaggctgcagcgagacccccaagaaccgctacaggaagcactag

SEQ ID NO: 168840 - DNA, 1422 bp, Artificial Sequence
  Description of Artificial Sequence: Synthetic coding sequence
atgagggccctggtgctgctgggctgcctgctggccagcctgctcttcagcggccaggccgaggagacagaagatgccaatgaggaggcccccctgcgggacaggagccacatcgagaagaccctgatgctgaatgaagacaagcccagtgatgactacagcgctgtgctgcagaggctgaggaagatctaccacagcagcatcaagcccctggagcagagctacaagtacaatgagctgcggcagcacgagatcacagatggagagatcaccagcaagcccatggtgctcttcctgggcccctggagcgtgggcaagagcaccatgatcaactacctgctgggcctggagaacacccgctaccagctgtacacaggagctgagcccaccaccagcgagttcaccgtgctgatgcacggccccaagctgaagaccatcgagggcatcgtgatggctgctgacagcgcccggagcttcagccccctggagaagtttggccagaacttcctggagaagctgattggcatcgaggtgccccacaagctgctggagcgggtgacctttgtggacaccccaggcatcatcgagaacaggaagcagcaggagcggggctaccccttcaatgatgtgtgccagtggttcatcgacagagctgacctgatctttgtggtgtttgaccccaccaagctggatgtgggcctggagctggagatgctgttccggcagctgaagggccgggagagccagatccgcatcatcctgaacaaggctgacaacctggccacccagatgctgatgagggtgtatggagccctcttctggagcctggcccccctcatcaacgtgacagagcccccccgggtgtatgtgagcagcttctggccccaggagtacaagccagacacccaccaggagctgttcctgcaggaggagatcagcctgctggaggacctgaaccaggtgattgaaaatcggctggagaacaagatcgccttcatccggcagcacgccatccgggtgcgcatccacgccctgctggtggaccgctacctgcagacctacaaggacaagatgaccttcttcagtgatggagagctggtgttcaaggacatcgtggaggaccctgacaagttctacatcttcaagaccatcctggccaagaccaacgtgtccaagtttgacctgcccaaccgggaggcctacaaggacttcttcggcatcaaccccatcagcagcttcaagctgctgagccagcagtgcagctacatgggcggctgcttcctggagaagattgagcgggccatcacccaggagctgcccggcctgctgggcagcctgggcctgggcaagaaccctggggccctgaactgtgacaagacaggctgcagcgagacccccaagaaccgctacaggaagcactag

SEQ ID NO: 168841 - DNA, 1296 bp, Artificial Sequence
  Description of Artificial Sequence: Synthetic coding sequence
atgctgaatgaagacaagcccagtgatgactacagcgctgtgctgcagaggctgaggaagatctaccacagcagcatcaagcccctggagcagagctacaagtacaatgagctgcggcagcacgagatcacagatggagagatcaccagcaagcccatggtgctcttcctgggcccctggagcgtgggcaagagcaccatgatcaactacctgctgggcctggagaacacccgctaccagctgtacacaggagctgagcccaccaccagcgagttcaccgtgctgatgcacggccccaagctgaagaccatcgagggcatcgtgatggctgctgacagcgcccggagcttcagccccctggagaagtttggccagaacttcctggagaagctgattggcatcgaggtgccccacaagctgctggagcgggtgacctttgtggacaccccaggcatcatcgagaacaggaagcagcaggagcggggctaccccttcaatgatgtgtgccagtggttcatcgacagagctgacctgatctttgtggtgtttgaccccaccaagctggatgtgggcctggagctggagatgctgttccggcagctgaagggccgggagagccagatccgcatcatcctgaacaaggctgacaacctggccacccagatgctgatgagggtgtatggagccctcttctggagcctggcccccctcatcaacgtgacagagcccccccgggtgtatgtgagcagcttctggccccaggagtacaagccagacacccaccaggagctgttcctgcaggaggagatcagcctgctggaggacctgaaccaggtgattgaaaatcggctggagaacaagatcgccttcatccggcagcacgccatccgggtgcgcatccacgccctgctggtggaccgctacctgcagacctacaaggacaagatgaccttcttcagtgatggagagctggtgttcaaggacatcgtggaggaccctgacaagttctacatcttcaagaccatcctggccaagaccaacgtgtccaagtttgacctgcccaaccgggaggcctacaaggacttcttcggcatcaaccccatcagcagcttcaagctgctgagccagcagtgcagctacatgggcggctgcttcctggagaagattgagcgggccatcacccaggagctgcccggcctgctgggcagcctgggcctgggcaagaaccctggggccctgaactgtgacaagacaggctgcagcgagacccccaagaaccgctacaggaagcactag

SEQ ID NO: 168842 - DNA, 1164 bp, Artificial Sequence
  Description of Artificial Sequence: Synthetic coding sequence
atggccgagaccctcttctggacccccctgctggtggtgctgctggccggcctgggggacacagaggcccagcagaccaccctgcaccccctggtgggccgggtgtttgtgcacaccctggaccacgagaccttcctgagcctgcctgagcacgtggccgtgcccccagctgtgcacatcacctaccacgcccacctgcagggccacccagacctgccccgctggctgcgctacacccagaggagcccccaccaccctggcttcctgtatggcagcgccaccccagaggaccggggcctgcaggtgattgaggtgacagcctacaacagagacagctttgacaccacccggcagaggctggtgctggagatcggggaccctgagggccccctgctgccctaccaggccgagttcctggtgcgcagccatgatgctgaggaggtgctgcccagcaccccagccagccgcttcctgagcgccctgggcggcctgtgggagcctggagagctgcagctgctgaatgtgaccagcgccctggaccggggcggccgggtgcccctgcccatcgagggcaggaaggagggcgtgtacatcaaggtgggcagcgccagccccttcagcacctgcctgaagatggtggccagcccagacagccacgcccgctgtgcccagggccagccccccctgctgagctgctatgacaccctggccccccacttccgggtggactggtgcaatgtgaccctggtggacaagtctgtgcctgagccagcagatgaggtgcccaccccaggagatggcatcctggagcatgaccccttcttctgccccccaacagaggccccagaccgggacttcctggtggatgccctggtgaccctgctggtgcccctgctggtggccctgctgctgaccctgctgctggcctacgtgatgtgctgcagaagagagggccgcctgaagagggacctggccaccagtgacatccagatggtgcaccactgcaccatccacggcaacacagaggagctgcggcagatggccgccagccgggaggtgccccggcccctgagcaccctgcccatgttcaacgtgcacactggagagcggctgcccccccgggtggacagcgcccaggtgcccctcatcctggaccagcactag

SEQ ID NO: 168843 - DNA, 792 bp, Artificial Sequence
  Description of Artificial Sequence: Synthetic coding sequence
atggccgagaccctcttctggacccccctgctggtggtgctgctggccggcctgggggacacagaggcccagcagaccaccctgcaccccctggtgggccgggtgtttgtgcacaccctggaccacgagaccttcctgagcctgcctgagcacgtggccgtgcccccagctgtgcacatcacctaccacgcccacctgcagggccacccagacctgccccgctggctgcgctacacccagaggagcccccaccaccctggcttcctgtatggcagcgccaccccagaggaccggggcctgcaggtgattgaggtgacagcctacaacagagacagctttgacaccacccggcagaggctggtgctggagatcggggaccctgagggccccctgctgccctaccaggccgagttcctggtgcgcagccatgatgctgaggaggtgctgcccagcaccccagccagccgcttcctgagcgccctgggcggcctgtgggagcctggagagctgcagctgctgaatgtgaccagcgccctggaccggggcggccgggtgcccctgcccatcgagggcaggaaggagggcctgaagagggacctggccaccagtgacatccagatggtgcaccactgcaccatccacggcaacacagaggagctgcggcagatggccgccagccgggaggtgccccggcccctgagcaccctgcccatgttcaacgtgcacactggagagcggctgcccccccgggtggacagcgcccaggtgcccctcatcctggaccagcactag

SEQ ID NO: 168844 - DNA, 537 bp, Artificial Sequence
  Description of Artificial Sequence: Synthetic coding sequence
atgtctgtgacagcctacaacagagacagctttgacaccacccggcagaggctggtgctggagatcggggaccctgagggccccctgctgccctaccaggccgagttcctggtgcgcagccatgatgctgaggaggtgctgcccagcaccccagccagccgcttcctgagcgccctgggcggcctgtgggagcctggagagctgcagctgctgaatgtgaccagcgccctggaccggggcggccgggtgcccctgcccatcgagggcaggaaggagggcgtgtacatcaaggtgggcagcgccagccccttcagcacctgcctgaagatggtggccagcccagacagccacgcccgctgtgcccagggccagccccccctgctgagctgctatgacaccctggccccccacttccgggtggactggtgcaatgtgaccctggtgagaagagaccccggcagcggcggcggcgtgggccacggcccccaccccagcccccccagcctgccctgctgcttcctgagccccagcctgtag

SEQ ID NO: 168845 - DNA, 792 bp, Artificial Sequence
  Description of Artificial Sequence: Synthetic coding sequence
atggccgagaccctcttctggacccccctgctggtggtgctgctggccggcctgggggacacagaggcccagcagaccaccctgcaccccctggtgggccgggtgtttgtgcacaccctggaccacgagaccttcctgagcctgcctgagcacgtggccgtgcccccagctgtgcacatcacctaccacgcccacctgcagggccacccagacctgccccgctggctgcgctacacccagaggagcccccaccaccctggcttcctgtatggcagcgccaccccagaggaccggggcctgcaggtgattgaggtgacagcctacaacagagacagctttgacaccacccggcagaggctggtgctggagatcggggaccctgagggccccctgctgccctaccaggccgagttcctggtgcgcagccatgatgctgaggaggtgctgcccagcaccccagccagccgcttcctgagcgccctgggcggcctgtgggagcctggagagctgcagctgctgaatgtgaccagcgccctggaccggggcggccgggtgcccctgcccatcgagggcaggaaggaggtgctgctgcggcacctgggcacccccctcatccagatggtgcaccactgcaccatccacggcaacacagaggagctgcggcagatggccgccagccgggaggtgccccggcccctgagcaccctgcccatgttcaacgtgcacactggagagcggctgcccccccgggtggacagcgcccaggtgcccctcatcctggaccagcactag

SEQ ID NO: 168846 - DNA, 957 bp, Artificial Sequence
  Description of Artificial Sequence: Synthetic coding sequence
atggctgctgctgctgctgctgctgctgagcagcagagcagcaatggacctgtgaagaagtccatgagggagaaggctgtggagaggagatctgtgaacaaggagcacaacagcaacttcaaggccggctacatccccattgatgaagatcggctgcacaagacaggcctgcggggcaggaaaggaaacctggccatctgtgtgatcatcctgctcttcatcctggccgtcatcaacctgatcatcaccctggtgatctgggccgtcatccgcatcggccccaacggctgtgacagcatggagttccatgaaagtggcctgctgcgcttcaagcaggtgtctgacatgggcgtcatccaccccctgtacaagagcacagtgggcggcagaagaaatgaaaacctggtgatcaccggcaacaaccagcccatcgtgttccagcagggcaccaccaagctgtctgtggagaacaacaagaccagcatcaccagtgacatcggcatgcagttctttgaccccaggacccagaacatcctcttcagcacagattatgagacccatgagttccacctgcccagcggcgtgaagagcctgaatgtgcagaaggccagcacagagcgcatcaccagcaatgccaccagtgacctgaacatcaaggtggatggccgggccatcgtgagaggaaatgaaggagtcttcatcatgggcaagaccatcgagttccacatgggcggcaacatggagctgaaggccgagaacagcatcatcctgaatggatctgtgatggtgtccaccacccggctgcccagcagcagcagcggggaccagctgggcagcggggactgggtgcgctacaagctgtgcatgtgtgctgatggcaccctcttcaaggtgcaggtgaccagccagaacatgggctgccagatcagtgacaacccctgtggcaacacccactag

SEQ ID NO: 168847 - DNA, 747 bp, Artificial Sequence
  Description of Artificial Sequence: Synthetic coding sequence
atggctgctgctgctgctgctgctgctgagcagatcaccctggtgatctgggccgtcatccgcatcggccccaacggctgtgacagcatggagttccatgaaagtggcctgctgcgcttcaagcaggtgtctgacatgggcgtcatccaccccctgtacaagagcacagtgggcggcagaagaaatgaaaacctggtgatcaccggcaacaaccagcccatcgtgttccagcagggcaccaccaagctgtctgtggagaacaacaagaccagcatcaccagtgacatcggcatgcagttctttgaccccaggacccagaacatcctcttcagcacagattatgagacccatgagttccacctgcccagcggcgtgaagagcctgaatgtgcagaaggccagcacagagcgcatcaccagcaatgccaccagtgacctgaacatcaaggtggatggccgggccatcgtgagaggaaatgaaggagtcttcatcatgggcaagaccatcgagttccacatgggcggcaacatggagctgaaggccgagaacagcatcatcctgaatggatctgtgatggtgtccaccacccggctgcccagcagcagcagcggggaccagctgggcagcggggactgggtgcgctacaagctgtgcatgtgtgctgatggcaccctcttcaaggtgcaggtgaccagccagaacatgggctgccagatcagtgacaacccctgtggcaacacccactag

SEQ ID NO: 168848 - DNA, 873 bp, Artificial Sequence
  Description of Artificial Sequence: Synthetic coding sequence
atgatgccccaggagcagtacacccaccacaggagcaccatgcctggctctgtgggcccccaggtgtacaaggtgggcatctacggctggaggaagcgctgcctgtacttctttgtgctgctgctgatgatcctgatcctggtgaacctggccatgaccatctggatcctgaaggtgatgaacttcaccattgatggcatgggcaacctgcgcatcacagagaagggcctgaagctggagggggacagcgagttcctgcagcccctgtatgccaaggagatccagagcaggcctggaaatgccctgtacttcaagagcgccagaaatgtgacagtgaacatcctgaatgaccagaccaaggtgctgacccagctgatcaccggccccaaggctgtggaggcctacggcaagaagtttgaggtgaagacagtgtctgggaagctgctcttctctgctgacaacaatgaggtggtggtgggcgctgagcggctgcgggtgctgggcgctgagggcaccgtcttccccaagagcattgagacccccaacgtgcgggctgaccccttcaaggagctgcggctggagagccccaccaggagcctggtgatggaggcccccaagggcgtggagatcaatgctgaggccggcaacatggaggccacctgcaggacagagctgcggctggagagcaaggatggagagatcaagctggatgctgccaagatccggctgccccggctgccccacggcagctacacccccaccggcacccggcagaaggtgtttgagatctgtgtgtgtgccaacggccgcctcttcctgagccaggccggggccggcagcacctgccagatcaacacctctgtgtgcctgtag

SEQ ID NO: 168849 - DNA, 870 bp, Artificial Sequence
  Description of Artificial Sequence: Synthetic coding sequence
atgccccaggagcagtacacccaccacaggagcaccatgcctggctctgtgggcccccaggtgtacaaggtgggcatctacggctggaggaagcgctgcctgtacttctttgtgctgctgctgatgatcctgatcctggtgaacctggccatgaccatctggatcctgaaggtgatgaacttcaccattgatggcatgggcaacctgcgcatcacagagaagggcctgaagctggagggggacagcgagttcctgcagcccctgtatgccaaggagatccagagcaggcctggaaatgccctgtacttcaagagcgccagaaatgtgacagtgaacatcctgaatgaccagaccaaggtgctgacccagctgatcaccggccccaaggctgtggaggcctacggcaagaagtttgaggtgaagacagtgtctgggaagctgctcttctctgctgacaacaatgaggtggtggtgggcgctgagcggctgcgggtgctgggcgctgagggcaccgtcttccccaagagcattgagaccccaaatgtgcgggctgaccccttcaaggagctgcggctggagagccccaccaggagcctggtgatggaggcccccaagggcgtggagatcaatgctgaggccggcaacatggaggccacctgcaggacagagctgcggctggagagcaaggatggagagatcaagctggatgctgccaagatccggctgccccggctgccccacggcagctacacccccaccggcacccggcagaaggtgtttgagatctgtgtgtgtgccaacggccgcctcttcctgagccaggccggggccggcagcacctgccagatcaacacctctgtgtgcctgtag

SEQ ID NO: 168850 - DNA, 771 bp, Artificial Sequence
  Description of Artificial Sequence: Synthetic coding sequence
atgatgccccaggagcagtacacccaccacaggagcaccatgcctggctctgtgggcccccaggtgtacaaggtgggcatctacggctggaggaagcgctgcctgtacttctttgtgctgctgctgatgatcctgatcctggtgaacctggccatgaccatctggatcctgaaggtgatgaacttcaccattgatggcatgggcaacctgcgcatcacagagaagggcctgaagctggagggggacagcgagttcctgcagcccctgtatgccaaggagatccagagcaggcctggaaatgccctgtacttcaagagcgccagaaatgtgacagtgaacatcctgaatgaccagaccaaggtgctgacccagctgatcaccggccccaaggctgtggaggcctacggcaagaagtttgaggtgaagacagtgtctgggaagctgctcttctctgctgacaacaatgaggtggtggtgggcgctgagcggctgcgggtgctgggcgctgagggcaccgtcttccccaagagcattgagacccccaacgtgcgggctgaccccttcaaggagctgcggctggagagccccaccaggagcctggtgatggaggcccccaagggcgtggagatcaatgctgaggccggcaacatggaggccacctgcaggacagagctgcggctggagagcaaggatggagaggtgagagatgagaaggacaggagcagcaagagctacagcttcaaccggcccaccctgcccatcactggatag

SEQ ID NO: 168851 - DNA, 771 bp, Artificial Sequence; identical to SEQ ID NO: 168850
  Description of Artificial Sequence: Synthetic coding sequence

SEQ ID NO: 168852 - DNA, 1314 bp, Artificial Sequence
  Description of Artificial Sequence: Synthetic coding sequence
atgcagctgccccgctggtgggagctgggggacccctgtgcctggacaggccagggccggggcaccaggaggatgagccctgccaccaccggcaccttcctgctgactgtgtacagcatcttcagcaaggtgcacagcgacagaaatgtgtaccccagcgctggggtgctgtttgtgcacgtgctggagcgggagtacttcaagggggagttccccccctaccccaagccaggagagatcagcaatgaccccatcaccttcaacaccaacctgatgggctacccagaccggcccggctggctgcgctacatccagaggaccccctacagtgatggagtgctgtatggcagccccacagcagaaaatgtgggcaagcccaccatcatcgagatcacagcctacaacagaaggacctttgaaacagcccggcacaacctgatcatcaacatcatgtctgctgaggacttccccctgccctaccaggccgagttcttcatcaagaacatgaatgtggaggagatgctggccagcgaggtgctgggggacttcctgggcgctgtgaagaatgtgtggcagcctgagcggctgaatgccatcaacatcaccagcgccctggaccggggcggccgggtgcccctgcccatcaatgacctgaaggagggcgtgtatgtgatggtgggcgcagatgtgcccttcagcagctgcctgcgggaggtggagaacccccagaaccagctgcgctgcagccaggagatggagcccgtcatcacctgtgacaagaagttccgcacccagttctacatcgactggtgcaagatcagcctggtggacaagaccaagcaggtgtccacctaccaggaggtgatccggggggagggcatcctgcctgatggaggagagtacaagcccccaagtgacagcctgaagagccgggactactacacagacttcctgatcaccctggccgtgcccagcgctgtggccctggtgctcttcctgatcctggcctacatcatgtgctgccggcgggagggcgtggagaagaggaacatgcagaccccagacatccagctggtgcaccacagcgccatccagaagagcaccaaggagctgcgggacatgagcaagaaccgggagatcgcctggcccctgagcaccctgcccgtcttccaccctgtgactggagagatcatcccccccctgcacacagacaactatgacagcaccaacatgcccctgatgcagacccagcagaacctgccccaccagacccagatcccccagcagcagaccaccgggaagtggtacccctag

SEQ ID NO: 168853 - DNA, 1416 bp, Artificial Sequence
  Description of Artificial Sequence: Synthetic coding sequence
atgcagctgccccgctggtgggagctgggggacccctgtgcctggacaggccagggccggggcaccaggaggatgagccctgccaccaccggcaccttcctgctgacagccttcctgctgagctgtgctgatggcatcaatggaacagtgaactggaagacccggcaggccaacaacttcatcatcagcaggaagatggccgccggcatgaaggatgtgtacagcatcttcagcaaggtgcacagcgacagaaatgtgtaccccagcgctggggtgctgtttgtgcacgtgctggagcgggagtacttcaagggggagttccccccctaccccaagccaggagagatcagcaatgaccccatcaccttcaacaccaacctgatgggctacccagaccggcccggctggctgcgctacatccagaggaccccctacagtgatggagtgctgtatggcagccccacagcagaaaatgtgggcaagcccaccatcatcgagatcacagcctacaacagaaggacctttgaaacagcccggcacaacctgatcatcaacatcatgtctgctgaggacttccccctgccctaccaggccgagttcttcatcaagaacatgaatgtggaggagatgctggccagcgaggtgctgggggacttcctgggcgctgtgaagaatgtgtggcagcctgagcggctgaatgccatcaacatcaccagcgccctggaccggggcggccgggtgcccctgcccatcaatgacctgaaggagggcgtgtatgtgatggtgggcgcagatgtgcccttcagcagctgcctgcgggaggtggagaacccccagaaccagctgcgctgcagccaggagatggagcccgtcatcacctgtgacaagaagttccgcacccagttctacatcgactggtgcaagatcagcctggtggacaagaccaagcaggtgtccacctaccaggaggtgatccggggggagggcatcctgcctgatggaggagagtacaagcccccaagtgacagcctgaagagccgggactactacacagacttcctgatcaccctggccgtgcccagcgctgtggccctggtgctcttcctgatcctggcctacatcatgtgctgccggcgggagggcgtggagaagaggaacatgcagaccccagacatccagctggtgcaccacagcgccatccagaagagcaccaaggagctgcgggacatgagcaagaaccgggagatcgcctggcccctgagcaccctgcccgtcttccaccctgtgactggagagatcatcccccccctgcacacagacaactatgacagcaccaacatgcccctgatgcagacccagcagaacctgccccaccagacccagatcccccagcagcagaccaccggggagtgctag

SEQ ID NO: 168854 - DNA, 1356 bp, Artificial Sequence
  Description of Artificial Sequence: Synthetic coding sequence
atgcagctgccccgctggtgggagctgggggacccctgtgcctggacaggccagggccggggcaccaggaggatgagccctgccaccaccggcaccttcctgctgactgtgtacagcatcttcagcaaggtgcacagcgacagaaatgtgtaccccagcgctggggtgctgtttgtgcacgtgctggagcgggagtacttcaagggggagttccccccctaccccaagccaggagagatcagcaatgaccccatcaccttcaacaccaacctgatgggctacccagaccggcccggctggctgcgctacatccagaggaccccctacagtgatggagtgctgtatggcagccccacagcagaaaatgtgggcaagcccaccatcatcgagatcacagcctacaacagaaggacctttgaaacagcccggcacaacctgatcatcaacatcatgtctgctgaggacttccccctgccctaccaggccgagttcttcatcaagaacatgaatgtggaggagatgctggccagcgaggtgctgggggacttcctgggcgctgtgaagaatgtgtggcagcctgagcggctgaatgccatcaacatcaccagcgccctggaccggggcggccgggtgcccctgcccatcaatgacctgaaggagggcgtgtatgtgatggtgggcgcagatgtgcccttcagcagctgcctgcgggaggtggagaacccccagaaccagctgcgctgcagccaggagatggagcccgtcatcacctgtgacaagaagttccgcacccagttctacatcgactggtgcaagatcagcctggtggacaagaccaagcaggtgtccacctaccaggaggtgatccggggggagggcatcctgcctgatggaggagagtacaagcccccaagtgacagcctgaagagccgggactactacacagacttcctgatcaccctggccgtgcccagcgctgtggccctggtgctcttcctgatcctggcctacatcatgtgctgccggcgggagggcgtcatccagctggtgcaccacagcgccatccagaagagcaccaaggagctgcgggacatgagcaagaaccgggagatcgcctggcccctgagcaccctgcctgtgttccaccctgtgactggagagatcatcccccccctgcacacagacaactatgacagcaccaacatgcccctgatgcagacccagcagaacctgccccaccagacccagatcccccagcagcagaccactggagacttccggctgaccaccttccagagatttgaggtgaatggcatccctgaggagaggaagctgacagaggccatgaacctgtag

SEQ ID NO: 168855 - DNA, 1389 bp, Artificial Sequence
  Description of Artificial Sequence: Synthetic coding sequence
atgcagctgccccgctggtgggagctgggggacccctgtgcctggacaggccagggccggggcaccaggaggatgagccctgccaccaccggcaccttcctgctgactgtgtacagcatcttcagcaaggtgcacagcgacagaaatgtgtaccccagcgctggggtgctgtttgtgcacgtgctggagcgggagtacttcaagggggagttccccccctaccccaagccaggagagatcagcaatgaccccatcaccttcaacaccaacctgatgggctacccagaccggcccggctggctgcgctacatccagaggaccccctacagtgatggagtgctgtatggcagccccacagcagaaaatgtgggcaagcccaccatcatcgagatcacagcctacaacagaaggacctttgaaacagcccggcacaacctgatcatcaacatcatgtctgctgaggacttccccctgccctaccaggccgagttcttcatcaagaacatgaatgtggaggagatgctggccagcgaggtgctgggggacttcctgggcgctgtgaagaatgtgtggcagcctgagcggctgaatgccatcaacatcaccagcgccctggaccggggcggccgggtgcccctgcccatcaatgacctgaaggagggcgtgtatgtgatggtgggcgcagatgtgcccttcagcagctgcctgcgggaggtggagaacccccagaaccagctgcgctgcagccaggagatggagcccgtcatcacctgtgacaagaagttccgcacccagttctacatcgactggtgcaagatcagcctggtggacaagaccaagcaggtgtccacctaccaggaggtgatccggggggagggcatcctgcctgatggaggagagtacaagcccccaagtgacagcctgaagagccgggactactacacagacttcctgatcaccctggccgtgcccagcgctgtggccctggtgctcttcctgatcctggcctacatcatgtgctgccggcgggagggcgtggagaagaggaacatgcagaccccagacatccagctggtgcaccacagcgccatccagaagagcaccaaggagctgcgggacatgagcaagaaccgggagatcgcctggcccctgagcaccctgcccgtcttccaccctgtgactggagagatcatcccccccctgcacacagacaactatgacagcaccaacatgcccctgatgcagacccagcagtggagctttgcccctgtggcccaggccggcgtgcagtggagcgacctgggcagcctgcagcccccacctccaagaaacctgccccaccagacccagatcccccagcagcagaccaccgggaagtggtacccctag

SEQ ID NO: 168856 - DNA, 2118 bp, Artificial Sequence
  Description of Artificial Sequence: Synthetic coding sequence
atgacagacaacagcaacaaccagctggtggtgcgggccaagttcaacttccagcagaccaatgaagatgagctgtccttcagcaaaggagatgtgatccacgtgaccagggtggaggagggcggctggtgggagggcaccctgaatggaagaacaggctggttccccagcaactacgtgcgggaggtgaaggccagcgagaagcctgtgagccccaagagcggcaccctgaagagcccccccaagggctttgacaccacagccatcaacaagagctactacaacgtggtgctgcagaacatcctggagacagaaaatgagtacagcaaggagctgcagacagtgctgagcacctacctgcggcccctgcagaccagcgagaagctgagcagcgccaacatctcctacctgatgggcaacctggaggagatctgcagcttccagcagatgctggtgcagagcctggaggagtgcaccaagctgcctgaggcccagcagagggtgggcggctgcttcctgaacctgatgccccagatgaagaccctgtacctgacctactgtgccaaccaccccagcgctgtgaatgtgctgacagagcacagcgaggagctgggggagttcatggagaccaagggggccagcagccctggcatcctggtgctgaccaccggcctgagcaagcccttcatgaggctggacaagtaccccaccctgctgaaggagctggagcggcacatggaggactaccacacagaccggcaggacatccagaagtccatggccgccttcaagaacctgagcgcccagtgccaggaggtgaggaagaggaaggagctggagctgcagatcctgacagaggccatccggaactgggagggagatgacatcaagaccctgggcaatgtgacctacatgagccaggtgctgatccagtgtgccggcagcgaggagaagaatgaaagatacctgctgctcttccccaacgtgctgctgatgctgagcgccagccccaggatgagcggcttcatctaccagggcaagctgcccaccaccggcatgaccatcaccaagctggaggacagcgagaaccacagaaatgcctttgagatcagcggctccatgattgagcgcatcctggtgtcctgcaacaaccagcaggacctgcaggagtgggtggagcacctgcagaagcagaccaaggtgacctctgtgggcaaccccaccatcaagccccacagcgtgcccagccacaccctgcccagccaccctgtgacccccagcagcaagcatgctgacagcaagccagcccccctgaccccagcctaccacaccctgccccaccccagccaccacggcaccccccacaccaccatcaactggggccccctggagccccccaagacccccaagccctggagcctgagctgcctgcggcctgccccacccctgcggcccagcgctgccctgtgctacaaggaggacctgagcaagagccccaagaccatgaagaagctgctgcccaagaggaagccagagaggaagcccagtgatgaggagtttgccagcaggaagagcacagctgccctggaggaggatgcccagatcctgaaggtgattgaggcctactgcaccagcgccaagacccggcagaccctgaacagcacctggcagggcacagacctgatgcacaaccacgtgctggctgatgatgaccagcccagcctggacagcctgggccgccgcagcagcctgagccggctggagcccagcgacctgtctgaggacagcgactatgacagcatctggacagcccacagctacaggatgggcagcaccagccgcagcaggaaggagagcgccccccaggtgctgctgcctgaggaggagaagatcatcgtggaggagaccaagagcaatggccagaccgtcatcgaggagaagagcctggtggacacagtgtatgccctgaaggatgaggtgcaggagctgcggcaggacaacaagaagatgaagaagagcctggaggaggagcagagggccaggaaggacctggagaagctggtgaggaaggtgctgaagaacatgaatgaccctgcctgggatgagaccaacctgtag

SEQ ID NO: 168857 - DNA, 876 bp, Artificial Sequence
  Description of Artificial Sequence: Synthetic coding sequence
atggtgcgggagcagtacaccacagccacagagggcatctgcatcgagaggcctgagaaccagtatgtgtacaagattggcatctacggctggaggaagcgctgcctgtacctgtttgtgctgctgctgctgatcatcctggtggtgaacctggccctgaccatctggatcctgaaggtgatgtggttctccccagctggcatgggccacctgtgtgtgaccaaggatggcctgcggctggagggggagagcgagttcctgttccccctgtatgccaaggagatccacagccgggtggacagcagcctgctgctgcagagcacccagaatgtgacagtgaatgccaggaacagcgagggggaggtgacaggccgcctgaaggtgggccccaagatggtggaggtgcagaaccagcagttccagatcaacagcaatgatggcaagcccctcttcaccgtggatgagaaggaggtggtggtgggcacagacaagctgcgggtgacaggccctgagggcgccctgtttgagcacagcgtggagacccccctggtgcgggctgaccccttccaggacctgcggctggagagccccaccaggagcctgtccatggatgccccccggggcgtgcacatccaggcccatgctgggaagattgaggccctgagccagatggacatcctcttccacagcagtgatggcatgctggtgctggatgctgagaccgtgtgcctgcccaagctggtgcagggcacctggggccccagcggcagcagccagagcctgtatgagatctgtgtgtgcccagatggcaagctgtacctgtctgtggccggcgtgtccaccacctgccaggagcacaaccacatctgcctgtag

SEQ ID NO: 168858 - DNA, 876 bp, Artificial Sequence; identical to SEQ ID NO: 168857
  Description of Artificial Sequence: Synthetic coding sequence

SEQ ID NO: 168859 - DNA, 96 bp, Artificial Sequence
  Description of Artificial Sequence: Synthetic coding sequence
atgggcatcaacacccgggagctgttcctgaacttcaccatcgtgctgatcaccgtcatcctgatgtggctgctggtgcgcagctaccagtactag

SEQ ID NO: 168860 - DNA, 96 bp, Artificial Sequence; identical to SEQ ID NO: 168859
  Description of Artificial Sequence: Synthetic coding sequence

SEQ ID NO: 168861 - DNA, 96 bp, Artificial Sequence; identical to SEQ ID NO: 168859
  Description of Artificial Sequence: Synthetic coding sequence

SEQ ID NO: 168862 - DNA, 732 bp, Artificial Sequence
  Description of Artificial Sequence: Synthetic coding sequence
atgggcaagaacaagcagccccggggccagcagaggcagggcggccccccagctgctgatgctgctggcccagatgacatggagcccaagaagggcactggagcccccaaggaatgtggggaggaggagcccaggacctgctgcggctgccgcttccccctgctgctggccctgctgcagctggccctgggcattgctgtgacagtggtgggcttcctgatggccagcatcagcagcagcctgctggtgcgggacacccccttctgggccggcatcatcgtgtgcctggtggcctacctgggcctcttcatgctgtgtgtgtcctaccaggtggatgagaggacctgcatccagttctccatgaagctgctgtacttcctgctgagcgccctgggcctgactgtgtgtgtgctggccgtggcctttgctgcccaccactacagccagctgacccagttcacctgtgagaccaccctggacagctgccagtgcaagctgcccagcagcgagcccctgagcaggacctttgtgtacagagatgtgacagactgcacctctgtgacaggcaccttcaagctgttcctgctgatccagatgatcctgaacctggtgtgtggcctggtgtgcctgctggcctgctttgtgatgtggaagcaccgctaccaggtgttctacgtgggcgtgcgcatctgcagcctgacagccagcgagggcccccagcagaagatctag

SEQ ID NO: 168863 - DNA, 423 bp, Artificial Sequence
  Description of Artificial Sequence: Synthetic coding sequence
atgctgtgtgtgtcctaccaggtggatgagaggacctgcatccagttctccatgaagctgctgtacttcctgctgagcgccctgggcctgactgtgtgtgtgctggccgtggcctttgctgcccaccactacagccagctgacccagttcacctgtgagaccaccctggacagctgccagtgcaagctgcccagcagcgagcccctgagcaggacctttgtgtacagagatgtgacagactgcacctctgtgacaggcaccttcaagctgttcctgctgatccagatgatcctgaacctggtgtgtggcctggtgtgcctgctggcctgctttgtgatgtggaagcaccgctaccaggtgttctacgtgggcgtgcgcatctgcagcctgacagccagcgagggcccccagcagaagatctag

SEQ ID NO: 168864 - DNA, 654 bp, Artificial Sequence
  Description of Artificial Sequence: Synthetic coding sequence
atggagcccaagaagggcactggagcccccaaggaatgtggggaggaggagcccaggacctgctgcggctgccgcttccccctgctgctggccctgctgcagctggccctgggcattgctgtgacagtggtgggcttcctgatggccagcatcagcagcagcctgctggtgcgggacacccccttctgggccggcatcatcgtgtgcctggtggcctacctgggcctcttcatgctgtgtgtgtcctaccaggtggatgagaggacctgcatccagttctccatgaagctgctgtacttcctgctgagcgccctgggcctgactgtgtgtgtgctggccgtggcctttgctgcccaccactacagccagctgacccagttcacctgtgagaccaccctggacagctgccagtgcaagctgcccagcagcgagcccctgagcaggacctttgtgtacagagatgtgacagactgcacctctgtgacaggcaccttcaagctgttcctgctgatccagatgatcctgaacctggtgtgtggcctggtgtgcctgctggcctgctttgtgatgtggaagcaccgctaccaggtgttctacgtgggcgtgcgcatctgcagcctgacagccagcgagggcccccagcagaagatctag

SEQ ID NO: 168865 - DNA, 387 bp, Artificial Sequence
  Description of Artificial Sequence: Synthetic coding sequence
atgggcaagaacaagcagccccggggccagcagaggcagggcggccccccagctgctgatgctgctggcccagatgacatggagcccaagaagggcactggagcccccaaggaatgtggggaggaggagcccaggacctgctgcggctgccgcttccccctgctgctggccctgctgcagctggccctgggcattgctgtgacagtggtgggcttcctgatggccagcatcagcagcagcctgctggtgcgggacacccccttctgggccggcatcatcgtgtgcctggtggcctacctgggcctcttcatgctgtgtgtgtcctaccaggtggatgagaggacctgcatccagttctccatgaagatccactgccacgacttctag

SEQ ID NO: 168866 - DNA, 363 bp, Artificial Sequence
  Description of Artificial Sequence: Synthetic coding sequence
atgctgtgtgtgtcctaccaggtggatgagaggacctgcatccagttctccatgaagctgctgtacttcctgctgagcgccctgggcctgactgtgtgtgtgctggccgtggcctttgctgcccaccactacagccagctgacccagttcacctgtgagaccaccctggacagctgccagtgcaagctgcccagcagcgagcccctgagcaggacctttgtgtacagagatgtgacagactgcacctctgtgacaggcaccttcaagctgttcctgctgatccagatgatcctgaacctggtgtgtggcctggtgtgcctgctggcctgctttgtgatgtggaagcaccgctaccaggtgtag

SEQ ID NO: 168867 - DNA, 423 bp, Artificial Sequence; identical to SEQ ID NO: 168863
  Description of Artificial Sequence: Synthetic coding sequence

SEQ ID NO: 168868 - DNA, 2292 bp, Artificial Sequence
  Description of Artificial Sequence: Synthetic coding sequence
atggaccacctgaatgaggccacccagggcaaggagcacagcgagatgagcaacaacgtgtctgaccccaagggccccccagccaagatcgcccggctggagcagaatggcagccccctgggccggggccgcctgggcagcactggagccaagatgcagggcgtgcccctgaagcacagcggccacctgatgaagaccaacctgaggaagggcaccatgctgcctgtgttctgtgtggtggagcactatgaaaatgccattgaatatgactgcaaggaggagcacgccgagtttgtgctggtgaggaaggacatgctgttcaaccagctgattgagatggccctgctgagcctgggctacagccacagcagcgctgcccaggccaagggcctcatccaggtgggcaagtggaaccctgtgcccctgtcctatgtgacagatgccccagatgccaccgtggccgacatgctgcaggatgtgtaccacgtggtgaccctgaagatccagctgcacagctgccccaagctggaggacctgcccccagagcagtggagccacaccaccgtgagaaatgccctgaaggacctgctgaaggacatgaaccagagcagcctggccaaggagtgccccctgagccagagcatgatcagcagcatcgtgaacagcacctactatgccaacgtgtctgctgccaagtgccaggagtttggccgctggtacaagcacttcaagaagaccaaggacatgatggtggagatggacagcctgtctgagctgagccagcagggcgccaaccacgtgaactttggccagcagcctgtgcccggcaacacagctgagcagccccccagccctgcccagctgagccacggcagccagcccagcgtgaggacccccctgcccaacctgcaccctggcctggtgtccacccccatcagcccccagctggtgaaccagcagctggtgatggcccagctgctgaaccagcagtatgctgtgaaccggctgctggcccagcagagcctgaaccagcagtacctgaaccaccccccacctgtgagccgctccatgaacaagcccctggagcagcaggtgtccaccaacacagaggtgtcctctgagatctaccagtgggtgagagatgagctgaagagagctggcatcagccaggccgtgtttgcccgggtggccttcaacagaacccagggcctgctgtctgagatcctgaggaaggaggaggaccccaagacagccagccagagcctgctggtgaacctgcgggccatgcagaacttcctgcagctgcctgaggccgagcgggaccgcatctaccaggatgagcgggagaggagcctgaatgctgccagcgccatgggccctgcccccctcatcagcaccccacccagcaggcctccccaggtgaagacagccaccatcgccacagaaagaaatggcaagccagagaacaacaccatgaacatcaatgccagcatctatgatgagatccagcaggagatgaagagggccaaggtgtcccaggccctgtttgccaaggtggccgccaccaagagccagggctggctgtgtgagctgctgcgctggaaggaggaccccagcccagaaaatagaaccctgtgggagaacctgtccatgatccgccgcttcctgagcctgccccagcctgagagagatgccatctatgagcaggagagcaatgctgtgcaccaccacggggacaggcctccccacatcatccacgtgcctgctgagcagatccagcagcagcagcagcagcagcagcagcagcagcagcagcagcaggcccctcctccaccccagccccagcagcagccccagacaggcccccggctgcccccccggcagcccaccgtggccagccctgctgagagtgatgaggagaaccggcagaagacccggcccaggaccaagatctctgtggaggccctgggcatcctgcagagcttcatccaggatgtgggcctgtacccagatgaggaggccatccagaccctgagcgcccagctggacctgcccaagtacaccatcatcaagttcttccagaaccagcgctactacctgaagcaccacggcaagctgaaggacaacagcggcctggaggtggatgtggccgagtacaaggaggaggagctgctgaaggacctggaggagagcgtgcaggacaagaacaccaacaccctcttctctgtgaagctggaggaggagctgtctgtggagggcaacacagacatcaacacagacctgaaggactag

SEQ ID NO: 168869 - DNA, 351 bp, Artificial Sequence
  Description of Artificial Sequence: Synthetic coding sequence
atggaccacctgaatgaggccacccagggcaaggagcacagcgagatgagcaacaacgtgtctgaccccaagggccccccagccaagatcgcccggctggagcagaatggcagccccctgggccggggccgcctgggcagcactggagccaagatgcagggcgtgcccctgaagcacagcggccacctgatgaagaccaacctgaggaagggcaccatgctgcctgtgttctgtgtggtggagcactatgaaaatgccattgaatatgactgcaaggaggagcacgccgagtttgtgctggtgaggaaggacatgctgttcaaccagctgattgagatggccctgctgtag

SEQ ID NO: 168870 - DNA, 675 bp, Artificial Sequence
  Description of Artificial Sequence: Synthetic coding sequence
atggaccacctgaatgaggccacccagggcaaggagcacagcgagatgagcaacaacgtgtctgaccccaagggccccccagccaagatcgcccggctggagcagaatggcagccccctgggccggggccgcctgggcagcactggagccaagatgcagggcgtgcccctgaagcacagcggccacctgatgaagaccaacctgaggaagggcaccatgctgcctgtgttctgtgtggtggagcactatgaaaatgccattgaatatgactgcaaggaggagcacgccgagtttgtgctggtgaggaaggacatgctgttcaaccagctgattgagatggccctgctgagcctgggctacagccacagcagcgctgcccaggccaagggcctcatccaggtgggcaagtggaaccctgtgcccctgtcctatgtgacagatgccccagatgccaccgtggccgacatgctgcaggatgtgtaccacgtggtgaccctgaagatccagctgcacagctgccccaagctggaggacctgcccccagagcagtggagccacaccaccgtgagaaatgccctgaaggacctgctgaaggacatgaaccagagcagcctggccaaggagtgccccctgagccagagcatgatcagcagcatcgtgaacagcacctactag

SEQ ID NO: 168871 - DNA, 216 bp, Artificial Sequence
  Description of Artificial Sequence: Synthetic coding sequence
atggaccacctgaatgaggccacccagggcaaggagcacagcgagatgagcaacaacgtgtctgaccccaagggccccccagccaagatcgcccggctggagcagaatggcagccccctgggccggggccgcctgggcagcactggagccaagatgcagggcgtgcccctgaagcacagcggccacctgatgaagaccaacctgaggaagggctag

SEQ ID NO: 168872 - DNA, 27 bp, Artificial Sequence
  Description of Artificial Sequence: Synthetic coding sequence
atggaccacctgaatgaggccacctag

SEQ ID NO: 168873 - DNA, 519 bp, Artificial Sequence
  Description of Artificial Sequence: Synthetic coding sequence
atggaccacctgaatgaggccacccagggcaaggagcacagcgagatgagcaacaacgtgtctgaccccaagggccccccagccaagatcgcccggctggagcagaatggcagccccctgggccggggccgcctgggcagcactggagccaagatgcagggcgtgcccctgaagcacagcggccacctgatgaagaccaacctgaggaagggcaccatgctgcctgtgttctgtgtggtggagcactatgaaaatgccattgaatatgactgcaaggaggagcacgccgagtttgtgctggtgaggaaggacatgctgttcaaccagctgattgagatggccctgctgagcctgggctacagccacagcagcgctgcccaggccaagggcctcatccaggtgggcaagtggaaccctgtgcccctgtcctatgtgacagatgccccagatgccaccgtggccgacatgctgcaggatgtgtaccacgtggtgaccctgaagatccagctgcacaggtag

SEQ ID NO: 168874 - DNA, 2292 bp, Artificial Sequence; identical to SEQ ID NO: 168868
  Description of Artificial Sequence: Synthetic coding sequence

SEQ ID NO: 168875 - DNA, 393 bp, Artificial Sequence
  Description of Artificial Sequence: Synthetic coding sequence
atggaccacctgaatgaggccacccagggcaaggagcacagcgagatgagcaacaacgtgtctgaccccaagggccccccagccaagatcgcccggctggagcagaatggcagccccctgggccggggccgcctgggcagcactggagccaagatgcagggcgtgcccctgaagcacagcggccacctgatgaagaccaacctgaggaagggcaccatgctgcctgtgttctgtgtggtggagcactatgaaaatgccattgaatatgactgcaaggaggagcacgccgagtttgtgctggtgaggaaggacatgctgttcaaccagctgattgagatggccctgctgagcctgggctacagccacagcagcgctgcccaggccaagggctag

SEQ ID NO: 168876 - DNA, 2388 bp, Artificial Sequence
  Description of Artificial Sequence: Synthetic coding sequence
atggaccacctgaatgaggccacccagggcaaggagcacagcgagatgagcaacaacgtgtctgaccccaagggccccccagccaagatcgcccggctggagcagaatggcagccccctgggccggggccgcctgggcagcactggagccaagatgcagggcgtgcccctgaagcacagcggccacctgatgaagaccaacctgaggaagggcaccatgctgcctgtgttctgtgtggtggagcactatgaaaatgccattgaatatgactgcaaggaggagcacgccgagtttgtgctggtgaggaaggacatgctgttcaaccagctgattgagatggccctgctgagcctgggctacagccacagcagcgctgcccaggccaagggcctcatccaggtgggcaagtggaaccctgtgcccctgtcctatgtgacagatgccccagatgccaccgtggccgacatgctgcaggatgtgtaccacgtggtgaccctgaagatccagctgcacagctgccccaagctggaggacctgcccccagagcagtggagccacaccaccgtgagaaatgccctgaaggacctgctgaaggacatgaaccagagcagcctggccaaggagtgccccctgagccagagcatgatcagcagcatcgtgaacagcacctactatgccaacgtgtctgctgccaagtgccaggagtttggccgctggtacaagcacttcaagaagaccaaggacatgatggtggagatggacagcctgtctgagctgagccagcagggcgccaaccacgtgaactttggccagcagcctgtgcccggcaacacagctgagcagccccccagccctgcccagctgagccacggcagccagcccagcgtgaggacccccctgcccaacctgcaccctggcctggtgtccacccccatcagcccccagctggtgaaccagcagctggtgatggcccagctgctgaaccagcagtatgctgtgaaccggctgctggcccagcagagcctgaaccagcagtacctgaaccaccccccacctgtgagccgctccatgaacaagcccctggagcagcaggtgtccaccaacacagaggtgtcctctgagatctaccagtgggtgagagatgagctgaagagagctggcatcagccaggccgtgtttgcccgggtggccttcaacagaacccagggcctgctgtctgagatcctgaggaaggaggaggaccccaagacagccagccagagcctgctggtgaacctgcgggccatgcagaacttcctgcagctgcctgaggccgagcgggaccgcatctaccaggatgagcgggagaggagcctgaatgctgccagcgccatgggccctgcccccctcatcagcaccccacccagcaggcctccccaggtgaagacagccaccatcgccacagaaagaaatggcaagccagagaacaacaccatgaacatcaatgccagcatctatgatgagatccagcaggagatgaagagggccaaggtgtcccaggccctgtttgccaaggtggccgccaccaagagccagggctggctgtgtgagctgctgcgctggaaggaggaccccagcccagaaaatagaaccctgtgggagaacctgtccatgatccgccgcttcctgagcctgccccagcctgagagagatgccatctatgagcaggagagcaatgctgtgcaccaccacggggacaggcctccccacatcatccacgtgcctgctgagcagatccagagccccagccccaccaccctgggcaagggggagagcagaggagtcttcctgcccggcctgcccaccccagccccctggctgggcgccgccccccagcagcagcagcagcagcagcagcagcagcagcagcagcagcaggcccctcctccaccccagccccagcagcagccccagacaggcccccggctgcccccccggcagcccaccgtggccagccctgctgagagtgatgaggagaaccggcagaagacccggcccaggaccaagatctctgtggaggccctgggcatcctgcagagcttcatccaggatgtgggcctgtacccagatgaggaggccatccagaccctgagcgcccagctggacctgcccaagtacaccatcatcaagttcttccagaaccagcgctactacctgaagcaccacggcaagctgaaggacaacagcggcctggaggtggatgtggccgagtacaaggaggaggagctgctgaaggacctggaggagagcgtgcaggacaagaacaccaacaccctcttctctgtgaagctggaggaggagctgtctgtggagggcaacacagacatcaacacagacctgaaggactag

SEQ ID NO: 168877 - DNA, 2202 bp, Artificial Sequence
  Description of Artificial Sequence: Synthetic coding sequence
atggagaggagaagtgagagcccctgcctgcgggacagcccagaccggcgcagcggcagcccagatgtgaagggccccccacctgtgaaggtggcccggctggagcagaatggcagccccatgggcgcccggggccggcccaacggggctgtggccaaggctgtgggcggcctgatgatccctgtgttctgtgtggtggagcagctggatggcagcctggagtatgacaaccgggaggagcacgccgagtttgtgctggtgaggaaggatgtgctcttcagccagctggtggagacagccctgctggccctgggctacagccacagcagcgctgcccaggcccagggcatcatcaagctgggccgctggaaccccctgcccctgtcctatgtgacagatgccccagatgccaccgtggccgacatgctgcaggatgtgtaccacgtggtgaccctgaagatccagctgcagagctgcagcaagctggaggacctgcctgctgagcagtggaaccacgccaccgtgagaaatgccctgaaggagctgctgaaggagatgaaccagagcaccctggccaaggagtgccccctgagccagagcatgatcagcagcatcgtgaacagcacctactatgccaacgtgtctgccaccaagtgccaggagtttggccgctggtacaagaagtacaagaagatcaaggtggagcgggtggagcgggagaacctgagtgactactgtgtgctgggccagaggcccatgcacctgcccaacatgaaccagctggccagcctgggcaagaccaatgagcagagcccccacagccagatccaccacagcacccccatccggaaccaggtgcctgccctgcagcccatcatgagccctggcctgctgagcccccagctgagcccccagctggtgcggcagcagatcgccatggcccacctgatcaaccagcagattgctgtgtcccggctgctggcccaccagcacccccaggccatcaaccagcagttcctgaaccacccccccatccccagggctgtgaagccagagcccaccaacagctctgtggaggtgtccccagacatctaccagcaggtgagagatgagctgaagagggcctctgtgtcccaggccgtgtttgcccgggtggccttcaacagaacccagggcctgctgtctgagatcctgaggaaggaggaggaccccaggacagccagccagagcctgctggtgaacctgcgggccatgcagaacttcctgaacctgcctgaggtggagcgggaccgcatctaccaggatgagcgggagaggtccatgaaccccaacgtgtccatggtgagcagcgccagcagcagccccagcagcagcaggaccccccaggccaagaccagcacccccaccacagacctgcccatcaaggtggatggagccaacatcaacatcacagctgccatctatgatgagatccagcaggagatgaagagggccaaggtgtcccaggccctgtttgccaaggtggccgccaacaagagccagggctggctgtgtgagctgctgcgctggaaggagaaccccagccctgagaacagaaccctgtgggagaacctgtgcaccatccgccgcttcctgaacctgccccagcacgagagagatgtgatctatgaggaggagagccgccaccaccacagcgagaggatgcagcacgtggtgcagctgcccccagagcctgtgcaggtgctgcaccggcagcagagccagcctgccaaggagagcagccccccccgggaggaggcccctcctcctcctccacccacagaggacagctgtgccaagaagcccaggagcaggaccaagatcagcctggaggccctgggcatcctgcagagcttcatccatgatgtgggcctgtacccagaccaggaggccatccacaccctgagcgcccagctggacctgcccaagcacaccatcatcaagttcttccagaaccagcgctaccacgtgaagcaccacggcaagctgaaggagcacctgggcagcgctgtggatgtggccgagtacaaggatgaggagctgctgacagagagcgaggagaatgattctgaggagggcagcgaggagatgtacaaggtggaggccgaggaggagaatgctgacaagagcaaggccgccccagctgagattgaccagaggtag

SEQ ID NO: 168878 - DNA, 2202 bp, Artificial Sequence; identical to SEQ ID NO: 168877
  Description of Artificial Sequence: Synthetic coding sequence

SEQ ID NO: 168879 - DNA, 1848 bp, Artificial Sequence
  Description of Artificial Sequence: Synthetic coding sequence
atggagaggagaagtgagagcccctgcctgcgggacagcccagaccggcgcagcggcagcccagatgtgaagggccccccacctgtgaaggtggcccggctggagcagaatggcagccccatgggcgcccggggccggcccaacggggctgtggccaaggctgtgggcggcctgatgatccctgtgttctgtgtggtggagcagctggatggcagcctggagtatgacaaccgggaggagcacgccgagtttgtgctggtgaggaaggatgtgctcttcagccagctggtggagacagccctgctggccctgggctacagccacagcagcgctgcccaggcccaggtggagcgggtggagcgggagaacctgagtgactactgtgtgctgggccagaggcccatgcacctgcccaacatgaaccagctggccagcctgggcaagaccaatgagcagagcccccacagccagatccaccacagcacccccatccggaaccaggtgcctgccctgcagcccatcatgagccctggcctgctgagcccccagctgagcccccagctggtgcggcagcagatcgccatggcccacctgatcaaccagcagattgctgtgtcccggctgctggcccaccagcacccccaggccatcaaccagcagttcctgaaccacccccccatccccagggctgtgaagccagagcccaccaacagctctgtggaggtgtccccagacatctaccagcaggtgagagatgagctgaagagggcctctgtgtcccaggccgtgtttgcccgggtggccttcaacagaacccagggcctgctgtctgagatcctgaggaaggaggaggaccccaggacagccagccagagcctgctggtgaacctgcgggccatgcagaacttcctgaacctgcctgaggtggagcgggaccgcatctaccaggatgagcgggagaggtccatgaaccccaacgtgtccatggtgagcagcgccagcagcagccccagcagcagcaggaccccccaggccaagaccagcacccccaccacagacctgcccatcaaggtggatggagccaacatcaacatcacagctgccatctatgatgagatccagcaggagatgaagagggccaaggtgtcccaggccctgtttgccaaggtggccgccaacaagagccagggctggctgtgtgagctgctgcgctggaaggagaaccccagccctgagaacagaaccctgtgggagaacctgtgcaccatccgccgcttcctgaacctgccccagcacgagagagatgtgatctatgaggaggagagccgccaccaccacagcgagaggatgcagcacgtggtgcagctgcccccagagcctgtgcaggtgctgcaccggcagcagagccagcctgccaaggagagcagccccccccgggaggaggcccctcctcctcctccacccacagaggacagctgtgccaagaagcccaggagcaggaccaagatcagcctggaggccctgggcatcctgcagagcttcatccatgatgtgggcctgtacccagaccaggaggccatccacaccctgagcgcccagctggacctgcccaagcacaccatcatcaagttcttccagaaccagcgctaccacgtgaagcaccacggcaagctgaaggagcacctgggcagcgctgtggatgtggccgagtacaaggatgaggagctgctgacagagagcgaggagaatgattctgaggagggcagcgaggagatgtacaaggtggaggccgaggaggagaatgctgacaagagcaaggccgccccagctgagattgaccagaggtag

SEQ ID NO: 168880 - DNA, 2202 bp, Artificial Sequence; identical to SEQ ID NO: 168877
  Description of Artificial Sequence: Synthetic coding sequence

SEQ ID NO: 168881 - DNA, 2748 bp, Artificial Sequence
  Description of Artificial Sequence: Synthetic coding sequence
atggccgagaccctgagcggcctgggggacagcggggccgccggggctgctgccctgagcagcgccagcagcgagaccggcacccggcggctgagtgacctgcgggtgattgacctgcgggcagagctgaggaagagaaatgtggacagcagcggcaacaagtctgtgctgatggagcggctgaagaaggccattgaagatgaaggaggcaacccagatgaaattgagatcaccagcgagggcaacaagaagaccagcaagaggagcagcaaaggaaggaagccagaggaggagggcgtggaggacaatggcctggaggagaacagcggagatggccaggaggatgtggagaccagcctggagaacctgcaggacatcgacatcatggacatctctgtgctggatgaagctgagattgacaatggatctgtggccgactgtgtggaggatgatgatgctgacaacctgcaggagagcctgagtgacagccgggagctggtggagggggagatgaaggagctgcctgagcagctgcaggagcacgccatcgaggacaaggagaccatcaacaacctggacaccagcagcagtgacttcaccatcctgcaggagattgaggagcccagcctggagccagaaaatgagaagatcctggacatcctgggggagacctgcaagtctgagcctgtgaaggaggagagcagcgagctggagcagccctttgcccaggacaccagctctgtgggccctgacaggaagctggccgaggaggaggacctgtttgattctgcccaccctgaggagggggacctggacctggccagcgagagcacagcccacgcccagagcagcaaggctgacagcctgctggccgtggtgaagcgggagcctgctgagcagcctggagatggagagaggacagactgtgagcctgtgggcctggagcctgctgtggagcagagcagcgctgccagcgagctggccgaggccagcagcgaggagctggccgaggcccccacagaggcccccagccctgaggcccgggacagcaaggaggatggcaggaagtttgattttgatgcctgcaatgaggtgcccccagcccccaaggagagcagcaccagcgagggcgctgaccagaagatgagcagcccagaagatgacagcgacaccaagaggctgagcaaggaggagaagggccgcagcagctgtggcaggaacttctgggtgtctggcctgagcagcaccacccgggccacagacctgaagaacctcttcagcaaatatggcaaggtggtgggcgccaaggtggtgaccaatgcccggagccctggggcccgctgctacggctttgtgaccatgagcacagctgaggaggccaccaagtgcatcaaccacctgcacaagacagagctgcacggcaagatgatctctgtggagaaggccaagaatgaacctgtgggcaagaagaccagtgacaagagggacagtgatggcaagaaggagaagagcagcaacagcgacaggagcaccaacctgaagagagatgacaagtgtgacaggaaggatgatgccaagaagggagatgatggcagcggggagaagagcaaggaccaggatgaccagaagccaggccccagcgagaggagccgggccaccaagagcggcagccggggcacagagaggacagtggtgatggacaagagcaagggcgtgcctgtgatctctgtgaagaccagcggcagcaaggagcgggccagcaagagccaggacaggaagagcgccagccgggagaagaggtctgtggtgtcctttgacaaggtgaaggagcccaggaagagccgggacagcgagagccacagccgggtgcgggagaggtctgagcgggagcagaggatgcaggcccagtgggagcgggaggagcgggagcggctggagatcgcccgggagcggctggccttccagaggcagaggctggagcgggagaggatggagcgggagcggctggagcgggagaggatgcacgtggagcacgagaggagaagagagcaggagcgcatccaccgggagcgggaggagctgcggcggcagcaggagctgcgctatgagcaggagcggcggcctgctgtgagaagaccctatgacctggacagaagagatgatgcctactggccagaggccaagagagctgccctggatgagcgctaccacagcgacttcaaccggcaggaccgcttccatgactttgaccaccgggaccggggccgctacccagaccacagcgtggaccggcgggagggcagccgctccatgatgggagagcgggagggccagcactacccagagcggcacggcggccctgagcggcacggccgggacagcagagatggctggggcggctacggcagtgacaagaggatgtctgagggccggggcctgcccccaccaccccggcgggactggggagaccacggccggcgggaggatgaccgctcctggcagggcacagcagatggcggcatgatggaccgggaccacaagcgctggcagggcggggagaggtccatgagcggccacagcggccctggccacatgatgaacagaggaggcatgagcggccggggcagctttgcccctggaggagccagccggggccaccccatcccccacggcggcatgcagggcggctttggaggccagagccggggcagccggcccagtgatgcccgcttcacccggcgctactag

SEQ ID NO: 168882 - DNA, 2244 bp, Artificial Sequence
  Description of Artificial Sequence: Synthetic coding sequence
atgaaggagctgcctgagcagctgcaggagcacgccatcgaggacaaggagaccatcaacaacctggacaccagcagcagtgacttcaccatcctgcaggagattgaggagcccagcctggagccagaaaatgagaagatcctggacatcctgggggagacctgcaagtctgagcctgtgaaggaggagagcagcgagctggagcagccctttgcccaggacaccagctctgtgggccctgacaggaagctggccgaggaggaggacctgtttgattctgcccaccctgaggagggggacctggacctggccagcgagagcacagcccacgcccagagcagcaaggctgacagcctgctggccgtggtgaagcgggagcctgctgagcagcctggagatggagagaggacagactgtgagcctgtgggcctggagcctgctgtggagcagagcagcgctgccagcgagctggccgaggccagcagcgaggagctggccgaggcccccacagaggcccccagccctgaggcccgggacagcaaggaggatggcaggaagtttgattttgatgcctgcaatgaggtgcccccagcccccaaggagagcagcaccagcgagggcgctgaccagaagatgagcagcccagaagatgacagcgacaccaagaggctgagcaaggaggagaagggccgcagcagctgtggcaggaacttctgggtgtctggcctgagcagcaccacccgggccacagacctgaagaacctcttcagcaaatatggcaaggtggtgggcgccaaggtggtgaccaatgcccggagccctggggcccgctgctacggctttgtgaccatgagcacagctgaggaggccaccaagtgcatcaaccacctgcacaagacagagctgcacggcaagatgatctctgtggagaaggccaagaatgaacctgtgggcaagaagaccagtgacaagagggacagtgatggcaagaaggagaagagcagcaacagcgacaggagcaccaacctgaagagagatgacaagtgtgacaggaaggatgatgccaagaagggagatgatggcagcggggagaagagcaaggaccaggatgaccagaagccaggccccagcgagaggagccgggccaccaagagcggcagccggggcacagagaggacagtggtgatggacaagagcaagggcgtgcctgtgatctctgtgaagaccagcggcagcaaggagcgggccagcaagagccaggacaggaagagcgccagccgggagaagaggtctgtggtgtcctttgacaaggtgaaggagcccaggaagagccgggacagcgagagccacagccgggtgcgggagaggtctgagcgggagcagaggatgcaggcccagtgggagcgggaggagcgggagcggctggagatcgcccgggagcggctggccttccagaggcagaggctggagcgggagaggatggagcgggagcggctggagcgggagaggatgcacgtggagcacgagaggagaagagagcaggagcgcatccaccgggagcgggaggagctgcggcggcagcaggagctgcgctatgagcaggagcggcggcctgctgtgagaagaccctatgacctggacagaagagatgatgcctactggccagaggccaagagagctgccctggatgagcgctaccacagcgacttcaaccggcaggaccgcttccatgactttgaccaccgggaccggggccgctacccagaccacagcgtggaccggcgggagggcagccgctccatgatgggagagcgggagggccagcactacccagagcggcacggcggccctgagcggcacggccgggacagcagagatggctggggcggctacggcagtgacaagaggatgtctgagggccggggcctgcccccaccaccccggggccggcgggactggggagaccacggccggcgggaggatgaccgctcctggcagggcacagcagatggcggcatgatggaccgggaccacaagcgctggcagggcggggagaggtccatgagcggccacagcggccctggccacatgatgaacagaggaggcatgagcggccggggcagctttgcccctggaggagccagccggggccaccccatcccccacggcggcatgcagggcggctttggaggccagagccggggcagccggcccagtgatgcccgcttcacccggcgctactag

SEQ ID NO: 168883 - DNA, 2547 bp, Artificial Sequence
  Description of Artificial Sequence: Synthetic coding sequence
atggccgagaccctgagcggcctgggggacagcggggccgccggggctgctgccctgagcagcgccagcagcgagaccggcacccggcggctgagtgacctgcgggtgattgacctgcgggcagagctgaggaagagaaatgtggacagcagcggcaacaagtctgtgctgatggagcggctgaagaaggccattgaagatgaaggaggcaacccagatgaaattgagatcaccagcgagggcaacaagaagaccagcaagaggagcagcaaaggaaggaagccagaggaggagggcgtggaggacaatggcctggaggagaacagcggagatggccagatcgaggacaaggagaccatcaacaacctggacaccagcagcagtgacttcaccatcctgcaggagattgaggagcccagcctggagccagaaaatgagaagatcctggacatcctgggggagacctgcaagtctgagcctgtgaaggaggagagcagcgagctggagcagccctttgcccaggacaccagctctgtgggccctgacaggaagctggccgaggaggaggacctgtttgacagcgcccaccctgaggagggggacctggacctggccagcgagagcacagcccacgcccagagcagcaaggctgacagcctgctggccgtggtgaagcgggagcctgctgagcagcctggagatggagagaggacagactgtgagcctgtgggcctggagcctgctgtggagcagagcagcgctgccagcgagctggccgaggccagcagcgaggagctggccgaggcccccacagaggcccccagccctgaggcccgggacagcaaagaagatggcaggaagtttgattttgatgcctgcaatgaggtgcccccagcccccaaggagagcagcaccagcgagggcgctgaccagaagatgagcagcccagaagatgacagcgacaccaagaggctgagcaaggaggagaagggccgcagcagctgtggcaggaacttctgggtgtctggcctgagcagcaccacccgggccacagacctgaagaacctcttcagcaaatatggcaaggtggtgggcgccaaggtggtgaccaatgcccggagccctggggcccgctgctacggctttgtgaccatgagcacagctgaggaggccaccaagtgcatcaaccacctgcacaagacagagctgcacggcaagatgatctctgtggagaaggccaagaatgaacctgtgggcaagaagaccagtgacaagagggacagtgatggcaagaaggagaagagcagcaacagcgacaggagcaccaacctgaagagagatgacaagtgtgacaggaaggatgatgccaagaagggagatgatggcagcggggagaagagcaaggaccaggatgaccagaagccaggccccagcgagaggagccgggccaccaagagcggcagccggggcacagagaggacagtggtgatggacaagagcaaaggagtgcctgtgatctctgtgaagaccagcggcagcaaggagcgggccagcaagagccaggacaggaagagcgccagccgggagaagaggtctgtggtgtcctttgacaaggtgaaggagcccaggaagagccgggacagcgagagccacagccgggtgcgggagaggtctgagcgggagcagaggatgcaggcccagtgggagcgggaggagcgggagcggctggagatcgcccgggagcggctggccttccagaggcagaggctggagcgggagaggatggagcgggagcggctggagcgggagaggatgcacgtggagcatgaaagaagaagagagcaggagcgcatccaccgggagcgggaggagctgcggcggcagcaggagctgcgctatgagcaggagaggaggcctgctgtgcggcggccctatgacctggacagaagagatgatgcctactggccagaggccaagagagctgccctggatgagcgctaccacagcgacttcaaccggcaggaccgcttccatgactttgaccaccgggaccggggccgctacccagaccacagcgtggacagaagagagggcagccgctccatgatgggagagcgggagggccagcactacccagagagacatggaggccctgagagacatggccgggacagcagagatggctggggcggctacggcagtgacaagaggatgtctgagggccggggcctgcccccaccaccccggggcagaagagactggggagaccatggaagaagagaagatgaccgctcctggcagggcacagcagatggcggcatgatggaccgggaccacaagcgctggcagggcggggagaggtccatgagcggccacagcggccctggccacatgatgaacagaggaggcatgagcggccggggcagctttgcccctgggggcgccagccggggccaccccatcccccatggaggcatgcagggcggctttggaggccagagccggggcagccggcccagtgatgcccgcttcacccggcgctactag

SEQ ID NO: 168884 - DNA, 2280 bp, Artificial Sequence
  Description of Artificial Sequence: Synthetic coding sequence
atgaaggtggtgatcctgaccaagctgaagctgcccccccgggagaccaggaagcaccagaggggcctggccaagattgaggacaaggagaccatcaacaacctggacaccagcagcagtgacttcaccatcctgcaggagattgaggagcccagcctggagccagaaaatgagaagatcctggacatcctgggggagacctgcaagtctgagcctgtgaaggaggagagcagcgagctggagcagccctttgcccaggacaccagctctgtgggccctgacaggaagctggccgaggaggaggacctgtttgacagcgcccaccctgaggagggggacctggacctggccagcgagagcacagcccacgcccagagcagcaaggctgacagcctgctggccgtggtgaagcgggagcctgctgagcagcctggagatggagagaggacagactgtgagcctgtgggcctggagcctgctgtggagcagagcagcgctgccagcgagctggccgaggccagcagcgaggagctggccgaggcccccacagaggcccccagccctgaggcccgggacagcaaagaagatggcaggaagtttgattttgatgcctgcaatgaggtgcccccagcccccaaggagagcagcaccagcgagggcgctgaccagaagatgagcagcccagaagatgacagcgacaccaagaggctgagcaaggaggagaagggccgcagcagctgtggcaggaacttctgggtgtctggcctgagcagcaccacccgggccacagacctgaagaacctcttcagcaaatatggcaaggtggtgggcgccaaggtggtgaccaatgcccggagccctggggcccgctgctacggctttgtgaccatgagcacagctgaggaggccaccaagtgcatcaaccacctgcacaagacagagctgcacggcaagatgatctctgtggagaaggccaagaatgaacctgtgggcaagaagaccagtgacaagagggacagtgatggcaagaaggagaagagcagcaacagcgacaggagcaccaacctgaagagagatgacaagtgtgacaggaaggatgatgccaagaagggagatgatggcagcggggagaagagcaaggaccaggatgaccagaagccaggccccagcgagaggagccgggccaccaagagcggcagccggggcacagagaggacagtggtgatggacaagagcaaaggagtgcctgtgatctctgtgaagaccagcggcagcaaggagcgggccagcaagagccaggacaggaagagcgccagccgggagaagaggtctgtggtgtcctttgacaaggtgaaggagcccaggaagagccgggacagcgagagccaccgggtgcgggagaggtctgagcgggagcagaggatgcaggcccagtgggagcgggaggagcgggagcggctggagatcgcccgggagcggctggccttccagaggcagaggctggagcgggagaggatggagcgggagcggctggagcgggagaggatgcacgtggagcacgagaggagaagagagcaggagcgcatccaccgggagcgggaggagctgcggcggcagcaggagctgcgctatgagcaggagcggcggcctgctgtgagaagaccctatgacctggacagaagagatgatgcctactggccagaggccaagagagctgccctggatgagcgctaccacagcgacttcaaccggcaggaccgcttccatgactttgaccaccgggaccggggccgctacccagaccacagcgtggaccggcgggagggcagccgctccatgatgggagagcgggagggccagcactacccagagcggcacggcggccctgagcggcacggccgggacagcagagatggctggggcggctacggcagtgacaagaggatgtctgagggccggggcctgcccccaccaccccggggccggcgggactggggagaccacggccggcgggaggatgaccgctcctggcagggcacagcagatggcggcatgatggaccgggaccacaagcgctggcagggcggggagaggtccatgagcggccacagcggccctggccacatgatgaacagaggaggcatgagcggccggggcagctttgcccctggaggagccagccggggccaccccatcccccacggcggcatgcagggcggctttggaggccagagccggggcagccggcccagtgatgcccgcttcacccggcgctactag

SEQ ID NO: 168885 - DNA, 2439 bp, Artificial Sequence
  Description of Artificial Sequence: Synthetic coding sequence
atggccgagaccctgagcggcctgggggacagcggggccgccggggctgctgccctgagcagcgccagcagcgagaccggcacccggcggctgagtgacctgcgggtgattgacctgcgggcagagctgaggaagagaaatgtggacagcagcggcaacaagtctgtgctgatggagcggctgaagaaggccattgaagatgaaggaggcaacccagatgaaattgagatcaccagcgagggcaacaagaagaccagcaagaggagcagcaaaggaaggaagccagaggaggagggcgtggaggacaatggcctggagccagaaaatgagaagatcctggacatcctgggggagacctgcaagtctgagcctgtgaaggaggagagcagcgagctggagcagccctttgcccaggacaccagctctgtgggccctgacaggaagctggccgaggaggaggacctgtttgacagcgcccaccctgaggagggggacctggacctggccagcgagagcacagcccacgcccagagcagcaaggctgacagcctgctggccgtggtgaagcgggagcctgctgagcagcctggagatggagagaggacagactgtgagcctgtgggcctggagcctgctgtggagcagagcagcgctgccagcgagctggccgaggccagcagcgaggagctggccgaggcccccacagaggcccccagccctgaggcccgggacagcaaagaagatggcaggaagtttgattttgatgcctgcaatgaggtgcccccagcccccaaggagagcagcaccagcgagggcgctgaccagaagatgagcagcccagaagatgacagcgacaccaagaggctgagcaaggaggagaagggccgcagcagctgtggcaggaacttctgggtgtctggcctgagcagcaccacccgggccacagacctgaagaacctcttcagcaaatatggcaaggtggtgggcgccaaggtggtgaccaatgcccggagccctggggcccgctgctacggctttgtgaccatgagcacagctgaggaggccaccaagtgcatcaaccacctgcacaagacagagctgcacggcaagatgatctctgtggagaaggccaagaatgaacctgtgggcaagaagaccagtgacaagagggacagtgatggcaagaaggagaagagcagcaacagcgacaggagcaccaacctgaagagagatgacaagtgtgacaggaaggatgatgccaagaagggagatgatggcagcggggagaagagcaaggaccaggatgaccagaagccaggccccagcgagaggagccgggccaccaagagcggcagccggggcacagagaggacagtggtgatggacaagagcaaaggagtgcctgtgatctctgtgaagaccagcggcagcaaggagcgggccagcaagagccaggacaggaagagcgccagccgggagaagaggtctgtggtgtcctttgacaaggtgaaggagcccaggaagagccgggacagcgagagccacagccgggtgcgggagaggtctgagcgggagcagaggatgcaggcccagtgggagcgggaggagcgggagcggctggagatcgcccgggagcggctggccttccagaggcagaggctggagcgggagaggatggagcgggagcggctggagcgggagaggatgcacgtggagcatgaaagaagaagagagcaggagcgcatccaccgggagcgggaggagctgcggcggcagcaggagctgcgctatgagcaggagaggaggcctgctgtgcggcggccctatgacctggacagaagagatgatgcctactggccagaggccaagagagctgccctggatgagcgctaccacagcgacttcaaccggcaggaccgcttccatgactttgaccaccgggaccggggccgctacccagaccacagcgtggacagaagagagggcagccgctccatgatgggagagcgggagggccagcactacccagagagacatggaggccctgagagacatggccgggacagcagagatggctggggcggctacggcagtgacaagaggatgtctgagggccggggcctgcccccaccaccccggggcagaagagactggggagaccatggaagaagagaagatgaccgctcctggcagggcacagcagatggcggcatgatggaccgggaccacaagcgctggcagggcggggagaggtccatgagcggccacagcggccctggccacatgatgaacagaggaggcatgagcggccggggcagctttgcccctgggggcgccagccggggccaccccatcccccatggaggcatgcagggcggctttggaggccagagccggggcagccggcccagtgatgcccgcttcacccggcgctactag

SEQ ID NO: 168886 - DNA, 2862 bp, Artificial Sequence
  Description of Artificial Sequence: Synthetic coding sequence
atggccgagaccctgcccggcagcggggacagcggccctggaacagccagcctgggccctggggtggccgagaccggcacccggcggctgtctgagctgcgggtcatcgacctgcgggcagagctgaagaagaggaacctggacacaggaggcaacaagtctgtgctgatggagcggctgaagaaggctgtgaaggaggagggccaggaccctgatgagatcggcatcgagctggaggccaccagcaagaagagcgccaagagatgtgtgaagggcctgaagatggaggaggagggcacagaagataatggcctggaggatgacagcagagatggccaggaggacatggaggccagcctggagaacctgcagaacatgggcatgatggacatgtctgtgctggatgaaacagaggtggccaacagcagcgccccagactttggagaagatggaacagatggcctgctggacagcttctgtgacagcaaggagtatgtggccgcccagctgcggcagctgcctgcccagcccccagagcacgctgtggatggagagggcttcaagaacaccctggagaccagcagcctgaacttcaaggtgaccccagacatcgaggagagcctgctggagccagaaaatgagaagatcctggacatcctgggggagacctgcaagtctgagcctgtgaaggaggagagcagcgagctggagcagccctttgcccaggacaccagctctgtgggccctgacaggaagctggccgaggaggaggacctgtttgacagcgcccaccctgaggagggggacctggacctggccagcgagagcacagcccacgcccagagcagcaaggctgacagcctgctggccgtggtgaagcgggagcctgctgagcagcctggagatggagagaggacagactgtgagcctgtgggcctggagcctgctgtggagcagagcagcgctgccagcgagctggccgaggccagcagcgaggagctggccgaggcccccacagaggcccccagccctgaggcccgggacagcaaagaagatggcaggaagtttgattttgatgcctgcaatgaggtgcccccagcccccaaggagagcagcaccagcgagggcgctgaccagaagatgagcagcttcaaggaggagaaggacatcaagcccatcatcaaggatgagaagggccgggtgggcagcggcagcggcaggaacctgtgggtgtctggcctgagcagcaccacccgggccacagacctgaagaacctcttcagcaaatatggcaaggtggtgggcgccaaggtggtgaccaatgcccggagccctggggcccgctgctacggctttgtgaccatgagcaccagtgatgaggccaccaagtgcatcagccacctgcacaggacagagctgcacggccgcatgatctctgtggagaaggccaagaatgaacctgctgggaagaagctgagtgacagaaaagaatgtgaggtgaagaaggagaagctgagctctgtggacagacaccacagcgtggagatcaagattgagaagacagtcatcaagaaggaggagaagattgagaagaaggaggagaagaagccagaggacatcaagaaggaggagaaggaccaggatgagctgaagccaggccccaccaacagaagccgggtgaccaagagcggcagccggggcatggagaggacagtggtgatggacaagagcaagggggagcctgtgatctctgtgaagaccaccagccgcagcaaggagaggagcagcaagagccaggacaggaagtctgagagcaaggagaagagggacatcctgagctttgacaagatcaaggagcagcgggagcgggagcggcagaggcagcgggagcgggagatccgggagacagagaggagaagagagcgggagcagcgggagcgggagcagaggctggaggccttccacgagaggaaggagaaggcccggctgcagcgggagcggctgcagctggagtgccagaggcagaggctggagcgggagaggatggagcgggagcggctggagcgggagaggatgagggtggagcgggagaggaggaaggagcaggagcgcatccaccgggagcgggaggagctgcggcggcagcaggagcagctgcgctatgagcaggagaggaggcctggaagaagaccctatgacctggacagaagagatgatgcctactggccagagggcaagagggtggccatggaggaccgctacagagctgacttccccaggccagaccaccgcttccatgactttgaccaccgggaccggggccagtaccaggaccacgccatcgacagaagagagggcagccggcccatgatgggagaccacagagatggccagcactatggagatgacagacatggccatggaggccccccagagcggcacggccgggacagcagagatggctggggcggctacggcagtgacaagaggctgtctgagggccggggcctgcccccaccaccccggggcggccgggactggggcgagcacaaccagaggctggaggagcaccaggcccgggcctggcagggcgccatggatgctggggccgccagccgggagcacgcccgctggcagggcggggagcggggcctgagcggccccagcggccctggccacatggccagccggggcggcgtggccggccggggcggctttgcccagggcggccacagccagggccacgtggtgcctgggggcggcctggagggcggcggcgtggccagccaggaccggggcagccgggtgccccacccccacccccaccccccaccctacccccacttcacccggcgctactag

SEQ ID NO: 168887 - DNA, 1533 bp, Artificial Sequence
  Description of Artificial Sequence: Synthetic coding sequence
atggccgagaccctgcccggcagcggggacagcggccctggaacagccagcctgggccctggggtggccgagaccggcacccggcggctgtctgagctgcgggtcatcgacctgcgggcagagctgaagaagaggaacctggacacaggaggcaacaagtctgtgctgatggagcggctgaagaaggctgtgaaggaggagggccaggaccctgatgagatcggcatcgagctggaggccaccagcaagaagagcgccaagagatgtgtgaagggcctgaagatggaggaggagggcacagaagataatggcctggaggatgacagcagagatggccaggaggacatggaggccagcctggagaacctgcagaacatgggcatgatggacatgtctgtgctggatgaaacagaggtggccaacagcagcgccccagactttggagaagatggaacagatggcctgctggacagcttctgtgacagcaaggagtatgtggccgcccagctgcggcagctgcctgcccagcccccagagcacgctgtgggcaacctggagacccggcaggatgtgcccaccagcagcagcctgcgggtgtctgtggccgctgtgcctgtgccccacctgtctgtggagaatgagaagatcctggacatcctgggggagacctgcaagtctgagcctgtgaaggaggagagcagcgagctggagcagccctttgcccaggacaccagctctgtgggccctgacaggaagctggccgaggaggaggacctgtttgacagcgcccaccctgaggagggggacctggacctggccagcgagagcacagcccacgcccagagcagcaaggctgacagcctgctggccgtggtgaagcgggagcctgctgagcagcctggagatggagagaggacagactgtgagcctgtgggcctggagcctgctgtggagcagagcagcgctgccagcgagctggccgaggccagcagcgaggagctggccgaggcccccacagaggcccccagccctgaggcccgggacagcaaagaagatggcaggaagtttgattttgatgcctgcaatgaggtgcccccagcccccaaggagagcagcaccagcgagggcgctgaccagaagatgagcagcttcaaggaggagaaggacatcaagcccatcatcaaggatgagaagggccgggtgggcagcggcagcggcaggaacctgtgggtgtctggcctgagcagcaccacccgggccacagacctgaagaacctcttcagcaaatatggcaaggtggtgggcgccaaggtggtgaccaatgcccggagccctggggcccgctgctacggctttgtgaccatgagcaccagtgatgaggccaccaagtgcatcagccacctgcacaggacagagctgcacggccgcatgatctctgtggagaaggccaagaatgaacctgctgggaagaagctgagtgacagaaaagaatgtgaggtgaagaaggagaagctgagctctgtggacagatag

SEQ ID NO: 168888 - DNA, 786 bp, Artificial Sequence
  Description of Artificial Sequence: Synthetic coding sequence
atggccgagaccctgcccggcagcggggacagcggccctggaacagccagcctgggccctggggtggccgagaccggcacccggcggctgtctgagctgcgggtcatcgacctgcgggcagagctgaagaagaggaacctggacacaggaggcaacaagtctgtgctgatggagcggctgaagaaggctgtgaaggaggagggccaggaccctgatgagatcggcatcgagctggaggccaccagcaagaagagcgccaagagatgtgtgaaggcccccagccctgaggcccgggacagcaaggaggatggcaggaagtttgattttgatgcctgcaatgaggtgcccccagcccccaaggagagcagcaccagcgagggcgctgaccagaagatgagcagcttcaaggaggagaaggacatcaagcccatcatcaaggatgagaagggccgggtgggcagcggcagcggcaggaacctgtgggtgtctggcctgagcagcaccacccgggccacagacctgaagaacctcttcagcaaatatggcaaggtggtgggcgccaaggtggtgaccaatgcccggagccctggggcccgctgctacggctttgtgaccatgagcaccagtgatgaggccaccaagtgcatcagccacctgcacaggacagagctgcacggccgcatgatctctgtggagaaggccaagaatgaacctgctgggaagaagctgagtgacagaaaagaatgtgaggtgaagaaggagaagctgagctctgtggacagatag

SEQ ID NO: 168889 - DNA, 1221 bp, Artificial Sequence
  Description of Artificial Sequence: Synthetic coding sequence
atggccgagaccctgcccggcagcggggacagcggccctggaacagccagcctgggccctggggtggccgagaccggcacccggcggctgtctgagctgcgggtcatcgacctgcgggcagagctgaagaagaggaacctggacacaggaggcaacaagtctgtgctgatggagcggctgaagaaggctgtgaaggaggagggccaggaccctgatgagatcggcatcgagctggaggccaccagcaagaagagcgccaagagatgtgtgaagggcctgaagatggaggaggagggcacagaagataatggcctggaggtggagaatgagaagatcctggacatcctgggggagacctgcaagtctgagcctgtgaaggaggagagcagcgagctggagcagccctttgcccaggacaccagctctgtgggccctgacaggaagctggccgaggaggaggacctgtttgacagcgcccaccctgaggagggggacctggacctggccagcgagagcacagcccacgcccagagcagcaaggctgacagcctgctggccgtggtgaagcgggagcctgctgagcagcctggagatggagagaggacagactgtgagcctgtgggcctggagcctgctgtggagcagagcagcgctgccagcgagctggccgaggccagcagcgaggagctggccgaggcccccacagaggcccccagccctgaggcccgggacagcaaagaagatggcaggaagtttgattttgatgcctgcaatgaggtgcccccagcccccaaggagagcagcaccagcgagggcgctgaccagaagatgagcagcttcaaggaggagaaggacatcaagcccatcatcaaggatgagaagggccgggtgggcagcggcagcggcaggaacctgtgggtgtctggcctgagcagcaccacccgggccacagacctgaagaacctcttcagcaaatatggcaaggtggtgggcgccaaggtggtgaccaatgcccggagccctggggcccgctgctacggctttgtgaccatgagcaccagtgatgaggccaccaagtgcatcagccacctgcacaggacagagctgcacggccgcatgatctctgtggagaaggccaagaatgaacctgctgggaagaagctgagtgacagaaaagaatgtgaggtgaagaaggagaagctgagctctgtggacagatag

SEQ ID NO: 168890 - DNA, 606 bp, Artificial Sequence
  Description of Artificial Sequence: Synthetic coding sequence
atggccgagaccggcacccggcggctgtctgagctgcgggtgattgacctgcgggcagagctgaagaagaggaacctggacaccggcggcaacaagtctgtgctgatggagcggctgaagaaggctgtgaaggaggagggccaggaccctgatgaaattggaattgagctggaggccaccagcaagaagagcgccaagagatgtgtgaagggcctgaagatggaggaggagggcacagaggacaatggcctggaggatgacagcagagatggccaggaggacatggaggccagcctggagaacctgcagaacatgggcatgatggacatgtctgtgctggatgaaacagaggtggccaacagcagcgccccagactttggagaagatggaacagatggcctgctggacagcttctgtgacagcaaggagtatgtggccgcccagctgcggcagctgcctgcccagcccccagagcacgctgtggatggagagggcttcaagaacaccctggagaccagcagcctgaacttcaaggtgaccccagacatcgaggagagcctgctggagcccggcacagacaagaggaacaccaccgtgatggtgtag

SEQ ID NO: 168891 - DNA, 1821 bp, Artificial Sequence
  Description of Artificial Sequence: Synthetic coding sequence
atgaaggtgcgctctgctggaggagatggagatgccctgtgtgtgacagaggaggacctggccggagatgatgaggacatgcccaccttcccctgcacccagaagggccggcccggcccccgctgcagccgctgccagaagaacctgagcctgcacacctctgtgcgcatcctgtacctgttcctggccctgctgctggtggccgtggccgtgctggccagcctggtgttcaggaaggtggacagcctgtctgaggacatcagcctgacccagagcatctatgacaagaagctggtgctgatgcagaagaacctgcagggcctggaccccaaggccctgaacaactgcagcttctgccacgaggccggccagctgggccctgagatcaggaagctgcaggaggagctggagggcatccagaagctgctgctggcccaggaggtgcagctggaccagaccctgcaggcccaggaggtgctgagcaccaccagccggcagatcagccaggagatgggcagctgcagcttcagcatccaccaggtgaaccagagcctgggcctcttcctggcccaggtgcggggctggcaggccaccacagctggcctggacctgagcctgaaggacctgacccaggagtgctatgatgtgaaggctgctgtgcaccagatcaacttcaccgtgggccagaccagcgagtggattcatggcatccagaggaagacagatgaggagaccctgaccctgcagaagatcgtgacagactggcagaactacaccaggctcttcagcggcctgcggaccaccagcaccaagacaggagaggccgtgaagaacatccaggccaccctgggcgccagcagccagaggatcagccagaacagcgagagcatgcatgacctggtgctgcaggtgatgggcctgcagctgcagctggacaacatcagcagcttcctggatgaccacgaggagaacatgcatgacctgcagtaccacacccactacgcccagaacagaacagtggagagatttgagagcctggagggccgcatggccagccatgaaattgaaattggcaccatcttcaccaacatcaatgccacagacaaccacgtgcacagcatgctgaagtacctggatgatgtgcggctgagctgcaccctgggcttccacacccatgctgaggagctgtactacctgaacaagtctgtgtccatcatgctgggcaccacagacctgctgcgggagcgcttcagcctgctgagcgcccggctggacctgaatgtgaggaacctgtccatgattgtggaggagatgaaggctgtggacacccagcacggggagatcctgagaaatgtgaccatcctgcggggggcccctggccccccaggcccccggggcttcaagggggacatgggcgtgaagggccctgtgggcggccggggccccaagggggaccccggcagcctgggccccctgggcccccagggcccccagggccagcctggagaggccggccctgtgggggagcggggccctgtgggcccccggggcttccctggcctgaagggcagcaagggcagctttggcaccggcggcccccggggccagcccggccccaagggggacatcggccccccaggccctgagggccccccaggcagccctggccccagcggcccccagggcaagccaggcattgctgggaagacaggcagccctggccagagaggagccatgggccccaagggggagcccggcatccagggccccccaggcctgcccggccccccaggccccccaggcagccagagcttctactag

SEQ ID NO: 168892 - DNA, 1401 bp, Artificial Sequence
  Description of Artificial Sequence: Synthetic coding sequence
atgaaggtgcgctctgctggaggagatggagatgccctgtgtgtgacagaggaggacctggccggagatgatgaggacatgcccaccttcccctgcacccagaagggccggcccggcccccgctgcagccgctgccagaagaacctgagcctgcacacctctgtgcgcatcctgtacctgttcctggccctgctgctggtggccgtggccgtgctggccagcctggtgttcaggaaggtggacagcctgtctgaggacatcagcctgacccagagcatctatgacaagaagctggtgctgatgcagaagaacctgcagggcctggaccccaaggccctgaacaactgcagcttctgccacgaggccggccagctgggccctgagatcaggaagctgcaggaggagctggagggcatccagaagctgctgctggcccaggaggtgcagctggaccagaccctgcaggcccaggaggtgctgagcaccaccagccggcagatcagccaggagatgggcagctgcagcttcagcatccaccaggtgaaccagagcctgggcctcttcctggcccaggtgcggggctggcaggccaccacagctggcctggacctgagcctgaaggacctgacccaggagtgctatgatgtgaaggctgctgtgcaccagatcaacttcaccgtgggccagaccagcgagtggattcatggcatccagaggaagacagatgaggagaccctgaccctgcagaagatcgtgacagactggcagaactacaccaggctcttcagcggcctgcggaccaccagcaccaagacaggagaggccgtgaagaacatccaggccaccctgggcgccagcagccagaggatcagccagaacagcgagagcatgcatgacctggtgctgcaggtgatgggcctgcagctgcagctggacaacatcagcagcttcctggatgaccacgaggagaacatgcatgacctgcagtaccacacccactacgcccagaacagaacagtggagagatttgagagcctggagggccgcatggccagccatgaaattgaaattggcaccatcttcaccaacatcaatgccacagacaaccacgtgcacagcatgctgaagtacctggatgatgtgcggctgagctgcaccctgggcttccacacccatgctgaggagctgtactacctgaacaagtctgtgtccatcatgctgggcaccacagacctgctgcgggagcgcttcagcctgctgagcgcccggctggacctgaatgtgaggaacctgtccatgattgtggaggagatgaaggctgtggacacccagcacggggagatcctgagaaatgtgaccatcctgcggggccacaccctcttcagccacaaccgcatctag

SEQ ID NO: 168893 - DNA, 1008 bp, Artificial Sequence
  Description of Artificial Sequence: Synthetic coding sequence
atgggccgctgctgcttctacacagctggcaccctgagcctgctgctgctggtgacctctgtgaccctgctggtggcccgggtcttccagaaggctgtggaccagagcattgagaagaagatcgtgctgagaaatggaacagaggcctttgacagctgggagaagccacccctgcctgtgtacacccagttctacttcttcaacgtgaccaaccctgaggagatcctgcggggggagaccccccgggtggaggaggtgggcccctacacctaccgcagcctggactggtggatcacagacaagtgcaacatgatcaatggaacagatggagacagcttccaccccctcatcaccaaggatgaggtgctgtatgtgttccccagcgacttctgccgctctgtgtacatcaccttcagtgactatgaatctgtgcagggcctgcctgccttccgctacaaggtgcctgctgagatcctggccaacaccagtgacaatgccggcttctgcatccctgagggcaactgcctgggcagcggcgtgctgaatgtgtccatctgcaagaatggagcccccatcatcatgtccttcccccacttctaccaggctgatgaaagatttgtgtctgccatcgagggcatgcaccccaaccaggaggaccacgagacctttgtggacatcaaccccctgaccggcatcatcctgaaggccgccaagcgcttccagatcaacatctacgtgaagaagctggatgactttgtggagactggagacatccgcaccatggtgtttcctgtgatgtacctgaatgaatctgtgcacatcgacaaggagacagccagccggctgaagtccatgatcaacaccaccctcatcatcaccaacatcccctacatcatcatggccctgggcgtcttcttcggcctggtgttcacctggctggcctgcaagggccagggctccatggatgagggcacagcagatgagcgggcccccctcatccgcacctag

SEQ ID NO: 168894 - DNA, 1530 bp, Artificial Sequence
  Description of Artificial Sequence: Synthetic coding sequence
atgggctgcagcgccaaggcccgctgggccgccggggccctgggcgtggccggcctgctgtgtgctgtgctgggcgctgtgatgattgtgatggtgcccagcctcatcaagcagcaggtgctgaagaatgtgagaattgaccccagcagcctgtccttcaacatgtggaaggagatccccatccccttctacctgtctgtgtacttctttgatgtgatgaaccccagcgagatcctgaagggggagaagccccaggtgcgggagcggggcccctacgtgtaccgggagttccgccacaagagcaacatcaccttcaacaacaatgacacagtgtccttcctggagtaccgcaccttccagttccagcccagcaagagccacggcagcgagagtgactacatcgtgatgcccaacatcctggtgctgggcgctgctgtgatgatggagaacaagcccatgaccctgaagctgatcatgaccctggccttcaccaccctgggggagcgggccttcatgaacagaacagtgggggagatcatgtggggctacaaggaccccctggtgaacctgatcaacaagtacttccctggcatgttccccttcaaggacaagtttggcctgtttgctgagctgaacaacagcgacagcggcctcttcaccgtcttcaccggggtgcagaacatcagccgcatccacctggtggacaagtggaatggcctgagcaaggtggacttctggcacagcgaccagtgcaacatgatcaatggcaccagcggccagatgtggccacccttcatgaccccagagagcagcctggagttctacagccctgaggcctgccgctccatgaagctgatgtacaaggagagcggcgtgtttgagggcatccccacctacagatttgtggcccccaagaccctgtttgccaacggcagcatctaccccccaaatgaaggcttctgcccctgcctggagagcggcatccagaatgtgtccacctgccgcttcagcgcccccctcttcctgagccacccccacttcctgaatgctgaccctgtgctggccgaggccgtgacaggcctgcaccccaaccaggaggcccacagcctcttcctggacatccaccctgtgacaggcatccccatgaactgcagcgtgaagctgcagctgagcctgtacatgaagtctgtggccggcatcggccagacaggcaagattgagcctgtggtgctgcccctgctgtggtttgctgagagcggggccatggagggggagaccctgcacaccttctacacccagctggtgctgatgcccaaggtgatgcactacgcccagtatgtgctgctggccctgggctgtgtgctgctgctggtgcctgtgatctgccagatccgcagccaggagaagtgctacctgttctggagcagcagcaagaagggcagcaaggacaaggaggccatccaggcctacagcgagagcctgatgaccagcgcccccaagggctctgtgctgcaggaggccaagctgtag

SEQ ID NO: 168895 - DNA, 1521 bp, Artificial Sequence
  Description of Artificial Sequence: Synthetic coding sequence
atgggctgcagcgccaaggcccgctgggccgccggggccctgggcgtggccggcctgctgtgtgctgtgctgggcgctgtgatgattgtgatggtgcccagcctcatcaagcagcaggtgctgaagaatgtgagaattgaccccagcagcctgtccttcaacatgtggaaggagatccccatccccttctacctgtctgtgtacttctttgatgtgatgaaccccagcgagatcctgaagggggagaagccccaggtgcgggagcggggcccctacgtgtaccgggagttccgccacaagagcaacatcaccttcaacaacaatgacacagtgtccttcctggagtaccgcaccttccagttccagcccagcaagagccacggcagcgagagtgactacatcgtgatgcccaacatcctggtgctgggcgctgctgtgatgatggagaacaagcccatgaccctgaagctgatcatgaccctggccttcaccaccctgggggagcgggccttcatgaacagaacagtgggggagatcatgtggggctacaaggaccccctggtgaacctgatcaacaagtacttccctggcatgttccccttcaaggacaagtttggcctgtttgctgagctgaacaacagcgacagcggcctcttcaccgtcttcaccggggtgcagaacatcagccgcatccacctggtggacaagtggaatggcctgagcaaggtggacttctggcacagcgaccagtgcaacatgatcaatggcaccagcggccagatgtggccacccttcatgaccccagagagcagcctggagttctacagccctgaggcctgccgctccatgaagctgatgtacaaggagagcggcgtgtttgagggcatccccacctacagatttgtggcccccaagaccctgtttgccaacggcagcatctaccccccaaatgaaggcttctgcccctgcctggagagcggcatccagaatgtgtccacctgccgcttcagcgcccccctcttcctgagccacccccacttcctgaatgctgaccctgtgctggccgaggccgtgacaggcctgcaccccaaccaggaggcccacagcctcttcctggacatccaccctgtgacaggcatccccatgaactgcagcgtgaagctgcagctgagcctgtacatgaagtctgtggccggcatcggccagacaggcaagattgagcctgtggtgctgcccctgctgtggtttgctgagagcggggccatggagggggagaccctgcacaccttctacacccagctggtgctgatgcccaaggtgatgcactacgcccagtatgtgctgctggccctgggctgtgtgctgctgctggtgcctgtgatctgccagatccgcagccagggccctgaggacacagtgtcccagcccggcctggccgccggccctgacaggcctcccagcccctacacccccctgctgcctgacagccccagcggccagccccccagccccacagcctag

SEQ ID NO: 168896 - DNA, 1230 bp, Artificial Sequence
  Description of Artificial Sequence: Synthetic coding sequence
atgggctgcagcgccaaggcccgctgggccgccggggccctgggcgtggccggcctgctgtgtgctgtgctgggcgctgtgatgattgtgatggtgcccagcctcatcaagcagcaggtgctgaagggagctgctgtgatgatggagaacaagcccatgaccctgaagctgatcatgaccctggccttcaccaccctgggggagcgggccttcatgaacagaacagtgggggagatcatgtggggctacaaggaccccctggtgaacctgatcaacaagtacttccctggcatgttccccttcaaggacaagtttggcctgtttgctgagctgaacaacagcgacagcggcctcttcaccgtcttcaccggggtgcagaacatcagccgcatccacctggtggacaagtggaatggcctgagcaaggtggacttctggcacagcgaccagtgcaacatgatcaatggcaccagcggccagatgtggccacccttcatgaccccagagagcagcctggagttctacagccctgaggcctgccgctccatgaagctgatgtacaaggagagcggcgtgtttgagggcatccccacctacagatttgtggcccccaagaccctgtttgccaacggcagcatctaccccccaaatgaaggcttctgcccctgcctggagagcggcatccagaatgtgtccacctgccgcttcagcgcccccctcttcctgagccacccccacttcctgaatgctgaccctgtgctggccgaggccgtgacaggcctgcaccccaaccaggaggcccacagcctcttcctggacatccaccctgtgacaggcatccccatgaactgcagcgtgaagctgcagctgagcctgtacatgaagtctgtggccggcatcggccagacaggcaagattgagcctgtggtgctgcccctgctgtggtttgctgagagcggggccatggagggggagaccctgcacaccttctacacccagctggtgctgatgcccaaggtgatgcactacgcccagtatgtgctgctggccctgggctgtgtgctgctgctggtgcctgtgatctgccagatccgcagccaggagaagtgctacctgttctggagcagcagcaagaagggcagcaaggacaaggaggccatccaggcctacagcgagagcctgatgaccagcgcccccaagggctctgtgctgcaggaggccaagctgtag

SEQ ID NO: 168897 - DNA, 1659 bp, Artificial Sequence
  Description of Artificial Sequence: Synthetic coding sequence
atgggctgcagcgccaaggcccgctgggccgccggggccctgggcgtggccggcctgctgtgtgctgtgctgggcgctgtgatgattgtgatggtgcccagcctcatcaagcagcaggtgctgaagaatgtgagaattgaccccagcagcctgtccttcaacatgtggaaggagatccccatccccttctacctgtctgtgtacttctttgatgtgatgaaccccagcgagatcctgaagggggagaagccccaggtgcgggagcggggcccctacgtgtaccgggagttccgccacaagagcaacatcaccttcaacaacaatgacacagtgtccttcctggagtaccgcaccttccagttccagcccagcaagagccacggcagcgagagtgactacatcgtgatgcccaacatcctggtgctgggcgctgctgtgatgatggagaacaagcccatgaccctgaagctgatcatgaccctggccttcaccaccctgggggagcgggccttcatgaacagaacagtgggggagatcatgtggggctacaaggaccccctggtgaacctgatcaacaagtacttccctggcatgttccccttcaaggacaagtttggcctgtttgctgagctgaacaacagcgacagcggcctcttcaccgtcttcaccggggtgcagaacatcagccgcatccacctggtggacaagtggaatggcctgagcaaggtggacttctggcacagcgaccagtgcaacatgatcaatggcaccagcggccagatgtggccacccttcatgaccccagagagcagcctggagttctacagccctgaggcctgccgctccatgaagctgatgtacaaggagagcggcgtgtttgagggcatccccacctacagatttgtggcccccaagaccctgtttgccaacggcagcatctaccccccaaatgaaggcttctgcccctgcctggagagcggcatccagaatgtgtccacctgccgcttcagcgcccccctcttcctgagccacccccacttcctgaatgctgaccctgtgctggccgaggccgtgacaggcctgcaccccaaccaggaggcccacagcctcttcctggacatccaccctgtgacaggcatccccatgaactgcagcgtgaagctgcagctgagcctgtacatgaagtctgtggccggcatcggccagacaggcaagattgagcctgtggtgctgcccctgctgtggtttgctgagagcggggccatggagggggagaccctgcacaccttctacacccagctggtgctgatgcccaaggtgatgcactacgcccagtatgtgctgctggccctgggctgtgtgctgctgctggtgcctgtgatctgccagatccgcagccaggtgggcgccggccagagagctgcccgggctgacagccacagcctggcctgctggggcaaaggagccagtgacaggaccctgtggcccacagctgcctggagccccccacctgctgctgtgctgcggctgtgccgcagcggcagcggccactgctggggcctgcggagcaccctggccagctttgcctgccgggtggccaccaccctgcctgtgctggagggcctgggccccagcctgggcggcggcaccggcagctag

SEQ ID NO: 168898 - DNA, 1551 bp, Artificial Sequence
  Description of Artificial Sequence: Synthetic coding sequence
atgtgtgctgtgggcaatgtgagaattgaccccagcagcctgtccttcaacatgtggaaggagatccccatccccttctacctgtctgtgtacttctttgatgtgatgaaccccagcgagatcctgaagggggagaagccccaggtgcgggagcggggcccctacgtgtaccgggagttccgccacaagagcaacatcaccttcaacaacaatgacacagtgtccttcctggagtaccgcaccttccagttccagcccagcaagagccacggcagcgagagtgactacatcgtgatgcccaacatcctggtgctgggcgctgctgtgatgatggagaacaagcccatgaccctgaagctgatcatgaccctggccttcaccaccctgggggagcgggccttcatgaacagaacagtgggggagatcatgtggggctacaaggaccccctggtgaacctgatcaacaagtacttccctggcatgttccccttcaaggacaagtttggcctgtttgctgagctgaacaacagcgacagcggcctcttcaccgtcttcaccggggtgcagaacatcagccgcatccacctggtggacaagtggaatggcctgagcaaggtggacttctggcacagcgaccagtgcaacatgatcaatggcaccagcggccagatgtggccacccttcatgaccccagagagcagcctggagttctacagccctgaggcctgccgctccatgaagctgatgtacaaggagagcggcgtgtttgagggcatccccacctacagatttgtggcccccaagaccctgtttgccaacggcagcatctaccccccaaatgaaggcttctgcccctgcctggagagcggcatccagaatgtgtccacctgccgcttcagcgcccccctcttcctgagccacccccacttcctgaatgctgaccctgtgctggccgaggccgtgacaggcctgcaccccaaccaggaggcccacagcctcttcctggacatccaccctgtgacaggcatccccatgaactgcagcgtgaagctgcagctgagcctgtacatgaagtctgtggccggcatcggccagacaggcaagattgagcctgtggtgctgcccctgctgtggtttgctgagagcggggccatggagggggagaccctgcacaccttctacacccagctggtgctgatgcccaaggtgatgcactacgcccagtatgtgctgctggccctgggctgtgtgctgctgctggtgcctgtgatctgccagatccgcagccaggtgggcgccggccagagagctgcccgggctgacagccacagcctggcctgctggggcaagggggccagtgacaggaccctgtggcccacagctgcctggagccccccacctgctgctgtgctgcggctgtgccgcagcggcagcggccactgctggggcctgcggagcaccctggccagctttgcctgccgggtggccaccaccctgcctgtgctggagggcctgggccccagcctgggcggcggcactggaggcctgtag

SEQ ID NO: 168899 - DNA, 1539 bp, Artificial Sequence
  Description of Artificial Sequence: Synthetic coding sequence
atgaatgtgagaattgaccccagcagcctgtccttcaacatgtggaaggagatccccatccccttctacctgtctgtgtacttctttgatgtgatgaaccccagcgagatcctgaagggggagaagccccaggtgcgggagcggggcccctacgtgtaccgggagttccgccacaagagcaacatcaccttcaacaacaatgacacagtgtccttcctggagtaccgcaccttccagttccagcccagcaagagccacggcagcgagagtgactacatcgtgatgcccaacatcctggtgctgggcgctgctgtgatgatggagaacaagcccatgaccctgaagctgatcatgaccctggccttcaccaccctgggggagcgggccttcatgaacagaacagtgggggagatcatgtggggctacaaggaccccctggtgaacctgatcaacaagtacttccctggcatgttccccttcaaggacaagtttggcctgtttgctgagctgaacaacagcgacagcggcctcttcaccgtcttcaccggggtgcagaacatcagccgcatccacctggtggacaagtggaatggcctgagcaaggtggacttctggcacagcgaccagtgcaacatgatcaatggcaccagcggccagatgtggccacccttcatgaccccagagagcagcctggagttctacagccctgaggcctgccgctccatgaagctgatgtacaaggagagcggcgtgtttgagggcatccccacctacagatttgtggcccccaagaccctgtttgccaacggcagcatctaccccccaaatgaaggcttctgcccctgcctggagagcggcatccagaatgtgtccacctgccgcttcagcgcccccctcttcctgagccacccccacttcctgaatgctgaccctgtgctggccgaggccgtgacaggcctgcaccccaaccaggaggcccacagcctcttcctggacatccaccctgtgacaggcatccccatgaactgcagcgtgaagctgcagctgagcctgtacatgaagtctgtggccggcatcggccagacaggcaagattgagcctgtggtgctgcccctgctgtggtttgctgagagcggggccatggagggggagaccctgcacaccttctacacccagctggtgctgatgcccaaggtgatgcactacgcccagtatgtgctgctggccctgggctgtgtgctgctgctggtgcctgtgatctgccagatccgcagccaggtgggcgccggccagagagctgcccgggctgacagccacagcctggcctgctggggcaagggggccagtgacaggaccctgtggcccacagctgcctggagccccccacctgctgctgtgctgcggctgtgccgcagcggcagcggccactgctggggcctgcggagcaccctggccagctttgcctgccgggtggccaccaccctgcctgtgctggagggcctgggccccagcctgggcggcggcactggaggcctgtag

SEQ ID NO: 168900 - DNA, 441 bp, Artificial Sequence
  Description of Artificial Sequence: Synthetic coding sequence
atgggctgcagcgccaaggcccgctgggccgccggggccctgggcgtggccggcctgctgtgtgctgtgctgggcgctgtgatgattgtgatggtgcccagcctcatcaagcagcaggtgctgaagaatgtgagaattgaccccagcagcctgtccttcaacatgtggaaggagatccccatccccttctacctgtctgtgtacttctttgatgtgatgaaccccagcgagatcctgaagggggagaagccccaggtgcgggagcggggcccctacgtgtaccgggagttccgccacaagagcaacatcaccttcaacaacaatgacacagtgtccttcctggagtaccgcaccttccagttccagcccagcaagagccacggcagcgagagtgactacatcgtgatgcccaacatcctggtgctggtgcggctgccctag

SEQ ID NO: 168901 - DNA, 1446 bp, Artificial Sequence
  Description of Artificial Sequence: Synthetic coding sequence
atgggctgcagcgccaaggcccgctgggccgccggggccctgggcgtggccggcctgctgtgtgctgtgctgggcgctgtgatgattgtgatggtgcccagcctcatcaagcagcaggtgctgaagaatgtgagaattgaccccagcagcctgtccttcaacatgtggaaggagatccccatccccttctacctgtctgtgtacttctttgatgtgatgaaccccagcgagatcctgaagggggagaagccccaggtgcgggagcggggcccctacgtgtaccgggagttccgccacaagagcaacatcaccttcaacaacaatgacacagtgtccttcctggagtaccgcaccttccagttccagcccagcaagagccacggcagcgagagtgactacatcgtgatgcccaacatcctggtgctgggcgctgctgtgatgatggagaacaagcccatgaccctgaagctgatcatgaccctggccttcaccaccctgggggagcgggccttcatgaacagaacagtgggggagatcatgtggggctacaaggaccccctggtgaacctgatcaacaagtacttccctggcatgttccccttcaaggacaagtttggcctgtttgctgagctgaacaacagcgacagcggcctcttcaccgtcttcaccggggtgcagaacatcagccgcatccacctggtggacaagtggaatggcctgagcaaggtggacttctggcacagcgaccagtgcaacatgatcaatggcaccagcggccagatgtggccacccttcatgaccccagagagcagcctggagttctacagccctgaggcctgccgctccatgaagctgatgtacaaggagagcggcgtgtttgagggcatccccacctacagatttgtggcccccaagaccctgtttgccaacggcagcatctaccccccaaatgaaggcttctgcccctgcctggagagcggcatccagaatgtgtccacctgccgcttcagcgcccccctcttcctgagccacccccacttcctgaatgctgaccctgtgctggccgaggccgtgacaggcctgcaccccaaccaggaggcccacagcctcttcctggacatccaccctgtgacaggcatccccatgaactgcagcgtgaagctgcagctgagcctgtacatgaagtctgtggccggcatcggccagacaggcaagattgagcctgtggtgctgcccctgctgtggtttgctgagagcggggccatggagggggagaccctgcacaccttctacacccagctggtgctgatgcccaaggagaagtgctacctgttctggagcagcagcaagaagggcagcaaggacaaggaggccatccaggcctacagcgagagcctgatgaccagcgcccccaagggctctgtgctgcaggaggccaagctgtag

SEQ ID NO: 168902 - DNA, 1437 bp, Artificial Sequence
  Description of Artificial Sequence: Synthetic coding sequence
atgggccgctgctgcttctacacagctggcaccctgagcctgctgctgctggtgacctctgtgaccctgctggtggcccgggtcttccagaaggctgtggaccagagcattgagaagaagatcgtgctgagaaatggaacagaggcctttgacagctgggagaagccacccctgcctgtgtacacccagttctacttcttcaacgtgaccaaccctgaggagatcctgcggggggagaccccccgggtggaggaggtgggcccctacacctaccgggagctgaggaacaaggccaacatccagtttggagacaatggcaccaccatctctgctgtgagcaacaaggcctacgtgtttgagcgggaccagagcgtgggggaccccaagattgacctgatccgcaccctgaacatccctgtgctgaccgtcatcgagtggagccaggtgcacttcctgcgggagatcatcgaggccatgctgaaggcctaccagcagaagctgtttgtgacccacacagtggatgagctgctgtggggctacaaggatgagatcctgagcctcatccacgtgttccggccagacatcagcccctacttcggcctcttctatgagaagaatggcaccaatgatggagactatgtgttcctgactggagaagattcctacctgaacttcaccaagatcgtggagtggaatggcaagaccagcctggactggtggatcacagacaagtgcaacatgatcaatggaacagatggagacagcttccaccccctcatcaccaaggatgaggtgctgtatgtgttccccagcgacttctgccgctctgtgtacatcaccttcagtgactatgagagcgtgcagggcctgcctgccttccgctacaaggtgcctgctgagatcctggccaacaccagtgacaatgccggcttctgcatccctgagggcaactgcctgggcagcggcgtgctgaatgtgtccatctgcaagaatggagcccccatcatcatgtccttcccccacttctaccaggctgatgaaagatttgtgtctgccatcgagggcatgcaccccaaccaggaggaccacgagacctttgtggacatcaaccccctgaccggcatcatcctgaaggccgccaagcgcttccagatcaacatctacgtgaagaagctggatgactttgtggagaccggggacatccgcaccatggtgtttcctgtgatgtacctgaatgaatctgtgcacatcgacaaggagacagccagccggctgaagtccatgatcaacaccaccctcatcatcaccaacatcccctacatcatcatggccctgggcgtcttcttcggcctggtgttcacctggctggcctgcaagggccagggctccatggatgagggcacagcagatgagcgggcccccctcatccgcacctag

SEQ ID NO: 168903 - DNA, 1710 bp, Artificial Sequence
  Description of Artificial Sequence: Synthetic coding sequence
atgggcctgggcctgctgctgcccctgctgctgctgtggacccggggcacccagggcagcgagctggaccccaagggccagcacgtgtgtgtggccagcagccccagcgctgagctgcagtgctgtgccggctggaggcagaaggaccaggagtgcaccatccccatctgtgagggcccagatgcctgccagaaggatgaggtgtgtgtgaagccaggcctgtgccgctgcaagccaggcttcttcggggcccactgcagcagccgctgccccggccagtactggggccctgactgccgggagagctgcccctgccacccccacggccagtgtgagcccgccactggagcctgccagtgccaggccgaccgctggggcgcccgctgtgagttcccctgtgcctgtggcccccacggccgctgtgaccctgccactggagtgtgccactgtgagcccggctggtggagcagcacctgccggcggccctgccagtgcaacacagctgctgcccgctgtgagcaggccaccggggcctgtgtgtgcaagccaggctggtggggccgccgctgcagcttccgctgcaactgccacggcagcccctgtgagcaggacagcggccgctgtgcctgccggcccggctggtggggccctgagtgccagcagcagtgtgaatgtgtgcggggccgctgcagcgctgccagcggggagtgcacctgccccccaggcttccggggggcccgctgtgagctgccctgcccagctggcagccatggagtgcagtgtgcccacagctgtggccgctgcaagcacaatgagccctgcagcccagacaccggcagctgtgagagctgtgagcccggctggaatggcacccagtgccagcagccctgcctgcccggcaccttcggggagagctgtgagcagcagtgcccccactgcagacatggagaggcctgtgagccagacaccggccactgccagagatgtgaccccggctggctgggcccccgctgtgaggacccctgccccaccggcacctttggagaggactgtggcagcacctgccccacctgtgtgcagggcagctgtgacacagtgactggagactgtgtgtgcagcgctggctactggggccccagctgcaatgccagctgcccagctggcttccacggcaacaactgcagcgtgccctgtgaatgtcctgagggcctgtgccaccctgtgtctggcagctgccagcccggcagcggcagccgggacacagccctgattgctggcagcctggtgcccctgctgctgctcttcctgggcctggcctgctgtgcctgctgctgctgggcccccaggagtgacctgaaggacaggcctgccagagatggagccaccgtgtccaggatgaagctgcaggtgtggggcaccctgaccagcctgggcagcaccctgccctgccgcagcctgagcagccacaagctgccctgggtgacagccagcagcagccggcccctgcctgctggccccctgatgacccccagccaccccatcctgagcctggagcggcagatgaggttcctgcccaccgtgtgccaccccaagaagggctggagcctgtggccccggcagggccggcagaggcctgcctggctgcaggtgctgagccggcccctgcggaccccacccaggcacagccccagccgggcccccccagcctag

SEQ ID NO: 168904 - DNA, 2613 bp, Artificial Sequence
  Description of Artificial Sequence: Synthetic coding sequence
atggagggcgccggccccagaggagctggccctgcccggaggagaggagctgggggcccccccagccccctgctgcccagcctgctgctgctgctgctgctgtggatgctgcctgacacagtggccccccaggagctgaacccccggggcagaaatgtgtgccgggcccctggcagccaggtgcccacctgctgtgccggctggaggcagcagggagatgaatgtggcattgctgtgtgtgagggcaacagcacctgcagtgaaaatgaggtgtgtgtgcggcctggagaatgtcgctgccgccacggctactttggagccaactgtgacaccaagtgcccccggcagttctggggccctgactgcaaggagctgtgcagctgccacccccacggccagtgtgaagatgtgacaggccagtgcacctgccacgcccggcgctggggcgcccgctgtgagcacgcctgccagtgccagcacggcacctgccaccccaggtctggggcctgccgctgtgagcccggctggtggggcgcccagtgtgccagcgcctgctactgcagcgccaccagccgctgtgacccccagacaggagcctgcctgtgccacgccggctggtggggccgcagctgcaacaaccagtgtgcctgcaacagcagcccctgtgagcagcagagcggccgctgccagtgccgggagaggaccttcggggcccgctgtgaccgctactgccagtgcttccggggccgctgccaccctgtggatggcacctgtgcctgtgagcccggctaccggggcaagtactgccgggagccctgcccagctggcttctacggcctgggctgcagaagaagatgtggccagtgcaagggccagcagccctgcaccgtggccgagggccgctgcctgacctgtgagcccggctggaatggcaccaagtgtgaccagccctgtgccaccggcttctatggagagggctgcagccaccgctgccccccctgcagagatggccacgcctgcaaccacgtgacaggcaagtgcacccgctgcaatgccggctggattggagacagatgtgagaccaagtgcagcaatggcacctacggggaggactgtgcctttgtgtgtgccgactgtggcagcggccactgtgacttccagagcggccgctgcctgtgcagccctggggtgcacggcccccactgcaatgtgacctgccccccaggcctgcatggagctgactgtgcccaggcctgcagctgccacgaggacacctgtgaccctgtgactggagcctgccacctggagaccaaccagaggaaaggagtgatgggcgctggggccctgctggtgctgctggtgtgcctgctgctgagcctgctgggctgctgctgtgcctgccggggcaaggaccccacccggcggccccggccccggcgggagctgagcctgggcaggaagaaggccccccaccggctgtgtggccgcttcagccgcatctccatgaagctgccccgcatccccctgcggcggcagaagctgcccaaggtggtggtggcccaccacgacctggacaacaccctgaactgcagcttcctggagcccccatctggcctggagcagcccagccccagctggagcagccgggccagcttcagcagctttgacaccacagatgagggccctgtgtactgtgtgccccatgaggaggccccagctgagagccgggaccctgaggtgcccaccgtgcctgctgaggccccagcccccagccctgtgcccctgaccaccccagccagcgctgaggaggccatccccctgcctgccagcagtgacagcgagaggtctgccagctctgtggagggccctggaggagccctgtatgcccgggtggcccggcgggaggcccggcctgcccgggcccggggggagattggaggcctgagcctgagccccagccctgagaggaggaagcccccacctccagaccctgccaccaagcccaaggtgtcctggatccacggcaagcacagcgctgctgctgctggccgggcccccagccccccacctcctggcagcgaggccgcccccagccccagcaagaggaagaggacccccagcgacaagagcgcccacacagtggagcacggcagccccaggacccgggaccccaccccccggcccccaggcctgcctgaggaggccacagccctggccgcccccagccccccccgggcccgggcccgggccgccccccggcccctgggcgcccacggcagaagaagaagccctgccaagagagctgaggccgcctccatgctggccgcagatgtgcggggcaagaccaggagcctgggccgggcagaggtggccctgggcgcccagggcccccgggagaagccagccccaccccagaaggccaagaggtctgtgcccccagccagccctgcccgggcccccccagccacagagaccccaggccctgagaaggccgccacagacctgcctgcccctgagacccccaggaagaagacccccatccagaagccacccaggaagaagagccgggaggccgccggggagctgggccgggccggggcccccaccctgtag

SEQ ID NO: 168905 - DNA, 2493 bp, Artificial Sequence
  Description of Artificial Sequence: Synthetic coding sequence
atgggcctgggcctgctgctgcccctgctgctgctgtggacccggggcacccagggcagcgagctggaccccaagggccagcacgtgtgtgtggccagcagccccagcgctgagctgcagtgctgtgccggctggaggcagaaggaccaggagtgcaccatccccatctgtgagggcccagatgcctgccagaaggatgaggtgtgtgtgaagccaggcctgtgccgctgcaagccaggcttcttcggggcccactgcagcagccgctgccccggccagtactggggccctgactgccgggagagctgcccctgccacccccacggccagtgtgagcccgccactggagcctgccagtgccaggccgaccgctggggcgcccgctgtgagttcccctgtgcctgtggcccccacggccgctgtgaccctgccactggagtgtgccactgtgagcccggctggtggagcagcacctgccggcggccctgccagtgcaacacagctgctgcccgctgtgagcaggccaccggggcctgtgtgtgcaagccaggctggtggggccgccgctgcagcttccgctgcaactgccacggcagcccctgtgagcaggacagcggccgctgtgcctgccggcccggctggtggggccctgagtgccagcagcagtgtgaatgtgtgcggggccgctgcagcgctgccagcggggagtgcacctgccccccaggcttccggggggcccgctgtgagctgccctgcccagctggcagccatggagtgcagtgtgcccacagctgtggccgctgcaagcacaatgagccctgcagcccagacaccggcagctgtgagagctgtgagcccggctggaatggcacccagtgccagcagccctgcctgcccggcaccttcggggagagctgtgagcagcagtgcccccactgcagacatggagaggcctgtgagccagacaccggccactgccagagatgtgaccccggctggctgggcccccgctgtgaggacccctgccccaccggcacctttggagaggactgtggcagcacctgccccacctgtgtgcagggcagctgtgacacagtgactggagactgtgtgtgcagcgctggctactggggccccagctgcaatgccagctgcccagctggcttccacggcaacaactgcagcgtgccctgtgaatgtcctgagggcctgtgccaccctgtgtctggcagctgccagcccggcagcggcagccgggacacagccctgattgctggcagcctggtgcccctgctgctgctcttcctgggcctggcctgctgtgcctgctgctgctgggcccccaggagtgacctgaaggacaggcctgccagagatggagccaccgtgtccaggatgaagctgcaggtgtggggcaccctgaccagcctgggcagcaccctgccctgccgcagcctgagcagccacaagctgccctgggtgacagtgagccaccacgaccctgaggtgcccttcaaccacagcttcatcgagccccccagcgctggctgggccacagatgacagcttcagcagtgaccctgagagcggggaggctgatgaggtgcctgcctactgtgtgcccccccaggagggcatggtgcctgtggcccaggccggcagcagcgaggccagcctggccgccggggccttccccccaccagaagatgccagcaccccatttgccatccccaggaccagcagcctggcccgggccaagaggccttctgtgtcctttgctgagggcaccaagtttgccccccagagcagaagaagcagcggggagctgagcagccccctgaggaagcccaagaggctgagcagaggagcccagagcggccctgagggccgggaggccgaggagagcacaggccctgaggaggccgaggcccctgagagcttccctgctgctgccagccctggggacagcgccaccggccacagaagaccacccctgggcggccgcacagtggccgagcacgtggaggccatcgagggctctgtgcaggagagcagcggccctgtgaccaccatctacatgctggccggcaagccccggggcagcgagggccctgtgcgctctgtgttccgccacttcggcagcttccagaagggccaggccgaggccaaggtgaagagggccatccccaagccaccccggcaggccctgaacaggaagaagggcagccctggcctggccagcggctctgtgggccagagccccaacagcgcccccaaggccggcctgcccggggccaccggccccatggctgtgcggcctgaggaggccgtgcggggcctgggcgccggcacagagagcagccggcgggcccaggagcctgtgtctggctgcggcagccctgagcaggacccccagaagcaggccgaggaggagcggcaggaggagccagaatatgaaaatgtggtgcccatcagcaggcctcctgagccctag

SEQ ID NO: 168906 - DNA, 2235 bp, Artificial Sequence
  Description of Artificial Sequence: Synthetic coding sequence
atgggcctgggcctgctgctgcccctgctgctgctgtggacccggggcacccagggcagcgagctggaccccaagggccagcacgtgtgtgtggccagcagccccagcgctgagctgcagtgctgtgccggctggaggcagaaggaccaggagtgcaccatccccatctgtgagggcccagatgcctgccagaaggatgaggtgtgtgtgaagccaggcctgtgccgctgcaagccaggcttcttcggggcccactgcagcagccgctgccccggccagtactggggccctgactgccgggagagctgcccctgccacccccacggccagtgtgagcccgccactggagcctgccagtgccaggccgaccgctggggcgcccgctgtgagttcccctgtgcctgtggcccccacggccgctgtgaccctgccactggagtgtgccactgtgagcccggctggtggagcagcacctgccggcggccctgccagtgcaacacagctgctgcccgctgtgagcaggccaccggggcctgtgtgtgcaagccaggctggtggggccgccgctgcagcttccgctgcaactgccacggcagcccctgtgagcaggacagcggccgctgtgcctgccggcccggctggtggggccctgagtgccagcagcagtgtgaatgtgtgcggggccgctgcagcgctgccagcggggagtgcacctgccccccaggcttccggggggcccgctgtgagctgccctgcccagctggcagccatggagtgcagtgtgcccacagctgtggccgctgcaagcacaatgagccctgcagcccagacaccggcagctgtgagagctgtgagcccggctggaatggcacccagtgccagcagccctgcctgcccggcaccttcggggagagctgtgagcagcagtgcccccactgcagacatggagaggcctgtgagccagacaccggccactgccagcgctgcagcggcagccgggacacagccctgattgctggcagcctggtgcccctgctgctgctcttcctgggcctggcctgctgtgcctgctgctgctgggcccccaggagtgacctgaaggacaggcctgccagagatggagccaccgtgtccaggatgaagctgcaggtgtggggcaccctgaccagcctgggcagcaccctgccctgccgcagcctgagcagccacaagctgccctgggtgacagtgagccaccacgaccctgaggtgcccttcaaccacagcttcatcgagccccccagcgctggctgggccacagatgacagcttcagcagtgaccctgagagcggggaggctgatgaggtgcctgcctactgtgtgcccccccaggagggcatggtgcctgtggcccaggccggcagcagcgaggccagcctggccgccggggccttccccccaccagaagatgccagcaccccatttgccatccccaggaccagcagcctggcccgggccaagaggccttctgtgtcctttgctgagggcaccaagtttgccccccagagcagaagaagcagcggggagctgagcagccccctgaggaagcccaagaggctgagcagaggagcccagagcggccctgagggccgggaggccgaggagagcacaggccctgaggaggccgaggcccctgagagcttccctgctgctgccagccctggggacagcgccaccggccacagaagaccacccctgggcggccgcacagtggccgagcacgtggaggccatcgagggctctgtgcaggagagcagcggccctgtgaccaccatctacatgctggccggcaagccccggggcagcgagggccctgtgcgctctgtgttccgccacttcggcagcttccagaagggccaggccgaggccaaggtgaagagggccatccccaagccaccccggcaggccctgaacaggaagaagggcagccctggcctggccagcggctctgtgggccagagccccaacagcgcccccaaggccggcctgcccggggccaccggccccatggctgtgcggcctgaggaggccgtgcggggcctgggcgccggcacagagagcagccggcgggcccaggagcctgtgtctggctgcggcagccctgagcaggacccccagaagcaggccgaggaggagcggcaggaggagccagaatatgaaaatgtggtgcccatcagcaggcctcctgagccctag

SEQ ID NO: 168907 - DNA, 1710 bp, Artificial Sequence; identical to SEQ ID NO: 168903
  Description of Artificial Sequence: Synthetic coding sequence

SEQ ID NO: 168908 - DNA, 2595 bp, Artificial Sequence
  Description of Artificial Sequence: Synthetic coding sequence
atggagggcgccggccccagaggagctggccctgcccggaggagaggagctgggggcccccccagccccctgctgcccagcctgctgctgctgctgctgctgtggatgctgcctgacacagtggccccccaggagctgaacccccggggcagaaatgtgtgccgggcccctggcagccaggtgcccacctgctgtgccggctggaggcagcagggagatgaatgtggcattgctgtgtgtgagggcaacagcacctgcagtgaaaatgaggtgtgtgtgcggcctggagaatgtcgctgccgccacggctactttggagccaactgtgacaccaagtgcccccggcagttctggggccctgactgcaaggagctgtgcagctgccacccccacggccagtgtgaagatgtgacaggccagtgcacctgccacgcccggcgctggggcgcccgctgtgagcacgcctgccagtgccagcacggcacctgccaccccaggtctggggcctgccgctgtgagcccggctggtggggcgcccagtgtgccagcgcctgctactgcagcgccaccagccgctgtgacccccagacaggagcctgcctgtgccacgccggctggtggggccgcagctgcaacaaccagtgtgcctgcaacagcagcccctgtgagcagcagagcggccgctgccagtgccgggagaggaccttcggggcccgctgtgaccgctactgccagtgcttccggggccgctgccaccctgtggatggcacctgtgcctgtgagcccggctaccggggcaagtactgccgggagccctgcccagctggcttctacggcctgggctgcagaagaagatgtggccagtgcaagggccagcagccctgcaccgtggccgagggccgctgcctgacctgtgagcccggctggaatggcaccaagtgtgaccagccctgtgccaccggcttctatggagagggctgcagccaccgctgccccccctgcagagatggccacgcctgcaaccacgtgacaggcaagtgcacccgctgcaatgccggctggattggagacagatgtgagaccaagtgcagcaatggcacctacggggaggactgtgcctttgtgtgtgccgactgtggcagcggccactgtgacttccagagcggccgctgcctgtgcagccctggggtgcacggcccccactgcaatgtgacctgccccccaggcctgcatggagctgactgtgcccaggcctgcagctgccacgaggacacctgtgaccctgtgactggagcctgccacctggagaccaaccagaggaaaggagtgatgggcgctggggccctgctggtgctgctggtgtgcctgctgctgagcctgctgggctgctgctgtgcctgccggggcaaggaccccacccggcgggagctgagcctgggcaggaagaaggccccccaccggctgtgtggccgcttcagccgcatctccatgaagctgccccgcatccccctgcggcggcagaagctgcccaaggtggtggtggcccaccacgacctggacaacaccctgaactgcagcttcctggagccccccagcggcctggagcagcccagccccagctggagcagccgggccagcttcagcagctttgacaccacagatgagggccctgtgtactgtgtgccccatgaggaggccccagctgagagccgggaccctgaggtgcccaccgtgcctgctgaggccccagcccccagccctgtgcccctgaccaccccagccagcgctgaggaggccatccccctgcctgccagcagtgacagcgagaggtctgccagctctgtggagggccctgggggcgccctgtatgcccgggtggcccggcgggaggcccggcctgcccgggcccggggggagatcggcggcctgagcctgagccccagccctgagaggaggaagcccccacctccagaccctgccaccaagcccaaggtgtcctggattcatggcaagcacagcgctgctgctgctggccgggcccccagccccccacctcctggcagcgaggccgcccccagccccagcaagaggaagaggacccccagcgacaagagcgcccacacagtggagcacggcagccccaggacccgggaccccacccccaggcctcctggcctgcctgaggaggccacagccctggccgcccccagccccccccgggcccgggcccgggcccggcccggcctgctggagcccacagatgctgggggcccccccaggtctgccccagctgcctccatgctggccgcagatgtgcggggcaagaccaggagcctgggccgggcagaggtggccctgggcgcccagggcccccgggagaagccagccccaccccagaaggccaagaggtctgtgcccccagccagccctgcccgggcccccccagccacagagaccccaggccctgagaaggccgccacagacctgcctgcccctgagacccccaggaagaagacccccatccagaagccacccaggaagaagagccgggaggccgccggggagctgggccgggccggggcccccaccctgtag

SEQ ID NO: 168909 - DNA, 2598 bp, Artificial Sequence
  Description of Artificial Sequence: Synthetic coding sequence
atggagggcgccggccccagaggagctggccctgcccggaggagaggagctgggggcccccccagccccctgctgcccagcctgctgctgctgctgctgctgtggatgctgcctgacacagtggccccccaggagctgaacccccggggcagaaatgtgtgccgggcccctggcagccaggtgcccacctgctgtgccggctggaggcagcagggagatgaatgtggcattgctgtgtgtgagggcaacagcacctgcagtgaaaatgaggtgtgtgtgcggcctggagaatgtcgctgccgccacggctactttggagccaactgtgacaccaagtgcccccggcagttctggggccctgactgcaaggagctgtgcagctgccacccccacggccagtgtgaagatgtgacaggccagtgcacctgccacgcccggcgctggggcgcccgctgtgagcacgcctgccagtgccagcacggcacctgccaccccaggtctggggcctgccgctgtgagcccggctggtggggcgcccagtgtgccagcgcctgctactgcagcgccaccagccgctgtgacccccagacaggagcctgcctgtgccacgccggctggtggggccgcagctgcaacaaccagtgtgcctgcaacagcagcccctgtgagcagcagagcggccgctgccagtgccgggagaggaccttcggggcccgctgtgaccgctactgccagtgcttccggggccgctgccaccctgtggatggcacctgtgcctgtgagcccggctaccggggcaagtactgccgggagccctgcccagctggcttctacggcctgggctgcagaagaagatgtggccagtgcaagggccagcagccctgcaccgtggccgagggccgctgcctgacctgtgagcccggctggaatggcaccaagtgtgaccagccctgtgccaccggcttctatggagagggctgcagccaccgctgccccccctgcagagatggccacgcctgcaaccacgtgacaggcaagtgcacccgctgcaatgccggctggattggagacagatgtgagaccaagtgcagcaatggcacctacggggaggactgtgcctttgtgtgtgccgactgtggcagcggccactgtgacttccagagcggccgctgcctgtgcagccctggggtgcacggcccccactgcaatgtgacctgccccccaggcctgcatggagctgactgtgcccaggcctgcagctgccacgaggacacctgtgaccctgtgactggagcctgccacctggagaccaaccagaggaaaggagtgatgggcgctggggccctgctggtgctgctggtgtgcctgctgctgagcctgctgggctgctgctgtgcctgccggggcaaggaccccacccggcgggagctgagcctgggcaggaagaaggccccccaccggctgtgtggccgcttcagccgcatctccatgaagctgccccgcatccccctgcggcggcagaagctgcccaaggtggtggtggcccaccacgacctggacaacaccctgaactgcagcttcctggagccccccagcggcctggagcagcccagccccagctggagcagccgggccagcttcagcagctttgacaccacagatgagggccctgtgtactgtgtgccccatgaggaggccccagctgagagccgggaccctgaggtgcccaccgtgcctgctgaggccccagcccccagccctgtgcccctgaccaccccagccagcgctgaggaggccatccccctgcctgccagcagtgacagcgagaggtctgccagctctgtggagggccctgggggcgccctgtatgcccgggtggcccggcgggaggcccggcctgcccgggcccggggggagatcggcggcctgagcctgagccccagccctgagaggaggaagcccccacctccagaccctgccaccaagcccaaggtgtcctggattcatggcaagcacagcgctgctgctgctggccgggcccccagccccccacctcctggcagcgaggccgcccccagccccagcaagaggaagaggacccccagcgacaagagcgcccacacagtggagcacggcagccccaggacccgggaccccacccccaggcctcctggcctgcctgaggaggccacagccctggccgcccccagccccccccgggcccgggcccgggccgccccccggcccctgggcgcccatggaagaagaagaagccctgccaagagagctgaggccgcctccatgctggccgcagatgtgcggggcaagaccaggagcctgggccgggcagaggtggccctgggcgcccagggcccccgggagaagccagccccaccccagaaggccaagaggtctgtgcccccagccagccctgcccgggcccccccagccacagagaccccaggccctgagaaggccgccacagacctgcctgcccctgagacccccaggaagaagacccccatccagaagccacccaggaagaagagccgggaggccgccggggagctgggccgggccggggcccccaccctgtag

SEQ ID NO: 168910 - DNA, 1728 bp, Artificial Sequence
  Description of Artificial Sequence: Synthetic coding sequence
atgcacaaggaggccgagatgctgattggcccccagctggatgagaagcgctggggctggaggctgggagatggcagcgctgccccacccttcctgccccaggccctgtccttcctgctgctgctgcccctggccagcgccctgcagcccacccccctgcccttccaggagctgcggctggtgggcggccccagccgctgccggggccgcctggaggtgatgcatggaggctcctggggctctgtgtgtgatgatgactgggatgtggtggatgccaacgtggtgtgccggcagctgggctgcggcctggccctgcctgtgccccggcccctggccttcggccagggccggggccccatcctgctggacaacgtggagtgccggggccaggaggccgccctgtctgaatgtggcagccggggctggggcgtgcacaactgcttccactatgaagatgtggccgtgctgtgtgatgagttcctgcccacccagccccccaccaggaagatgctgaccagccgggccccacccaccaccctgcccaacgggaagtctgagggctctgtgcggctggtgggcggggccaacctgtgccagggccgggtggagatcctgcacagcggcctgtggggcaccgtgtgtgatgatgactggggcctgcctgatgctgctgtggtgtgccggcagctgggctgtggggccgccatggccgccaccaccaatgccttcttcggctacggcaccggccacatcctgctggacaacgtgcactgtgagggcggggagccccggctggccgcctgccagagcctgggctggggcgtgcacaactgtggccaccatgaagatgctggggccctgtgtgccggcctgggcccccccaccctgacagccctgcccagcagcgccacccgggaggactgggcctggcagacagaccccagcgccactggagtgggcccccagcccagccgggagacagccctgctgaccacagctgcctgggccgccggcaagaagagcggccgcctgcggctggtgggcggccctggcccctgccggggccgggtggaggtgctgcacgccggcggctggggcaccgtgtgtgatgatgactgggactttgctgatgcccgggtggcctgccgggaggccggctgcggccctgccctgggcgccaccggcctgggccacttcggctacggccggggccctgtgctgctggacaacgtgggctgtgccggcacagaggcccggctgagtgactgcttccacctgggctggggccagcacaactgtggccaccatgaagatgctggggccctgtgtgccggccctgaggagctgggcctgcaggtgcagcaggacggcagcgagaccaccagggtgcccaccccccggcccagagatggccacctgcggctggtgaatggagcccaccgctgtgagggccgggtggagctgtacctgggccagcgctggggcaccgtgtgtgatgatgcctgggacctgcgggctgctggggtgctgtgccggcagctgggctgcggccaggccctggccgcccctggagaggcccacttcggccctggccggggccccatcctgctggacaacgtgaagtgccgcggggaggagagcgccctgctgctgtgcagccacatccgctgggatgcccacaactgtgaccacagtgaagatgcctctgtgctgtgccagcccagctag

SEQ ID NO: 168911 - DNA, 849 bp, Artificial Sequence
  Description of Artificial Sequence: Synthetic coding sequence
atgagcaatgtgaccctgaggaagatgagccccactggaaatgagatgaagagcaccacccagggcaccaccaggaagcagcaggacttccacgaggtgaacaagaggaggaccttcctgcaggacaacagctggatcaagaagaggcctgaggaggagaaggatgagaactacggccgggtggtgctgaacagacacaacagccatgatgccctggacaggaaggtgaatgaaagagatgtgcccaaggccaccatcagccgctacagcagtgatgacaccctggaccgctccatgtccatgttccgcagcctggaggtgaccaagctgcagcccggcggcagcctgaatgccaacaccagcaacaccatcgccagcaccagcgccaccacccctgtgaagaagaagaggcagagctggttccccccacctcctcctggctacaatgccagcagcagcacaggcacccggcggcgggagcccggggtgcacccccccatcccccccaagcccagcagccctgtgagcagccccaaccagctgcggcaggacaaccggcagatccacccccccaagccaggagtgtacacagagaccaacagatctgctgagaggaacatcagcgaggagctggacaacctgatcaagatgaacaagagcctgaacagaaaccagggcctggacagcctcttccgggccaaccccaaggtggaggagcgggagaagagggccaagagcctggagagcctcatctacatgagcaccaggacagacaaggatggcaagggcatccagagcctgggcagccccatcaaggtgaaccagaggacagacaagaatgagaagtag

SEQ ID NO: 168912 - DNA, 2067 bp, Artificial Sequence
  Description of Artificial Sequence: Synthetic coding sequence
atgagcaatgtgaccctgaggaagatgagccccactggaaatgagatgaagagcaccacccagggcaccaccaggaagcagcaggacttccacgaggtgaacaagaggaggaccttcctgcaggacaacagctggatcaagaagaggcctgaggaggagaaggatgagaactacggccgggtggtgctgaacagacacaacagccatgatgccctggacaggaaggtgaatgaaagagatgtgcccaaggccaccatcagccgctacagcagtgatgacaccctggaccgcatcagtgacagaaatgatgctgccaagacctacaaggccaacaccctggacaaccagctgaccaacagatccatgtccatgttccgcagcctggaggtgaccaagctgcagcccggcggcagcctgaatgccaacaccagcaacaccatcgccagcaccagcgccaccacccctgtgaagaagaagaggcagagctggttccccccacctcctcctggctacaatgccagcagcagcacaggcaccaggagaagagagcccggggtgcacccccccatcccccccaagcccagcagccctgtgagcagccccaaccagctgcggcaggacaaccggcagatccacccccccaagccaggagtgtacacagagaccaacagatctgctgagaggaacatccgcagccaggacctggacaacatcgtgaaggtggccaccagcctgcagaggagtgacaagggggaggagctggacaacctgatcaagatgaacaagagcctgaacagaaaccagggcctggacagcctcttccgggccaaccccaaggtggaggagcgggagaagagggccaagagcctggagagcctcatctacatgagcaccaggacagacaaggatggcaagggcatccagagcctgggcagccccatcaaggtgaaccagaggacagacaagaatgagaagggccggcagaacctggagagcgtggccaaggtgaatgccaggatgaacaagaccagcagaagaagtgaggacctggacaatgccacagaggtgaaccccaagggccacgagaacaccaccgggaagaaggacctggatggcctcatcaaggtggaccctgagaccaacaagaacatcacccggggccagagcctggacaacctgatcaaggtgaccccagaggtgaagaggagcaaccagggcagcaaggacctgaacaacttcatcaaggtgtacccaggcacagagaagagcacagagggcggccagagcctggacagcctcatcaaggtgaccccagagaggaacagaaccaaccagggcaaccaggacctggagaacctgatcaaggtgatccccagcgccaacaagagcagcgagcagggcctggatgagcacatcaacgtgagccccaaggctgtgaagaacacagatggcaagcaggacctggacaagctgatcaaggtgaaccctgagatcttcaccaacaaccagaggaaccaggacctggccaacctgatcaaggtgaacccagctgtgatccggaacaaccagagccaggacctggacaacctgatcaaggtgaagcccagcgccctgaggaacaccaacagagaccagaacctggagaacctgattgaggtgaacagccacgtgtctgagaacaagaatggcagcagcaacacaggagccaagcaggccggcccccaggacacagtggtgtacaccaggacctacgtggagaacagcaagagccccaaggatggctaccaggagaacatcagcggcaagtacatccagacagtgtacagcaccagtgacaggagcgtcatcgagcgggacatgtgcacctactgcaggaagcccctgggcgtggagaccaagatgatcctggatgagctgcagatctgctgccacagcacctgcttcaagtgtgagatctgcaagcagcccctggagaacctgcaggccggggacagcatctggatctaccggcagaccatccactgtgagccctgctacagcaagatcatggccaagtggatcccctag

SEQ ID NO: 168913 - DNA, 2007 bp, Artificial Sequence
  Description of Artificial Sequence: Synthetic coding sequence
atgagcaatgtgaccctgaggaagatgagccccactggaaatgagatgaagagcaccacccagggcaccaccaggaagcagcaggacttccacgaggtgaacaagaggaggaccttcctgcaggacaacagctggatcaagaagaggcctgaggaggagaaggatgagaactacggccgggtggtgctgaacagacacaacagccatgatgccctggacaggaaggtgaatgaaagagatgtgcccaaggccaccatcagccgctacagcagtgatgacaccctggaccgcatcagtgacagaaatgatgctgccaagacctacaaggccaacaccctggacaaccagctgaccaacagatccatgtccatgttccgcagcctggaggtgaccaagctgcagcccggcggcagcctgaatgccaacaccagcaacaccatcgccagcaccagcgccaccacccctgtgaagaagaagaggcagagctggttccccccacctcctcctggctacaatgccagcagcagcacaggcaccaggagaagagagcccggggtgcacccccccatcccccccaagcccagcagccctgtgagcagccccaaccagctgcggcaggacaaccggcagatccacccccccaagccaggagtgtacacagagaccaacagatctgctgagaggaacatcagcgaggagctggacaacctgatcaagatgaacaagagcctgaacagaaaccagggcctggacagcctcttccgggccaaccccaaggtggaggagcgggagaagagggccaagagcctggagagcctcatctacatgagcaccaggacagacaaggatggcaagggcatccagagcctgggcagccccatcaaggtgaaccagaggacagacaagaatgagaagggccggcagaacctggagagcgtggccaaggtgaatgccaggatgaacaagaccagcagaagaagtgaggacctggacaatgccacagaggtgaaccccaagggccacgagaacaccaccgggaagaaggacctggatggcctcatcaaggtggaccctgagaccaacaagaacatcacccggggccagagcctggacaacctgatcaaggtgaccccagaggtgaagaggagcaaccagggcagcaaggacctgaacaacttcatcaaggtgtacccaggcacagagaagagcacagagggcggccagagcctggacagcctcatcaaggtgaccccagagaggaacagaaccaaccagggcaaccaggacctggagaacctgatcaaggtgatccccagcgccaacaagagcagcgagcagggcctggatgagcacatcaacgtgagccccaaggctgtgaagaacacagatggcaagcaggacctggacaagctgatcaaggtgaaccctgagatcttcaccaacaaccagaggaaccaggacctggccaacctgatcaaggtgaacccagctgtgatccggaacaaccagagccaggacctggacaacctgatcaaggtgaagcccagcgccctgaggaacaccaacagagaccagaacctggagaacctgattgaggtgaacagccacgtgtctgagaacaagaatggcagcagcaacacaggagccaagcaggccggcccccaggacacagtggtgtacaccaggacctacgtggagaacagcaagagccccaaggatggctaccaggagaacatcagcggcaagtacatccagacagtgtacagcaccagtgacaggagcgtcatcgagcgggacatgtgcacctactgcaggaagcccctgggcgtggagaccaagatgatcctggatgagctgcagatctgctgccacagcacctgcttcaagtgtgagatctgcaagcagcccctggagaacctgcaggccggggacagcatctggatctaccggcagaccatccactgtgagccctgctacagcaagatcatggccaagtggatcccctag

SEQ ID NO: 168914 - DNA, 1941 bp, Artificial Sequence
  Description of Artificial Sequence: Synthetic coding sequence
atgagcaatgtgaccctgaggaagatgagccccactggaaatgagatgaagagcaccacccagggcaccaccaggaagcagcaggacttccacgaggtgaacaagaggaggaccttcctgcaggacaacagctggatcaagaagaggcctgaggaggagaaggatgagaactacggccgggtggtgctgaacagacacaacagccatgatgccctggacaggaaggtgaatgaaagagatgtgcccaaggccaccatcagccgctacagcagtgatgacaccctggaccgcatcagtgacagaaatgatgctgccaagacctacaaggccaacaccctggacaaccagctgaccaacagatccatgtccatgttccgcagcctggaggtgaccaagctgcagcccggcggcagcctgaatgccaacaccagcaacaccatcgccagcaccagcgccaccacccctgtgaagaagaagcgggagcccggggtgcacccccccatcccccccaagcccagcagccctgtgagcagccccaaccagctgcggcaggacaaccggcagatccacccccccaagccaggagtgtacacagagaccaacagatctgctgagaggaacatccgcagccaggacctggacaacatcgtgaaggtggccaccagcctgcagaggagtgacaagggggaggagctggacaacctgatcaagatgaacaagagcctgaacagaaaccagggcctggacagcctcttccgggccaaccccaaggtggaggagcgggagaagagggccaagagcctggagagcctcatctacatgagcaccaggacagacaaggatggcaagggcatccagagcctgggcagccccatcaaggtgaaccagaggacagacaagaatgagaagggccggcagaacctggagagcgtggccaaggtgaatgccaggatgaacaagaccagcagaagaagtgaggacctggacaatgccacagaggtgaaccccaagggccacgagaacaccactggaggccagagcctggacaacctgatcaaggtgaccccagaggtgaagaggagcaaccagggcagcaaggacctgaacaacttcatcaaggtgtacccaggcacagagaagagcacagagggcggccagagcctggacagcctcatcaaggtgaccccagagaggaacagaaccaaccagggcaaccaggacctggagaacctgatcaaggtgatccccagcgccaacaagagcagcgagcagggcctggatgagcacatcaacgtgagccccaaggctgtgaagaacacagatggcaagcaggacctggacaagctgatcaaggtgaaccctgagatcttcaccaacaaccagaggaaccaggacctggccaacctgatcaaggtgaacccagctgtgatccggaacaaccagagccaggacctggacaacctgatcaaggtgaagcccagcgccctgaggaacaccaacagagaccagaacctggagaacctgattgaggtgaacagccacgtgtctgagaacaagaatggcagcagcaacacaggagccaagcaggccggcccccaggacacagtggtgtacaccaggacctacgtggagaacagcaagagccccaaggatggctaccaggagaacatcagcggcaagtacatccagacagtgtacagcaccagtgacaggagcgtcatcgagcgggacatgtgcacctactgcaggaagcccctgggcgtggagaccaagatgatcctggatgagctgcagatctgctgccacagcacctgcttcaagtgtgagatctgcaagcagcccctggagaacctgcaggccggggacagcatctggatctaccggcagaccatccactgtgagccctgctacagcaagatcatggccaagtggatcccctag

SEQ ID NO: 168915 - DNA, 2148 bp, Artificial Sequence
  Description of Artificial Sequence: Synthetic coding sequence
atggcccgggagctgtaccacgaggagtttgcccgggccggcaagcaggccggcctgcaggtgtggagaattgagaagctggagctggtgcctgtgccccagagcgcccatggagacttctacgtgggagatgcctacctggtgctgcacacagccaagaccagccggggcttcacctaccacctgcacttctggctgggcaaggaatgttcccaggatgagagcacagctgctgccatcttcaccgtgcagatggatgactacctgggcggcaagcctgtgcagaaccgggagctgcagggctatgagagcaatgactttgtgtcctacttcaagggcggcctgaagtacaaggccggcggcgtggccagcggcctgaaccacgtgctgaccaatgacctgacagccaagaggctgctgcacgtgaagggcagaagagtggtgcgggccacagaggtgcccctgtcctgggacagcttcaacaagggggactgcttcatcatcgacctgggcacagagatctaccagtggtgtggcagcagctgcaacaagtatgagcggctgaaggccaaccaggtggccaccggcatccgctacaatgaaaggaagggccgctctgagctgattgtggtggaggagggcagcgagcccagcgagctgatcaaggtgctgggggagaagccagagctgcctgatggaggagatgatgatgacatcatcgctgacatcagcaacaggaagatggccaagctgtacatggtgtctgatgccagcggctccatgagggtgacagtggtggccgaggagaaccccttctccatggccatgctgctgtctgaggagtgcttcatcctggaccatggagctgccaagcagatctttgtgtggaagggcaaggatgccaacccccaggagaggaaggccgccatgaagacagctgaggagttcctgcagcagatgaactacagcaagaacacccagatccaggtgctgcctgagggcggggagacccccatcttcaagcagttcttcaaggactggagggacaaggaccagagtgatggctttgggaaggtgtatgtgacagagaaggtggcccagatcaagcagatcccctttgatgccagcaagctgcacagcagcccccagatggccgcccagcacaacatggtggatgatggcagcggcaaggtggagatctggagggtggagaacaacggccgcatccaggtggaccagaacagctatggagagttctacggcggggactgctacatcatcctgtacacctacccccggggccagatcatctacacctggcagggcgccaatgccaccagagatgagctgaccaccagcgccttcctgactgtgcagctggacaggagcctgggcggccaggccgtgcagatccgggtgtcccagggcaaggagcctgtgcacctgctgagcctcttcaaggacaagcccctcatcatctacaagaatggcaccagcaagaagggcggccaggccccagccccacccaccaggctcttccaggtgagaagaaacctggccagcatcaccagaattgtggaggtggatgtggatgccaacagcctgaacagcaatgatgtgtttgtgctgaagctgccccagaacagcggctacatctgggtgggcaagggggccagccaggaggaggagaagggagcagaatatgtggcctctgtgctgaagtgcaagaccctgcgcatccaggagggggaggagcctgaggagttctggaacagcctgggcggcaagaaggactaccagaccagccccctgctggagacccaggccgaggaccaccccccccggctgtatggctgcagcaacaagacaggccgcttcgtcatcgaggagatccctggagagttcacccaggatgacctggccgaggatgatgtgatgctgctggatgcctgggagcagatcttcatctggattggcaaggatgccaatgaggtggagaagaaggagagcctgaagagcgccaagatgtacctggagacagaccccagcggccgggacaagaggacccccatcgtcatcatcaagcagggccacgagccccccaccttcaccggctggttcctgggctgggacagcagcaagtggtag

SEQ ID NO: 168916 - DNA, 1407 bp, Artificial Sequence
  Description of Artificial Sequence: Synthetic coding sequence
atggccaagctgtacatggtgtctgatgccagcggctccatgagggtgacagtggtggccgaggagaaccccttctccatggccatgctgctgtctgaggagtgcttcatcctggaccacggggccgccaagcagatctttgtgtggaagggcaaggatgccaacccccaggagaggaaggccgccatgaagacagctgaggagttcctgcagcagatgaactacagcaagaacacccagatccaggtgctgcctgagggcggggagacccccatcttcaagcagttcttcaaggactggagggacaaggaccagagtgatggctttgggaaggtgtatgtgacagagaaggtggcccagatcaagcagatcccctttgatgccagcaagctgcacagcagcccccagatggccgcccagcacaacatggtggatgatggcagcggcaaggtggagatctggagggtggagaacaacggccgcatccaggtggaccagaacagctatggagagttctatggaggagactgctacatcatcctgtacacctacccccggggccagatcatctacacctggcagggcgccaatgccaccagagatgagctgaccaccagcgccttcctgactgtgcagctggacaggagcctgggcggccaggccgtgcagatccgggtgtcccagggcaaggagcctgtgcacctgctgagcctcttcaaggacaagcccctcatcatctacaagaatggcaccagcaagaagggcggccaggccccagccccacccaccaggctcttccaggtgagaagaaacctggccagcatcacccgcatcgtggaggtggatgtggatgccaacagcctgaacagcaatgatgtgtttgtgctgaagctgccccagaacagcggctacatctgggtgggcaaaggagccagccaggaggaggagaagggagcagaatatgtggcctctgtgctgaagtgcaagaccctgcgcatccaggagggggaggagcctgaggagttctggaacagcctgggcggcaagaaggactaccagaccagccccctgctggagacccaggccgaggaccaccccccccggctgtatggctgcagcaacaagacaggccgctttgtgattgaggagatccctggagagttcacccaggatgacctggctgaagatgatgtgatgctgctggatgcctgggagcagatcttcatctggattggcaaggatgccaatgaggtggagaagaaggagagcctgaagagcgccaagatgtacctggagacagaccccagcggccgggacaagaggacccccatcgtcatcatcaagcagggccacgagccccccaccttcaccggctggttcctgggctgggacagcagcaagtggtag

SEQ ID NO: 168917 - DNA, 1407 bp, Artificial Sequence; identical to SEQ ID NO: 168916
  Description of Artificial Sequence: Synthetic coding sequence

SEQ ID NO: 168918 - DNA, 3864 bp, Artificial Sequence
  Description of Artificial Sequence: Synthetic coding sequence
atggagcccatctacccctttgcccggccccagatgaacacccgcttccccagcagcaggatggtgcccttccacttcccccccagcaaatgtgccctgtggaaccccacccccactggagacttcatctacctgcacctgagctactacagaaaccccaagctggtggtgacagagaagaccatccggctggcctacagacatgccaagcagaacaagaagaacagcagctgcttcctgctgggcagcctgacagcagatgaagatgaggagggcgtgaccctgactgtggacagatttgaccccggccgggaggtgcctgagtgcctggagatcacccccacagccagcctgcccggggacttcctgatcccctgcaaggtgcacacccaggagctgtgcagccgggagatgattgtgcacagcgtggatgacttcagcagcgccctgaaggccctgcagtgccacatctgcagcaaggacagcctggactgtgggaagctgctgagcctgcgggtgcacatcaccagccgggagagcctggacagcgtggagtttgacctgcactgggccgctgtgaccctggccaacaacttcaagtgcacccctgtgaagcccatccccatcatccccacagccctggccaggaacctgagcagcaacctgaacatcagccaggtgcagggcacctacaagtatggctacctgaccatggatgagaccaggaagctgctgctgctgctggagagtgaccccaaggtgtacagcctgcccctggtgggcatctggctgagcggcatcacccacatctacagcccccaggtgtgggcctgctgcctgcgctacatcttcaacagctctgtgcaggagagggtcttcagcgagagcggcaacttcatcatcgtgctgtacagcatgacccacaaggagcctgagttctatgagtgcttcccctgtgatggcaagatcccagacttccgcttccagctgctgaccagcaaggagaccctgcacctgttcaagaatgtggagcccccagacaagaaccccatccgctgtgagctgtctgctgagagccagaatgctgagacagagttcttcagcaaggccagcaagaacttcagcatcaagaggagcagccagaagctgagcagcggcaagatgcccatccatgaccatgattctggagtggaggatgaggacttcagcccccggcccatccccagcccccaccctgtgtcccagaagatcagcaagatccagcccagcgtgcctgagctgagcctggtgctggatggcaacttcatcgagagcaaccccctgcccacccccctggagatggtgaacaatgaaaatcctcctctcatcaaccacctggagcacctgaagcccctgcagccccagctgtatgatgagaagcacagccctgaggtggaggccggggagcccagcctgcggggcatccccaaccagctgaaccaggacaagccagccctgctgcggcactgcaaggtgcggcagcccccagcctacaagaagggcaacccccacaccagaaattccatcaagcccagcagccacaacggccccagccatgacatctttgagaagctgcagacagtgtctgctggaaatgtgcagaatgaggagtaccccatccggcccagcaccctgaacagccggcagagcagcctggccccccagagccagccccatgactttgtgttcagcccccacaacagcggccggcccatggagctgcagatccccaccccacccctgcccagctactgcagcaccaacgtgtgccgctgctgccagcaccacagccacatccagtacagccccctgaacagctggcagggcgccaacacagtgggcagcatccaggatgtgcagagcgaggccctgcagaagcacagcctcttccaccccagcggctgcccagccctgtactgcaatgccttctgcagcagcagcagccccatcgccctgcggccccagggcgacatgggcagctgcagcccccacagcaacatcgagcccagccctgtggcccggccccccagccacatggacctgtgcaacccccagccctgcaccgtgtgcatgcacacccccaagacagaaagtgacaatggcatgatgggcctgagcccagatgcctaccgcttcctgacagagcaggaccggcagctgcggctgctgcaggcccagatccagaggctgctggaggcccagagcctgatgccctgcagccccaagaccacagctgtggaggacacagtgcaggccggccggcagatggagctggtgtctgtggaggcccagagcagccctggcctgcacatgaggaagggcgtgtccattgctgtgtccactggagccagcctcttctggaatgctgctggggaggaccaggagccagacagccagatgaagcaggatgacaccaagatcagcagcgaggacatgaacttctctgtggacatcaacaatgaggtgaccagcctgcccggcagcgccagcagcctgaaggctgtggacatccccagctttgaggagagcaacattgctgtggaggaggagttcaaccagcccctgtctgtgagcaacagcagcctggtggtgaggaaggagccagatgtgcctgtgttcttccccagcggccagctggccgagagcgtgtccatgtgcctgcagacaggccccactggaggagccagcaacaacagcgagaccagcgaggagcccaagattgagcacgtgatgcagcccctgctgcaccagcccagcgacaaccagaagatctaccaggacctgctgggccaggtgaaccacctgctgaacagcagcagcaaggagacagagcagcccagcaccaaggctgtgatcatcagccatgaatgtaccaggacccagaatgtgtaccacaccaagaagaagacccaccacagccggctggtggacaaggactgtgtgctgaatgccaccctgaagcagctgcggagcctgggcgtgaagattgacagccccaccaaggtgaagaagaatgcccacaacgtggaccacgcctctgtgctggcctgcatcagccctgaggccgtcatcagcggcctgaactgcatgagctttgccaacgtgggcatgagcggcctgagccccaacggggtggacctgtccatggaggccaatgccatcgccctgaagtacctgaatgaaaaccagctgagccagctgtctgtgaccaggagcaaccagaacaactgtgaccccttcagcctgctgcacatcaacacagacaggagcacagtgggcctgagcctcatcagccccaacaacatgagctttgccaccaagaagtacatgaagagatatggcctgctgcagagcagtgacaacagtgaagatgaggaggagcccccagacaatgctgacagcaagtctgagtacctgctgaaccagaacctgcggagcatccctgagcagctgggcggccagaaggagcccagcaagaatgaccacgagatcatcaactgcagcaactgtgagagcgtgggcaccaatgctgacacccctgtgctgaggaacatcaccaatgaggtgctgcagaccaaggccaagcagcagctgacagagaagccagccttcctggtgaagaacctgaagcccagccctgctgtgaacctgaggacaggcaaggccgagttcacccagcaccctgagaaggaaaatgaaggagacatcaccatcttccctgagagcctgcagcccagcgagaccctgaagcagatgaacagcatgaacagcgtgggcaccttcctggatgtgaagaggctgcggcagctgcccaagctgttctag

SEQ ID NO: 168919 - DNA, 3864 bp, Artificial Sequence; identical to SEQ ID NO: 168918
  Description of Artificial Sequence: Synthetic coding sequence

SEQ ID NO: 168920 - DNA, 3864 bp, Artificial Sequence; identical to SEQ ID NO: 168918
  Description of Artificial Sequence: Synthetic coding sequence

SEQ ID NO: 168921 - DNA, 633 bp, Artificial Sequence
  Description of Artificial Sequence: Synthetic coding sequence
cagctgtatgatgagaagcacagccctgaggtggaggccggggagcccagcctgcggggcatccccaaccagctgaaccaggacaagccagccctgctgcggcactgcaagccctgcaccgtgtgcatgcacacccccaagacagaaagtgacaatggcatgatgggcctgagcccagatgcctaccgcttcctgacagagcaggaccggcagctgcggctgctgcaggcccagatccagaggctgctggaggcccagagcctgatgccctgcagccccaagaccacagctgtggaggacacagtgcaggccggccggcagatggagctggtgtctgtggaggcccagagcagccctggcctgcacatgaggaaaggagtgtccattgctgtgtccactggagccagcctcttctggaatgctgctggggaggaccaggagccagacagccagatgaagcaggatgacaccaagatcagcagcgaggacatgaacttctctgtggacatcaacaatgaggtgaccagcctgcccggcagcgccagcagcctgaaggctgtggacatccccagctttgaggagagcaacattgctgtggaggaggagttcaaccagcccctgtctgtgtcctag

SEQ ID NO: 168922 - DNA, 3867 bp, Artificial Sequence
  Description of Artificial Sequence: Synthetic coding sequence
atggagcccatctacccctttgcccggccccagatgaacacccgcttccccagcagcaggatggtgcccttccacttcccccccagcaaatgtgccctgtggaaccccacccccactggagacttcatctacctgcacctgagctactacagaaaccccaagctggtggtgacagagaagaccatccggctggcctacagacatgccaagcagaacaagaagaacagcagctgcttcctgctgggcagcctgacagcagatgaagatgaggagggcgtgaccctgactgtggacagatttgaccccggccgggaggtgcctgagtgcctggagatcacccccacagccagcctgcccggggacttcctgatcccctgcaaggtgcacacccaggagctgtgcagccgggagatgattgtgcacagcgtggatgacttcagcagcgccctgaaggccctgcagtgccacatctgcagcaaggacagcctggactgtgggaagctgctgagcctgcgggtgcacatcaccagccgggagagcctggacagcgtggagtttgacctgcactgggccgctgtgaccctggccaacaacttcaagtgcacccctgtgaagcccatccccatcatccccacagccctggccaggaacctgagcagcaacctgaacatcagccaggtgcagggcacctacaagtatggctacctgaccatggatgagaccaggaagctgctgctgctgctggagagtgaccccaaggtgtacagcctgcccctggtgggcatctggctgagcggcatcacccacatctacagcccccaggtgtgggcctgctgcctgcgctacatcttcaacagctctgtgcaggagagggtcttcagcgagagcggcaacttcatcatcgtgctgtacagcatgacccacaaggagcctgagttctatgagtgcttcccctgtgatggcaagatcccagacttccgcttccagctgctgaccagcaaggagaccctgcacctgttcaagaatgtggagcccccagacaagaaccccatccgctgtgagctgtctgctgagagccagaatgctgagacagagttcttcagcaaggccagcaagaacttcagcatcaagaggagcagccagaagctgagcagcggcaagatgcccatccatgaccatgattctggagtggaggatgaggacttcagcccccggcccatccccagcccccaccctgtgtcccagaagatcagcaagatccagcccagcgtgcctgagctgagcctggtgctggatggcaacttcatcgagagcaaccccctgcccacccccctggagatggtgaacaatgaaaatcctcctctcatcaaccacctggagcacctgaagcccctgcagccccagctgtatgatgagaagcacagccctgaggtggaggccggggagcccagcctgcggggcatccccaaccagctgaaccaggacaagccagccctgctgcggcactgcaaggtgcggcagcccccagcctacaagaagggcaacccccacaccagaaattccatcaagcccagcagccacaacggccccagccatgacatctttgagaagctgcagacagtgtctgctggaaatgtgcagaatgaggagtaccccatccggcccagcaccctgaacagccggcagagcagcctggccccccagagccagccccatgactttgtgttcagcccccacaacagcggccggcccatggagctgcagatccccaccccacccctgcccagctactgcagcaccaacgtgtgccgctgctgccagcaccacagccacatccagtacagccccctgaacagctggcagggcgccaacacagtgggcagcatccaggatgtgcagagcgaggccctgcagaagcacagcctcttccaccccagcggctgcccagccctgtactgcaatgccttctgcagcagcagcagccccatcgccctgcggccccagggcgacatgggcagctgcagcccccacagcaacatcgagcccagccctgtggcccggccccccagccacatggacctgtgcaacccccagccctgcaccgtgtgcatgcacacccccaagacagaaagtgacaatggcatgatgggcctgagcccagatgcctaccgcttcctgacagagcaggaccggcagctgcggctgctgcaggcccagatccagaggctgctggaggcccagagcctgatgccctgcagccccaagaccacagctgtggaggacacagtgcaggccggccggcagatggagctggtgtctgtggaggcccagagcagccctggcctgcacatgaggaagggcgtgtccattgctgtgtccactggagccagcctcttctggaatgctgctggggaggaccaggagccagacagccagatgaagcaggatgacaccaagatcagcagcgaggacatgaacttctctgtggacatcaacaatgaggtgaccagcctgcccggcagcgccagcagcctgaaggctgtggacatccccagctttgaggagagcaacattgctgtggaggaggagttcaaccagcccctgtctgtgagcaacagcagcagcctggtggtgaggaaggagccagatgtgcctgtgttcttccccagcggccagctggccgagagcgtgtccatgtgcctgcagacaggccccaccggcggggccagcaacaacagcgagaccagcgaggagcccaagattgaacatgtgatgcagcccctgctgcaccagcccagcgacaaccagaagatctaccaggacctgctgggccaggtgaaccacctgctgaacagcagcagcaaggagacagagcagcccagcaccaaggccgtcatcatcagccatgagtgcaccaggacccagaatgtgtaccacaccaagaagaagacccaccacagccggctggtggacaaggactgtgtgctgaatgccaccctgaagcagctgcggagcctgggcgtgaagattgacagccccaccaaggtgaagaagaatgcccacaacgtggaccacgcctctgtgctggcctgcatcagccctgaggccgtcatcagcggcctgaactgcatgagctttgccaacgtgggcatgagcggcctgagccccaatggagtggacctgtccatggaggccaatgccatcgccctgaagtacctgaatgaaaaccagctgagccagctgtctgtgaccaggagcaaccagaacaactgtgaccccttcagcctgctgcacatcaacacagacaggagcacagtgggcctgagcctcatcagccccaacaacatgagctttgccaccaagaagtacatgaagagatatggcctgctgcagagcagtgacaacagtgaagatgaggaggagcccccagacaatgctgacagcaagtctgagtacctgctgaaccagaacctgcggagcatccctgagcagctgggcggccagaaggagcccagcaagaatgaccacgagatcatcaactgcagcaactgtgagagcgtgggcaccaatgctgacacccctgtgctgaggaacatcaccaatgaggtgctgcagaccaaggccaagcagcagctgacagagaagccagccttcctggtgaagaacctgaagcccagccctgctgtgaacctgaggacaggcaaggccgagttcacccagcaccctgagaaggaaaatgaaggagacatcaccatcttccctgagagcctgcagcccagcgagaccctgaagcagatgaacagcatgaacagcgtgggcaccttcctggatgtgaagaggctgcggcagctgcccaagctgttctag

SEQ ID NO: 168923 - DNA, 606 bp, Artificial Sequence
  Description of Artificial Sequence: Synthetic coding sequence
atgagctttgccaccctgcggcctgcccctcctggccgctacctgtacccagaggtgagccccctgtctgaagatgaggaccggggcagtgacagcagcggcagtgatgagaagccctgccgggtgcacgccgcccgctgtggcctgcagggcgcccggcggcgggccggcggcagaagagctgggggcggcggccctgggggccggcccggccgggagccccggcagaggcacacagccaatgcccgggagcgggacaggaccaacagcgtgaacacagccttcaccgccctgcggaccctcatccccacagagcctgctgacaggaagctgagcaagattgagaccctgcggctggccagcagctacatcagccacctgggcaatgtgctgctggccggggaggcctgtggagatggccagccctgccacagcggccctgccttcttccacgccgcccgggccggcagccccccacctcctcctcctcctcctccagccagagatggagagaacacccagcccaagcagatctgcaccttctgcctgagcaaccagaggaagctgagcaaggaccgggacaggaagacagccatccgctcctag

SEQ ID NO: 168924 - DNA, 642 bp, Artificial Sequence
  Description of Artificial Sequence: Synthetic coding sequence
atgcagctgcccctggccctgtgcctggtgtgcctgctggtgcacacagccttccgggtggtggagggccagggctggcaggccttcaagaatgatgccacagagatcatccctgagctgggggagtacccagagcccccacctgagctggagaacaacaagaccatgaacagagcagaaaatggaggccggcccccccaccacccctttgagaccaaggatgtgtctgagtacagctgccgggagctgcacttcacccgctacgtgacagatggcccctgccgcagcgccaagcctgtgacagagctggtgtgcagcggccagtgtggccctgcccggctgctgcccaatgccatcggccggggcaagtggtggaggcccagcggccctgacttccgctgcatcccagaccgctaccgggcccagagggtgcagctgctgtgccctggaggagaggccccccgggccaggaaggtgcggctggtggccagctgcaagtgcaagaggctgacccgcttccacaaccagagcgagctgaaggactttggaacagaggccgcccggccccagaagggcaggaagccccggccccgggcccggagcgccaaggccaaccaggccgagctggagaatgcctactag

SEQ ID NO: 168925 - DNA, 906 bp, Artificial Sequence
  Description of Artificial Sequence: Synthetic coding sequence
atggccatgctggtgctggtgcccggccgggtgatgaggcccctgggcggccagctgtggaggttcctgccccggggcctggagttctggggccctgctgagggcacagcccgggtgctgctgcggcagttctgtgcccggcaggccgaggcctggagggccagcggccggcccggctactgcctgggcacccggcccctgagcacagcccggcccccaccaccctggagccagaagggccctggggacagcacccggcccagcaagccaggccctgtgtcctggaagagcctggccatcacctttgccatcggcggggccctgctggccggcatgaagcacgtgaagaaggagaaggccgagaagctggagaaggagcggcagaggcacatcggcaagcccctgctgggcggccccttcagcctgaccacccacactggagagaggaagacagacaaggactacctgggccagtggctgctgatctacttcggcttcacccactgcccagatgtgtgcccagaggagctggagaagatgatccaggtggtggatgaaattgacagcatcaccaccctgcctgacctgacccccctcttcatcagcattgatcctgagcgggacaccaaggaggccatcgccaactacgtgaaggagttcagccccaagctggtgggcctgaccggcacccgggaggaggtggaccaggtggcccgggcctacagagtgtactacagccctggccccaaggatgaagatgaggactacatcgtggaccacaccatcatcatgtacctgattggaccagatggagagttcctggactacttcggccagaacaagaggaaaggagaaattgctgccagcatcgccacccacatgaggccctacaggaagaagagctag

SEQ ID NO: 168926 - DNA, 813 bp, Artificial Sequence
  Description of Artificial Sequence: Synthetic coding sequence
atggccatgctggtgctggtgcccggccgggtgatgaggcccctgggcggccagctgtggaggttcctgccccggggcctggagttctggggccctgctgagggcacagcccgggtgctgctgcggcagttctgtgcccggcaggccgaggcctggagggccagcggccggcccggctactgcctgggcacccggcccctgagcacagcccggcccccaccaccctggagccagaagggccctggggacagcacccggcccagcaagccaggccctgtgtcctggaagagcctggccatcacctttgccatcggcggggccctgctggccggcatgaagcacgtgaagaaggagaaggccgagaagctggagaaggagcggcagaggcacatcggcaagcccctgctgggcggccccttcagcctgaccacccacactggagagaggaagacagacaaggactacctggacagcatcaccaccctgcctgacctgacccccctcttcatcagcattgatcctgagcgggacaccaaggaggccatcgccaactacgtgaaggagttcagccccaagctggtgggcctgaccggcacccgggaggaggtggaccaggtggcccgggcctacagagtgtactacagccctggccccaaggatgaagatgaggactacatcgtggaccacaccatcatcatgtacctgattggaccagatggagagttcctggactacttcggccagaacaagaggaagggggagattgctgccagcatcgccacccacatgaggccctacaggaagaagagctag

SEQ ID NO: 168927 - DNA, 801 bp, Artificial Sequence
  Description of Artificial Sequence: Synthetic coding sequence
atgctgctgctgaccaggagccccacagcctggcaccggctgagccagctgaagccccgggtgctgcccggcaccctgggcggccaggccctgcacctgcgctcctggctgctgagccggcagggccctgctgagaccggcggccagggccagccccagggccctggcctgcggacccggctgctgatcaccggcctgtttggagctggcctgggcggggcctggctggccctgcgggcagagaaggagcggctgcagcagcagaagaggacagaggccctgcggcaggccgctgtgggccagggcgacttccacctgctggaccaccggggccgggcccgctgcaaggctgacttccggggccagtgggtgctgatgtacttcggcttcacccactgcccagacatctgcccagatgagctggagaagctggtgcaggtggtgcggcagctggaggccgagcccggcctgccccctgtgcagcccgtcttcatcaccgtggaccctgagagagatgatgtggaggccatggcccgctacgtgcaggacttccacccccggctgctgggcctgaccggcagcaccaagcaggtggcccaggccagccacagctacagagtgtactacaatgccggccccaaggatgaggaccaggactacatcgtggaccacagcatcgccatctacctgctgaacccagatggcctcttcacagactactacggccgcagccgctctgctgagcagatcagtgacagcgtgagaagacacatggccgccttccgctctgtgctgtcctag

SEQ ID NO: 168928 - DNA, 801 bp, Artificial Sequence; identical to SEQ ID NO: 168927
  Description of Artificial Sequence: Synthetic coding sequence

SEQ ID NO: 168929 - DNA, 411 bp, Artificial Sequence
  Description of Artificial Sequence: Synthetic coding sequence
atgctgctgctgaccaggagccccacagcctggcaccggctgagccagctgaagccccgggtgctgcccggcaccctgggcggccaggccctgcacctgcgctcctggctgctgagccggcagggccctgctgagaccggcggccagggccagccccagggccctggcctgcggacccggctgctgatcaccggcctgtttggagctggcctgggcggggcctggctggccctgcgggcagagaaggagcggctgcagcagcagaagaggacagaggccctgcggcaggccgctgtgggccagggcgacttccacctgctggaccaccggggccgggcccgctgcaaggctgacttccggggccagtgggtgctgatgtacttcggcttcacccactgcccagacatctag

SEQ ID NO: 168930 - DNA, 411 bp, Artificial Sequence; identical to SEQ ID NO: 168929
  Description of Artificial Sequence: Synthetic coding sequence

SEQ ID NO: 168931 - DNA, 801 bp, Artificial Sequence; identical to SEQ ID NO: 168927
  Description of Artificial Sequence: Synthetic coding sequence

SEQ ID NO: 168932 - DNA, 801 bp, Artificial Sequence; identical to SEQ ID NO: 168927
  Description of Artificial Sequence: Synthetic coding sequence

SEQ ID NO: 168933 - DNA, 1047 bp, Artificial Sequence
  Description of Artificial Sequence: Synthetic coding sequence
atgcccaggagcttcctggtgaagaaggtgaagctggatgccttcagcagcgctgacctggagagcgcctacggccgggcccggagtgacctgggcgcccccctgcatgacaagggctacctgagtgactatgtgggccccagctctgtgtatgatggagatgctgaggccgccctgctgaagggccccagccctgagcccatgtatgctgctgctgtgcggggggagctgggccctgctgctgctggcagcgcccccccacccacccccaggcctgagctggccacagctgctgggggctacatcaatggagatgctgctgtgtctgagggctatgctgctgatgccttcttcatcacagatggccgcagcaggaggaaggccagcaatgccggcagcgctgctgcccccagcacagccagcgctgctgccccagatggagatgctgggggcggcggcggggccggcggccgcagcctgggcagcggccctgggggccggggcggcacccgggccggggccggcacagaggcccgggccggccctggagctgctggagctgggggcagacatgcctgtggagaatgtgggaagacctacgccaccagcagcaacctgagccgccacaagcagacccacaggagcctggacagccagctggcccggcgctgccccacctgtgggaaggtgtatgtgtccatgcctgccatggccatgcacctgctgacccatgacctgcggcacaagtgtggggtgtgtgggaaggccttcagccggccctggctgctgcagggccacatgaggagccacactggagagaagcccttcggctgtgcccactgcggcaaggcctttgctgacaggagcaacctgcgggcccacatgcagacccacagcgccttcaagcacttccagtgcaagcgctgcaagaagagctttgccctgaagagctacctgaacaagcactatgaaagtgcctgcttcaagggcggggccggcggccctgctgccccagccccaccccagctgagccctgtgcaggcctag

SEQ ID NO: 168934 - DNA, 4893 bp, Artificial Sequence
  Description of Artificial Sequence: Synthetic coding sequence
atgctgaagtgcatccccctgtggcgctgcaacagacatgtggagagcgtggacaagaggcactgcagcctgcaggccgtgcctgaggagatctaccgctacagccgcagcctggaggagctgctgctggatgccaaccagctgcgggagctgcccaagcccttcttccggctgctgaacctgaggaagctgggcctgagtgacaatgagatccagaggctgcccccagaggtggccaacttcatgcagctggtggagctggatgtgtccagaaatgacatccctgagatccctgagagcatcaagttctgcaaggccctggagattgctgacttcagcggcaaccccctgagccggctgcctgatggcttcacccagctgcggagcctggcccacctggccctgaatgatgtgtccctgcaggccctgcctggagatgtgggcaacctggccaacctggtgaccctggagctgcgggagaacctgctgaagagcctgcctgccagcctgtccttcctggtgaagctggagcagctggacctgggcggcaatgacctggaggtgctgcctgacaccctgggcgccctgcccaacctgcgggagctgtggctggacaggaaccagctgagcgccctgcccccagagctgggcaacctgcggcggctggtgtgcctggatgtgtctgaaaatcggctggaggagctgcctgctgagctgggcggcctggtgctgctgacagacctgctgctgagccagaacctgctgcggcggctgcctgatggcatcggccagctgaagcagctgagcatcctgaaggtggaccagaaccggctgtgtgaggtgacagaggccatcggggactgtgagaacctgtctgagctgatcctgacagagaacctgctgatggccctgcccaggagcctgggcaagctgaccaagctgaccaacctgaatgtggacaggaaccacctggaggccctgcccccagaaattggaggctgtgtggccctgtctgtgctgagcctgcgggacaaccggctggccgtgctgcccccagagctggcccacaccacagagctgcacgtgctggatgtggccggcaaccggctgcagagcctgccctttgccctgacccacctgaacctgaaggccctgtggctggccgagaaccaggcccagcccatgctgcgcttccagacagaagatgatgccaggactggagagaaggtgctgacctgctacctgctgccccagcagcccccacccagcctggaggatgctggccagcagggcagcctgtctgagacctggagcgatgccccacccagccgggtgtctgtcatccagttcctggaggcccccatcggagatgaagatgctgaggaggccgctgctgagaagaggggcctgcagaggcgggccaccccccaccccagcgagctgaaggtgatgaagaggagcattgagggcagaagaagtgaggcctgcccctgccagcctgacagcggcagccccctgcctgctgaggaggagaagaggctgtctgctgagagcggcctgtctgaggacagccggcccagcgccagcacagtgtctgaggccgagcctgagggccccagcgctgaggcccagggcggcagccagcaggaggccaccacagctggaggagaggaggatgctgaggaggactaccaggagcccaccgtgcactttgctgaagatgccctgctgcctggagatgaccgggagattgaggagggccagcctgaggccccctggaccctgcccggcggccggcagaggctcatcaggaaggacaccccccactacaagaagcacttcaagatcagcaagctgccccagcctgaggccgtggtggccctgctgcagggcatgcagccagatggagagggccctgtggcccctgggggctggcacaacggcccccacgccccctgggccccccgggcccagaaggaggaggaggaggaggaggagggcagcccccaggaggaggaggtggaggaggaggaggagaacagagctgaggaggaggaggccagcacagaggaggaggacaaggagggcgctgtggtgtctgcccccagcgtgaagggcgtgtcctttgaccaggccaacaacctgctgattgaaccagcccgcatcgaggaggaggagctgaccctgaccatcctgcggcagacaggaggcctgggcatcagcattgctgggggcaagggcagcaccccctacaagggagatgatgagggcatcttcatcagccgggtgtctgaggagggccctgctgcccgggccggcgtgcgggtgggggacaagctgctggaggtgaatggagtggccctgcagggcgctgagcaccacgaggccgtggaggccctgcggggagctggaacagctgtgcagatgagggtgtggagggagaggatggtggagccagaaaatgctgtgaccatcacccccctgcggccagaagatgactacagcccccgggagaggagaggaggcggcctgcggctgcccctgctgcccccagagagccctggccccctgcggcagagacatgtggcctgcctggcccggtctgagcggggcctgggcttcagcattgctgggggcaagggcagcaccccctacagagctggagatgctggcatctttgtgtccagaattgctgagggcggggccgcccaccgggccggcaccctgcaggtgggggacagagtgctgagcatcaatggagtggatgtgacagaggcccggcatgaccatgctgtgtccctgctgacagctgccagccccaccatcgccctgctgctggagcgggaggccggcggccccctgccccccagccccctgccccacagcagccccccaacagctgctgtggccaccaccagcatcaccacagccaccccaggagtgcccggcctgcccagcctggcccccagcctgctggccgccgccctggagggcccctaccctgtggaggagatccggctgccccgggccggcggccccctgggcctgagcatcgtgggcggcagtgaccacagcagccacccctttggagtgcaggagcccggggtcttcatcagcaaggtgctgccccggggcctggccgcccggagcggcctgcgggtgggggaccgcatcctggccgtgaatggccaggatgtgagagatgccacccaccaggaggccgtgtctgccctgctgcggccctgcctggagctgagcctgctggtgcggcgggaccctgcccctcctggcctgcgggagctgtgcatccagaaggcccctggagagcggctgggcatcagcatccggggcggggcccggggccatgctggcaacccccgggaccccacagatgagggcatcttcatcagcaaggtgagccccaccggggctgctggaagagatggccgcctgcgggtgggcctgcggctgctggaggtgaaccagcagagcctgctgggcctgacccacggggaggccgtgcagctgctgcggtctgtgggggacaccctgactgtgctggtgtgtgatggctttgaggccagcacagatgctgccctggaggtgtcccctggggtgattgccaacccctttgctgctggcatcggccacaggaacagcctggagagcatcagcagcattgaccgggagctgagccctgagggccctgggaaggagaaggagctgcccggccagaccctgcactggggccctgaggccacagaggccgccggccggggcctgcagcccctgaagctggactaccgggccctggccgctgtgcccagcgctggctctgtgcagagggtgcccagcggggccgccggcggcaagatggccgagagcccctgcagccccagcggccagcagccccccagcccccccagcccagatgagctgcctgccaacgtgaagcaggcctaccgggcctttgctgctgtgcccaccagccaccccccagaagatgccccagcccagccccccaccccaggccctgctgccagccctgagcagctgtccttccgggagcggcagaagtactttgagctggaggtgcgggtgccccaggccgagggcccccccaagagggtgtccctggtgggcgcagatgacctgaggaagatgcaggaggaggaggccaggaagctgcagcagaagagggcccagatgctgcgggaggccgctgaggccggggctgaggcccggctggccctggatggagagaccctgggggaggaggagcaggaggatgagcagcccccctgggccagccccagccccaccagccggcagagccctgccagccccccacccctgggcggcggggcccctgtgaggacagccaaggccgagaggaggcaccaggagcggctgcgggtgcagagccctgagcccccagcccctgagcgggccctgagccctgctgagctgcgggccctggaggccgagaagagggccctgtggagggctgccaggatgaagagcctggagcaggatgccctgcgggcccagatggtgctgagccgcagccaggagggccggggcacccggggccccctggagcggctggccgaggcccccagccctgcccccacccccagccccacccctgtggaggacctgggcccccagaccagcaccagccctggccgcctgagcccagactttgctgaggagctgcggagcctggagcccagccccagccctggcccccaggaggaggatggagaggtggccctggtgctgctgggccggcccagccctggagctgtgggcccagaagatgtggccctgtgcagcagcagaagacctgtgcggcccggccggcggggcctgggccctgtgcccagctag

SEQ ID NO: 168935 - DNA, 4650 bp, Artificial Sequence
  Description of Artificial Sequence: Synthetic coding sequence
atgcagctggtggagctggatgtgtccagaaatgacatccctgagatccctgagagcatcaagttctgcaaggccctggagattgctgacttcagcggcaaccccctgagccggctgcctgatggcttcacccagctgcggagcctggcccacctggccctgaatgatgtgtccctgcaggccctgcctggagatgtgggcaacctggccaacctggtgaccctggagctgcgggagaacctgctgaagagcctgcctgccagcctgtccttcctggtgaagctggagcagctggacctgggcggcaatgacctggaggtgctgcctgacaccctgggcgccctgcccaacctgcgggagctgtggctggacaggaaccagctgagcgccctgcccccagagctgggcaacctgcggcggctggtgtgcctggatgtgtctgagaaccggctggaggagctgcctgctgagctgggcggcctggtgctgctgacagacctgctgctgagccagaacctgctgcggcggctgcctgatggcatcggccagctgaagcagctgagcatcctgaaggtggaccagaaccggctgtgtgaggtgacagaggccatcggggactgtgagaacctgtctgagctgatcctgacagagaacctgctgatggccctgcccaggagcctgggcaagctgaccaagctgaccaacctgaatgtggacaggaaccacctggaggccctgcccccagagatcggcggctgtgtggccctgtctgtgctgagcctgcgggacaaccggctggccgtgctgcccccagagctggcccacaccacagagctgcacgtgctggatgtggccggcaaccggctgcagagcctgccctttgccctgacccacctgaacctgaaggccctgtggctggccgagaaccaggcccagcccatgctgcgcttccagacagaagatgatgccaggactggagagaaggtgctgacctgctacctgctgccccagcagcccccacccagcctggaggatgctggccagcagggcagcctgtctgagacctggagcgatgccccacccagccgggtgtctgtcatccagttcctggaggcccccatcggagatgaagatgctgaggaggccgctgctgagaagaggggcctgcagaggcgggccaccccccaccccagcgagctgaaggtgatgaagaggagcattgagggccgccgctctgaggcctgcccctgccagccagattctggcagccccctgcctgctgaggaggagaagaggctgtctgctgagagcggcctgtctgaggacagccggcccagcgccagcacagtgtctgaggccgagcctgagggccccagcgctgaggcccagggcggcagccagcaggaggccaccacagctggaggagaagaagatgctgaggaggactaccaggagcccaccgtgcactttgctgaagatgccctgctgcctggagatgaccgggagattgaggagggccagcctgaggccccctggaccctgcccggcggccggcagaggctcatcaggaaggacaccccccactacaagaagcacttcaagatcagcaagctgccccagcctgaggccgtggtggccctgctgcagggcatgcagccagatggagagggccctgtggcccctgggggctggcacaacggcccccacgccccctgggccccccgggcccagaaggaggaggaggaggaggaggagggcagcccccaggaggaggaggtggaggaggaggaggagaacagagctgaggaggaggaggccagcacagaggaggaggacaaggagggcgctgtggtgtctgcccccagcgtgaagggcgtgtcctttgaccaggccaacaacctgctgattgagcccgccagaattgaggaggaggagctgaccctgaccatcctgcggcagacaggaggcctgggcatcagcattgctgggggcaagggcagcaccccctacaagggagatgatgagggcatcttcatcagccgggtgtctgaggagggccctgctgcccgggccggcgtgcgggtgggggacaagctgctggaggtgaatggagtggccctgcagggcgctgagcaccatgaagctgtggaggccctgcggggggccggcacagctgtgcagatgagggtgtggagggagaggatggtggagccagaaaatgctgtgaccatcacccccctgcggccagaagatgactacagcccccgggagcggcggggcggcggcctgcggctgcccctgctgcccccagagagccctggccccctgcggcagagacatgtggcctgcctggcccggtctgagcggggcctgggcttcagcattgctgggggcaagggcagcaccccctacagagctggagatgctggcatctttgtgtccagaattgctgagggcggggccgcccacagagctggcaccctgcaggtgggggacagagtgctgagcatcaacggggtggatgtgacagaggcccggcatgaccatgctgtgtccctgctgacagctgccagccccaccatcgccctgctgctggagcgggaggccggcggccccctgccccccagccccctgccccacagcagccccccaacagctgctgtggccaccaccagcatcaccacagccaccccaggagtgcccggcctgcccagcctggcccccagcctgctggccgccgccctggagggcccctaccctgtggaggagatccggctgcccagggctgggggccccctgggcctgagcatcgtgggcggcagtgaccacagcagccaccccttcggcgtgcaggagcccggggtcttcatcagcaaggtgctgccccggggcctggccgcccggagcggcctgcgggtgggggaccgcatcctggccgtgaatggccaggatgtgagagatgccacccaccaggaggccgtgtctgccctgctgcggccctgcctggagctgagcctgctggtgagaagagatcctgcccctcctggcctgcgggagctgtgcatccagaaggcccctggagagcggctgggcatcagcatccggggcggggcccggggccacgccggcaacccccgggaccccacagatgagggcatcttcatcagcaaggtgagccccactggagctgctggaagagatggccgcctgcgggtgggcctgcggctgctggaggtgaaccagcagagcctgctgggcctgacccatggagaggccgtgcagctgctgcggtctgtgggggacaccctgactgtgctggtgtgtgatggctttgaggccagcacagatgctgccctggaggtgtccccaggagtcatcgccaacccctttgctgctggcatcggccacaggaacagcctggagagcatcagcagcattgaccgggagctgagccctgagggccctgggaaggagaaggagctgcccggccagaccctgcactggggccctgaggccacagaagctgctggccggggcctgcagcccctgaagctggactaccgggccctggccgctgtgcccagcgctggctctgtgcagagggtgcccagcggggctgctgggggcaagatggccgagagcccctgcagccccagcggccagcagccccccagcccccccagcccagatgagctgcctgccaacgtgaagcaggcctaccgggcctttgctgctgtgcccaccagccaccccccagaagatgccccagcccagccccccaccccaggccctgctgccagccctgagcagctgtccttccgggagcggcagaagtactttgagctggaggtgcgggtgccccaggccgagggcccccccaagagggtgtccctggtgggcgcagatgacctgaggaagatgcaggaggaggaggccaggaagctgcagcagaagagggcccagatgctgcgggaggccgctgaggccggggctgaggcccggctggccctggatggagagaccctgggggaggaggagcaggaggatgagcagcccccctgggccagccccagccccaccagccggcagagccctgccagccccccacccctgggcggcggggcccctgtgaggacagccaaggccgagcggcggcaccaggagcggctgcgggtgcagagccctgagcccccagcccctgagcgggccctgagccctgctgagctgcgggccctggaggccgagaagagggccctgtggagggctgccaggatgaagagcctggagcaggatgccctgcgggcccagatggtgctgagccgcagccaggagggccggggcacccggggccccctggagcggctggccgaggcccccagccctgcccccacccccagccccacccctgtggaggacctgggcccccagaccagcaccagccctggccgcctgagcccagactttgctgaggagctgcggagcctggagcccagccccagccctggcccccaggaggaggatggagaggtggccctggtgctgctgggccggcccagccctggagctgtgggcccagaagatgtggccctgtgcagcagccggcggcctgtgcggcctggaagaagaggcctgggccctgtgcccagctag

SEQ ID NO: 168936 - DNA, 2268 bp, Artificial Sequence
  Description of Artificial Sequence: Synthetic coding sequence
atgcagccagatggagagggccctgtggcccctgggggctggcacaacggcccccacgccccctgggccccccgggcccagaaggaggaggaggaggaggaggagggcagcccccaggaggaggaggtggaggaggaggaggagaacagagctgaggaggaggaggccagcacagaggaggaggacaaggagggcgctgtggtgtctgcccccagcgtgaagggcgtgtcctttgaccaggccaacaacctgctgattgagcccgccagaattgaggaggaggagctgaccctgaccatcctgcggcagacaggaggcctgggcatcagcattgctgggggcaagggcagcaccccctacaagggagatgatgagggcatcttcatcagccgggtgtctgaggagggccctgctgcccgggccggcgtgcgggtgggggacaagctgctggaggtgaatggagtggccctgcagggcgctgagcaccatgaagctgtggaggccctgcggggggccggcacagctgtgcagatgagggtgtggagggagaggatggtggagccagaaaatgctgtgaccatcacccccctgcggccagaagatgactacagcccccgggagcggcggggcggcggcctgcggctgcccctgctgcccccagagagccctggccccctgcggcagagacatgtggcctgcctggcccggtctgagcggggcctgggcttcagcattgctgggggcaagggcagcaccccctacagagctggagatgctggcatctttgtgtccagaattgctgagggcggggccgcccacagagctggcaccctgcaggtgggggacagagtgctgagcatcaacggggtggatgtgacagaggcccggcatgaccatgctgtgtccctgctgacagctgccagccccaccatcgccctgctgctggagcgggaggccggcggccccctgccccccagccccctgccccacagcagccccccaacagctgctgtggccaccaccagcatcaccacagccaccccaggagtgcccggcctgcccagcctggcccccagcctgctggccgccgccctggagggcccctaccctgtggaggagatccggctgcccagggctgggggccccctgggcctgagcatcgtgggcggcagtgaccacagcagccaccccttcggcgtgcaggagcccggggtcttcatcagcaaggtgctgccccggggcctggccgcccggagcggcctgcgggtgggggaccgcatcctggccgtgaatggccaggatgtgagagatgccacccaccaggaggccgtgtctgccctgctgcggccctgcctggagctgagcctgctggtgagaagagatcctgcccctcctggcctgcgggagctgtgcatccagaaggcccctggagagcggctgggcatcagcatccggggcggggcccggggccacgccggcaacccccgggaccccacagatgagggcatcttcatcagcaaggtgagccccactggagctgctggaagagatggccgcctgcgggtgggcctgcggctgctggaggtgaaccagcagagcctgctgggcctgacccatggagaggccgtgcagctgctgcggtctgtgggggacaccctgactgtgctggtgtgtgatggctttgaggccagcacagatgctgccctggaggtgtccccaggagtcatcgccaacccctttgctgctggcatcggccacaggaacagcctggagagcatcagcagcattgaccgggagctgagccctgagggccctgggaaggagaaggagctgcccggccagaccctgcactggggccctgaggccacagaagctgctggccggggcctgcagcccctgaagctggactaccgggccctggccgctgtgcccagcgctggctctgtgcagagggtgcccagcggggctgctgggggcaagatggccgagagcccctgcagccccagcggccagcagccccccagcccccccagcccagatgagctgcctgccaacgtgaagcaggcctaccgggcctttgctgctgtgcccaccagccaccccccagaagatgccccagcccagccccccaccccaggccctgctgccagccctgagcagctgtccttccgggagcggcagaagtactttgagctggaggtgcgggtgccccaggccgagggccccctgcggcctggaagaagaggcctgggccctgtgcccagctag

SEQ ID NO: 168937 - DNA, 4968 bp, Artificial Sequence
  Description of Artificial Sequence: Synthetic coding sequence
atgctgaagtgcatccccctgtggcgctgcaacagacatgtggagagcgtggacaagaggcactgcagcctgcaggccgtgcctgaggagatctaccgctacagccgcagcctggaggagctgctgctggatgccaaccagctgcgggagctgcccaagcccttcttccggctgctgaacctgaggaagctgggcctgagtgacaatgagatccagaggctgcccccagaggtggccaacttcatgcagctggtggagctggatgtgtccagaaatgacatccctgagatccctgagagcatcaagttctgcaaggccctggagattgctgacttcagcggcaaccccctgagccggctgcctgatggcttcacccagctgcggagcctggcccacctggccctgaatgatgtgtccctgcaggccctgcctggagatgtgggcaacctggccaacctggtgaccctggagctgcgggagaacctgctgaagagcctgcctgccagcctgtccttcctggtgaagctggagcagctggacctgggcggcaatgacctggaggtgctgcctgacaccctgggcgccctgcccaacctgcgggagctgtggctggacaggaaccagctgagcgccctgcccccagagctgggcaacctgcggcggctggtgtgcctggatgtgtctgaaaatcggctggaggagctgcctgctgagctgggcggcctggtgctgctgacagacctgctgctgagccagaacctgctgcggcggctgcctgatggcatcggccagctgaagcagctgagcatcctgaaggtggaccagaaccggctgtgtgaggtgacagaggccatcggggactgtgagaacctgtctgagctgatcctgacagagaacctgctgatggccctgcccaggagcctgggcaagctgaccaagctgaccaacctgaatgtggacaggaaccacctggaggccctgcccccagaaattggaggctgtgtggccctgtctgtgctgagcctgcgggacaaccggctggccgtgctgcccccagagctggcccacaccacagagctgcacgtgctggatgtggccggcaaccggctgcagagcctgccctttgccctgacccacctgaacctgaaggccctgtggctggccgagaaccaggcccagcccatgctgcgcttccagacagaagatgatgccaggactggagagaaggtgctgacctgctacctgctgccccagcagcccccacccagcctggaggatgctggccagcagggcagcctgtctgagacctggagcgatgccccacccagccgggtgtctgtcatccagttcctggaggcccccatcggagatgaagatgctgaggaggccgctgctgagaagaggggcctgcagaggcgggccaccccccaccccagcgagctgaaggtgatgaagaggagcattgagggcagaagaagtgaggcctgcccctgccagcctgacagcggcagccccctgcctgctgaggaggagaagaggctgtctgctgagagcggcctgtctgaggacagccggcccagcgccagcacagtgtctgaggccgagcctgagggccccagcgctgaggcccagggcggcagccagcaggaggccaccacagctggaggagaggaggatgctgaggaggactaccaggagcccaccgtgcactttgctgaagatgccctgctgcctggagatgaccgggagattgaggagggccagcctgaggccccctggaccctgcccggcggccggcagaggctcatcaggaaggacaccccccactacaagaagcacttcaagatcagcaagctgccccagcctgaggccgtggtggccctgctgcagggcatgcagccagatggagagggccctgtggcccctgggggctggcacaacggcccccacgccccctgggccccccgggcccagaaggaggaggaggaggaggaggagggcagcccccaggaggaggaggtggaggaggaggaggagaacagagctgaggaggaggaggccagcacagaggaggaggacaaggagggcgctgtggtgtctgcccccagcgtgaagggcgtgtcctttgaccaggccaacaacctgctgattgaaccagcccgcatcgaggaggaggagctgaccctgaccatcctgcggcagacaggaggcctgggcatcagcattgctgggggcaagggcagcaccccctacaagggagatgatgagggcatcttcatcagccgggtgtctgaggagggccctgctgcccgggccggcgtgcgggtgggggacaagctgctggaggtgaatggagtggccctgcagggcgctgagcaccacgaggccgtggaggccctgcggggagctggaacagctgtgcagatgagggtgtggagggagaggatggtggagccagaaaatgctgtgaccatcacccccctgcggccagaagatgactacagcccccgggagaggagaggaggcggcctgcggctgcccctgctgcccccagagagccctggccccctgcggcagagacatgtggcctgcctggcccggtctgagcggggcctgggcttcagcattgctgggggcaagggcagcaccccctacagagctggagatgctggcatctttgtgtccagaattgctgagggcggggccgcccaccgggccggcaccctgcaggtgggggacagagtgctgagcatcaatggagtggatgtgacagaggcccggcatgaccatgctgtgtccctgctgacagctgccagccccaccatcgccctgctgctggagcgggaggccggcggccccctgccccccagccccctgccccacagcagccccccaacagctgctgtggccaccaccagcatcaccacagccaccccaggagtgcccggcctgcccagcctggcccccagcctgctggccgccgccctggagggcccctaccctgtggaggagatccggctgccccgggccggcggccccctgggcctgagcatcgtgggcggcagtgaccacagcagccacccctttggagtgcaggagcccggggtcttcatcagcaaggtgctgccccggggcctggccgcccggagcggcctgcgggtgggggaccgcatcctggccgtgaatggccaggatgtgagagatgccacccaccaggaggccgtgtctgccctgctgcggccctgcctggagctgagcctgctggtgcggcgggaccctgcccctcctggcctgcgggagctgtgcatccagaaggcccctggagagcggctgggcatcagcatccggggcggggcccggggccatgctggcaacccccgggaccccacagatgagggcatcttcatcagcaaggtgagccccaccggggctgctggaagagatggccgcctgcgggtgggcctgcggctgctggaggtgaaccagcagagcctgctgggcctgacccacggggaggccgtgcagctgctgcggtctgtgggggacaccctgactgtgctggtgtgtgatggctttgaggccagcacagatgctgccctggaggtgtcccctggggtgattgccaacccctttgctgctggcatcggccacaggaacagcctggagagcatcagcagcattgaccgggagctgagccctgagggccctgggaaggagaaggagctgcccggccagaccctgcactggggccctgaggccacagaggccgccggccggggcctgcagcccctgaagctggactaccgggccctggccgctgtgcccagcgctggctctgtgcagagggtgcccagcggggccgccggcggcaagatggccgagagcccctgcagccccagcggccagcagccccccagcccccccagcccagatgagctgcctgccaacgtgaagcaggcctaccgggcctttgctgctgtgcccaccagccaccccccagaagatgccccagcccagccccccaccccaggccctgctgccagccctgagcagctgtccttccgggagcggcagaagtactttgagctggaggtgcgggtgccccaggccgagggcccccccaagagggtgtccctggtgggcgcagatgacctgaggaagatgcaggaggaggaggccaggaagctgcagcagaagagggcccagatgctgcgggaggccgctgaggccggggctgaggcccggctggccctggatggagagaccctgggggaggaggagcaggaggatgagcagcccccctgggccagccccagccccaccagccggcagagccctgccagccccccacccctgggcggcggggcccctgtgaggacagccaaggccgagaggaggcaccaggagcggctgcgggtgcagagccctgagcccccagcccctgagcgggccctgagccctgctgagctgcgggccctggaggccgagaagagggccctgtggagggctgccaggatgaagagcctggagcaggatgccctgcgggcccagatggtgctgagccgcagccaggagggccggggcacccggggccccctggagcggctggccgaggcccccagccctgcccccacccccagccccacccctgtggaggacctgggcccccagaccagcaccagccctggccgcctgcccctgagcggcaagaagtttgactaccgggcctttgctgccctgcccagcagcaggcctgtgtatgacatccagagcccagactttgctgaggagctgcggagcctggagcccagccccagccctggcccccaggaggaggatggagaggtggccctggtgctgctgggccggcccagccctggagctgtgggcccagaagatgtggccctgtgcagcagccggcggcctgtgcggcctggaagaagaggcctgggccctgtgcccagctag

SEQ ID NO: 168938 - DNA, 2427 bp, Artificial Sequence
  Description of Artificial Sequence: Synthetic coding sequence
atgtggttctttgcccgggaccctgtgcgggacttcccctttgagctgatccctgagcccccagagggcggcctgcccggcccctgggccctgcaccggggcaggaagaaggccaccggcagccctgtgtccatctttgtgtatgatgtgaagccaggagctgaggagcagacccaggtggccaaggccgccttcaagcgcttcaagaccctgcggcaccccaacatcctggcctacattgatggcctggagacagagaagtgcctgcacgtggtgacagaagctgtgacccccctgggcatctacctgaaggcccgggtggaggccggcggcctgaaggagctggagatctcctggggcctgcaccagatcgtgaaggccctgtccttcctggtgaatgactgcagcctcatccacaacaacgtgtgcatggctgctgtgtttgtggaccgggccggggagtggaagctgggcggcctggactacatgtacagcgcccagggcaatggaggcggcccccccaggaagggcatccctgagctggagcagtatgaccccccagagctggccgacagcagcggccgggtggtgcgggagaagtggagcgctgacatgtggaggctgggctgcctgatctgggaggtgttcaacggccccctgcccagggctgctgccctgagaaatcctgggaagatccccaagaccctggtgccccactactgtgagctggtgggcgccaaccccaaggtgcggcccaacccagcccgcttcctgcagaactgccgggcccctgggggcttcatgagcaacagatttgtggagaccaacctcttcctggaggagatccagatcaaggagcctgctgagaagcagaagttcttccaggagctgagcaagagcctggatgccttccctgaggacttctgccgccacaaggtgctgccccagctgctgacagcctttgaatttggaaatgctggagctgtggtgctgacccccctcttcaaggtgggcaagttcctgtctgctgaggagtaccagcagaagatcatccctgtggtggtgaagatgttcagcagcacagaccgggccatgaggatccggctgctgcagcagatggagcagttcatccagtacctggatgagcccaccgtgaacacccagatcttcccccacgtggtgcacggcttcctggacaccaacccagccatccgggagcagacagtgaagtccatgctgctgctggcccccaagctgaatgaggccaacctgaatgtggagctgatgaagcactttgcccggctgcaggccaaggatgagcagggccccatccgctgcaacaccaccgtgtgcctgggcaagattggcagctacctgagcgccagcaccaggcaccgggtgctgaccagcgccttcagccgggccacccgggacccctttgcccccagccgggtggccggcgtgctgggctttgctgccacccacaacctgtacagcatgaatgactgtgcccagaagatcctgcctgtgctgtgtggcctgactgtggaccctgagaagtctgtgcgggaccaggccttcaaggccatccgctccttcctgagcaagctggagagcgtgtctgaggaccccacccagctggaggaggtggagaaggatgtgcacgccgccagcagccctggcatgggcggggccgccgcctcctgggccggctgggccgtgactggagtgagcagcctgaccagcaagctgatccgcagccaccccaccacagcccccacagagaccaacatcccccagaggcccaccccagagggcgtgcctgccccagcccccacccctgtgcctgccacccccaccaccagcggccactgggagacccaggaggaggacaaggacacagctgaggacagcagcacagctgaccgctgggatgatgaggactggggcagcctggagcaggaggccgagagcgtgctggcccagcaggatgactggagcactggaggccaggtgtcccgggccagccaggtgagcaacagcgaccacaagagcagcaagagccctgagagtgactggagctcctgggaggccgagggctcctgggagcagggctggcaggagcccagcagccaggagcccccaccagatggcacccggctggccagcgagtacaactggggcggccctgagagcagtgacaagggggacccctttgccaccctgagcgcccggcccagcacccagcccaggccagacagctggggcgaggacaactgggagggcctggagacagacagccggcaggtgaaggccgagctggccaggaagaagcgggaggagaggagaagagagatggaggccaagagagctgagaggaaggtggccaagggccccatgaagctgggcgccaggaagctggactag

SEQ ID NO: 168939 - DNA, 2346 bp, Artificial Sequence
  Description of Artificial Sequence: Synthetic coding sequence
atgtggttctttgcccgggaccctgtgcgggacttcccctttgagctgatccctgagcccccagagggcggcctgcccggcccctgggccctgcaccggggcaggaagaaggccaccggcagccctgtgtccatctttgtgtatgatgtgaagccaggagctgaggagcagacccaggtggccaaggccgccttcaagcgcttcaagaccctgcggcaccccaacatcctggcctacattgatggcctggagacagagaagtgcctgcacgtggtgacagaagctgtgacccccctgggcatctacctgaaggcccgggtggaggccggcggcctgaaggagctggagatctcctggggcctgcaccagatcgtgaaggccctgtccttcctggtgaatgactgcagcctcatccacaacaacgtgtgcatggctgctgtgtttgtggaccgggccggggagtggaagctgggcggcctggactacatgtacagcgcccagggcaatggaggcggcccccccaggaagggcatccctgagctggagcagtatgaccccccagagctggccgacagcagcggccgggtggtgcgggagaagtggagcgctgacatgtggaggctgggctgcctgatctgggaggtgttcaacggccccctgcccagggctgctgccctgagaaatcctgggaagatccccaagaccctggtgccccactactgtgagctggtgggcgccaaccccaaggtgcggcccaacccagcccgcttcctgcagaactgccgggcccctgggggcttcatgagcaacagatttgtggagaccaacctcttcctggaggagatccagatcaaggagcctgctgagaagcagaagttcttccaggagctgagcaagagcctggatgccttccctgaggacttctgccgccacaaggtgctgccccagctgctgacagcctttgaatttggaaatgctggagctgtggtgctgacccccctcttcaaggtgggcaagttcctgtctgctgaggagtaccagcagaagatcatccctgtggtggtgaagatgttcagcagcacagaccgggccatgaggatccggctgctgcagcagatggagcagttcatccagtacctggatgagcccaccgtgaacacccagatcttcccccacgtggtgcacggcttcctggacaccaacccagccatccgggagcagacagtgaagtccatgctgctgctggcccccaagctgaatgaggccaacctgaatgtggagctgatgaagcactttgcccggctgcaggccaaggatgagcagggccccatccgctgcaacaccaccgtgtgcctgggcaagattggcagctacctgagcgccagcaccaggcaccgggtgctgaccagcgccttcagccgggccacccgggacccctttgcccccagccgggtggccggcgtgctgggctttgctgccacccacaacctgtacagcatgaatgactgtgcccagaagatcctgcctgtgctgtgtggcctgactgtggaccctgagaagtctgtgcgggaccaggccttcaaggccatccgctccttcctgagcaagctggagagcgtgtctgaggaccccacccagctggaggaggtggagaaggatgtgcacgccgccagcagccctggcatgggcggggccgccgcctcctgggccggctgggccgtgactggagtgagcagcctgaccagcaagctgatccgcagccaccccaccacagcccccacagagaccaacatcccccagaggcccaccccagagggcgtgcctgccccagcccccacccctgtgcctgccacccccaccaccagcggccactgggagacccaggaggaggacaaggacacagctgaggacagcagcacagctgaccgctgggatgatgaggactggggcagcctggagcaggaggccgagagcgtgctggcccagcaggatgactggagcactggaggccaggtgtcccgggccagccaggtgagcaacagcgaccacaagagcagcaagagccctgagagtgactggagctcctgggaggccgagggctcctgggagcagggctggcaggagcccagcagccaggagcccccaccagatggcacccggctggccagcgagtacaactggggcggccctgagagcagtgacaagggggacccctttgccaccctgagcgcccggcccagcacccaggacaggagccggctgtcctggccaggccgcagcgcccggagcggcggcggccgctggaggcccaatgccccccggggccgctggccccgggccccctag

SEQ ID NO: 168940 - DNA, 2124 bp, Artificial Sequence
  Description of Artificial Sequence: Synthetic coding sequence
atgtggttctttgcccgggaccctgtgcgggacttcccctttgagctgatccctgagcccccagagggcggcctgcccggcccctgggccctgcaccggggcaggaagaaggccaccggcagccctgtgtccatctttgtgtatgatgtgaagccaggagctgaggagcagacccaggtggccaaggccgccttcaagcgcttcaagaccctgcggcaccccaacatcctggcctacattgatggcctggagacagagaagtgcctgcacgtggtgacagaagctgtgacccccctgggcatctacctgaaggcccgggtggaggccggcggcctgaaggagctggagatctcctggggcctgcaccagatcgtgaaggccctgtccttcctggtgaatgactgcagcctcatccacaacaacgtgtgcatggctgctgtgtttgtggaccgggccggggagtggaagctgggcggcctggactacatgtacagcgcccagggcaatggaggcggcccccccaggaagggcatccctgagctggagcagtatgaccccccagagctggccgacagcagcggccgggtggtgcgggagaagtggagcgctgacatgtggaggctgggctgcctgatctgggaggtgttcaacggccccctgcccagggctgctgccctgagaaatcctgggaagatccccaagaccctggtgccccactactgtgagctggtgggcgccaaccccaaggtgcggcccaacccagcccgcttcctgcagaactgccgggcccctgggggcttcatgagcaacagatttgtggagaccaacctcttcctggaggagatccagatcaaggagcctgctgagaagcagaagttcttccaggagctgagcaagagcctggatgccttccctgaggacttctgccgccacaaggtgctgccccagctgctgacagcctttgaatttggaaatgctggagctgtggtgctgacccccctcttcaaggtgggcaagttcctgtctgctgaggagtaccagcagaagatcatccctgtggtggtgaagatgttcagcagcacagaccgggccatgaggatccggctgctgcagcagatggagcagttcatccagtacctggatgagcccaccgtgaacacccagatcttcccccacgtggtgcacggcttcctggacaccaacccagccatccgggagcagacagtgaagtccatgctgctgctggcccccaagctgaatgaggccaacctgaatgtggagctgatgaagcactttgcccggctgcaggccaaggatgagcagggccccatccgctgcaacaccaccgtgtgcctgggcaagattggcagctacctgagcgccagcaccaggcaccgggtgctgaccagcgccttcagccgggccacccgggacccctttgcccccagccgggtggccggcgtgctgggctttgctgccacccacaacctgtacagcatgaatgactgtgcccagaagatcctgcctgtgctgtgtggcctgactgtggaccctgagaagtctgtgcgggaccaggccttcaaggccatccgctccttcctgagcaagctggagagcgtgtctgaggaccccacccagctggaggaggtggagaaggatgtgcacgccgccagcagccctggcatgggcggggccgccgcctcctgggccggctgggccgtgactggagtgagcagcctgaccagcaagctgatccgcagccaccccaccacagcccccacagagaccaacatcccccagaggcccaccccagagggccactgggagacccaggagcccccaccagatggcacccggctggccagcgagtacaactggggcggccctgagagcagtgacaagggggacccctttgccaccctgagcgcccggcccagcacccagcccaggccagacagctggggcgaggacaactgggagggcctggagacagacagccggcaggtgaaggccgagctggccaggaagaagcgggaggagcggcggcgggagatggaggccaagagagctgagaggaaggtggccaagggccccatgaagctgggcgccaggaagctggactag

SEQ ID NO: 168941 - DNA, 1071 bp, Artificial Sequence
  Description of Artificial Sequence: Synthetic coding sequence
atgtggttctttgcccgggaccctgtgcgggacttcccctttgagctgatccctgagcccccagagggcggcctgcccggcccctgggccctgcaccggggcaggaagaaggccaccggcagccctgtgtccatctttgtgtatgatgtgaagccaggagctgaggagcagacccaggtggccaaggccgccttcaagcgcttcaagaccctgcggcaccccaacatcctggcctacattgatggcctggagacagagaagtgcctgcacgtggtgacagaagctgtgacccccctgggcatctacctgaaggcccgggtggaggccggcggcctgaaggagctggagatctcctggggcctgcaccagatcgtgaaggccctgtccttcctggtgaatgactgcagcctcatccacaacaacgtgtgcatggctgctgtgtttgtggaccgggccggggagtggaagctgggcggcctggactacatgtacagcgcccagggcaatggaggcggcccccccaggaagggcatccctgagctggagcagtatgaccccccagagctggccgacagcagcggccgggtggtgcgggagaagtggagcgctgacatgtggaggctgggctgcctgatctgggaggtgttcaacggccccctgcccagggctgctgccctgagaaatcctgggaagatccccaagaccctggtgccccactactgtgagctggtgggcgccaaccccaaggtgcggcccaacccagcccgcttcctgcagaactgccgggcccctgggggcttcatgagcaacagatttgtggagaccaacctcttcctggaggagatccagcccaaggacccccggctgaaggagttcctgccccagcccccacccctcttcctgccccccctgcagccccaggccactggaagaagaagaagaaggaccaggacccagcagaggacagctgccctgctgacagatggcaccaccaagacaggagctgcctggagcagaagacccagcctgtgctggcccagcaggaccaccggggcccctggggccaagtag

SEQ ID NO: 168942 - DNA, 2376 bp, Artificial Sequence
  Description of Artificial Sequence: Synthetic coding sequence
atgtggttctttgcccgggaccctgtgcgggacttcccctttgagctgatccctgagcccccagagggcggcctgcccggcccctgggccctgcaccggggcaggaagaaggccaccggcagccctgtgtccatctttgtgtatgatgtgaagccaggagctgaggagcagacccaggtggccaaggccgccttcaagcgcttcaagaccctgcggcaccccaacatcctggcctacattgatggcctggagacagagaagtgcctgcacgtggtgacagaagctgtgacccccctgggcatctacctgaaggcccgggtggaggccggcggcctgaaggagctggagatctcctggggcctgcaccagatcgtgaaggccctgtccttcctggtgaatgactgcagcctcatccacaacaacgtgtgcatggctgctgtgtttgtggaccgggccggggagtggaagctgggcggcctggactacatgtacagcgcccagggcaatggaggcggcccccccaggaagggcatccctgagctggagcagtatgaccccccagagctggccgacagcagcggccgggtggtgcgggagaagtggagcgctgacatgtggaggctgggctgcctgatctgggaggtgttcaacggccccctgcccagggctgctgccctgagaaatcctgggaagatccccaagaccctggtgccccactactgtgagctggtgggcgccaaccccaaggtgcggcccaacccagcccgcttcctgcagaactgccgggcccctgggggcttcatgagcaacagatttgtggagaccaacctcttcctggaggagatccagatcaaggagcctgctgagaagcagaagttcttccaggagctgagcaagagcctggatgccttccctgaggacttctgccgccacaaggtgctgccccagctgctgacagcctttgaatttggaaatgctggagctgtggtgctgacccccctcttcaaggtgggcaagttcctgtctgctgaggagtaccagcagaagatcatccctgtggtggtgaagatgttcagcagcacagaccgggccatgaggatccggctgctgcagcagatggagcagttcatccagtacctggatgagcccaccgtgaacacccagatcttcccccacgtggtgcacggcttcctggacaccaacccagccatccgggagcagacagtgaagtccatgctgctgctggcccccaagctgaatgaggccaacctgaatgtggagctgatgaagcactttgcccggctgcaggccaaggatgagcagggccccatccgctgcaacaccaccgtgtgcctgggcaagattggcagctacctgagcgccagcaccaggcaccgggtgctgaccagcgccttcagccgggccacccgggacccctttgcccccagccgggtggccggcgtgctgggctttgctgccacccacaacctgtacagcatgaatgactgtgcccagaagatcctgcctgtgctgtgtggcctgactgtggaccctgagaagtctgtgcgggaccaggccttcaaggccatccgctccttcctgagcaagctggagagcgtgtctgaggaccccacccagctggaggaggtggagaaggatgtgcacgccgccagcagccctggcatgggcggggccgccgcctcctgggccggctgggccgtgactggagtgagcagcctgaccagcaagctgatccgcagccaccccaccacagcccccacagagaccaacatcccccagaggcccaccccagagggccactgggagacccaggaggaggacaaggacacagctgaggacagcagcacagctgaccgctgggatgatgaggactggggcagcctggagcaggaggccgagagcgtgctggcccagcaggatgactggagcactggaggccaggtgtcccgggccagccaggtgagcaacagcgaccacaagagcagcaagagccctgagagtgactggagctcctgggaggccgagggctcctgggagcagggctggcaggagcccagcagccaggagcccccaccagatggcacccggctggccagcgagtacaactggggcggccctgagagcagtgacaagggggacccctttgccaccctgagcgcccggcccagcacccagcccaggccagacagctggggcgaggacaactgggagggcctggagacagacagccggcaggtgaaggccgagctggccaggaagaagcgggaggagcggcggcgggagatggaggccaagagagctgagaggaaggtggccaagggccccatgaagctgggcgccaggaagctggactag

SEQ ID NO: 168943 - DNA, 2343 bp, Artificial Sequence
  Description of Artificial Sequence: Synthetic coding sequence
atgtggttctttgcccgggaccctgtgcgggacttcccctttgagctgatccctgagcccccagagggcggcctgcccggcccctgggccctgcaccggggcaggaagaaggccaccggcagccctgtgtccatctttgtgtatgatgtgaagccaggagctgaggagcagacccaggtggccaaggccgccttcaagcgcttcaagaccctgcggcaccccaacatcctggcctacattgatggcctggagacagagaagtgcctgcacgtggtgacagaagctgtgacccccctgggcatctacctgaaggcccgggtggaggccggcggcctgaaggagctggagatctcctggggcctgcaccagatcgtgaaggccctgtccttcctggtgaatgactgcagcctcatccacaacaacgtgtgcatggctgctgtgtttgtggaccgggccggggagtggaagctgggcggcctggactacatgtacagcgcccagggcaatggaggcggcccccccaggaagggcatccctgagctggagcagtatgaccccccagagctggccgacagcagcggccgggtggtgcgggagaagtggagcgctgacatgtggaggctgggctgcctgatctgggaggtgttcaacggccccctgcccagggctgctgccctgagaaatcctgggaagatccccaagaccctggtgccccactactgtgagctggtgggcgccaaccccaaggtgcggcccaacccagcccgcttcctgcagaactgccgggcccctgggggcttcatgagcaacagatttgtggagaccaacctcttcctggaggagatccagatcaaggagcctgctgagaagcagaagttcttccaggagctgagcaagagcctggatgccttccctgaggacttctgccgccacaaggtgctgccccagctgctgacagcctttgaatttggaaatgctggagctgtggtgctgacccccctcttcaaggtgggcaagttcctgtctgctgaggagtaccagcagaagatcatccctgtggtggtgaagatgttcagcagcacagaccgggccatgaggatccggctgctgcagcagatggagcagttcatccagtacctggatgagcccaccgtgaacacccagatcttcccccacgtggtgcacggcttcctggacaccaacccagccatccgggagcagacagtgaagtccatgctgctgctggcccccaagctgaatgaggccaacctgaatgtggagctgatgaagcactttgcccggctgcaggccaaggatgagcagggccccatccgctgcaacaccaccgtgtgcctgggcaagattggcagctacctgagcgccagcaccaggcaccgggtgctgaccagcgccttcagccgggccacccgggacccctttgcccccagccgggtggccggcgtgctgggctttgctgccacccacaacctgtacagcatgaatgactgtgcccagaagatcctgcctgtgctgtgtggcctgactgtggaccctgagaagtctgtgcgggaccaggccttcaaggccatccgctccttcctgagcaagctggagagcgtgtctgaggaccccacccagctggaggaggtggagaaggatgtgcacgccgccagcagccctggcatgggcggggccgccgcctcctgggccggctgggccgtgactggagtgagcagcctgaccagcaagctgatccgcagccaccccaccacagcccccacagagaccaacatcccccagaggcccaccccagagggcgtgcctgccccagcccccacccctgtgcctgccacccccaccaccagcggccactgggagacccaggaggaggacaaggacacagctgaggacagcagcacagctgaccgctgggatgatgaggactggggcagcctggaggaggccgagagcgtgctggcccagcaggatgactggagcactggaggccaggtgtcccgggccagccaggtgagcaacagcgaccacaagagcagcaagagccctgagagtgactggagctcctgggaggccgagggctcctgggagcagggctggcaggagcccagcagccaggagcccccaccagatggcacccggctggccagcgagtacaactggggcggccctgagagcagtgacaagggggacccctttgccaccctgagcgcccggcccagcacccaggacaggagccggctgtcctggccaggccgcagcgcccggagcggcggcggccgctggaggcccaatgccccccggggccgctggccccgggccccctag

SEQ ID NO: 168944 - DNA, 2124 bp, Artificial Sequence; identical to SEQ ID NO: 168940
  Description of Artificial Sequence: Synthetic coding sequence

SEQ ID NO: 168945 - DNA, 2364 bp, Artificial Sequence
  Description of Artificial Sequence: Synthetic coding sequence
atgtggttctttgcccgggaccctgtgcgggacttcccctttgagctgatccctgagcccccagagggcggcctgcccggcccctgggccctgcaccggggcaggaagaaggccaccggcagccctgtgtccatctttgtgtatgatgtgaagccaggagctgaggagcagacccaggtggccaaggccgccttcaagcgcttcaagaccctgcggcaccccaacatcctggcctacattgatggcctggagacagagaagtgcctgcacgtggtgacagaagctgtgacccccctgggcatctacctgaaggcccgggtggaggccggcggcctgaaggagctggagatctcctggggcctgcaccagatcgtgaaggccctgtccttcctggtgaatgactgcagcctcatccacaacaacgtgtgcatggctgctgtgtttgtggaccgggccggggagtggaagctgggcggcctggactacatgtacagcgcccagggcaatggaggcggcccccccaggaagggcatccctgagctggagcagtatgaccccccagagctggccgacagcagcggccgggtggtgcgggagaagtggagcgctgacatgtggaggctgggctgcctgatctgggaggtgttcaacggccccctgcccagggctgctgccctgagaaatcctgggaagatccccaagaccctggtgccccactactgtgagctggtgggcgccaaccccaaggtgcggcccaacccagcccgcttcctgcagaactgccgggcccctgggggcttcatgagcaacagatttgtggagaccaacctcttcctggaggagatccagatcaaggagcctgctgagaagcagaagttcttccaggagctgagcaagagcctggatgccttccctgaggacttctgccgccacaaggtgctgccccagctgctgacagcctttgaatttggaaatgctggagctgtggtgctgacccccctcttcaaggtgggcaagttcctgtctgctgaggagtaccagcagaagatcatccctgtggtggtgaagatgttcagcagcacagaccgggccatgaggatccggctgctgcagcagatggagcagttcatccagtacctggatgagcccaccgtgaacacccagatcttcccccacgtggtgcacggcttcctggacaccaacccagccatccgggagcagacagtgaagtccatgctgctgctggcccccaagctgaatgaggccaacctgaatgtggagctgatgaagcactttgcccggctgcaggccaaggatgagcagggccccatccgctgcaacaccaccgtgtgcctgggcaagattggcagctacctgagcgccagcaccaggcaccgggtgctgaccagcgccttcagccgggccacccgggacccctttgcccccagccgggtggccggcgtgctgggctttgctgccacccacaacctgtacagcatgaatgactgtgcccagaagatcctgcctgtgctgtgtggcctgactgtggaccctgagaagtctgtgcgggaccaggccttcaaggccatccgctccttcctgagcaagctggagagcgtgtctgaggaccccacccagctggaggaggtggagaaggatgtgcacgccgccagcagccctggcatgggcggggccgccgcctcctgggccggctgggccgtgactggagtgagcagcctgaccagcaagctgatccgcagccaccccaccacagcccccacagagaccaacatcccccagaggcccaccccagagggcgtgcctgccccagcccccacccctgtgcctgccacccccaccaccagcggccactgggagacccaggaggaggacaaggacacagctgaggacagcagcacagctgaccgctgggatgatgaggactggggcagcctggagcaggaggccgagagcgtgctggcccagcaggatgactggagcactggaggccaggtgtcccgggccagccagagccccaccggggctgctgggaagctgcgggcccctggcaacagagctggccgcagccaggcccccaggagccacctgctgactgtgcacggctggccagccagcatcaccggggtggcccagagccctgccacccgggccacccccagcctgccctgcctgcacgtgcctgcccccagccggggccagaccctgggcgtgaggaccaccggccgggccagccggctgactgtggacaggagccggctgtcctggccaggccgcagcgcccggagcggcggcggccgctggaggcccaatgccccccggggccgctggccccgggccccctag

SEQ ID NO: 168946 - DNA, 663 bp, Artificial Sequence
  Description of Artificial Sequence: Synthetic coding sequence
atgatcaagcccaagtggggcggcctggtgtgggcccagtggcacggccccctggcccggcccagcggcaccctgccctttgccagctccatgcccagccctgtggatgccagcagcgcagatggcggcagcggcctgggcagccacaggaggaagaggaccaccttcagcaagggccagctgctggagctggagcgggcctttgctgcctggccctaccccaacatcagcacccatgagcacctggcctgggtgacctgcctgcctgaggccaaggtgcaggtgtggttccagaagcgctgggccaagatcatcaagaacaggaagagcggcatcctgagccctggcagcgagtgcccccagagcagctgcagcctgcctgacaccctgcagcagccctgggacccccagatgcctggccagcccccacccagcagcggcaccccccagaggacctctgtgtgccgccacagcagctgcccagcccctggcctgagcccccggcagggctgggagggcgccaaggctgtggccccctggggcagcgctggggccagcgaggtgcaccccagcctggagcgggccaccccccagaccagcctgggcagcctgagtgacctgatctatgccctggccatcgtggtgaatgtggaccacagctag

SEQ ID NO: 168947 - DNA, 651 bp, Artificial Sequence
  Description of Artificial Sequence: Synthetic coding sequence
atgggcggcagcggcgtgggcacagcctggcacggccccctggcccggcccagcggcaccctgccctttgccagctccatgcccagccctgtggatgccagcagcgcagatggcggcagcggcctgggcagccacaggaggaagaggaccaccttcagcaagggccagctgctggagctggagcgggcctttgctgcctggccctaccccaacatcagcacccatgagcacctggcctgggtgacctgcctgcctgaggccaaggtgcaggtgtggttccagaagcgctgggccaagatcatcaagaacaggaagagcggcatcctgagccctggcagcgagtgcccccagagcagctgcagcctgcctgacaccctgcagcagccctgggacccccagatgcctggccagcccccacccagcagcggcaccccccagaggacctctgtgtgccgccacagcagctgcccagcccctggcctgagcccccggcagggctgggagggcgccaaggctgtggccccctggggcagcgctggggccagcgaggtgcaccccagcctggagcgggccaccccccagaccagcctgggcagcctgagtgacctgatctatgccctggccatcgtggtgaatgtggaccacagctag

SEQ ID NO: 168948 - DNA, 648 bp, Artificial Sequence
  Description of Artificial Sequence: Synthetic coding sequence
atgatgaccaccggctggacaggcctgtgcctgccccctgtgaaccccagccgggtgagcagcagcagcctggagaccagcaccacagagagcatctttgcccatgatggcggcagcggcctgggcagccacaggaggaagaggaccaccttcagcaagggccagctgctggagctggagcgggcctttgctgcctggccctaccccaacatcagcacccatgagcacctggcctgggtgacctgcctgcctgaggccaaggtgcaggtgtggttccagaagcgctgggccaagatcatcaagaacaggaagagcggcatcctgagccctggctctgaatgtccccagagcagctgcagcctgcctgacaccctgcagcagccctgggacccccagatgcctggccagcccccacccagcagcggcaccccccagaggacctctgtgtgccgccacagcagctgcccagcccctggcctgagcccccggcagggctgggagggcgccaaggctgtggccccctggggcagcgctggggccagcgaggtgcaccccagcctggagcgggccaccccccagaccagcctgggcagcctgagtgacctgatctatgccctggccatcgtggtgaatgtggaccacagctag

SEQ ID NO: 168949 - DNA, 648 bp, Artificial Sequence; identical to SEQ ID NO: 168948
  Description of Artificial Sequence: Synthetic coding sequence

SEQ ID NO: 168950 - DNA, 1212 bp, Artificial Sequence
  Description of Artificial Sequence: Synthetic coding sequence
atgagcggccgggtgggggacctgagcccccggcagaaggaggccctggccaagttcagagaaaatgtgcaggatgtgctgcctgccctgcccaacccagatgactacttcctgctgcgctggctgcgggcccggagctttgacctgcagaagtctgaggccatgctgaggaagcacgtggagttcaggaagcagaaggacatcgacaacatcatctcctggcagcccccagaggtgatccagcagtacctgagcggcggcatgtgtggctatgacctggatggctgccctgtgtggtatgacatcatcggccccctggatgccaagggcctgctcttcagcgccagcaagcaggacctgctgcggaccaagatgagagaatgtgagctgctgctgcaggagtgtgcccaccagaccaccaagctgggcaggaaggtggagaccatcaccatcatctatgactgtgagggcctgggcctgaagcacctgtggaagccagctgtggaggcctatggagagttcctgtgcatgtttgaggagaactacccagagaccctgaagaggctgtttgtggtgaaggcccccaagctgtttcctgtggcctacaacctgatcaagcccttcctgtctgaggacaccaggaagaagatcatggtgctgggcgccaactggaaggaggtgctgctgaagcacatcagcccagaccaggtgcctgtggagtatggaggcaccatgacagatcctgatggcaaccccaagtgcaagagcaagatcaactacggcggggacatccccaggaagtactacgtgcgggaccaggtgaagcagcagtatgagcacagcgtgcagatcagccggggcagcagccaccaggtggagtatgagatcctcttccctggctgtgtgctgcgctggcagttcatgtctgatggagcagatgtgggcttcggcatcttcctgaagaccaagatgggagagcggcagagagctggggagatgacagaggtgctgcccaaccagcgctacaacagccacctggtgcctgaagatggcaccctgacctgcagcgaccccggcatctacgtgctgcgctttgacaacacctacagcttcatccacgccaagaaggtgaacttcaccgtggaggtgctgctgcctgacaaggccagcgaggagaagatgaagcagctgggcgccggcacccccaagtag

SEQ ID NO: 168951 - DNA, 963 bp, Artificial Sequence
  Description of Artificial Sequence: Synthetic coding sequence
atgagcggccgggtgggggacctgagcccccggcagaaggaggccctggccaagttcagagaaaatgtgcaggatgtgctgcctgccctgcccaacccagatgactacttcctgctgcgctggctgcgggcccggagctttgacctgcagaagtctgaggccatgctgaggaagctgggcaggaaggtggagaccatcaccatcatctatgactgtgagggcctgggcctgaagcacctgtggaagccagctgtggaggcctacggggagttcctgtgcatgtttgaggagaactacccagagaccctgaagaggctgtttgtggtgaaggcccccaagctgtttcctgtggcctacaacctgatcaagcccttcctgtctgaggacaccaggaagaagatcatggtgctgggcgccaactggaaggaggtgctgctgaagcacatcagcccagaccaggtgcctgtggagtatggaggcaccatgacagatcctgatggcaaccccaagtgcaagagcaagatcaactatggaggagacatccccaggaagtactacgtgcgggaccaggtgaagcagcagtatgagcacagcgtgcagatcagccggggcagcagccaccaggtggagtatgagatcctcttccctggctgtgtgctgcgctggcagttcatgtctgatggagcagatgtgggcttcggcatcttcctgaagaccaagatgggagagcggcagagagctggggagatgacagaggtgctgcccaaccagcgctacaacagccacctggtgcctgaagatggcaccctgacctgcagcgaccccggcatctacgtgctgcgctttgacaacacctacagcttcatccacgccaagaaggtgaacttcaccgtggaggtgctgctgcctgacaaggccagcgaggagaagatgaagcagctgggcgccggcacccccaagtag

SEQ ID NO: 168952 - DNA, 990 bp, Artificial Sequence
  Description of Artificial Sequence: Synthetic coding sequence
atgctgaggaaggtgatccagcagtacctgagcggcggcatgtgtggctatgacctggatggctgccctgtgtggtatgacatcatcggccccctggatgccaagggcctgctcttcagcgccagcaagcaggacctgctgcggaccaagatgagagaatgtgagctgctgctgcaggagtgtgcccaccagaccaccaagctgggcaggaaggtggagaccatcaccatcatctatgactgtgagggcctgggcctgaagcacctgtggaagccagctgtggaggcctatggagagttcctgtgcatgtttgaggagaactacccagagaccctgaagaggctgtttgtggtgaaggcccccaagctgtttcctgtggcctacaacctgatcaagcccttcctgtctgaggacaccaggaagaagatcatggtgctgggcgccaactggaaggaggtgctgctgaagcacatcagcccagaccaggtgcctgtggagtatggaggcaccatgacagatcctgatggcaaccccaagtgcaagagcaagatcaactacggcggggacatccccaggaagtactacgtgcgggaccaggtgaagcagcagtatgagcacagcgtgcagatcagccggggcagcagccaccaggtggagtatgagatcctcttccctggctgtgtgctgcgctggcagttcatgtctgatggagcagatgtgggcttcggcatcttcctgaagaccaagatgggagagcggcagagagctggggagatgacagaggtgctgcccaaccagcgctacaacagccacctggtgcctgaagatggcaccctgacctgcagcgaccccggcatctacgtgctgcgctttgacaacacctacagcttcatccacgccaagaaggtgaacttcaccgtggaggtgctgctgcctgacaaggccagcgaggagaagatgaagcagctgggcgccggcacccccaagtag

SEQ ID NO: 168953 - DNA, 1179 bp, Artificial Sequence
  Description of Artificial Sequence: Synthetic coding sequence
atgagcggccgggtgggggacctgagcccccggcagaaggaggccctggccaagttcagagaaaatgtgcaggatgtgctgcctgccctgcccaacccagatgactacttcctgctgcgctggctgcgggcccggagctttgacctgcagaagtctgaggccatgctgaggaagcacgtggagttcaggaagcagaaggacatcgacaacatcatctcctggcagcccccagaggtgatccagcagtacctgagcggcggcatgtgtggctatgacctggatggctgccctgtgtggtatgacatcatcggccccctggatgccaagggcctgctcttcagcgccagcaagcaggacctgctgcggaccaagatgagagaatgtgagctgctgctgcaggagtgtgcccaccagaccaccaagctgggcaggaaggtggagaccatcaccatcatctatgactgtgagggcctgggcctgaagcacctgtggaagccagctgtggaggcctatggagagttcctgtgcatgtttgaggagaactacccagagaccctgaagaggctgtttgtggtgaaggcccccaagctgtttcctgtggcctacaacctgatcaagcccttcctgtctgaggacaccaggaagaagatcatggtgctgggcgccaactggaaggaggtgctgctgaagcacatcagcccagaccaggtgcctgtggagtatggaggcaccatgacagatcctgatggcaaccccaagtgcaagagcaagatcaactacggcggggacatccccaggaagtactacgtgcgggaccaggtgaagcagcagtatgagcacagcgtgcagatcagccggggcagcagccaccaggtggagtatgagatcctcttccctggctgtgtgctgcgctggcagttcatgtctgatggagcagatgtgggcttcggcatcttcctgaagaccaagatgggagagcggcagagagctggggagatgacagaggtgctgcccaaccagcgctacaacagccacctggtgcctgaagatggcaccctgacctgcagcgaccccggcatctgcaagtacctgtgcctgggcaatgccctgaagccccacgtgcagctgagcgcctgtgaggtgcccctgcccccctggatcttcggctctgaatgttag

SEQ ID NO: 168954 - DNA, 1119 bp, Artificial Sequence
  Description of Artificial Sequence: Synthetic coding sequence
atgagcaaggccttcggcctgctgcggcagatctgccagagcatcctggccgagagcagccagagccctgctgacctggaggagaagaaggaggaggacagcaacatgaagcgggagcagccccgggagcggccccgggcctgggactacccccacggcctggtgggcctgcacaacatcggccagacctgctgcctgaacagcctcatccaggtgtttgtgatgaatgtggacttcacccgcatcctgaagaggatcaccgtgcccagaggagcagatgagcagaggagatctgtgcccttccagatgctgctgctgctggagaagatgcaggacagccggcagaaggctgtgcggcccctggagctggcctactgcctgcagaagtgcaatgtgcccctgtttgtgcagcatgatgctgcccagctgtacctgaagctgtggaacctgatcaaggaccagatcacagatgtgcacctggtggagcggctgcaggccctgtacaccatccgggtgaaggacagcctcatctgtgtggactgtgccatggagagcagcaggaacagctccatgctgaccctgcccctgagcctgtttgatgtggacagcaagcccctgaagaccctggaggatgccctgcactgcttcttccagccccgggagctgagcagcaagagcaagtgcttctgtgagaactgtgggaagaagacccggggcaagcaggtgctgaagctgacccacctgccccagaccctgaccatccacctgatgaggttcagcatccggaacagccagaccaggaagatctgccacagcctgtacttcccccagagcctggacttcagccagatcctgcccatgaagcgggagagctgtgatgctgaggagcagagcggcggccagtatgagctgtttgctgtgattgcccacgtgggcatggctgacagcggccactactgtgtgtacatcagaaatgctgtggatggcaagtggttctgcttcaatgacagcaacatctgcctggtgtcctgggaggacatccagtgcacctacggcaaccccaactaccactggcaggagacagcctacctgctggtgtacatgaagatggagtgctag

SEQ ID NO: 168955 - DNA, 1062 bp, Artificial Sequence
  Description of Artificial Sequence: Synthetic coding sequence
atggagttcaggaagaccatggacatcgaccacatcctggactggcagcccccagaggtgatccagaagtacatgcctgggggcctgtgtggctatgacagagatggctgccctgtgtggtatgacatcatcggccccctggaccccaagggcctgctcttctctgtgaccaagcaggacctgctgaagaccaagatgagggactgtgagcgcatcctgcatgaatgtgacctgcagacagagcggctgggcaagaagattgagaccatcgtgatgatctttgactgtgagggcctgggcctgaagcacttctggaagcccctggtggaggtgtaccaggagttcttcggcctgctggaggagaactacccagagaccctgaagttcatgctgattgtgaaggccaccaagctgtttcctgtgggctacaacctgatgaagcccttcctgtctgaggacaccaggaggaagatcatcgtgctgggcaacaactggaaggagggcctgctgaagctgatcagccctgaggagctgcctgcccagtttggaggcaccctgacagatcctgatggcaaccccaagtgcctgaccaagatcaactatggaggagagatccccaagtccatgtatgtgcgggaccaggtgaagacccagtatgagcacagcgtgcagatcaacagaggcagcagccaccaggtggagtatgagatcctcttccctggctgtgtgctgcgctggcagttcagcagtgatggagctgacattggatttggagtcttcctgaagaccaagatgggagagcggcagagagctggggagatgacagatgtgctgcccagccagcgctacaatgcccacatggtgcctgaagatggcaacctgacctgcagcgaggccggcgtgtatgtggagagcgagagcggcaagagctgctgccacctgcctgtgatcatctgcagccatgagctgcagaacagccacagcaacagccaggtgatggcctaccagatggtgaggaagtgcaagctgagccggcccctgcccctgcctgccagcaactag

SEQ ID NO: 168956 - DNA, 1026 bp, Artificial Sequence
  Description of Artificial Sequence: Synthetic coding sequence
atggagttcaggaagaccatggacatcgaccacatcctggactggcagcccccagaggtgatccagaagtacatgcctgggggcctgtgtggctatgacagagatggctgccctgtgtggtatgacatcatcggccccctggaccccaagggcctgctcttctctgtgaccaagcaggacctgctgaagaccaagatgagggactgtgagcgcatcctgcatgaatgtgacctgcagacagagcggctgggcaagaagattgagaccatcgtgatgatctttgactgtgagggcctgggcctgaagcacttctggaagcccctggtggaggtgtaccaggagttcttcggcctgctggaggagaactacccagagaccctgaagttcatgctgattgtgaaggccaccaagctgtttcctgtgggctacaacctgatgaagcccttcctgtctgaggacaccaggaggaagatcatcgtgctgggcaacaactggaaggagggcctgctgaagctgatcagccctgaggagctgcctgcccagtttggaggcaccctgacagatcctgatggcaaccccaagtgcctgaccaagatcaactatggaggagagatccccaagtccatgtatgtgcgggaccaggtgaagacccagtatgagcacagcgtgcagatcaacagaggcagcagccaccaggtggagtatgagatcctcttccctggctgtgtgctgcgctggcagttcagcagtgatggagctgacattggatttggagtcttcctgaagaccaagatgggagagcggcagagagctggggagatgacagatgtgctgcccagccagcgctacaatgcccacatggtgcctgaagatggcaacctgacctgcagcgaggccggcgtgtatgtgctgcgctttgacaacacctacagctttgtgcacgccaagaaggtgtccttcaccgtggaggtgctgctgcctgatgagggcatgcagaagtatgacaaggagctgacccctgtgtag

SEQ ID NO: 168957 - DNA, 972 bp, Artificial Sequence
  Description of Artificial Sequence: Synthetic coding sequence
atggtgatccagaagtacatgcctgggggcctgtgtggctatgacagagatggctgccctgtgtggtatgacatcatcggccccctggaccccaagggcctgctcttctctgtgaccaagcaggacctgctgaagaccaagatgagggactgtgagcgcatcctgcatgaatgtgacctgcagacagagcggctgggcaagaagattgagaccatcgtgatgatctttgactgtgagggcctgggcctgaagcacttctggaagcccctggtggaggtgtaccaggagttcttcggcctgctggaggagaactacccagagaccctgaagttcatgctgattgtgaaggccaccaagctgtttcctgtgggctacaacctgatgaagcccttcctgtctgaggacaccaggaggaagatcatcgtgctgggcaacaactggaaggagggcctgctgaagctgatcagccctgaggagctgcctgcccagtttggaggcaccctgacagatcctgatggcaaccccaagtgcctgaccaagatcaactatggaggagagatccccaagtccatgtatgtgcgggaccaggtgaagacccagtatgagcacagcgtgcagatcaacagaggcagcagccaccaggtggagtatgagatcctcttccctggctgtgtgctgcgctggcagttcagcagtgatggagctgacattggatttggagtcttcctgaagaccaagatgggagagcggcagagagctggggagatgacagatgtgctgcccagccagcgctacaatgcccacatggtgcctgaagatggcaacctgacctgcagcgaggccggcgtgtatgtgctgcgctttgacaacacctacagctttgtgcacgccaagaaggtgtccttcaccgtggaggtgctgctgcctgatgagggcatgcagaagtatgacaaggagctgacccctgtgtag

SEQ ID NO: 168958 - DNA, 972 bp, Artificial Sequence; identical to SEQ ID NO: 168957
  Description of Artificial Sequence: Synthetic coding sequence

SEQ ID NO: 168959 - DNA, 1221 bp, Artificial Sequence
  Description of Artificial Sequence: Synthetic coding sequence
atgagcagccgggtgggggacctgagcccccagcagcaggaggccctggcccgcttccgggagaacctgcaggacctgctgcccatcctgcccaatgctgatgactacttcctgctgcgctggctgcgggccaggaactttgacctgcagaagtctgaggacatgctgcggcggcacatggagttcaggaagcagcaggacctggacaacatcgtgacctggcagcccccagaggtgatccagctgtatgattctgggggcctgtgtggctatgactatgagggctgccctgtgtacttcaacatcatcggcagcctggaccccaagggcctgctgctgagcgccagcaagcaggacatgatcaggaagaggatcaaggtgtgtgagctgctgctgcatgaatgtgagctgcagacccagaagctgggcaggaagattgagatggccctgatggtgtttgacatggagggcctgagcctgaagcacctgtggaagccagctgtggaggtgtaccagcagttcttcagcatcctggaggccaactacccagagaccctgaagaacctgattgtcatccgggcccccaagctgtttcctgtggccttcaacctggtgaagagcttcatgtctgaggagaccaggaggaagatcgtcatcctgggggacaactggaagcaggagctgaccaagttcatcagcccagaccagctgcctgtggagtttggaggcaccatgacagatcctgatggcaaccccaagtgcctgaccaagatcaactacggcggggaggtgcccaagagctactacctgtgtgagcaggtgcggctgcagtatgagcacaccaggtctgtgggccggggcagcagcctgcaggtggagaatgagatcctcttccctggctgtgtgctgcgctggcagtttgccagtgatggaggagacatcggctttggagtcttcctgaagaccaagatgggagagcagcagagcgcccgggagatgacagaggtgctgcccagccagcgctacaatgcccacatggtgcctgaagatggcagcctgacctgcctgcaggccggcgtgtatgtgctgcgctttgacaacacctacagcaggatgcacgccaagaagctgagctacacagtggaggtgctgctgcctgacaaggccagcgaggagaccctgcagagcctgaaggccatgaggcccagccccacccagtag

SEQ ID NO: 168960 - DNA, 1083 bp, Artificial Sequence
  Description of Artificial Sequence: Synthetic coding sequence
atgagcagccgggtgggggacctgagcccccagcagcaggaggccctggcccgcttccgggagaacctgcaggacctgctgcccatcctgcccaatgctgatgactacttcctgctgcgctggctgcgggccaggaactttgacctgcagaagtctgaggacatgctgcggcggcacatggagttcaggaagcagcaggacctggacaacatcgtgacctggcagcccccagaggtgatccagctgtatgattctgggggcctgtgtggctatgactatgagggctgccctgtgtacttcaacatcatcggcagcctggaccccaagggcctgctgctgagcgccagcaagcaggacatgatcaggaagaggatcaaggtgtgtgagctgctgctgcatgaatgtgagctgcagacccagaagctgggcaggaagattgagatggccctgatggtgtttgacatggagggcctgagcctgaagcacctgtggaagccagctgtggaggtgtaccagcagttcttcagcatcctggaggccaactacccagagaccctgaagaacctgattgtcatccgggcccccaagctgtttcctgtggccttcaacctggtgaagagcttcatgtctgaggagaccaggaggaagatcgtcatcctgggggacaactggaagcaggagctgaccaagttcatcagcccagaccagctgcctgtggagtttggaggcaccatgacagatcctgatggcaaccccaagtgcctgaccaagatcaactacggcggggaggtgcccaagagctactacctgtgtgagcaggtgcggctgcagtatgagcacaccaggtctgtgggccggggcagcagcctgcaggtggagaatgagatcctcttccctggctgtgtgctgcgctggcagtttgccagtgatggaggagacatcggctttggagtcttcctgaagaccaagatgggagagcagcagagcgcccgggagatgacagaggtgctgcccagccagcgctacaatgcccacatggtgcctgaagatggcagcctgacctgcctgcaggccggcgtgtag

SEQ ID NO: 168961 - DNA, 1083 bp, Artificial Sequence
  Description of Artificial Sequence: Synthetic coding sequence
atgctgcggcggcacatggagttcaggaagcagcaggacctggacaacatcgtgacctggcagcccccagaggtgatccagctgtatgattctgggggcctgtgtggctatgactatgagggctgccctgtgtacttcaacatcatcggcagcctggaccccaagggcctgctgctgagcgccagcaagcaggacatgatcaggaagaggatcaaggtgtgtgagctgctgctgcatgaatgtgagctgcagacccagaagctgggcaggaagattgagatggccctgatggtgtttgacatggagggcctgagcctgaagcacctgtggaagccagctgtggaggtgtaccagcagttcttcagcatcctggaggccaactacccagagaccctgaagaacctgattgtcatccgggcccccaagctgtttcctgtggccttcaacctggtgaagagcttcatgtctgaggagaccaggaggaagatcgtcatcctgggggacaactggaagcaggagctgaccaagttcatcagcccagaccagctgcctgtggagtttggaggcaccatgacagatcctgatggcaaccccaagtgcctgaccaagatcaactacggcggggaggtgcccaagagctactacctgtgtgagcaggtgcggctgcagtatgagcacaccaggtctgtgggccggggcagcagcctgcaggtggagaatgagatcctcttccctggctgtgtgctgcgctggcagtttgccagtgatggaggagacatcggctttggagtcttcctgaagaccaagatgggagagcagcagagcgcccgggagatgacagaggtgctgcccagccagcgctacaatgcccacatggtgcctgaagatggcagcctgacctgcctgcaggccggcgtgtatgtgcggggcctgtgcagcctcatcaccagccccagcctgcagatgagctgtgccagcaccacccccacagctggctgcatgcccaggagcagcgccaccctgtggcgctgctgcttccccacccggcccctgcggcggcgctgccgggtgtccagaagatag

SEQ ID NO: 168962 - DNA, 1176 bp, Artificial Sequence
  Description of Artificial Sequence: Synthetic coding sequence
atgctgatgaccaccagcagctgtgccggctgtgagctggagaccctgacctgcaggaaccccaagacctgcagcgagggccccaagagcccccagcccaccagctgcccccacgccctgcgggcctggcacatggagttcaggaagcagcaggacctggacaacatcgtgacctggcagcccccagaggtgatccagctgtatgacagcggcggcctgtgtggctatgactatgagggctgccctgtgtacttcaacatcatcggcagcctggaccccaagggcctgctgctgagcgccagcaagcaggacatgatcaggaagaggatcaaggtgtgtgagctgctgctgcatgaatgtgagctgcagacccagaagctgggcaggaagattgagatggccctgatggtgtttgacatggagggcctgagcctgaagcacctgtggaagccagctgtggaggtgtaccagcagttcttcagcatcctggaggccaactacccagagaccctgaagaacctgattgtcatccgggcccccaagctgtttcctgtggccttcaacctggtgaagagcttcatgtctgaggagaccaggaggaagatcgtcatcctgggggacaactggaagcaggagctgaccaagttcatcagcccagaccagctgcctgtggagtttggaggcaccatgacagatcctgatggcaaccccaagtgcctgaccaagatcaactatggaggagaggtgcccaagagctactacctgtgtgagcaggtgcggctgcagtatgagcacaccaggtctgtgggccggggcagcagcctgcaggtggagaatgagatcctcttccctggctgtgtgctgcgctggcagtttgccagtgatggaggagacattggatttggagtcttcctgaagaccaagatgggagagcagcagagcgcccgggagatgacagaggtgctgcccagccagcgctacaatgcccacatggtgcctgaagatggcagcctgacctgcctgcaggccggcgtgtatgtgctgcgctttgacaacacctacagcaggatgcacgccaagaagctgagctacacagtggaggtgctgctgcctgacaaggccagcgaggagaccctgcagagcctgaaggccatgaggcccagccccacccagtag

SEQ ID NO: 168963 - DNA, 2256 bp, Artificial Sequence
  Description of Artificial Sequence: Synthetic coding sequence
ccagctgctgctgccagcagcctggagcgggagacagagcgcttccgggagctgctgctgtatggcaggaagaaggatgccctggagagcgccatgaagaatggcctgtggggccacgccctgctgctggccagcaagatggacagcaggacccacgcccgggtgatgaccaggtttgccaacagcctgcccatcaatgaccccctgcagacagtgtaccagctgatgagcggccgcatgcctgctgccagcacctgctgcggagatgagaagtggggagactggaggccccacctggccatggtgctgagcaacctgaacaacaacatggatgtggagagcaggaccatggccaccatgggagacaccctggccagccggggcctgctggatgctgcccacttctgctacctgatggcccaggccggcttcggcgtgtacaccaagaagaccaccaagctggtgctgattggcagcaaccacagcctgcccttcctgaagtttgccaccaatgaggccatccagaggacagaggcctatgaatatgcccagagcctgggcgctgagacctgccccctgcccagcttccaggtgttcaagttcatctacagctgccgcctggccgagatgggcctggccacccaggccttccactactgtgaggccatcgccaagagcatcctgacccagccccacctgtacagccctgtgctgatcagccagctggtgcagatggccagccagctgcggctgtttgacccccagctgaaggagaagccagaggaggagagcctggccgcccccacctggctggtgcacctgcagcaggtggagcggcagatcaaggagggcgccggcgtgtggcaccaggatggagccctgccccagcagtgccccggcacccccagcagcgagatggagcagctggaccggcccggcctgagccagcccggggccctgggcatcgccaaccccctgctggccgtgcctgcccccagccctgagcacagcagccccagcgtgcggctgctgcccagcgccccccagaccctgcctgatggccccctggccagccctgcccgggtgcccatgtttcctgtgcccctgcccccaggccccctggagcccggccctggctgtgtgaccccaggccctgccctgggcttcctggagcccagcggccctggcctgcccccaggagtgccccccctgcaggagaggaggcacctgctgcaggaggcccggagcccagaccccggcatcgtgccccaggaggcccctgtgggcaacagcctgtctgagctgtctgaggagaactttgatggcaagtttgccaacctgacccccagcaggacagtgcctgacagcgaggcccctcctggctgggacagagctgacagcggccccacccagccccccctgagcctgagccctgcccctgagaccaagaggcctggccaggccgccaagaaggagaccaaggagcccaagaagggggagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccaccccagatgctgaggagccccagctgcctgatggcaccggccgggagggccctgctgctgcccggggcctggccaaccctgagcccgcccctgagcccaaggtgctgagcagcgctgccagcctgcccggcagcgagctgcccagcagcaggcctgagggcagccagggcggggagctgagccgctgcagctccatgagcagcctgagccgggaggtgtcccagcacttcaaccaggcccctggggacctgcctgctgctgggggcccccccagcggggccatgcccttctacaacccagcccagctggcccaggcctgtgccaccagcggcagcagccggctgggccgcatcggccagaggaagcacctggtgctgaactag

SEQ ID NO: 168964 - DNA, 6480 bp, Artificial Sequence
  Description of Artificial Sequence: Synthetic coding sequence
atgcctggcctggaccggcccctgagccggcagaacccccatgatggagtggtgaccccagctgccagccccagcctgccccagcccggcctgcagatgcctggccagtggggccctgtgcagggcggcccccagcccagcggccagcacaggagcccctgcccagagggccctgtgcccagcggcgtgccctgtgccacctctgtgccccacttccccacccccagcatcctgcaccagggccctggccacgagcagcacagccccctggtggcccctcctgctgccctgcccagtgatggaagagatgaggtgagccacctgcagagcggcagccacctggccaacaacagcgaccctgagagcaccttccggcagaacccccgcatcgtgaaccactgggccagccctgagctgcggcagaaccctggggtgaagaatgagcacaggcctgccagcgccctggtgaaccccctggcccggggggacagccctgagaacagaacccaccaccccctgggcgctggggccggcagcggctgtgcccccctggaggccgacagcggggccagcggggccctggccatgttcttccagggcggggagacagaaaatgaggagaacctgagcagcgagaaggccggcctgagcggccaggccgactttgatgacttctgcagcagccctggcctgggccggcccccagcccccacccacgtgggcgccggcagcctgtgccaggccctgctgcccggccccagcaatgaagctgctggagatgtgtggggagacacagccagcactggagtgcctgatgccagcggcagccagtatgaaaatgtggagaacctggagtttgtgcagaaccaggaggtgctgcccagcgagcccctgaacctggaccccagcagccccagcgaccagttccgctatggccccctgcccggccctgctgtgcccaggcatggagctgtgtgccacactggagccccagatgccaccctgcacacagtgcacccagacagcgtgagcagcagctacagcagccgcagccacggccgcctgagcggcagcgcccggccccaggagctggtgggcaccttcatccagcaggaggtgggcaagccagaagatgaggccagcggcagcttcttcaagcagattgacagcagccctgtgggcggggagacagatgagaccaccgtgtcccagaactaccggggctctgtgtcccagcccagcacccccagcccccccaagcccaccggcatcttccagaccagcgccaacagcagctttgagcctgtgaagagccacctggtgggcgtgaagccctttgaggccgaccgggccaacgtggtgggggaggtgcgggagacctgtgtgcggcagaagcagtgcaggcctgctgctgccctgcctgatgccagccctggcaacctggagcagcccccagacaacatggagaccctgtgtgccccccaggtgtgccccctgcccctgaacagcaccacagaagctgtgcacatgctgccccacgccggggccccacccctggacacagtgtacccagcccctgagaagaggccttctgcccggacccagggccctgtgaagtgtgagagccctgccaccaccctgtgggcccagagcgagctgcctgactttggaggaaatgtgctgctggccccagctgccccagccctgtatgtgtgtgccaagccccagccccctgtggtgcagcccccagaggaggccatgagcggccagcagagcaggaaccccagcagcgctgcccctgtgcagagcagaggaggcattggagccagcgagaacctggagaacccccccaagatgggagaggaggaggccctgcagagccaggccagcagcggctacgccagcctgctgagcagccccccaacagagagcctgcagaacccccctgtgctgattgcccagcctgaccacagctacaacctggcccagcccatcaacttctctgtgtccctgagcaacagccatgagaagaaccagagctggagggaggccctggtgggggacaggcctgctgtgtcctcctgggccctgggcggggacagcggggagaacaccagcctgagcggcatccccaccagctctgtgctgagcctgagcctgcccagctctgtggcccagagcaacttcccccagggcagcggggccagcgagatggtgagcaaccagcctgccaacctgctggtgcagccccccagccagcctgtgcctgagaacctggtgcctgagagccagaaggacaggaaggccggcagcgccctgcccggctttgccaacagccctgctggcagcacctctgtggtgctggtgcccccagcccacggcaccctggtgcctgatggcaacaaggccaaccacagcagccaccaggaggacacctatggagccctggacttcaccctgagcaggaccctggagaaccctgtgaatgtgtacaaccccagccacagcgacagcctggccagccagcagagcgtggccagccacccccggcagagcggccctggggcccccaacctggaccgcttctaccagcaggtgaccaaggatgcccagggccagcccggcctggagcgggcccagcaggagctggtgcccccccagcagcaggccagccccccccagctgcccaaggccatgttttctgagctgagcaaccctgagagcctgcctgcccagggccaggcccagaacagcgcccagagccctgccagcctggtgctggtggatgctggccagcagctgcccccccggcccccccagagcagctctgtgtccctggtgagcagcggcagcggccaggccgctgtgcccagcgagcagccctggccccagcctgtgcctgccctggcccctggccccccaccccaggacctggccgcctactactactaccggcccctgtatgatgcctaccagccccagtacagcctgccctacccacctgagcctggagctgccagcctgtactaccaggatgtgtacagcctgtatgagccccgctaccggccctatgatggagctgccagcgcctatgcccagaactaccgctacccagagcctgagcggcccagcagccgggccagccacagcagcgagcggcccccaccccggcagggctacccagagggctactacagcagcaagagcggctggagcagccagagcgactactatgccagctactacagcagccagtatgactatggagaccccggccactgggaccgctaccactacagcgcccgggtgcgggaccccaggacctatgaccggcgctactggtgtgatgctgaatatgatgcctacagaagagagcacagcgcctttggagacaggcctgagaagagggacaacaactggaggtatgacccccgcttcaccggcagctttgatgatgatcctgacccccaccgggacccctatggagaggaggtggacagaagatctgtgcacagcgagcacagcgcccggagcctgcacagcgcccacagcctggccagccgccgcagcagcctgagcagccacagccaccagagccagatctaccgcagccacaacgtggccgccggcagctatgaggcccccctgcccccaggcagcttccacggggactttgcctacggcacctaccgcagcaacttcagcagcggccctggcttcccagaatatggctacccagctgacacagtgtggccagccatggagcaggtgagcagccggcccaccagccctgagaagttctctgtgccccacgtgtgtgcccgcttcggccctgggggccagctgatcaaggtgatccccaacctgcccagcgagggccagcctgccctggtggaggtgcacagcatggaggccctgctgcagcacaccagcgagcaggaggagatgagggccttccctggccccctggccaaggatgacacccacaaggtggatgtgatcaactttgcccagaacaaggccatgaagtgcctgcagaatgaaaacctgattgacaaggagagcgccagcctgctgtggaacttcatcgtgctgctgtgccggcagaatggcaccgtggtgggcacagacattgctgagctgctgctgcgggaccacaggacagtgtggctgcccgggaagagccccaatgaggccaacctgattgacttcaccaatgaggccgtggagcaggtggaggaggaggagagcggggaggcccagctgtccttcctgaccggcggccctgctgctgctgccagcagcctggagcgggagacagagcgcttccgggagctgctgctgtatggcaggaagaaggatgccctggagagcgccatgaagaatggcctgtggggccacgccctgctgctggccagcaagatggacagcaggacccacgcccgggtgatgaccaggtttgccaacagcctgcccatcaatgaccccctgcagacagtgtaccagctgatgagcggccgcatgcctgctgccagcacctgctgcggagatgagaagtggggagactggaggccccacctggccatggtgctgagcaacctgaacaacaacatggatgtggagagcaggaccatggccaccatgggagacaccctggccagccggggcctgctggatgctgcccacttctgctacctgatggcccaggccggcttcggcgtgtacaccaagaagaccaccaagctggtgctgattggcagcaaccacagcctgcccttcctgaagtttgccaccaatgaggccatccagaggacagaggcctatgaatatgcccagagcctgggcgctgagacctgccccctgcccagcttccaggtgttcaagttcatctacagctgccgcctggccgagatgggcctggccacccaggccttccactactgtgaggccatcgccaagagcatcctgacccagccccacctgtacagccctgtgctgatcagccagctggtgcagatggccagccagctgcggctgtttgacccccagctgaaggagaagccagaggaggagagcctggccgcccccacctggctggtgcacctgcagcaggtggagcggcagatcaaggagggcgccggcgtgtggcaccaggatggagccctgccccagcagtgccccggcacccccagcagcgagatggagcagctggaccggcccggcctgagccagcccggggccctgggcatcgccaaccccctgctggccgtgcctgcccccagccctgagcacagcagccccagcgtgcggctgctgcccagcgccccccagaccctgcctgatggccccctggccagccctgcccgggtgcccatgtttcctgtgcccctgcccccaggccccctggagcccggccctggctgtgtgaccccaggccctgccctgggcttcctggagcccagcggccctggcctgcccccaggagtgccccccctgcaggagaggaggcacctgctgcaggaggcccggagcccagaccccggcatcgtgccccaggaggcccctgtgggcaacagcctgtctgagctgtctgaggagaactttgatggcaagtttgccaacctgacccccagcaggacagtgcctgacagcgaggcccctcctggctgggacagagctgacagcggccccacccagccccccctgagcctgagccctgcccctgagaccaagaggcctggccaggccgccaagaaggagaccaaggagcccaagaagggggagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccaccccagatgctgaggagccccagctgcctgatggcaccggccgggagggccctgctgctgcccggggcctggccaaccctgagcccgcccctgagcccaaggtgctgagcagcgctgccagcctgcccggcagcgagctgcccagcagcaggcctgagggcagccagggcggggaggcccctggggacctgcctgctgctgggggcccccccagcggggccatgcccttctacaacccagcccagctggcccaggcctgtgccaccagcggcagcagccggctgggccgcatcggccagaggaagcacctggtgctgaactag

SEQ ID NO: 168965 - DNA, 7074 bp, Artificial Sequence
  Description of Artificial Sequence: Synthetic coding sequence
atgcagcccccaccccagacagtgcccagcggcatggccggccccccacctgctggcaaccccaggtctgtgttctgggccagcagcccctacagaagaagagccaacaacaatgctgctgtggcccccaccacctgccccctgcagcctgtgacagacccctttgccttcagccggcaggccctgcagagcacccccctgggcagcagcagcaagagcagcccccctgtgctgcagggccctgccccagctggcttcagccagcaccctggcctgctggtgccccacacccacgcccgggacagcagccagggcccctgtgagcccctgcccggccccctgacccagccccgggcccacgccagccccttcagcggggccctgaccccatctgcccctcctggccctgagatgaacagatctgctgaggtgggccccagcagcgagcctgaggtgcagaccctgccctacctgccccactacatccctggggtggaccctgagaccagccatggaggccacccccacggcaacatgcctggcctggaccggcccctgagccggcagaacccccatgatggagtggtgaccccagctgccagccccagcctgccccagcccggcctgcagatgcctggccagtggggccctgtgcagggcggcccccagcccagcggccagcacaggagcccctgcccagagggccctgtgcccagcggcgtgccctgtgccacctctgtgccccacttccccacccccagcatcctgcaccagggccctggccacgagcagcacagccccctggtggcccctcctgctgccctgcccagtgatggaagagatgaggtgagccacctgcagagcggcagccacctggccaacaacagcgaccctgagagcaccttccggcagaacccccgcatcgtgaaccactgggccagccctgagctgcggcagaaccctggggtgaagaatgagcacaggcctgccagcgccctggtgaaccccctggcccggggggacagccctgagaacagaacccaccaccccctgggcgctggggccggcagcggctgtgcccccctggaggccgacagcggggccagcggggccctggccatgttcttccagggcggggagacagaaaatgaggagaacctgagcagcgagaaggccggcctgagcggccaggccgactttgatgacttctgcagcagccctggcctgggccggcccccagcccccacccacgtgggcgccggcagcctgtgccaggccctgctgcccggccccagcaatgaagctgctggagatgtgtggggagacacagccagcactggagtgcctgatgccagcggcagccagtatgaaaatgtggagaacctggagtttgtgcagaaccaggaggtgctgcccagcgagcccctgaacctggaccccagcagccccagcgaccagttccgctatggccccctgcccggccctgctgtgcccaggcatggagctgtgtgccacactggagccccagatgccaccctgcacacagtgcacccagacagcgtgagcagcagctacagcagccgcagccacggccgcctgagcggcagcgcccggccccaggagctggtgggcaccttcatccagcaggaggtgggcaagccagaagatgaggccagcggcagcttcttcaagcagattgacagcagccctgtgggcggggagacagatgagaccaccgtgtcccagaactaccggggctctgtgtcccagcccagcacccccagcccccccaagcccaccggcatcttccagaccagcgccaacagcagctttgagcctgtgaagagccacctggtgggcgtgaagccctttgaggccgaccgggccaacgtggtgggggaggtgcgggagacctgtgtgcggcagaagcagtgcaggcctgctgctgccctgcctgatgccagccctggcaacctggagcagcccccagacaacatggagaccctgtgtgccccccaggtgtgccccctgcccctgaacagcaccacagaagctgtgcacatgctgccccacgccggggccccacccctggacacagtgtacccagcccctgagaagaggccttctgcccggacccagggccctgtgaagtgtgagagccctgccaccaccctgtgggcccagagcgagctgcctgactttggaggaaatgtgctgctggccccagctgccccagccctgtatgtgtgtgccaagccccagccccctgtggtgcagcccccagaggaggccatgagcggccagcagagcaggaaccccagcagcgctgcccctgtgcagagcagaggaggcattggagccagcgagaacctggagaacccccccaagatgggagaggaggaggccctgcagagccaggccagcagcggctacgccagcctgctgagcagccccccaacagagagcctgcagaacccccctgtgctgattgcccagcctgaccacagctacaacctggcccagcccatcaacttctctgtgtccctgagcaacagccatgagaagaaccagagctggagggaggccctggtgggggacaggcctgctgtgtcctcctgggccctgggcggggacagcggggagaacaccagcctgagcggcatccccaccagctctgtgctgagcctgagcctgcccagctctgtggcccagagcaacttcccccagggcagcggggccagcgagatggtgagcaaccagcctgccaacctgctggtgcagccccccagccagcctgtgcctgagaacctggtgcctgagagccagaaggacaggaaggccggcagcgccctgcccggctttgccaacagccctgctggcagcacctctgtggtgctggtgcccccagcccacggcaccctggtgcctgatggcaacaaggccaaccacagcagccaccaggaggacacctatggagccctggacttcaccctgagcaggaccctggagaaccctgtgaatgtgtacaaccccagccacagcgacagcctggccagccagcagagcgtggccagccacccccggcagagcggccctggggcccccaacctggaccgcttctaccagcaggtgaccaaggatgcccagggccagcccggcctggagcgggcccagcaggagctggtgcccccccagcagcaggccagccccccccagctgcccaaggccatgttttctgagctgagcaaccctgagagcctgcctgcccagggccaggcccagaacagcgcccagagccctgccagcctggtgctggtggatgctggccagcagctgcccccccggcccccccagagcagctctgtgtccctggtgagcagcggcagcggccaggccgctgtgcccagcgagcagccctggccccagcctgtgcctgccctggcccctggccccccaccccaggacctggccgcctactactactaccggcccctgtatgatgcctaccagccccagtacagcctgccctacccacctgagcctggagctgccagcctgtactaccaggatgtgtacagcctgtatgagccccgctaccggccctatgatggagctgccagcgcctatgcccagaactaccgctacccagagcctgagcggcccagcagccgggccagccacagcagcgagcggcccccaccccggcagggctacccagagggctactacagcagcaagagcggctggagcagccagagcgactactatgccagctactacagcagccagtatgactatggagaccccggccactgggaccgctaccactacagcgcccgggtgcgggaccccaggacctatgaccggcgctactggtgtgatgctgaatatgatgcctacagaagagagcacagcgcctttggagacaggcctgagaagagggacaacaactggaggtatgacccccgcttcaccggcagctttgatgatgatcctgacccccaccgggacccctatggagaggaggtggacagaagatctgtgcacagcgagcacagcgcccggagcctgcacagcgcccacagcctggccagccgccgcagcagcctgagcagccacagccaccagagccagatctaccgcagccacaacgtggccgccggcagctatgaggcccccctgcccccaggcagcttccacggggactttgcctacggcacctaccgcagcaacttcagcagcggccctggcttcccagaatatggctacccagctgacacagtgtggccagccatggagcaggtgagcagccggcccaccagccctgagaagttctctgtgccccacgtgtgtgcccgcttcggccctgggggccagctgatcaaggtgatccccaacctgcccagcgagggccagcctgccctggtggaggtgcacagcatggaggccctgctgcagcacaccagcgagcaggaggagatgagggccttccctggccccctggccaaggatgacacccacaaggtggatgtgatcaactttgcccagaacaaggccatgaagtgcctgcagaatgaaaacctgattgacaaggagagcgccagcctgctgtggaacttcatcgtgctgctgtgccggcagaatggcaccgtggtgggcacagacattgctgagctgctgctgcgggaccacaggacagtgtggctgcccgggaagagccccaatgaggccaacctgattgacttcaccaatgaggccgtggagcaggtggaggaggaggagagcggggaggcccagctgtccttcctgaccggcggccctgctgctgctgccagcagcctggagcgggagacagagcgcttccgggagctgctgctgtatggcaggaagaaggatgccctggagagcgccatgaagaatggcctgtggggccacgccctgctgctggccagcaagatggacagcaggacccacgcccgggtgatgaccaggtttgccaacagcctgcccatcaatgaccccctgcagacagtgtaccagctgatgagcggccgcatgcctgctgccagcacctgctgcggagatgagaagtggggagactggaggccccacctggccatggtgctgagcaacctgaacaacaacatggatgtggagagcaggaccatggccaccatgggagacaccctggccagccggggcctgctggatgctgcccacttctgctacctgatggcccaggccggcttcggcgtgtacaccaagaagaccaccaagctggtgctgattggcagcaaccacagcctgcccttcctgaagtttgccaccaatgaggccatccagaggacagaggcctatgaatatgcccagagcctgggcgctgagacctgccccctgcccagcttccaggtgttcaagttcatctacagctgccgcctggccgagatgggcctggccacccaggccttccactactgtgaggccatcgccaagagcatcctgacccagccccacctgtacagccctgtgctgatcagccagctggtgcagatggccagccagctgcggctgtttgacccccagctgaaggagaagccagaggaggagagcctggccgcccccacctggctggtgcacctgcagcaggtggagcggcagatcaaggagggcgccggcgtgtggcaccaggatggagccctgccccagcagtgccccggcacccccagcagcgagatggagcagctggaccggcccggcctgagccagcccggggccctgggcatcgccaaccccctgctggccgtgcctgcccccagccctgagcacagcagccccagcgtgcggctgctgcccagcgccccccagaccctgcctgatggccccctggccagccctgcccgggtgcccatgtttcctgtgcccctgcccccaggccccctggagcccggccctggctgtgtgaccccaggccctgccctgggcttcctggagcccagcggccctggcctgcccccaggagtgccccccctgcaggagaggaggcacctgctgcaggaggcccggagcccagaccccggcatcgtgccccaggaggcccctgtgggcaacagcctgtctgagctgtctgaggagaactttgatggcaagtttgccaacctgacccccagcaggacagtgcctgacagcgaggcccctcctggctgggacagagctgacagcggccccacccagccccccctgagcctgagccctgcccctgagaccaagaggcctggccaggccgccaagaaggagaccaaggagcccaagaagggggagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccaccccagatgctgaggagccccagctgcctgatggcaccggccgggagggccctgctgctgcccggggcctggccaaccctgagcccgcccctgagcccaaggtgctgagcagcgctgccagcctgcccggcagcgagctgcccagcagcaggcctgagggcagccagggcggggagctgagccgctgcagctccatgagcagcctgagccgggaggtgtcccagcacttcaaccaggcccctggggacctgcctgctgctgggggcccccccagcggggccatgcccttctacaacccagcccagctggcccaggcctgtgccaccagcggcagcagccggctgggccgcatcggccagaggaagcacctggtgctgaactag

SEQ ID NO: 168966 - DNA, 1158 bp, Artificial Sequence
  Description of Artificial Sequence: Synthetic coding sequence
atggacctgctgcccaccagcatcctgctggccagcctgtggatctgcagccacctgcaccccccaggagtgtctgtggacctgccccccaccagcatcctgctggtgtccctgtggatctgcagccacctgcaccccccaggagtgtctgtggaccggcccccaccacccagctcctggtgcctgtgtggcagcccccccaccagcatcctgctggtgtccctgtggatctgcagccccccacccagctcctggtgcctgtgtggcagcgcccccaccagcatcctgctggtgtccctgtggatctggaggctgtggggcctgacagaaggagagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccacccctgtgtcctctgtgcggccccagggccgcagcggcagaaatgatggcctgctggccctgagcagcccagatgctgaggagccccagctgcctgatggcaccggccgggagggccctgctgctgcccggggcctggccaaccctgagcccgcccctgagcccaaggtgctgagcagcgctgccagcctgcccggcagcgagctgcccagcagcaggcctgagggcagccagggcggggagctgagccgctgcagctccatgagcagcctgagccgggaggtgtcccagcacttcaaccaggcccctggggacctgcctgctgctgggggcccccccagcggggccatgcccttctacaacccagcccagctggcccaggcctgtgccaccagcggcagcagccggctgggccgcatcggccagaggaagcacctggtgctgaactag

SEQ ID NO: 168967 - DNA, 6405 bp, Artificial Sequence
  Description of Artificial Sequence: Synthetic coding sequence
atgcctggcctggaccggcccctgagccggcagaacccccatgatggagtggtgaccccagctgccagccccagcctgccccagcccggcctgcagatgcctggccagtggggccctgtgcagggcggcccccagcccagcggccagcacaggagcccctgcccagagggccctgtgcccagcggcgtgccctgtgccacctctgtgccccacttccccacccccagcatcctgcaccagggccctggccacgagcagcacagccccctggtggcccctcctgctgccctgcccagtgatggaagagatgaggtgagccacctgcagagcggcagccacctggccaacaacagcgaccctgagagcaccttccggcagaacccccgcatcgtgaaccactgggccagccctgagctgcggcagaaccctggggtgaagaatgagcacaggcctgccagcgccctggtgaaccccctggcccggggggacagccctgagaacagaacccaccaccccctgggcgctggggccggcagcggctgtgcccccctggaggccgacagcggggccagcggggccctggccatgttcttccagggcggggagacagaaaatgaggagaacctgagcagcgagaaggccggcctgagcggccaggccgactttgatgacttctgcagcagccctggcctgggccggcccccagcccccacccacgtgggcgccggcagcctgtgccaggccctgctgcccggccccagcaatgaagctgctggagatgtgtggggagacacagccagcactggagtgcctgatgccagcggcagccagtatgaaaatgtggagaacctggagtttgtgcagaaccaggaggtgctgcccagcgagcccctgaacctggaccccagcagccccagcgaccagttccgctatggccccctgcccggccctgctgtgcccaggcatggagctgtgtgccacactggagccccagatgccaccctgcacacagtgcacccagacagcgtgagcagcagctacagcagccgcagccacggccgcctgagcggcagcgcccggccccaggagctggtgggcaccttcatccagcaggaggtgggcaagccagaagatgaggccagcggcagcttcttcaagcagattgacagcagccctgtgggcggggagacagatgagaccaccgtgtcccagaactaccggggctctgtgtcccagcccagcacccccagcccccccaagcccaccggcatcttccagaccagcgccaacagcagctttgagcctgtgaagagccacctggtgggcgtgaagccctttgaggccgaccgggccaacgtggtgggggaggtgcgggagacctgtgtgcggcagaagcagtgcaggcctgctgctgccctgcctgatgccagccctggcaacctggagcagcccccagacaacatggagaccctgtgtgccccccaggtgtgccccctgcccctgaacagcaccacagaagctgtgcacatgctgccccacgccggggccccacccctggacacagtgtacccagcccctgagaagaggccttctgcccggacccagggccctgtgaagtgtgagagccctgccaccaccctgtgggcccagagcgagctgcctgactttggaggaaatgtgctgctggccccagctgccccagccctgtatgtgtgtgccaagccccagccccctgtggtgcagcccccagaggaggccatgagcggccagcagagcaggaaccccagcagcgctgcccctgtgcagagcagaggaggcattggagccagcgagaacctggagaacccccccaagatgggagaggaggaggccctgcagagccaggccagcagcggctacgccagcctgctgagcagccccccaacagagagcctgcagaacccccctgtgctgattgcccagcctgaccacagctacaacctggcccagcccatcaacttctctgtgtccctgagcaacagccatgagaagaaccagagctggagggaggccctggtgggggacaggcctgctgtgtcctcctgggccctgggcggggacagcggggagaacaccagcctgagcggcatccccaccagctctgtgctgagcctgagcctgcccagctctgtggcccagagcaacttcccccagggcagcggggccagcgagatggtgagcaaccagcctgccaacctgctggtgcagccccccagccagcctgtgcctgagaacctggtgcctgagagccagaaggacaggaaggccggcagcgccctgcccggctttgccaacagccctgctggcagcacctctgtggtgctggtgcccccagcccacggcaccctggtgcctgatggcaacaaggccaaccacagcagccaccaggaggacacctatggagccctggacttcaccctgagcaggaccctggagaaccctgtgaatgtgtacaaccccagccacagcgacagcctggccagccagcagagcgtggccagccacccccggcagagcggccctggggcccccaacctggaccgcttctaccagcaggtgaccaaggatgcccagggccagcccggcctggagcgggcccagcaggagctggtgcccccccagcagcaggccagccccccccagctgcccaaggccatgttttctgagctgagcaaccctgagagcctgcctgcccagggccaggcccagaacagcgcccagagccctgccagcctggtgctggtggatgctggccagcagctgcccccccggcccccccagagcagctctgtgtccctggtgagcagcggcagcggccaggccgctgtgcccagcgagcagccctggccccagcctgtgcctgccctggcccctggccccccaccccaggacctggccgcctactactactaccggcccctgtatgatgcctaccagccccagtacagcctgccctacccacctgagcctggagctgccagcctgtactaccaggatgtgtacagcctgtatgagccccgctaccggccctatgatggagctgccagcgcctatgcccagaactaccgctacccagagcctgagcggcccagcagccgggccagccacagcagcgagcggcccccaccccggcagggctacccagagggctactacagcagcaagagcggctggagcagccagagcgactactatgccagctactacagcagccagtatgactatggagaccccggccactgggaccgctaccactacagcgcccgggtgcgggaccccaggacctatgaccggcgctactggtgtgatgctgaatatgatgcctacagaagagagcacagcgcctttggagacaggcctgagaagagggacaacaactggaggtatgacccccgcttcaccggcagctttgatgatgatcctgacccccaccgggacccctatggagaggaggtggacagaagatctgtgcacagcgagcacagcgcccggagcctgcacagcgcccacagcctggccagccgccgcagcagcctgagcagccacagccaccagagccagatctaccgcagccacaacgtggccgccggcagctatgaggcccccctgcccccaggcagcttccacggggactttgcctacggcacctaccgcagcaacttcagcagcggccctggcttcccagaatatggctacccagctgacacagtgtggccagccatggagcaggtgagcagccggcccaccagccctgagaagttctctgtgccccacgtgtgtgcccgcttcggccctgggggccagctgatcaaggtgatccccaacctgcccagcgagggccagcctgccctggtggaggtgcacagcatggaggccctgctgcagcacaccagcgagcaggaggagatgagggccttccctggccccctggccaaggatgacacccacaaggtggatgtgatcaactttgcccagaacaaggccatgaagtgcctgcagaatgaaaacctgattgacaaggagagcgccagcctgctgtggaacttcatcgtgctgctgtgccggcagaatggcaccgtggtgggcacagacattgctgagctgctgctgcgggaccacaggacagtgtggctgcccgggaagagccccaatgaggccaacctgattgacttcaccaatgaggccgtggagcaggtggaggaggaggagagcggggaggcccagctgtccttcctgaccggcggccctgctgctgctgccagcagcctggagcgggagacagagcgcttccgggagctgctgctgtatggcaggaagaaggatgccctggagagcgccatgaagaatggcctgtggggccacgccctgctgctggccagcaagatggacagcaggacccacgcccgggtgatgaccaggtttgccaacagcctgcccatcaatgaccccctgcagacagtgtaccagctgatgagcggccgcatgcctgctgccagcacctgctgcggagatgagaagtggggagactggaggccccacctggccatggtgctgagcaacctgaacaacaacatggatgtggagagcaggaccatggccaccatgggagacaccctggccagccggggcctgctggatgctgcccacttctgctacctgatggcccaggccggcttcggcgtgtacaccaagaagaccaccaagctggtgctgattggcagcaaccacagcctgcccttcctgaagtttgccaccaatgaggccatccagaggacagaggcctatgaatatgcccagagcctgggcgctgagacctgccccctgcccagcttccaggtgttcaagttcatctacagctgccgcctggccgagatgggcctggccacccaggccttccactactgtgaggccatcgccaagagcatcctgacccagccccacctgtacagccctgtgctgatcagccagctggtgcagatggccagccagctgcggctgtttgacccccagctgaaggagaagccagaggaggagagcctggccgcccccacctggctggtgcacctgcagcaggtggagcggcagatcaaggagggcgccggcgtgtggcaccaggatggagccctgccccagcagtgccccggcacccccagcagcgagatggagcagctggaccggcccggcctgagccagcccggggccctgggcatcgccaaccccctgctggccgtgcctgcccccagccctgagcacagcagccccagcgtgcggctgctgcccagcgccccccagaccctgcctgatggccccctggccagccctgcccgggtgcccatgtttcctgtgcccctgcccccaggccccctggagcccggccctggctgtgtgaccccaggccctgccctgggcttcctggagcccagcggccctggcctgcccccaggagtgccccccctgcaggagaggaggcacctgctgcaggaggcccggagcccagaccccggcatcgtgccccaggaggcccctgtgggcaacagcctgtctgagctgtctgaggagaactttgatggcaagtttgccaacctgacccccagcaggacagtgcctgacagcgaggcccctcctggctgggacagagctgacagcggccccacccagccccccctgagcctgagccctgcccctgagaccaagaggcctggccaggccgccaagaaggagaccaaggagcccaagaagggggagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccaccccagatgctgaggagccccagctgcctgatggcaccggccgggagggccctgctgctgcccggggcctggccaaccctgagcccgcccctgagcccaaggcccctggggacctgcctgctgctgggggccccccatctggggccatgcccttctacaacccagcccagctggcccaggcctgtgccaccagcggcagcagccggctgggcagaattggccagaggaagcacctggtgctgaactag

SEQ ID NO: 168968 - DNA, 423 bp, Artificial Sequence
  Description of Artificial Sequence: Synthetic coding sequence
atggacctgctgcccaccagcatcctgctggccagcctgtggatctgcagccacctgcaccccccaggagtgtctgtggacctgccccccaccagcatcctgctggtgtccctgtggatctgcagccacctgcaccccccaggagtgtctgtggaccggcccccaccacccagctcctggtgcctgtgtggcagcccccccaccagcatcctgctggtgtccctgtggatctgcagccccccacccagctcctggtgcctgtgtggcagcgcccccaccagcatcctgctggtgtccctgtggatctggaggctgtggggcctgacagaggtgggccacgtggagtttgtgttcctgccctggctgatctcctggaacatcatgttcagcaagctgttcagctgcttcctgtacctgggctag

SEQ ID NO: 168969 - DNA, 2205 bp, Artificial Sequence
  Description of Artificial Sequence: Synthetic coding sequence
atgttttctgagctgagcaaccctgagagcctgcctgcccagggccaggcccagaacagcgcccagagccctgccagcctggtgctggtggatgctggccagcagctgcccccccggcccccccagagcagctctgtgtccctggtgagcagcggcagcggccaggccgctgtgcccagcgagcagccctggccccagcctgtgcctgccctggcccctggccccccaccccaggacctggccgcctactactactaccggcccctgtatgatgcctaccagccccagtacagcctgccctacccacctgagcctggagctgccagcctgtactaccaggatgtgtacagcctgtatgagccccgctaccggccctatgatggagctgccagcgcctatgcccagaactaccgctacccagagcctgagcggcccagcagccgggccagccacagcagcgagcggcccccaccccggcagggctacccagagggctactacagcagcaagagcggctggagcagccagagcgactactatgccagctactacagcagccagtatgactatggagaccccggccactgggaccgctaccactacagcgcccgggtgcgggaccccaggacctatgaccggcgctactggtgtgatgctgaatatgatgcctacagaagagagcacagcgcctttggagacaggcctgagaagagggacaacaactggaggtatgacccccgcttcaccggcagctttgatgatgatcctgacccccaccgggacccctatggagaggaggtggacagaagatctgtgcacagcgagcacagcgcccggagcctgcacagcgcccacagcctggccagccgccgcagcagcctgagcagccacagccaccagagccagatctaccgcagccacaacgtggccgccggcagctatgaggcccccctgcccccaggcagcttccacggggactttgcctacggcacctaccgcagcaacttcagcagcggccctggcttcccagaatatggctacagacctgccctgggcttcctggagcccagcggccctggcctgcccccaggagtgccccccctgcaggagaggaggcacctgctgcaggaggcccggagcccagaccccggcatcgtgccccaggaggcccctgtgggcaacagcctgtctgagctgtctgaggagaactttgatggcaagtttgccaacctgacccccagcaggacagtgcctgacagcgaggcccctcctggctgggacagagctgacagcggccccacccagccccccctgagcctgagccctgcccctgagaccaagaggcctggccaggccgccaagaaggagaccaaggagcccaagaagggggagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccacccctgtgcggccccagggccgctctggaagaaatgatggcctgctggccctgagcagcccagatgctgaggagccccagctgcctgatggcaccggccgggagggccctgctgctgcccggggcctggccaaccctgagcccgcccctgagcccaaggtgctgagcagcgctgccagcctgcccggcagcgagctgcccagcagcaggcctgagggcagccagggcggggagctgagccgctgcagctccatgagcagcctgagccgggaggtgtcccagcacttcaaccaggcccctggggacctgcctgctgctgggggccccccatctggggccatgcccttctacaacccagcccagctggcccaggcctgtgccaccagcggcagcagccggctgggcagaattggccagaggaagcacctggtgctgaactag

SEQ ID NO: 168970 - DNA, 5184 bp, Artificial Sequence
  Description of Artificial Sequence: Synthetic coding sequence
atgttcttccagggcggggagacagaaaatgaggagaacctgagcagcgagaaggccggcctgagcggccaggccgactttgatgacttctgcagcagccctggcctgggccggcccccagcccccacccacgtgggcgccggcagcctgtgccaggccctgctgcccggccccagcaatgaggccgctggagatgtgtggggagacacagccagcactggagtgcctgatgccagcggcagccagtatgaaaatgtggagaacctggagtttgtgcagaaccaggaggtgctgcccagcgagcccctgaacctggaccccagcagccccagcgaccagttccgctatggccccctgcccggccctgctgtgcccaggcatggagctgtgtgccacactggagccccagatgccaccctgcacacagtgcacccagattctgtgagcagcagctacagcagccgcagccacggccgcctgagcggcagcgcccggccccaggagctggtgggcaccttcatccagcaggaggtgggcaagccagaagatgaggccagcggcagcttcttcaagcagattgacagcagccctgtgggcggggagacagatgagaccaccgtgtcccagaactaccggggctctgtgtcccagcccagcacccccagcccccccaagcccaccggcatcttccagaccagcgccaacagcagctttgagcctgtgaagagccacctggtgggcgtgaagccctttgaagctgaccgggccaacgtggtgggggaggtgcgggagacctgtgtgcggcagaagcagtgcaggcctgctgctgccctgcctgatgccagccctggcaacctggagcagcccccagacaacatggagaccctgtgtgccccccaggtgtgccccctgcccctgaacagcaccacagaggccgtgcacatgctgccccatgctggggccccacccctggacacagtgtacccagcccctgagaagaggcccagcgcccggacccagggccctgtgaagtgtgagagccctgccaccaccctgtgggcccagagcgagctgcctgactttggaggaaatgtgctgctggccccagctgccccagccctgtatgtgtgtgccaagccccagccccctgtggtgcagcccccagaggaggccatgagcggccagcagagcaggaaccccagcagcgctgcccctgtgcagagccggggcggcatcggggccagcgagaacctggagaacccccccaagatgggagaggaggaggccctgcagagccaggtgaccaaggatgcccagggccagcccggcctggagcgggcccagcaggagctggtgcccccccagcagcaggccagccccccccagctgcccaaggccatgttttctgagctgagcaaccctgagagcctgcctgcccagggccaggcccagaacagcgcccagagccctgccagcctggtgctggtggatgctggccagcagctgcccccccggcccccccagagcagctctgtgtccctggtgagcagcggcagcggccaggccgctgtgcccagcgagcagccctggccccagcctgtgcctgccctggcccctggccccccaccccaggacctggccgcctactactactaccggcccctgtatgatgcctaccagccccagtacagcctgccctacccacctgagcctggagctgccagcctgtactaccaggatgtgtacagcctgtatgagccccgctaccggccctatgatggagctgccagcgcctatgcccagaactaccgctacccagagcctgagcggcccagcagccgggccagccacagcagcgagcggcccccaccccggcagggctacccagagggctactacagcagcaagagcggctggagcagccagagcgactactatgccagctactacagcagccagtatgactatggagaccccggccactgggaccgctaccactacagcgcccgggtgcgggaccccaggacctatgaccggcgctactggtgtgatgctgaatatgatgcctacagaagagagcacagcgcctttggagacaggcctgagaagagggacaacaactggaggtatgacccccgcttcaccggcagctttgatgatgatcctgacccccaccgggacccctatggagaggaggtggacagaagatctgtgcacagcgagcacagcgcccggagcctgcacagcgcccacagcctggccagccgccgcagcagcctgagcagccacagccaccagagccagatctaccgcagccacaacgtggccgccggcagctatgaggcccccctgcccccaggcagcttccacggggactttgcctacggcacctaccgcagcaacttcagcagcggccctggcttcccagaatatggctacccagctgacacagtgtggccagccatggagcaggtgagcagccggcccaccagccctgagaagttctctgtgccccacgtgtgtgcccgcttcggccctgggggccagctgatcaaggtgatccccaacctgcccagcgagggccagcctgccctggtggaggtgcacagcatggaggccctgctgcagcacaccagcgagcaggaggagatgagggccttccctggccccctggccaaggatgacacccacaaggtggatgtgatcaactttgcccagaacaaggccatgaagtgcctgcagaatgaaaacctgattgacaaggagagcgccagcctgctgtggaacttcatcgtgctgctgtgccggcagaatggcaccgtggtgggcacagacattgctgagctgctgctgcgggaccacaggacagtgtggctgcccgggaagagccccaatgaggccaacctgattgacttcaccaatgaggccgtggagcaggtggaggaggaggagagcggggaggcccagctgtccttcctgaccggcggccctgctgctgctgccagcagcctggagcgggagacagagcgcttccgggagctgctgctgtatggcaggaagaaggatgccctggagagcgccatgaagaatggcctgtggggccacgccctgctgctggccagcaagatggacagcaggacccacgcccgggtgatgaccaggtttgccaacagcctgcccatcaatgaccccctgcagacagtgtaccagctgatgagcggccgcatgcctgctgccagcacctgctgcggagatgagaagtggggagactggaggccccacctggccatggtgctgagcaacctgaacaacaacatggatgtggagagcaggaccatggccaccatgggagacaccctggccagccggggcctgctggatgctgcccacttctgctacctgatggcccaggccggcttcggcgtgtacaccaagaagaccaccaagctggtgctgattggcagcaaccacagcctgcccttcctgaagtttgccaccaatgaggccatccagaggacagaggcctatgaatatgcccagagcctgggcgctgagacctgccccctgcccagcttccaggtgttcaagttcatctacagctgccgcctggccgagatgggcctggccacccaggccttccactactgtgaggccatcgccaagagcatcctgacccagccccacctgtacagccctgtgctgatcagccagctggtgcagatggccagccagctgcggctgtttgacccccagctgaaggagaagccagaggaggagagcctggccgcccccacctggctggtgcacctgcagcaggtggagcggcagatcaaggagggcgccggcgtgtggcaccaggatggagccctgccccagcagtgccccggcacccccagcagcgagatggagcagctggaccggcccggcctgagccagcccggggccctgggcatcgccaaccccctgctggccgtgcctgcccccagccctgagcacagcagccccagcgtgcggctgctgcccagcgccccccagaccctgcctgatggccccctggccagccctgcccgggtgcccatgtttcctgtgcccctgcccccaggccccctggagcccggccctggctgtgtgaccccaggccctgccctgggcttcctggagcccagcggccctggcctgcccccaggagtgccccccctgcaggagaggaggcacctgctgcaggaggcccggagcccagaccccggcatcgtgccccaggaggcccctgtgggcaacagcctgtctgagctgtctgaggagaactttgatggcaagtttgccaacctgacccccagcaggacagtgcctgacagcgaggcccctcctggctgggacagagctgacagcggccccacccagccccccctgagcctgagccctgcccctgagaccaagaggcctggccaggccgccaagaaggagaccaaggagcccaagaagggggagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccaccccagatgctgaggagccccagctgcctgatggcaccggccgggagggccctgctgctgcccggggcctggccaaccctgagcccgcccctgagcccaaggtgctgagcagcgctgccagcctgcccggcagcgagctgcccagcagcaggcctgagggcagccagggcggggaggcccctggggacctgcctgctgctgggggcccccccagcggggccatgcccttctacaacccagcccagctggcccaggcctgtgccaccagcggcagcagccggctgggccgcatcggccagaggaagcacctggtgctgaactag

SEQ ID NO: 168971 - DNA, 6465 bp, Artificial Sequence
  Description of Artificial Sequence: Synthetic coding sequence
atgcctggcctggaccggcccctgagccggcagaacccccatgatggagtggtgaccccagctgccagccccagcctgccccagcccggcctgcagatgcctggccagtggggccctgtgcagggcggcccccagcccagcggccagcacaggagcccctgcccagagggccctgtgcccagcggcgtgccctgtgccacctctgtgccccacttccccacccccagcatcctgcaccagggccctggccacgagcagcacagccccctggtggcccctcctgctgccctgcccagtgatggaagagatgaggtgagccacctgcagagcggcagccacctggccaacaacagcgaccctgagagcaccttccggcagaacccccgcatcgtgaaccactgggccagccctgagctgcggcagaaccctggggtgaagaatgagcacaggcctgccagcgccctggtgaaccccctggcccggggggacagccctgagaacagaacccaccaccccctgggcgctggggccggcagcggctgtgcccccctggaggccgacagcggggccagcggggccctggccatgttcttccagggcggggagacagaaaatgaggagaacctgagcagcgagaaggccggcctgagcggccaggccgactttgatgacttctgcagcagccctggcctgggccggcccccagcccccacccacgtgggcgccggcagcctgtgccaggccctgctgcccggccccagcaatgaagctgctggagatgtgtggggagacacagccagcactggagtgcctgatgccagcggcagccagtatgaaaatgtggagaacctggagtttgtgcagaaccaggaggtgctgcccagcgagcccctgaacctggaccccagcagccccagcgaccagttccgctatggccccctgcccggccctgctgtgcccaggcatggagctgtgtgccacactggagccccagatgccaccctgcacacagtgcacccagacagcgtgagcagcagctacagcagccgcagccacggccgcctgagcggcagcgcccggccccaggagctggtgggcaccttcatccagcaggaggtgggcaagccagaagatgaggccagcggcagcttcttcaagcagattgacagcagccctgtgggcggggagacagatgagaccaccgtgtcccagaactaccggggctctgtgtcccagcccagcacccccagcccccccaagcccaccggcatcttccagaccagcgccaacagcagctttgagcctgtgaagagccacctggtgggcgtgaagccctttgaggccgaccgggccaacgtggtgggggaggtgcgggagacctgtgtgcggcagaagcagtgcaggcctgctgctgccctgcctgatgccagccctggcaacctggagcagcccccagacaacatggagaccctgtgtgccccccaggtgtgccccctgcccctgaacagcaccacagaagctgtgcacatgctgccccacgccggggccccacccctggacacagtgtacccagcccctgagaagaggccttctgcccggacccagggccctgtgaagtgtgagagccctgccaccaccctgtgggcccagagcgagctgcctgactttggaggaaatgtgctgctggccccagctgccccagccctgtatgtgtgtgccaagccccagccccctgtggtgcagcccccagaggaggccatgagcggccagcagagcaggaaccccagcagcgctgcccctgtgcagagcagaggaggcattggagccagcgagaacctggagaacccccccaagatgggagaggaggaggccctgcagagccaggccagcagcggctacgccagcctgctgagcagccccccaacagagagcctgcagaacccccctgtgctgattgcccagcctgaccacagctacaacctggcccagcccatcaacttctctgtgtccctgagcaacagccatgagaagaaccagagctggagggaggccctggtgggggacaggcctgctgtgtcctcctgggccctgggcggggacagcggggagaacaccagcctgagcggcatccccaccagctctgtgctgagcctgagcctgcccagctctgtggcccagagcaacttcccccagggcagcggggccagcgagatggtgagcaaccagcctgccaacctgctggtgcagccccccagccagcctgtgcctgagaacctggtgcctgagagccagaaggacaggaaggccggcagcgccctgcccggctttgccaacagccctgctggcagcacctctgtggtgctggtgcccccagcccacggcaccctggtgcctgatggcaacaaggccaaccacagcagccaccaggaggacacctatggagccctggacttcaccctgagcaggaccctggagaaccctgtgaatgtgtacaaccccagccacagcgacagcctggccagccagcagagcgtggccagccacccccggcagagcggccctggggcccccaacctggaccgcttctaccagcaggtgaccaaggatgcccagggccagcccggcctggagcgggcccagcaggagctggtgcccccccagcagcaggccagccccccccagctgcccaaggccatgttttctgagctgagcaaccctgagagcctgcctgcccagggccaggcccagaacagcgcccagagccctgccagcctggtgctggtggatgctggccagcagctgcccccccggcccccccagagcagctctgtgtccctggtgagcagcggcagcggccaggccgctgtgcccagcgagcagccctggccccagcctgtgcctgccctggcccctggccccccaccccaggacctggccgcctactactactaccggcccctgtatgatgcctaccagccccagtacagcctgccctacccacctgagcctggagctgccagcctgtactaccaggatgtgtacagcctgtatgagccccgctaccggccctatgatggagctgccagcgcctatgcccagaactaccgctacccagagcctgagcggcccagcagccgggccagccacagcagcgagcggcccccaccccggcagggctacccagagggctactacagcagcaagagcggctggagcagccagagcgactactatgccagctactacagcagccagtatgactatggagaccccggccactgggaccgctaccactacagcgcccgggtgcgggaccccaggacctatgaccggcgctactggtgtgatgctgaatatgatgcctacagaagagagcacagcgcctttggagacaggcctgagaagagggacaacaactggaggtatgacccccgcttcaccggcagctttgatgatgatcctgacccccaccgggacccctatggagaggaggtggacagaagatctgtgcacagcgagcacagcgcccggagcctgcacagcgcccacagcctggccagccgccgcagcagcctgagcagccacagccaccagagccagatctaccgcagccacaacgtggccgccggcagctatgaggcccccctgcccccaggcagcttccacggggactttgcctacggcacctaccgcagcaacttcagcagcggccctggcttcccagaatatggctacccagctgacacagtgtggccagccatggagcaggtgagcagccggcccaccagccctgagaagttctctgtgccccacgtgtgtgcccgcttcggccctgggggccagctgatcaaggtgatccccaacctgcccagcgagggccagcctgccctggtggaggtgcacagcatggaggccctgctgcagcacaccagcgagcaggaggagatgagggccttccctggccccctggccaaggatgacacccacaaggtggatgtgatcaactttgcccagaacaaggccatgaagtgcctgcagaatgaaaacctgattgacaaggagagcgccagcctgctgtggaacttcatcgtgctgctgtgccggcagaatggcaccgtggtgggcacagacattgctgagctgctgctgcgggaccacaggacagtgtggctgcccgggaagagccccaatgaggccaacctgattgacttcaccaatgaggccgtggagcaggtggaggaggaggagagcggggaggcccagctgtccttcctgaccggcggccctgctgctgctgccagcagcctggagcgggagacagagcgcttccgggagctgctgctgtatggcaggaagaaggatgccctggagagcgccatgaagaatggcctgtggggccacgccctgctgctggccagcaagatggacagcaggacccacgcccgggtgatgaccaggtttgccaacagcctgcccatcaatgaccccctgcagacagtgtaccagctgatgagcggccgcatgcctgctgccagcacctgctgcggagatgagaagtggggagactggaggccccacctggccatggtgctgagcaacctgaacaacaacatggatgtggagagcaggaccatggccaccatgggagacaccctggccagccggggcctgctggatgctgcccacttctgctacctgatggcccaggccggcttcggcgtgtacaccaagaagaccaccaagctggtgctgattggcagcaaccacagcctgcccttcctgaagtttgccaccaatgaggccatccagaggacagaggcctatgaatatgcccagagcctgggcgctgagacctgccccctgcccagcttccaggtgttcaagttcatctacagctgccgcctggccgagatgggcctggccacccaggccttccactactgtgaggccatcgccaagagcatcctgacccagccccacctgtacagccctgtgctgatcagccagctggtgcagatggccagccagctgcggctgtttgacccccagctgaaggagaagccagaggaggagagcctggccgcccccacctggctggtgcacctgcagcaggtggagcggcagatcaaggagggcgccggcgtgtggcaccaggatggagccctgccccagcagtgccccggcacccccagcagcgagatggagcagctggaccggcccggcctgagccagcccggggccctgggcatcgccaaccccctgctggccgtgcctgcccccagccctgagcacagcagccccagcgtgcggctgctgcccagcgccccccagaccctgcctgatggccccctggccagccctgcccgggtgcccatgtttcctgtgcccctgcccccaggccccctggagcccggccctggctgtgtgaccccaggccctgccctgggcttcctggagcccagcggccctggcctgcccccaggagtgccccccctgcaggagaggaggcacctgctgcaggaggcccggagcccagaccccggcatcgtgccccaggaggcccctgtgggcaacagcctgtctgagctgtctgaggagaactttgatggcaagtttgccaacctgacccccagcaggacagtgcctgacagcgaggcccctcctggctgggacagagctgacagcggccccacccagccccccctgagcctgagccctgcccctgagaccaagaggcctggccaggccgccaagaaggagaccaaggagcccaagaagggggagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccaccccagatgctgaggagccccagctgcctgatggcaccggccgggagggccctgctgctgcccggggcctggccaaccctgagcccgcccctgagcccaagctgagccgctgcagctccatgagcagcctgagccgggaggtgtcccagcacttcaaccaggcccctggggacctgcctgctgctgggggccccccatctggggccatgcccttctacaacccagcccagctggcccaggcctgtgccaccagcggcagcagccggctgggcagaattggccagaggaagcacctggtgctgaactag

SEQ ID NO: 168972 - DNA, 1521 bp, Artificial Sequence
  Description of Artificial Sequence: Synthetic coding sequence
tgaagcgccttcggggacaggcctgagaagagggacaacaactggaggtatgacccccgcttcaccggcagctttgatgatgatcctgacccccaccgggacccctacggggaggaggtggaccggcgctctgtgcacagcgagcacagcgcccggagcctgcacagcgcccacagcctggccagcagaagaagcagcctgagcagccacagccaccagagccagatctaccgcagccacaacgtggccgccggcagctatgaggcccccctgcccccaggcagcttccatggagactttgcctacggcacctaccgcagcaacttcagcagcggccctggcttcccagaatatggctacccagccctgggcttcctggagcccagcggccctggcctgcccccaggagtgccccccctgcaggagaggaggcacctgctgcaggaggcccggagcccagaccccggcatcgtgccccaggaggcccctgtgggcaacagcctgtctgagctgtctgaggagaactttgatggcaagtttgccaacctgacccccagcaggacagtgcctgacagcgaggcccctcctggctgggacagagctgacagcggccccacccagccccccctgagcctgagccctgcccctgagaccaagaggcctggccaggccgccaagaaggagaccaaggagcccaagaagggggagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccacccctgtgcggccccagggccgctctggaagaaatgatggcctgctggccctgagcagcccagatgctgaggagccccagctgcctgatggcaccggccgggagggccctgctgctgcccggggcctggccaaccctgagcccgcccctgagcccaaggtgctgagcagcgctgccagcctgcccggcagcgagctgcccagcagcaggcctgagggcagccagggcggggagctgagccgctgcagctccatgagcagcctgagccgggaggtgtcccagcacttcaaccaggcccctggggacctgcctgctgctgggggccccccatctggggccatgcccttctacaacccagcccagctggcccaggcctgtgccaccagcggcagcagccggctgggcagaattggccagaggaagcacctggtgctgaactag

SEQ ID NO: 168973 - DNA, 3180 bp, Artificial Sequence
  Description of Artificial Sequence: Synthetic coding sequence
gcccgggtgcgggaccccaggacctatgaccggcgctactggtgtgatgctgaatatgatgcctacagaagagagcacagcgcctttggagacaggcctgagaagagggacaacaactggaggtatgacccccgcttcaccggcagctttgatgatgatcctgacccccaccgggacccctatggagaggaggtggacagaagatctgtgcacagcgagcacagcgcccggagcctgcacagcgcccacagcctggccagccgccgcagcagcctgagcagccacagccaccagagccagatctaccgcagccacaacgtggccgccggcagctatgaggcccccctgcccccaggcagcttccacggggactttgcctacggcacctaccgcagcaacttcagcagcggccctggcttcccagaatatggctacccagctgacacagtgtggccagccatggagcaggtgagcagccggcccaccagccctgagaagttctctgtgccccacgtgtgtgcccgcttcggccctgggggccagctgatcaaggtgatccccaacctgcccagcgagggccagcctgccctggtggaggtgcacagcatggaggccctgctgcagcacaccagcgagcaggaggagatgagggccttccctggccccctggccaaggatgacacccacaaggtggatgtgatcaactttgcccagaacaaggccatgaagtgcctgcagaatgaaaacctgattgacaaggagagcgccagcctgctgtggaacttcatcgtgctgctgtgccggcagaatggcaccgtggtgggcacagacattgctgagctgctgctgcgggaccacaggacagtgtggctgcccgggaagagccccaatgaggccaacctgattgacttcaccaatgaggccgtggagcaggtggaggaggaggagagcggggaggcccagctgtccttcctgaccggcggccctgctgctgctgccagcagcctggagcgggagacagagcgcttccgggagctgctgctgtatggcaggaagaaggatgccctggagagcgccatgaagaatggcctgtggggccacgccctgctgctggccagcaagatggacagcaggacccacgcccgggtgatgaccaggtttgccaacagcctgcccatcaatgaccccctgcagacagtgtaccagctgatgagcggccgcatgcctgctgccagcacctgctgcggagatgagaagtggggagactggaggccccacctggccatggtgctgagcaacctgaacaacaacatggatgtggagagcaggaccatggccaccatgggagacaccctggccagccggggcctgctggatgctgcccacttctgctacctgatggcccaggccggcttcggcgtgtacaccaagaagaccaccaagctggtgctgattggcagcaaccacagcctgcccttcctgaagtttgccaccaatgaggccatccagaggacagaggcctatgaatatgcccagagcctgggcgctgagacctgccccctgcccagcttccaggtgttcaagttcatctacagctgccgcctggccgagatgggcctggccacccaggccttccactactgtgaggccatcgccaagagcatcctgacccagccccacctgtacagccctgtgctgatcagccagctggtgcagatggccagccagctgcggctgtttgacccccagctgaaggagaagccagaggaggagagcctggccgcccccacctggctggtgcacctgcagcaggtggagcggcagatcaaggagggcgccggcgtgtggcaccaggatggagccctgccccagcagtgccccggcacccccagcagcgagatggagcagctggaccggcccggcctgagccagcccggggccctgggcatcgccaaccccctgctggccgtgcctgcccccagccctgagcacagcagccccagcgtgcggctgctgcccagcgccccccagaccctgcctgatggccccctggccagccctgcccgggtgcccatgtttcctgtgcccctgcccccaggccccctggagcccggccctggctgtgtgaccccaggccctgccctgggcttcctggagcccagcggccctggcctgcccccaggagtgccccccctgcaggagaggaggcacctgctgcaggaggcccggagcccagaccccggcatcgtgccccaggaggcccctgtgggcaacagcctgtctgagctgtctgaggagaactttgatggcaagtttgccaacctgacccccagcaggacagtgcctgacagcgaggcccctcctggctgggacagagctgacagcggccccacccagccccccctgagcctgagccctgcccctgagaccaagaggcctggccaggccgccaagaaggagaccaaggagcccaagaagggggagagctggttcttccgctggctgcccgggaagaagaagacagaggcctacctgcctgatgacaagaacaagagcatcgtgtgggatgagaagaagaaccagtgggtgaacctgaatgaacctgaggaggagaagaaggcccctcctcctccacccacctccatgcccaagacagtgcaggccgcccccccagccctgcccggccccccaggggcccctgtgaacatgtacagccggcgggctgctggcacccgggcccgctacgtggatgtgctgaaccccagcggcacccagaggtctgagcccgccctggccccagctgactttgtggcccccctggcccccctgcccatccccagcaacctgtttgtgcccaccccagatgctgaggagccccagctgcctgatggcaccggccgggagggccctgctgctgcccggggcctggccaaccctgagcccgcccctgagcccaaggtgctgagcagcgctgccagcctgcccggcagcgagctgcccagcagcaggcctgagggcagccagggcggggaggcccctggggacctgcctgctgctgggggcccccccagcggggccatgcccttctacaacccagcccagctggcccaggcctgtgccaccagcggcagcagccggctgggccgcatcggccagaggaagcacctggtgctgaactag

SEQ ID NO: 168974 - DNA, 603 bp, Artificial Sequence
  Description of Artificial Sequence: Synthetic coding sequence
atgcccaagacagtgcaggccgcccccccagccctgcccggccccccaggggcccctgtgaacatgtacagcagaagagctgctggcacccgggcccgctacgtggatgtgctgaaccccagcggcacccagaggtctgagcccgccctggccccagctgactttgtggcccccctggcccccctgcccatccccagcaacctgtttgtgcccacccctgtgtcctctgtgcggccccagggccgctctggaagaaatgatggcctgctggccctgagcagcccagatgctgaggagccccagctgcctgatggcaccggccgggagggccctgctgctgcccggggcctggccaaccctgagcccgcccctgagcccaaggtgctgagcagcgctgccagcctgcccggcagcgagctgcccagcagcaggcctgagggcagccagggcggggaggcccctggggacctgcctgctgctgggggccccccatctggggccatgcccttctacaacccagcccagctggcccaggcctgtgccaccagcggcagcagccggctgggcagaattggccagaggaagcacctggtgctgaactag

SEQ ID NO: 168975 - DNA, 924 bp, Artificial Sequence
  Description of Artificial Sequence: Synthetic coding sequence
atgtccatgatcctgagcgccagcgtcatccgggtgagagatggcctgcccctgagcgccagcacagattatgagcagagcacaggcatgcaggagtgcaggaagtacttcaagatgctgagcaggaagctggcccagctgcctgaccgctgcaccctgaagacaggccactacaacatcaacttcatcagcagcctgggcgtgtcctacatgatgctgtgcacagagaactaccccaacgtgctggccttctccttcctggatgagctgcagaaggagttcatcaccacctacaacatgatgaagaccaacacagctgtgcggccctactgcttcattgaatttgacaacttcatccagaggaccaagcagcgctacaacaaccccaggagcctgagcaccaagatcaacctgagtgacatgcagacagagatcaagctgcggcccccctaccagatctccatgtgtgagctgggcagcgccaacggggtgaccagcgccttctctgtggactgcaagggagctgggaagatcagcagcgcccaccagaggctggagcccgccaccctgtctggaattgtgggcttcatcctgagcctgctgtgtggggccctgaacctgatccggggcttccacgccatcgagagcctgctgcagagtgatggagatgacttcaactacatcatcgccttcttcctgggcacagctgcctgcctgtaccagtgctacctgctggtgtactacacaggctggagaaatgtgaagagcttcctgaccttcggcctcatctgcctgtgcaacatgtacctgtatgagctgaggaacctgtggcagctgttcttccacgtgacagtgggcgcctttgtgaccctgcagatctggctgcggcaggcccagggcaaggccccagactatgatgtgtag

SEQ ID NO: 168976 - DNA, 330 bp, Artificial Sequence
  Description of Artificial Sequence: Synthetic coding sequence
atgtccatgatcctgagcgccagcgtcatccgggtgagagatggcctgcccctgagcgccagcacagattatgagcagagcacaggcatgcaggagtgcaggaagtacttcaagatgctgagcaggaagctggcccagctgcctgaccgctgcaccctgaagacaggccactacaacatcaacttcatcagcagcctgggcgtgtcctacatgatgctgtgcacagagaactaccccaacgtgctggccttctccttcctggatgagctgcagaaggagttcatcaccacctacaacatgatgaagaccaacacagctgtgcggccctag

SEQ ID NO: 168977 - DNA, 870 bp, Artificial Sequence
  Description of Artificial Sequence: Synthetic coding sequence
atgtccatgatcctgagcgccagcgtcatccgggtgagagatggcctgcccctgagcgccagcacagattatgagcagagcacaggcatgcaggagtgcaggaagtacttcaagatgctgagcaggaagctggcccagctgcctgaccgctgcaccctgaagacaggccactacaacatcaacttcatcagcagcctgggcgtgtcctacatgatgctgtgcacagagaactaccccaacgtgctggccttctccttcctggatgagctgcagaaggagttcatcaccacctacaacatgatgaagaccaacacagctgtgcggccctactgcttcattgaatttgacaacttcatccagaggaccaagcagcgctacaacaaccccaggagcctgagcaccaagatcaacctgagtgacatgcagacagagatcaagctgcggcccccctaccagatctccatgtgtgagctgggcagcgccaacggggtgaccagcgccttctctgtggactgcaagggagctgggaagatcagcagcgcccaccagaggctggagcccgccaccctgtctggaattgtgggcttcatcctgagcctgctgtgtggggccctgaacctgatccggggcttccacgccatcgagagcctgctgcagagtgatggagatgacttcaactacatcatcgccttcttcctgggcacagctgcctgcctgtaccagtgctacctgctggtgtactacacaggctggagaaatgtgaagagcttcctgaccttcggcctcatctgcctgtgcaacatgtacctgtatgagctgaggaacctgtggcagctgttcttccacgtgacagtgggcgcctttgtgtag

SEQ ID NO: 168978 - DNA, 417 bp, Artificial Sequence
  Description of Artificial Sequence: Synthetic coding sequence
atgtccatgatcctgagcgccagcgtcatccgggtgagagatggcctgcccctgagcgccagcacagattatgagcagagcacaggcatgcaggagtgcaggaagtacttcaagatgctgagcaggaagctggcccagctgcctgaccgctgcaccctgaagacaggccactacaacatcaacttcatcagcagcctgggcgtgtcctacatgatgctgtgcacagagaactaccccaacgtgctggccttctccttcctggatgagctgcagaaggagttcatcaccacctacaacatgatgaagaccaacacagctgtgcggccctactgcttcattgaatttgacaacttcatccagaggaccaagcagcgctacaacaaccccaggagcctgagcaccaagatcaacctgtag

SEQ ID NO: 168979 - DNA, 657 bp, Artificial Sequence
  Description of Artificial Sequence: Synthetic coding sequence
atgtccatgatcctgagcgccagcgtcatccgggtgagagatggcctgcccctgagcgccagcacagattatgagcagagcacaggcatgcaggagtgcaggaagtacttcaagatgctgagcaggaagctggcccagctgcctgaccgctgcaccctgaagacaggccactacaacatcaacttcatcagcagcctgggcgtgtcctacatgatgctgtgcacagagaactaccccaacgtgctggccttctccttcctggatgagctgcagaaggagttcatcaccacctacaacatgatgaagaccaacacagctgtgcggccctactgcttcattgaatttgacaacttcatccagaggaccaagcagcgctacaacaaccccaggagcctgagcaccaagatcaacctgagtgacatgcagacagagatcaagctgcggcccccctaccagatctccatgtgtgagctgggcagcgccaacggggtgaccagcgccttctctgtggactgcaagggagctgggaagatcagcagcgcccaccagaggctggagcccgccaccctgtctggaattgtgggcttcatcctgagcctgctgtgtggggccctgaacctgatccggggcttccacgccatcgagagcctgctgtag

SEQ ID NO: 168980 - DNA, 306 bp, Artificial Sequence
  Description of Artificial Sequence: Synthetic coding sequence
atgtccatgatcctgagcgccagcgtcatccgggtgagagatggcctgcccctgagcgccagcacagattatgagcagagcacaggcatgcaggagtgcaggaagtacttcaagatgctgagcaggaagctggcccagctgcctgaccgctgcaccctgaagacaggccactacaacatcaacttcatcagcagcctgggcgtgtcctacatgatgctgtgcacagagaactaccccaacgtgctggccttctccttcctggatgagctgcagaaggagttcatcaccacctacaacatgatgtag

SEQ ID NO: 168981 - DNA, 924 bp, Artificial Sequence; identical to SEQ ID NO: 168975
  Description of Artificial Sequence: Synthetic coding sequence

SEQ ID NO: 168982 - DNA, 2298 bp, Artificial Sequence
  Description of Artificial Sequence: Synthetic coding sequence
atgaccacctacctggagttcatccagcagaatgaggagagagatggagtgcgcttctcctggaatgtgtggcccagcagccggctggaggccaccaggatggtggtgcctgtggccgccctcttcacccccctgaaggagaggccagacctgccccccatccagtatgagcctgtgctgtgcagcaggaccacctgcagagctgtgctgaaccccctgtgccaggtggactaccgggccaagctgtgggcctgcaacttctgctaccagaggaaccagtttcctccttcctatgccggcatcagcgagctgaaccagcctgctgagctgctgccccagttcagcagcattgaatatgtggtgctgcggggcccccagatgcccctcatcttcctgtatgtggtggacacctgcatggaggatgaggacctgcaggccctgaaggagagcatgcagatgagcctgagcctgctgcccccaacagccctggtgggcctcatcacctttggaaggatggtgcaggtgcatgagctgggctgtgagggcatcagcaagagctatgtgttccggggcaccaaggacctgagcgccaagcagctgcaggagatgctgggcctgagcaaggtgcccctgacccaggccacccggggcccccaggtgcagcagcccccacccagcaaccgcttcctgcagcctgtgcagaagattgacatgaacctgacagacctgctgggggagctgcagagggacccctggcctgtgccccagggcaagaggcccctgcggagcagcggcgtggccctgagcattgctgtgggcctgctggagtgcaccttccccaacacaggagcccgcatcatgatgttcatcggcggccctgccacccagggccctggcatggtggtgggagatgagctgaagacccccatccgctcctggcatgacatcgacaaggacaatgccaagtatgtgaagaagggcaccaagcactttgaggccctggccaacagagctgccaccactggacatgtgattgacatctatgcctgtgccctggaccagacaggcctgctggagatgaagtgctgccccaacctgactggaggctacatggtgatgggagacagcttcaacaccagcctcttcaagcagaccttccagagggtcttcaccaaggacatgcacggccagttcaagatgggctttggaggcaccctggagatcaagaccagccgggagatcaagatcagcggggccatcggcccctgtgtgtccctgaacagcaagggcccctgtgtgtctgaaaatgagatcggcaccggcggcacctgccagtggaagatctgtggcctgagccccaccaccaccctggccatctactttgaggtggtgaaccagcacaatgcccccatcccccagggcggccgcggggccatccagtttgtgacccagtaccagcacagcagcggccagaggcgcatccgggtgaccaccatcgccaggaactgggcagatgcccagacccagatccagaacattgctgccagctttgaccaggaggccgccgccatcctgatggcccggctggccatctacagagctgagacagaggagggcccagatgtgctgcgctggctggaccggcagctgatccggctgtgccagaagtttggagagtaccacaaggatgaccccagcagcttccgcttcagcgagaccttcagcctgtacccccagttcatgttccacctgcggcgcagcagcttcctgcaggtgttcaacaacagcccagatgagagcagctactaccgccaccacttcatgaggcaggacctgacccagagcctcatcatgatccagcccatcctgtatgcctacagcttcagcggccccccagagcctgtgctgctggacagcagcagcatcctggccgaccgcatcctgctgatggacaccttcttccagatcctgatctaccacggggagaccatcgcccagtggaggaagagcggctaccaggacatgccagaatatgagaacttccgccacctgctgcaggcccctgtggatgatgcccaggagatcctgcacagccgcttccccatgccccgctacatcgacacagagcacggcggcagccaggcccgcttcctgctgagcaaggtgaaccccagccagacccacaacaacatgtatgcctggggccaggagagcggggcccccatcctgacagatgatgtgtccctgcaggtgttcatggaccacctgaagaagctggccgtgtcctctgctgcctag

SEQ ID NO: 168983 - DNA, 1992 bp, Artificial Sequence
  Description of Artificial Sequence: Synthetic coding sequence
atgcccctcatcttcctgtatgtggtggacacctgcatggaggatgaggacctgcaggccctgaaggagagcatgcagatgagcctgagcctgctgcccccaacagccctggtgggcctcatcacctttggaaggatggtgcaggtgcatgagctgggctgtgagggcatcagcaagagctatgtgttccggggcaccaaggacctgagcgccaagcagctgcaggagatgctgggcctgagcaaggtgcccctgacccaggccacccggggcccccaggtgcagcagcccccacccagcaaccgcttcctgcagcctgtgcagaagattgacatgaacctgacagacctgctgggggagctgcagagggacccctggcctgtgccccagggcaagaggcccctgcggagcagcggcgtggccctgagcattgctgtgggcctgctggagtgcaccttccccaacacaggagcccgcatcatgatgttcatcggcggccctgccacccagggccctggcatggtggtgggagatgagctgaagacccccatccgctcctggcatgacatcgacaaggacaatgccaagtatgtgaagaagggcaccaagcactttgaggccctggccaacagagctgccaccactggacatgtgattgacatctatgcctgtgccctggaccagacaggcctgctggagatgaagtgctgccccaacctgactggaggctacatggtgatgggagacagcttcaacaccagcctcttcaagcagaccttccagagggtcttcaccaaggacatgcacggccagttcaagatgggctttggaggcaccctggagatcaagaccagccgggagatcaagatcagcggggccatcggcccctgtgtgtccctgaacagcaagggcccctgtgtgtctgaaaatgagatcggcaccggcggcacctgccagtggaagatctgtggcctgagccccaccaccaccctggccatctactttgaggtggtgaaccagcacaatgcccccatcccccagggcggccgcggggccatccagtttgtgacccagtaccagcacagcagcggccagaggcgcatccgggtgaccaccatcgccaggaactgggcagatgcccagacccagatccagaacattgctgccagctttgaccaggaggccgccgccatcctgatggcccggctggccatctacagagctgagacagaggagggcccagatgtgctgcgctggctggaccggcagctgatccggctgtgccagaagtttggagagtaccacaaggatgaccccagcagcttccgcttcagcgagaccttcagcctgtacccccagaggcgggacttccccaagaccagcggggagatcctggagaaccaggagaaggcccggagcgcctgcctgaagttcatgttccacctgcggcgcagcagcttcctgcaggtgttcaacaacagcccagatgagagcagctactaccgccaccacttcatgaggcaggacctgacccagagcctcatcatgatccagcccatcctgtatgcctacagcttcagcggccccccagagcctgtgctgctggacagcagcagcatcctggccgaccgcatcctgctgatggacaccttcttccagatcctgatctaccacggggagaccatcgcccagtggaggaagagcggctaccaggacatgccagaatatgagaacttccgccacctgctgcaggcccctgtggatgatgcccaggagatcctgcacagccgcttccccatgccccgctacatcgacacagagcacggcggcagccaggcccgcttcctgctgagcaaggtgaaccccagccagacccacaacaacatgtatgcctggggccaggagagcggggcccccatcctgacagatgatgtgtccctgcaggtgttcatggaccacctgaagaagctggccgtgtcctctgctgcctag

SEQ ID NO: 168984 - DNA, 1692 bp, Artificial Sequence
  Description of Artificial Sequence: Synthetic coding sequence
atgctgggcctgagcaaggtgcccctgacccaggccacccggggcccccaggtgcagcagcccccacccagcaaccgcttcctgcagcctgtgcagaagattgacatgaacctgacagacctgctgggggagctgcagagggacccctggcctgtgccccagggcaagaggcccctgcggagcagcggcgtggccctgagcattgctgtgggcctgctggagtgcaccttccccaacacaggagcccgcatcatgatgttcatcggcggccctgccacccagggccctggcatggtggtgggagatgagctgaagacccccatccgctcctggcatgacatcgacaaggacaatgccaagtatgtgaagaagggcaccaagcactttgaggccctggccaacagagctgccaccactggacatgtgattgacatctatgcctgtgccctggaccagacaggcctgctggagatgaagtgctgccccaacctgactggaggctacatggtgatgggagacagcttcaacaccagcctcttcaagcagaccttccagagggtcttcaccaaggacatgcacggccagttcaagatgggctttggaggcaccctggagatcaagaccagccgggagatcaagatcagcggggccatcggcccctgtgtgtccctgaacagcaagggcccctgtgtgtctgaaaatgagatcggcaccggcggcacctgccagtggaagatctgtggcctgagccccaccaccaccctggccatctactttgaggtggtgaaccagcacaatgcccccatcccccagggcggccgcggggccatccagtttgtgacccagtaccagcacagcagcggccagaggcgcatccgggtgaccaccatcgccaggaactgggcagatgcccagacccagatccagaacattgctgccagctttgaccaggaggccgccgccatcctgatggcccggctggccatctacagagctgagacagaggagggcccagatgtgctgcgctggctggaccggcagctgatccggctgtgccagaagtttggagagtaccacaaggatgaccccagcagcttccgcttcagcgagaccttcagcctgtacccccagttcatgttccacctgcggcgcagcagcttcctgcaggtgttcaacaacagcccagatgagagcagctactaccgccaccacttcatgaggcaggacctgacccagagcctcatcatgatccagcccatcctgtatgcctacagcttcagcggccccccagagcctgtgctgctggacagcagcagcatcctggccgaccgcatcctgctgatggacaccttcttccagatcctgatctaccacggggagaccatcgcccagtggaggaagagcggctaccaggacatgccagaatatgagaacttccgccacctgctgcaggcccctgtggatgatgcccaggagatcctgcacagccgcttccccatgccccgctacatcgacacagagcacggcggcagccaggcccgcttcctgctgagcaaggtgaaccccagccagacccacaacaacatgtatgcctggggccaggagagcggggcccccatcctgacagatgatgtgtccctgcaggtgttcatggaccacctgaagaagctggccgtgtcctctgctgcctag

SEQ ID NO: 168985 - DNA, 2211 bp, Artificial Sequence
  Description of Artificial Sequence: Synthetic coding sequence
atgaccacctacctggagttcatccagcagaatgaggagagagatggagtgcgcttctcctggaatgtgtggcccagcagccggctggaggccaccaggatggtggtgcctgtggccgccctcttcacccccctgaaggagaggccagacctgccccccatccagtatgagcctgtgctgtgcagcaggaccacctgcagagctgtgctgaaccccctgtgccaggtggactaccgggccaagctgtgggcctgcaacttctgctaccagaggaaccagaggggcccccagatgcccctcatcttcctgtatgtggtggacacctgcatggaggatgaggacctgcaggccctgaaggagagcatgcagatgagcctgagcctgctgcccccaacagccctggtgggcctcatcaccttcggccgcatggtgcaggtgcatgagctgggctgtgagggcatcagcaagagctatgtgttccggggcaccaaggacctgagcgccaagcagctgcaggagatgctgggcctgagcaaggtgcccctgacccaggccacccggggcccccaggtgcagcagcccccacccagcaaccgcttcctgcagcctgtgcagaagattgacatgaacctgacagacctgctgggggagctgcagagggacccctggcctgtgccccagggcaagaggcccctgcggagcagtggagtggccctgagcattgctgtgggcctgctggagtgcaccttccccaacacaggagcccgcatcatgatgtttattggaggccctgccacccagggccctggcatggtggtgggagatgagctgaagacccccatccgctcctggcatgacatcgacaaggacaatgccaagtatgtgaagaagggcaccaagcactttgaggccctggccaacagagctgccaccaccggccacgtgattgacatctatgcctgtgccctggaccagacaggcctgctggagatgaagtgctgccccaacctgaccggcggctacatggtgatgggagacagcttcaacaccagcctcttcaagcagaccttccagagggtcttcaccaaggacatgcacggccagttcaagatgggctttggaggcaccctggagatcaagaccagccgggagatcaagatcagcggggccatcggcccctgtgtgtccctgaacagcaagggcccctgtgtgtctgaaaatgaaattggaactggaggcacctgccagtggaagatctgtggcctgagccccaccaccaccctggccatctactttgaggtggtgaaccagcacaatgcccccatcccccagggcggccgcggggccatccagtttgtgacccagtaccagcacagcagcggccagaggcgcatccgggtgaccaccatcgccaggaactgggcagatgcccagacccagatccagaacattgctgccagctttgaccaggaggccgccgccatcctgatggcccggctggccatctacagagctgagacagaggagggcccagatgtgctgcgctggctggaccggcagctgatccggctgtgccagaagtttggagagtaccacaaggatgaccccagcagcttccgcttcagcgagaccttcagcctgtacccccagttcatgttccacctgcggcgcagcagcttcctgcaggtgttcaacaacagcccagatgagagcagctactaccgccaccacttcatgaggcaggacctgacccagagcctcatcatgatccagcccatcctgtatgcctacagcttcagcggccccccagagcctgtgctgctggacagcagcagcatcctggccgaccgcatcctgctgatggacaccttcttccagatcctgatctaccatggagagaccatcgcccagtggaggaagagcggctaccaggacatgccagaatatgagaacttccgccacctgctgcaggcccctgtggatgatgcccaggagatcctgcacagccgcttccccatgccccgctacatcgacacagaacatggaggcagccaggcccgcttcctgctgagcaaggtgaaccccagccagacccacaacaacatgtatgcctggggccaggagagcggggcccccatcctgacagatgatgtgtccctgcaggtgttcatggaccacctgaagaagctggccgtgagcagcgctgcctag

SEQ ID NO: 168986 - DNA, 510 bp, Artificial Sequence
  Description of Artificial Sequence: Synthetic coding sequence
atgaccacctacctggagttcatccagcagaatgaggagagagatggagtgcgcttctcctggaatgtgtggcccagcagccggctggaggccaccaggatggtggtgcctgtggccgccctcttcacccccctgaaggagaggccagacctgccccccatccagtatgagcctgtgctgtgcagcaggaccacctgcagagctgtgctgaaccccctgtgccaggtggactaccgggccaagctgtgggcctgcaacttctgctaccagaggaaccagtttcctccttcctatgccggcatcagcgagctgaaccagcctgctgagctgctgccccagttcagcagcattgaatatgtggtgctgcggggcccccagatgcccctcatcttcctgtatgtggtggacacctgcatggaggatgaggacctgcaggccctgaaggagagcatgcagatgagcctgagcctgctgcccccaacagccctggtgggcctcatcaccttctag

SEQ ID NO: 168987 - DNA, 285 bp, Artificial Sequence
  Description of Artificial Sequence: Synthetic coding sequence
atgaccacctacctggagttcatccagcagaatgaggagagagatggagtgcgcttctcctggaatgtgtggcccagcagccggctggaggccaccaggatggtggtgcctgtggccgccctcttcacccccctgaaggagaggccagacctgccccccatccagtatgagcctgtgctgtgcagcaggaccacctgcagagctgtgctgaaccccctgtgccaggtggactaccgggccaagctgtgggcctgcaacttctgctaccagaggaaccaggtgtag

SEQ ID NO: 168988 - DNA, 423 bp, Artificial Sequence
  Description of Artificial Sequence: Synthetic coding sequence
atgaccacctacctggagttcatccagcagaatgaggagagagatggagtgcgcttctcctggaatgtgtggcccagcagccggctggaggccaccaggatggtggtgcctgtggccgccctcttcacccccctgaaggagaggccagacctgccccccatccagtatgagcctgtgctgtgcagcaggaccacctgcagagctgtgctgaaccccctgtgccaggtggactaccgggccaagctgtgggcctgcaacttctgctaccagaggaaccagtttcctccttcctatgccggcatcagcgagctgaaccagcctgctgagctgctgccccagttcagcagcattgaatatgtggtgctgcggggcccccagatgcccctcatcttcctgtatgtggtggacacctgcatggagtag

SEQ ID NO: 168989 - DNA, 123 bp, Artificial Sequence
  Description of Artificial Sequence: Synthetic coding sequence
atgaccacctacctggagttcatccagcagaatgaggagagagatggagtgcgcttctcctggaatgtgtggcccagcagccggctggaggccaccaggatggtggtgcctgtggccgcctag

SEQ ID NO: 168990 - DNA, 2304 bp, Artificial Sequence
  Description of Artificial Sequence: Synthetic coding sequence
atggccacctacctggagttcatccagcagaatgaggagagagatggagtgcgcttctcctggaatgtgtggcccagcagccggctggaggccaccaggatggtggtgcccctggcctgcctgctgacccccctgaaggagaggccagacctgccccctgtgcagtatgagcctgtgctgtgcagccggcccacctgcaaggctgtgctgaaccccctgtgccaggtggactaccgggccaagctgtgggcctgcaacttctgcttccagaggaaccagtttcctccagcctacggcggcatcagcgaggtgaaccagcctgctgagctgatgccccagttcagcaccattgaatatgtgatccagagaggagcccagagccccctcatcttcctgtatgtggtggacacctgcctggaggaggatgacctgcaggccctgaaggagagcctgcagatgagcctgagcctgctgcccccagatgccctggtgggcctcatcacctttggaaggatggtgcaggtgcatgagctgagctgtgagggcatcagcaagagctatgtgttccggggcaccaaggacctgacagccaagcagatccaggacatgctgggcctgaccaagccagccatgcccatgcagcaggcccggcctgcccagccccaggagcacccctttgccagcagccgcttcctgcagcctgtgcacaagattgacatgaacctgacagacctgctgggggagctgcagagggacccctggcctgtgacccagggcaagaggcccctgcggagcactggagtggccctgagcattgctgtgggcctgctggagggcaccttccccaacacaggagcccgcatcatgctgttcaccggcggcccccccacccagggccctggcatggtggtgggagatgagctgaagatccccatccgctcctggcatgacatcgagaaggacaatgcccgcttcatgaagaaggccaccaagcactatgagatgctggccaacagaacagctgccaacggccactgcatcgacatctatgcctgtgccctggaccagacaggcctgctggagatgaagtgctgtgccaacctgactggaggctacatggtgatgggagacagcttcaacaccagcctcttcaagcagaccttccagaggatcttcaccaaggacttcaatggagacttcaggatggccttcggggccaccctggatgtgaagaccagccgggagctgaagattgctggggccatcggcccctgtgtgtccctgaatgtgaagggcccctgtgtgtctgaaaatgagctgggcgtgggcggcaccagccagtggaagatctgtggcctggaccccaccagcaccctgggcatctactttgaggtggtgaaccagcacaacacccccatcccccagggcggccgcggggccatccagtttgtgacccactaccagcacagcagcacccagaggcgcatccgggtgaccaccatcgccaggaactgggcagatgtgcagagccagctgcggcacattgaagctgcctttgaccaggaggccgctgctgtgctgatggcccggctgggcgtcttccgggcagagagcgaggagggcccagatgtgctgcgctggctggaccggcagctgatccggctgtgccagaagtttggccagtacaacaaggaggaccccaccagcttccggctgagtgacagcttcagcctgtacccccagttcatgttccacctgcggcgcagccccttcctgcaggtgttcaacaacagcccagatgagagcagctactaccgccaccactttgcccggcaggacctgacccagagcctcatcatgatccagcccatcctgtacagctacagcttccacggccccccagagcctgtgctgctggacagcagcagcatcctggccgaccgcatcctgctgatggacaccttcttccagatcgtcatctacctgggggagaccatcgcccagtggaggaaggccggctaccaggacatgccagaatatgagaacttcaagcacctgctgcaggcccccctggatgatgcccaggagatcctgcaggcccgcttccccatgccccgctacatcaacacagagcacggcggcagccaggcccgcttcctgctgagcaaggtgaaccccagccagacccacaacaacctgtatgcctggggccaggagaccggggcccccatcctgacagatgatgtgtccctgcaggtgttcatggaccacctgaagaagctggccgtgtcctctgcctgctag

SEQ ID NO: 168991 - DNA, 2304 bp, Artificial Sequence; identical to SEQ ID NO: 168990
  Description of Artificial Sequence: Synthetic coding sequence

SEQ ID NO: 168992 - DNA, 2304 bp, Artificial Sequence; identical to SEQ ID NO: 168990
  Description of Artificial Sequence: Synthetic coding sequence

SEQ ID NO: 168993 - DNA, 2304 bp, Artificial Sequence; identical to SEQ ID NO: 168990
  Description of Artificial Sequence: Synthetic coding sequence

SEQ ID NO: 168994 - DNA, 741 bp, Artificial Sequence
  Description of Artificial Sequence: Synthetic coding sequence
cagaggcgcatccgggtgaccaccatcgccaggaactgggcagatgtgcagagccagctgcggcacattgaagctgcctttgaccaggaggccgctgctgtgctgatggcccggctgggcgtcttccgggcagagagcgaggagggcccagatgtgctgcgctggctggaccggcagctgatccggctgtgccagaagtttggccagtacaacaaggaggaccccaccagcttccggctgagtgacagcttcagcctgtacccccagttcatgttccacctgcggcgcagccccttcctgcaggtgttcaacaacagcccagatgagagcagctactaccgccaccactttgcccggcaggacctgacccagagcctcatcatgatccagcccatcctgtacagctacagcttccacggccccccagagaccatcgcccagtggaggaaggccggctaccaggacatgccagaatatgagaacttcaagcacctgctgcaggcccccctggatgatgcccaggagatcctgcaggcccgcttccccatgccccgctacatcaacacagaacatggaggcagccaggcccgcttcctgctgagcaaggtgaaccccagccagacccacaacaacctgtatgcctggggccaggagactggagcccccatcctgacagatgatgtgtccctgcaggtgttcatggaccacctgaagaagctggccgtgagcagcgcctgctag

SEQ ID NO: 168995 - DNA, 996 bp, Artificial Sequence
  Description of Artificial Sequence: Synthetic coding sequence
atggccacctacctggagttcatccagcagaatgaggagagagatggagtgcgcttctcctggaatgtgtggcccagcagccggctggaggccaccaggatggtggtgcccctggcctgcctgctgacccccctgaaggagaggccagacctgccccctgtgcagtatgagcctgtgctgtgcagccggcccacctgcaaggctgtgctgaaccccctgtgccaggtggactaccgggccaagctgtgggcctgcaacttctgcttccagaggaaccagtttcctccagcctacggcggcatcagcgaggtgaaccagcctgctgagctgatgccccagttcagcaccattgaatatgtgatccagagaggagcccagagccccctcatcttcctgtatgtggtggacacctgcctggaggaggatgacctgcaggccctgaaggagagcctgcagatgagcctgagcctgctgcccccagatgccctggtgggcctcatcacctttggaaggatggtgcaggtgcatgagctgagctgtgagggcatcagcaagagctatgtgttccggggcaccaaggacctgacagccaagcagatccaggacatgctgggcctgaccaagccagccatgcccatgcagcaggcccggcctgcccagccccaggagcacccctttgccagcagccgcttcctgcagcctgtgcacaagattgacatgaacctgacagacctgctgggggagctgcagagggacccctggcctgtgacccagggcaagaggcccctgcggagcactggagtggccctgagcattgctgtgggcctgctggagggcaccttccccaacacaggagcccgcatcatgctgttcaccggcggcccccccacccagggccctggcatggtggtgggagatgagctgaagatccccatccgctcctggcatgacatcgagaaggacaatgcccgcttcatgaagaaggccaccaagtag

SEQ ID NO: 168996 - DNA, 1200 bp, Artificial Sequence
  Description of Artificial Sequence: Synthetic coding sequence
atggccgagaggagaagacacaagaagaggatccaggaggtgggggagcccagcaaggaggagaaggctgtggccaagtacctgcgcttcaactgccccaccaagagcaccaacatgatgggccaccgggtggactacttcatcgccagcaaggctgtggactgcctgctggacagcaagtgggccaaggccaagaagggggaggaggccctcttcaccacccgggagagcgtggtggactactgcaaccggctgctgaagaagcagttcttccaccgggccctgaaggtgatgaagatgaagtatgacaaggacatcaagaaggagaaggacaagggcaaggccgagagcggcaaggaggaggacaagaagagcaagaaggagaacatcaaggatgagaagaccaagaaggagaaggagaagaagaaggatggagagaaggaggagagcaagaaggaggagaccccaggcacccccaagaagaaggagaccaagaagaagttcaagctggagccccatgatgaccaggtgttcctggatggaaatgaggtgtatgtgtggatctatgaccctgtgcacttcaagacctttgtgatgggcctcatcctggtgattgctgtgattgctgccaccctcttccccctgtggccagctgagatgagggtgggcgtgtactacctgtctgtgggcgccggctgctttgtggccagcatcctgctgctggccgtggcccgctgcatcctcttcctgatcatctggctgatcaccggcggccgccaccacttctggttcctgcccaacctgacagcagatgtgggcttcatcgacagcttccggcccctgtacacccatgagtacaagggccccaaggctgacctgaagaaggatgagaagtctgagaccaagaagcagcagaagagtgacagcgaggagaagagtgacagcgagaagaaggaggatgaggagggcaaggtgggccctggcaaccacggcacagagggcagcggcggggagcggcacagcgacacagacagcgacagaagagaagatgacaggagccagcacagcagtggaaatggaaatgactttgagatgatcaccaaggaggagctggagcagcagacagatggagactgtgaagaagatgaggaggaggagaatgatggagagacccccaagagcagccatgagaagagctag

SEQ ID NO: 168997 - DNA, 1200 bp, Artificial Sequence; identical to SEQ ID NO: 168996
  Description of Artificial Sequence: Synthetic coding sequence

SEQ ID NO: 168998 - DNA, 372 bp, Artificial Sequence
  Description of Artificial Sequence: Synthetic coding sequence
atggccgagaggagaagacacaagaagaggatccaggaggtgggggagcccagcaaggatgagaagtctgagaccaagaagcagcagaagagtgacagcgaggagaagagtgacagcgagaagaaggaggatgaggagggcaaggtgggccctggcaaccacggcacagagggcagcggcggggagcggcacagcgacacagacagcgacagaagagaagatgacaggagccagcacagcagtggaaatggaaatgactttgagatgatcaccaaggaggagctggagcagcagacagatggagactgtgaagaagatgaggaggaggagaatgatggagagacccccaagagcagccatgagaagagctag

SEQ ID NO: 168999 - DNA, 2283 bp, Artificial Sequence
  Description of Artificial Sequence: Synthetic coding sequence
atggccggccagcagttccagtatgatgattctggcaacaccttcttctacttcctgaccagctttgtgggcctcatcgtcatcccagccacctactacctgtggccccgggaccagaatgctgagcagatccggctgaagaacatcaggaaggtgtatggccgctgcatgtggtaccgcctgcggctgctgaagccccagcccaacatcatccccaccgtgaagaagatcgtgctgctggccggctgggccctcttcctgttcctggcctacaaggtgtccaagacagaccgggagtaccaggagtacaacccctatgaggtgctgaacctggaccccggggccaccgtggccgagatcaagaagcagtaccgcctgctgagcctgaagtaccacccagacaagggaggagatgaggtgatgttcatgagaattgccaaggcctatgctgccctgacagatgaggagagcaggaagaactgggaggagtttggaaatccagatggcccccaggccaccagctttggaattgccctgcctgcctggatcgtggaccagaagaacagcatcctggtgctgctggtgtatggcctggccttcatggtgatcctgcctgtggtggtgggctcctggtggtaccgcagcatccgctacagcggggaccagatcctgatccgcaccacccagatctacacctactttgtgtacaagaccaggaacatggacatgaagaggctcatcatggtgctggccggggccagcgagtttgacccccagtacaacaaggatgccaccagccggcccacagacaacatcctgatcccccagctgatccgggagatcggcagcatcaacctgaagaagaatgaaccacccctgacctgcccctacagcctgaaggcccgggtgctgctgctgagccacctggccaggatgaagatccctgagaccctggaggaggaccagcagttcatgctgaagaagtgcccagccctgctgcaggagatggtgaatgtcatctgccagctgattgtgatggccaggaaccgggaggagcgggagttccgggcccccaccctggccagcctggagaactgcatgaagctgagccagatggctgtgcagggcctgcagcagttcaagagccccctgctgcagctgccccacatcgaggaggacaacctgcggcgggtgagcaaccacaagaagtacaagatcaagaccatccaggacctggtgtccctgaaggagagtgacagacacaccctgctgcacttcctggaggatgagaagtatgaggaggtgatggctgtgctgggcagcttcccctacgtgaccatggacatcaagagccaggtgctggatgatgaggacagcaacaacatcaccgtgggcagcctggtgacagtgctggtgaagctgacccggcagaccatggccgaggtgtttgagaaggagcagagcatctgtgccgctgaggagcagcctgcagaagatggccagggcgagaccaacaagaacagaaccaagggcggctggcagcagaagagcaagggccccaagaagacagccaagagcaagaagaagaagcccctgaagaagaagcccacccctgtgctgctgccccagagcaagcagcagaagcagaagcaggccaatggagtggtgggcaatgaggccgctgtgaaggaggatgaggaggaggtgtctgacaagggcagtgacagcgaggaggaggagaccaacagagacagccagagcgagaaggatgatggcagtgaccgggacagcgaccgggagcaggatgagaagcagaacaaggatgatgaagctgagtggcaggagctgcagcagagcatccagaggaaggagcgggccctgctggagaccaagagcaagatcacccaccctgtgtacagcctgtacttccctgaggagaagcaggagtggtggtggctgtacatcgctgacaggaaggagcagaccctcatctccatgccctaccacgtgtgcaccctgaaggacacagaggaggtggagctgaagtttcctgcccctgggaagccaggcaactaccagtacacagtgttcctgcggagtgacagctacatgggcctggaccagatcaagcccctgaagctggaggtgcatgaggccaagcctgtgcctgagaaccacccccagtgggacacagccattgaaggagatgaggaccaggaggacagcgagggctttgaggacagctttgaggaggaggaggaggaggaggaggatgatgactag

SEQ ID NO: 169000 - DNA, 1254 bp, Artificial Sequence
  Description of Artificial Sequence: Synthetic coding sequence
atgttcatgagaattgccaaggcctatgctgccctgacagatgaggagagcaggaagaactgggaggagtttggaaatccagatggcccccaggccaccagctttggaattgccctgcctgcctggatcgtggaccagaagaacagcatcctggtgctgctggtgtatggcctggccttcatggtgatcctgcctgtggtggtgggctcctggtggtaccgcagcatccgctacagcggggaccagatcctgatccgcaccacccagatctacacctactttgtgtacaagaccaggaacatggacatgaagaggctcatcatggtgctggccggggccagcgagtttgacccccagtacaacaaggatgccaccagccggcccacagacaacatcctgatcccccagctgatccgggagatcggcagcatcaacctgaagaagaatgaaccacccctgacctgcccctacagcctgaaggcccgggtgctgctgctgagccacctggccaggatgaagatccctgagaccctggaggaggaccagcagttcatgctgaagaagtgcccagccctgctgcaggagatggtgaatgtcatctgccagctgattgtgatggccaggaaccgggaggagcgggagttccgggcccccaccctggccagcctggagaactgcatgaagctgagccagatggctgtgcagggcctgcagcagttcaagagccccctgctgcagctgccccacatcgaggaggacaacctgcggcgggtgagcaaccacaagaagtacaagatcaagaccatccaggacctggtgtccctgaaggagagtgacagacacaccctgctgcacttcctggaggatgagaagtatgaggaggtgatggctgtgctgggcagcttcccctacgtgaccatggacatcaagagccaggtgctggatgatgaggacagcaacaacatcaccgtgggcagcctggtgacagtgctggtgaagctgacccggcagaccatggccgaggtgtttgagaaggagcagagcatctgtgccgctgaggagcagcctgcagaagatggccagggcgagaccaacaagaacagaaccaagggcggctggcagcagaagagcaagggccccaagaagacagccaagaagaagaaggagaccttcaagaagaagacctacacctgtgccatcaccaccgtgaaggccacagagaccaaggccggcaagtggagccgctgggagtag

SEQ ID NO: 169001 - DNA, 1137 bp, Artificial Sequence
  Description of Artificial Sequence: Synthetic coding sequence
gagcacgagcgggagttccgggcccccaccctggccagcctggagaactgcatgaagctgagccagatggctgtgcagggcctgcagcagttcaagagccccctgctgcagctgccccacatcgaggaggacaacctgcggcgggtgagcaaccacaagaagtacaagatcaagaccatccaggacctggtgtccctgaaggagagtgacagacacaccctgctgcacttcctggaggatgagaagtatgaggaggtgatggctgtgctgggcagcttcccctacgtgaccatggacatcaagagccaggtgctggatgatgaggacagcaacaacatcaccgtgggcagcctggtgacagtgctggtgaagctgacccggcagaccatggccgaggtgtttgagaaggagcagagcatctgtgccgctgaggagcagcctgcagaagatggccagggcgagaccaacaagaacagaaccaagggcggctggcagcagaagagcaagggccccaagaagacagccaagagcaagaagaagaagcccctgaagaagaagcccacccctgtgctgctgccccagagcaagcagcagaagcagaagcaggccaacggggtggtgggcaatgaagctgctgtgaaggaggatgaggaggaggtgtctgacaagggcagtgacagcgaggaggagtggcaggagctgcagcagagcatccagaggaaggagcgggccctgctggagaccaagagcaagatcacccaccctgtgtacagcctgtacttccctgaggagaagcaggagtggtggtggctgtacatcgctgacaggaaggagcagaccctcatctccatgccctaccacgtgtgcaccctgaaggacacagaggaggtggagctgaagtttcctgcccctgggaagccaggcaactaccagtacacagtgttcctgcggagtgacagctacatgggcctggaccagatcaagcccctgaagctggaggtgcatgaggccaagcctgtgcctgagaaccacccccagtgggacacagccattgaaggagatgaggaccaggaggacagcgagggctttgaggacagctttgaggaggaggaggaggaggaggaggatgatgactag

SEQ ID NO: 169002 - DNA, 2346 bp, Artificial Sequence
  Description of Artificial Sequence: Synthetic coding sequence
atggtgcgggtgctgcgctccatgtgcctgccccagctgtgcagccacatcctgtctgtgtgcagcggcaccaccagtgacagaaatgtgtacagcgtgcccggcagccagtacctgtacaaccagcccagctgctaccggggcttccagacagtgaagcacagaaatgaaaacacctgccccctgccccaggagatgaaggccctcttcaagaagaagacctatgatgagaagaagacctatgaccagcagaagtttgacagcgagcgggcagatggcaccatcagcagcgagatcaagagcgcccggggcagccaccacctgagcatctatgcagagaacagcctgaagagtgatggctaccacaagaggacagacaggaagagccgcatcatcgccaagaatgtgtccaccagcaagccagagtttgagttcaccaccctggacttccctgagctgcagggcgctgagaacaacatgtctgagatccagaagcagcccaagtggggccctgtgcacagcgtgtccacagacatcagcctgctgcgggaggtggtgaagccagctgctgtgctgagcaagggggagatcgtggtgaagaacaaccccaatgaatctgtgacagccaatgctgccaccaacagccccagctgcacccgggagctgtcctggacccccatgggctacgtggtgcggcagaccctgagcacagagctgtctgctgcccccaagaatgtgacctccatgatcaacctgaagaccatcgccagcagcgctgaccccaagaatgtgtccatccccagcagcgaggccctgagcagtgaccccagctacaacaaggagaagcacatcatccaccccacccagaagagcaaggccagccagggcagtgacctggagcagaatgaggccagcaggaagaacaagaagaagaaggagaagagcaccagcaaatatgaggtgctgactgtgcaggagcccccaagaattgaagatgctgaggagttccccaacctggccgtggccagcgagcggcgggacagaattgagacccccaagttccagagcaagcagcagccccaggacaacttcaagaacaacgtgaagaagagccagctgcctgtgcagctggacctgggcggcatgctgacagccctggagaagaagcagcacagccagcacgccaagcagagcagcaagcctgtggtggtgtctgtgggcgctgtgcctgtgctgagcaaagaatgtgccagcggggagcggggccgcaggatgagccagatgaagaccccccacaaccccctggacagcagcgcccccctgatgaagaagggcaagcagcgggagatccccaaggccaagaagcccaccagcctgaagaagatcatcctgaaggagcggcaggagaggaagcagaggctgcaggagaatgctgtgtccccagccttcaccagtgatgacacccaggatggagagagcggaggagatgaccagtttcctgagcaggccgagctgagcggccctgagggcatggatgagctgatcagcaccccatctgtggaggacaagtctgaggagcccccaggcacagagctgcagagggacacagaggccagccacctggcccccaaccacaccaccttccccaagatccacagccgccgcttccgggactactgcagccagatgctgagcaaggaggtggatgcctgtgtgacagacctgctgaaggagctggtgcgcttccaggacaggatgtaccagaaggaccctgtgaaggccaagaccaagaggcggctggtgctgggcctgcgggaggtgctgaagcacctgaagctgaagaagctgaagtgtgtgatcatcagccccaactgtgagaagatccagagcaaaggaggcctggatgacaccctgcacaccatcatcgactatgcctgtgagcagaacatcccctttgtgtttgccctgaacaggaaggccctgggccgcagcctgaacaaggctgtgcctgtgtctgtggtgggcatcttctcctatgatggagcccaggaccagttccacaagatggtggagctgactgtggccgcccggcaggcctacaagaccatgctggagaatgtgcagcaggagctggtgggggagccccggccccaggccccacccagcctgcccacccagggccccagctgcccagcagaagatggccccccagccctgaaggagaaggaggagccccactacatcgagatctggaagaagcacctggaggcctacagcggctgcaccctggagctggaggagagcctggaggccagcaccagccagatgatgaacctgaacctgtag

SEQ ID NO: 169003 - DNA, 2565 bp, Artificial Sequence
  Description of Artificial Sequence: Synthetic coding sequence
atggccagcgagggcccccgggagcctgagagcgagggcatcaagctgtctgcagatgtgaagccctttgtgcccaggtttgctggcctgaatgtggcctggctggagagcagcgaggcctgtgtgttccccagcagcgctgccacctactacccctttgtgcaggagccccctgtgacagagcagaagatctacacagaggacatggcctttggagccagcaccttccccccccagtacctgagcagcgagatcaccctgcacccctatgcctacagcccctacaccctggacagcacccagaatgtgtacagcgtgcccggcagccagtacctgtacaaccagcccagctgctaccggggcttccagacagtgaagcacagaaatgaaaacacctgccccctgccccaggagatgaaggccctcttcaagaagaagacctatgatgagaagaagacctatgaccagcagaagtttgattctgagcgggcagatggcaccatcagcagcgagatcaagagcgcccggggcagccaccacctgagcatctatgcagagaacagcctgaagagtgatggctaccacaagaggacagacaggaagagccgcatcatcgccaagaatgtgtccaccagcaagccagagtttgagttcaccaccctggacttccctgagctgcagggcgctgagaacaacatgtctgagatccagaagcagcccaagtggggccctgtgcacagcgtgtccacagacatcagcctgctgcgggaggtggtgaagccagctgctgtgctgagcaaaggagagatcgtggtgaagaacaaccccaatgaatctgtgacagccaatgctgccaccaacagccccagctgcacccgggagctgtcctggacccccatgggctacgtggtgcggcagaccctgagcacagagctgtctgctgcccccaagaatgtgacctccatgatcaacctgaagaccatcgccagcagcgctgaccccaagaatgtgtccatccccagcagcgaggccctgagcagtgaccccagctacaacaaggagaagcacatcatccaccccacccagaagagcaaggccagccagggcagtgacctggagcagaatgaggccagcaggaagaacaagaagaagaaggagaagagcaccagcaaatatgaggtgctgactgtgcaggagcccccaagaattgaagatgctgaggagttccccaacctggccgtggccagcgagcggcgggaccgcatcgagacccccaagttccagagcaagcagcagccccaggacaacttcaagaacaacgtgaagaagagccagctgcctgtgcagctggacctgggcggcatgctgacagccctggagaagaagcagcacagccagcacgccaagcagagcagcaagcctgtggtggtgtctgtgggcgctgtgcctgtgctgagcaaagaatgtgccagcggggagcggggccgcaggatgagccagatgaagaccccccacaaccccctggacagcagcgcccccctgatgaagaagggcaagcagcgggagatccccaaggccaagaagcccaccagcctgaagaagatcatcctgaaggagcggcaggagaggaagcagaggctgcaggagaatgctgtgtccccagccttcaccagtgatgacacccaggatggagagagcggaggagatgaccagtttcctgagcaggccgagctgagcggccctgagggcatggatgagctgatcagcacccccagcgtggaggacaagtctgaggagcccccaggcacagagctgcagagggacacagaggccagccacctggcccccaaccacaccaccttccccaagatccacagccgccgcttccgggactactgcagccagatgctgagcaaggaggtggatgcctgtgtgacagacctgctgaaggagctggtgcgcttccaggacaggatgtaccagaaggaccctgtgaaggccaagaccaagaggcggctggtgctgggcctgcgggaggtgctgaagcacctgaagctgaagaagctgaagtgtgtgatcatcagccccaactgtgagaagatccagagcaagggcggcctggatgacaccctgcacaccatcattgattatgcctgtgagcagaacatcccctttgtgtttgccctgaacaggaaggccctgggccgcagcctgaacaaggctgtgcctgtgtctgtggtgggcatcttctcctatgatggagcccaggaccagttccacaagatggtggagctgactgtggccgcccggcaggcctacaagaccatgctggagaatgtgcagcaggagctggtgggggagccccggccccaggccccacccagcctgcccacccagggccccagctgcccagcagaagatggccccccagccctgaaggagaaggaggagccccactacatcgagatctggaagaagcacctggaggcctacagcggctgcaccctggagctggaggagagcctggaggccagcaccagccagatgatgaacctgaacctgtag

SEQ ID NO: 169004 - DNA, 2583 bp, Artificial Sequence
  Description of Artificial Sequence: Synthetic coding sequence
ccagccagccggcggcctgctgctggcctgagagatgctgccagcagcgccccccggggcatggccagcgagggcccccgggagcctgagagcgagggcatcaagctgtctgcagatgtgaagccctttgtgcccaggtttgctggcctgaatgtggcctggctggagagcagcgaggcctgtgtgttccccagcagcgctgccacctactacccctttgtgcaggagccccctgtgacagagcagaagatctacacagaggacatggcctttggagccagcaccttccccccccagtacctgagcagcgagatcaccctgcacccctatgcctacagcccctacaccctggacagcacccagaatgtgtacagcgtgcccggcagccagtacctgtacaaccagcccagctgctaccggggcttccagacagtgaagcacagaaatgaaaacacctgccccctgccccaggagatgaaggccctcttcaagaagaagacctatgatgagaagaagacctatgaccagcagaagtttgattctgagcgggcagatggcaccatcagcagcgagatcaagagcgcccggggcagccaccacctgagcatctatgcagagaacagcctgaagagtgatggctaccacaagaggacagacaggaagagccgcatcatcgccaagaatgtgtccaccagcaagccagagtttgagttcaccaccctggacttccctgagctgcagggcgctgagaacaacatgtctgagatccagaagcagcccaagtggggccctgtgcacagcgtgtccacagacatcagcctgctgcgggaggtggtgaagccagctgctgtgctgagcaaaggagagatcgtggtgaagaacaaccccaatgaatctgtgctgatgcccctgcccatcctgctgcacgtgcaggagaccctgagcacagagctgtctgctgcccccaagaatgtgacctccatgatcaacctgaagaccatcgccagcagcgctgaccccaagaatgtgtccatccccagcagcgaggccctgagcagtgaccccagctacaacaaggagaagcacatcatccaccccacccagaagagcaaggccagccagggcagtgacctggagcagaatgaggccagcaggaagaacaagaagaagaaggagaagagcaccagcaaatatgaggtgctgactgtgcaggagcccccaagaattgaagatgctgaggagttccccaacctggccgtggccagcgagcggcgggaccgcatcgagacccccaagttccagagcaagcagcagccccaggacaacttcaagaacaacgtgaagaagagccagctgcctgtgcagctggacctgggcggcatgctgacagccctggagaagaagcagcacagccagcacgccaagcagagcagcaagcctgtggtggtgtctgtgggcgctgtgcctgtgctgagcaaagaatgtgccagcggggagcggggccgcaggatgagccagatgaagaccccccacaaccccctggacagcagcgcccccctgatgaagaagggcaagcagcgggagatccccaaggccaagaagcccaccagcctgaagaagatcatcctgaaggagcggcaggagaggaagcagaggctgcaggagaatgctgtgtccccagccttcaccagtgatgacacccaggatggagagagcggaggagatgaccagtttcctgagcaggccgagctgagcggccctgagggcatggatgagctgatcagcacccccagcgtggaggacaagtctgaggagcccccaggcacagagctgcagagggacacagaggccagccacctggcccccaaccacaccaccttccccaagatccacagccgccgcttccgggactactgcagccagatgctgagcaaggaggtggatgcctgtgtgacagacctgctgaaggagctggtgcgcttccaggacaggatgtaccagaaggaccctgtgaaggccaagaccaagaggcggctggtgctgggcctgcgggaggtgctgaagcacctgaagctgaagaagctgaagtgtgtgatcatcagccccaactgtgagaagatccagagcaagggcggcctggatgacaccctgcacaccatcattgattatgcctgtgagcagaacatcccctttgtgtttgccctgaacaggaaggccctgggccgcagcctgaacaaggctgtgcctgtgtctgtggtgggcatcttctcctatgatggagcccaggaccagttccacaagatggtggagctgactgtggccgcccggcaggcctacaagaccatgctggagaatgtgcagcaggagctggtgggggagccccggccccaggccccacccagcctgcccacccagggccccagctgcccagcagaagatggccccccagccctgaaggagaaggaggagccccactacatcgagatctggaagaagcacctggaggcctacagcggctgcaccctggagctggaggagagcctggaggccagcaccagccagatgatgaacctgaacctgtag

SEQ ID NO: 169005 - DNA, 828 bp, Artificial Sequence
  Description of Artificial Sequence: Synthetic coding sequence
ggcaccatcagcagcgagatcaagagcgcccggggcagccaccacctgagcatctatgcagagaacagcctgaagagtgatggctaccacaagaggacagacaggaagagccgcatcatcgccaagaatgtgtccaccagcaagccagagtttgagttcaccaccctggacttccctgagctgcagggcgctgagaacaacatgtctgagatccagaagcagcccaagtggggccctgtgcacagcgtgtccacagacatcagcctgctgcgggaggtggtgaagccagctgctgtgctgagcaagggggagatcgtggtgaagaacaaccccaatgaatctgtgacagccaatgctgccaccaacagccccagctgcaccagggctgaccccaagaatgtgtccatccccagcagcgaggccctgagcagtgaccccagctacaacaaggagaagcacatcatccaccccacccagaagagcaaggccagccagggcagtgacctggagcagaatgaggccagcaggaagaacaagaagaagaaggagaagagcaccagcaaatatgaggtgctgactgtgcaggagcccccaagaattgaagatgctgaggagttccccaacctggccgtggccagcgagcggcgggacagaattgagacccccaagttccagagcaagcagcagccccaggacaacttcaagaacaacgtgaagaagagccagctgcctgtgcagctggacctgggcggcatgctgacagccctggagaagaagcagcacagccagcacgccaagcagagcagcaagcctgtggtggtgtcctag

SEQ ID NO: 169006 - DNA, 183 bp, Artificial Sequence
  Description of Artificial Sequence: Synthetic coding sequence
atgcccctgcccatcctgctgcacgtgcaggagcagatcctgaagatgctggtgtaccacctgctgaagctgtacctgcgcatcctgcccaccaccaagaagaacaccctcttcatcctgcccaagagcctgaagcaccacaaggtggtgaccctgaacaagatgaagccccaggagaggtag

SEQ ID NO: 169007 - DNA, 2361 bp, Artificial Sequence
  Description of Artificial Sequence: Synthetic coding sequence
atggcctttggagccagcaccttccccccccagtacctgagcagcgagatcaccctgcacccctatgcctacagcccctacaccctggacagcacccagaatgtgtacagcgtgcccggcagccagtacctgtacaaccagcccagctgctaccggggcttccagacagtgaagcacagaaatgaaaacacctgccccctgccccaggagatgaaggccctcttcaagaagaagacctatgatgagaagaagacctatgaccagcagaagtttgattctgagcgggcagatggcaccatcagcagcgagatcaagagcgcccggggcagccaccacctgagcatctatgcagagaacagcctgaagagtgatggctaccacaagaggacagacaggaagagccgcatcatcgccaagaatgtgtccaccagcaagccagagtttgagttcaccaccctggacttccctgagctgcagggcgctgagaacaacatgtctgagatccagaagcagcccaagtggggccctgtgcacagcgtgtccacagacatcagcctgctgcgggaggtggtgaagccagctgctgtgctgagcaaaggagagatcgtggtgaagaacaaccccaatgaatctgtgacagccaatgctgccaccaacagccccagctgcacccgggagctgtcctggacccccatgggctacgtggtgcggcagaccctgagcacagagctgtctgctgcccccaagaatgtgacctccatgatcaacctgaagaccatcgccagcagcgctgaccccaagaatgtgtccatccccagcagcgaggccctgagcagtgaccccagctacaacaaggagaagcacatcatccaccccacccagaagagcaaggccagccagggcagtgacctggagcagaatgaggccagcaggaagaacaagaagaagaaggagaagagcaccagcaaatatgaggtgctgactgtgcaggagcccccaagaattgaagatgctgaggagttccccaacctggccgtggccagcgagcggcgggaccgcatcgagacccccaagttccagagcaagcagcagccccaggacaacttcaagaacaacgtgaagaagagccagctgcctgtgcagctggacctgggcggcatgctgacagccctggagaagaagcagcacagccagcacgccaagcagagcagcaagcctgtggtggtgtctgtgggcgctgtgcctgtgctgagcaaagaatgtgccagcggggagcggggccgcaggatgagccagatgaagaccccccacaaccccctggacagcagcgcccccctgatgaagaagggcaagcagcgggagatccccaaggccaagaagcccaccagcctgaagaagatcatcctgaaggagcggcaggagaggaagcagaggctgcaggagaatgctgtgtccccagccttcaccagtgatgacacccaggatggagagagcggaggagatgaccagtttcctgagcaggccgagctgagcggccctgagggcatggatgagctgatcagcacccccagcgtggaggacaagtctgaggagcccccaggcacagagctgcagagggacacagaggccagccacctggcccccaaccacaccaccttccccaagatccacagccgccgcttccgggactactgcagccagatgctgagcaaggaggtggatgcctgtgtgacagacctgctgaaggagctggtgcgcttccaggacaggatgtaccagaaggaccctgtgaaggccaagaccaagaggcggctggtgctgggcctgcgggaggtgctgaagcacctgaagctgaagaagctgaagtgtgtgatcatcagccccaactgtgagaagatccagagcaagggcggcctggatgacaccctgcacaccatcattgattatgcctgtgagcagaacatcccctttgtgtttgccctgaacaggaaggccctgggccgcagcctgaacaaggctgtgcctgtgtctgtggtgggcatcttctcctatgatggagcccaggaccagttccacaagatggtggagctgactgtggccgcccggcaggcctacaagaccatgctggagaatgtgcagcaggagctggtgggggagccccggccccaggccccacccagcctgcccacccagggccccagctgcccagcagaagatggccccccagccctgaaggagaaggaggagccccactacatcgagatctggaagaagcacctggaggcctacagcggctgcaccctggagctggaggagagcctggaggccagcaccagccagatgatgaacctgaacctgtag

SEQ ID NO: 169008 - DNA, 747 bp, Artificial Sequence
  Description of Artificial Sequence: Synthetic coding sequence
atgcagacctgccccctggccttccctggccacgtgtcccaggccctgggcaccctgctcttcctggccgccagcctgagcgcccagaatgaaggctgggacagccccatctgcacagaaggagtggtgtctgtgtcctggggagaaaatacagtgatgagctgcaacatcagcaatgccttcagccacgtgaacatcaagctgcgggcccacggccaggagagcgccatcttcaatgaggtggcccctggctacttcagcagagatggctggcagctgcaggtgcagggcggcgtggcccagctggtgatcaagggggcccgggacagccacgccggcctgtacatgtggcacctggtgggccaccagaggaacaaccggcaggtgaccctggaggtgtctggagctgagccccagagcgccccagacaccggcttctggcctgtgcctgctgtggtgacagctgtgttcatcctgctggtggccctggtgatgtttgcctggtaccgctgccgctgcagccagcagaggcgggagaagaagttcttcctgctggagccccagatgaaggtggccgccctgcgggccggggcccagcagggcctgagccgggccagcgctgagctgtggaccccagacagcgagcccaccccccggcccctggccctggtgttcaagcccagccccctgggcgccctggagctgctgagcccccagcccctcttcccctatgctgctgacccctag

SEQ ID NO: 169009 - DNA, 888 bp, Artificial Sequence
  Description of Artificial Sequence: Synthetic coding sequence
atgctgcagggccctggcagcctgctgctgctcttcctggccagccactgctgcctgggcagcgcccggggcctcttcctgtttggccagcctgacttctcctacaagaggagcaactgcaagcccatcccagccaacctgcagctgtgccacggcatcgagtaccagaacatgaggctgcccaacctgctgggccacgagaccatgaaggaggtgctggagcaggccggggcctggatccccctggtgatgaagcagtgccacccagacaccaagaagttcctgtgcagcctgtttgcccctgtgtgcctggatgacctggatgagaccatccagccctgccacagcctgtgtgtgcaggtgaaggacagatgtgcccctgtgatgtctgccttcggcttcccctggccagacatgctggagtgtgaccgcttcccccaggacaatgacctgtgcatccccctggccagcagtgaccacctgctgcctgccacagaggaggcccccaaggtgtgtgaggcctgcaagaacaagaatgatgatgacaatgacatcatggagaccctgtgcaagaatgactttgccctgaagatcaaggtgaaggagatcacctacatcaacagagacaccaagatcatcctggagaccaagagcaagaccatctacaagctgaatggagtgtctgagcgggacctgaagaagtctgtgctgtggctgaaggacagcctgcagtgcacctgtgaggagatgaatgacatcaatgccccctacctggtgatgggccagaagcagggcggggagctggtgatcacctctgtgaagcgctggcagaagggccagcgggagttcaagaggatcagccgcagcatcaggaagctgcagtgctag

SEQ ID NO: 169010 - DNA, 312 bp, Artificial Sequence
  Description of Artificial Sequence: Synthetic coding sequence
atggccagccgctgggccgtgcagctgctgctggtggccgcctggagcatgggctgtggggaggccctgaagtgctacacctgcaaggagcccatgaccagcgccagctgcaggaccatcacccgctgcaagccagaggacacagcctgcatgaccaccctggtgacagtggaggccgagtaccccttcaaccagagccctgtggtgaccaggagctgcagcagcagctgtgtggccacagatcctgacagcattggagctgcccacctgatcttctgctgcttccgggacctgtgcaacagcgagctgtag

SEQ ID NO: 169011 - DNA, 636 bp, Artificial Sequence
  Description of Artificial Sequence: Synthetic coding sequence
atgatcagcaggatggagaagatgaccatgatgatgaagatcctgatcatgtttgccctgggcatgaactactggagctgcagcggcttccctgtgtatgactatgaccccagcagcctgagagatgccctgagcgcctctgtggtgaaggtgaacagccagagcctgagcccctacctgttccgggccttccgcagcagcctgaagagggtggaggtgctggatgagaacaacctggtgatgaacctggagttcagcatccgggagaccacctgcaggaaggacagcggggaggaccctgccacctgtgccttccagagggactactacgtgtccacagctgtgtgccgcagcacagtgaaggtgtctgcccagcaggtgcagggcgtgcacgcccgctgctcctggagcagcagcaccagcgagagctacagcagcgaggagatgatctttggagacatgctgggcagccacaagtggaggaacaactacctgtttggcctcatcagtgatgagagcatcagcgagcagttctatgacaggagcctgggcatcatgagaagagtgctgcccccaggcaacagacgctaccccaaccaccgccaccgggcccgcatcaacacagactttgaatag

SEQ ID NO: 169012 - DNA, 636 bp, Artificial Sequence; identical to SEQ ID NO: 169011
  Description of Artificial Sequence: Synthetic coding sequence

SEQ ID NO: 169013 - DNA, 366 bp, Artificial Sequence
  Description of Artificial Sequence: Synthetic coding sequence
atggccccccggcccctgctgctgctgctgctgctgctgggcggcagcgctgcccggcctgccccaccccgggcccggcggcacagtgatggcaccttcaccagcgagctgagccggctgcgggagggcgcccggctgcagaggctgctgcagggcctggtgggcaagaggtctgagcaggatgctgaaaattccatggcctggacccggctgtctgctggcctgctgtgccccagcggcagcaacatgcccatcctgcaggcctggatgcccctggatggcacctggagcccctggctgcccccaggccccatggtgtctgagcctgctggagctgctgctgagggcaccctgcggcccaggtag

SEQ ID NO: 169014 - DNA, 1323 bp, Artificial Sequence
  Description of Artificial Sequence: Synthetic coding sequence
atgaggccccacctgagcccccccctgcagcagctgctgctgcctgtgctgctggcctgtgccgcccacagcactggagccctgccccggctgtgtgatgtgctgcaggtgctgtgggaggagcaggaccagtgcctgcaggagctgagccgggagcagacaggagacctgggcacagagcagcctgtgcccggctgtgagggcatgtgggacaacatcagctgctggcccagctctgtgcccggccgcatggtggaggtggagtgcccccgcttcctgaggatgctgaccagcagaaatggcagcctcttcaggaactgcacccaggacggctggagcgagaccttcccccggcccaacctggcctgtggggtgaatgtgaatgacagcagcaatgagaagaggcacagctacctgctgaagctgaaggtgatgtacacagtgggctacagcagcagcctggtgatgctgctggtggccctgggcatcctgtgtgccttccggcggctgcactgcaccaggaactacatccacatgcacctgtttgtgtccttcatcctgcgggccctgagcaacttcatcaaggatgctgtgctcttcagcagtgatgatgtgacctactgtgatgcccacagagctggctgcaagctggtgatggtgctcttccagtactgcatcatggccaactacagctggctgctggtggagggcctgtacctgcacaccctgctggccatctccttcttcagcgagaggaagtacctgcagggctttgtggccttcggctggggcagccctgccatctttgtggccctgtgggccatcgcccggcacttcctggaggatgtgggctgctgggacatcaatgccaatgccagcatctggtggatcatccggggccctgtgatcctgagcatcctgatcaacttcatcctcttcatcaacatcctgcgcatcctgatgaggaagctgcggacccaggagaccagaggaaatgaggtgagccactacaagaggctggcccggagcaccctgctgctgatccccctgtttggcatccactacatcgtgtttgccttctccccagaagatgccatggagatccagctgttctttgagctggccctgggcagcttccagggcctggtggtggccgtgctgtactgcttcctgaatggagaggtgcagctggaggtgcagaagaagtggcagcagtggcacctgcgggagttccccctgcaccctgtggccagcttcagcaacagcaccaaggccagccacctggagcagagccagggcacctgcaggaccagcatcatctag

SEQ ID NO: 169015 - DNA, 288 bp, Artificial Sequence
  Description of Artificial Sequence: Synthetic coding sequence
atgaagctgctgatggtgctgatgctggccgccctgctgctgcactgctacgccgacagcggctgcaagctgctggaggacatggtggagaagaccatcaacagcgacatcagcatccctgagtacaaggagctgctgcaggagttcatcgacagtgatgctgctgctgaggccatgggcaagttcaagcagtgcttcctgaaccagagccacaggaccctgaagaactttggcctgatgatgcacacagtgtatgacagcatctggtgcaacatgaagagcaactag

SEQ ID NO: 169016 - DNA, 1746 bp, Artificial Sequence
  Description of Artificial Sequence: Synthetic coding sequence
atgcctgccccccgggcccgggagcagccccgggtgcctggagagcggcagcccctgctgcccaggggggcccggggcccccggcgctggaggagagctgctggagctgctgtgctgctggtggagatgctggagagagctgccttcttcggcgtgacagccaacctggtgctgtacctgaacagcaccaacttcaactggacaggagagcaggccaccagggctgccctggtgttcctgggcgccagctacctgctggcccctgtgggcggctggctggctgatgtgtacctgggccgctacagagctgtggccctgagcctgctgctgtacctggccgccagcggcctgctgcctgccacagccttcccagatggccgcagcagcttctgtggggagatgcctgccagccccctgggccctgcctgccccagcgctggctgccccaggagcagccccagcccctactgtgcccctgtgctgtatgccggcctgctgctgctgggcctggccgccagctctgtgcgcagcaacctgaccagctttggagctgaccaggtgatggacctgggcagagatgccacccggcgcttcttcaactggttctactggagcatcaacctgggcgctgtgctgagcctgctggtggtggccttcatccagcagaacatctccttcctgctgggctacagcatccctgtgggctgtgtgggcctggccttcttcatcttcctgtttgccacccctgtgttcatcaccaagccacccatgggcagccaggtgtcctccatgctgaagctggccctgcagaactgctgcccccagctgtggcagaggcacagcgcccgggaccggcagtgtgcccgggtgctggctgatgagaggagcccccagcccggggccagcccccaggaggacatcgccaacttccaggtgctggtgaagatcctgcctgtgatggtgaccctggtgccctactggatggtgtacttccagatgcagagcacctacgtgctgcagggcctgcacctgcacatccccaacatcttccctgccaacccagccaacatctctgtggccctgcgggcccagggcagcagctacaccatccctgaggcctggctgctgctggccaacgtggtggtggtgctgatcctggtgcccctgaaggaccggctgattgaccccctgctgctgcgctgcaagctgctgcccagcgccctgcagaagatggccctgggcatgttcttcggcttcacctctgtgattgtggccggcgtgctggagatggagcggctgcactacatccaccacaatgaaacagtgtcccagcagatcggggaggtgctgtacaatgctgcccccctgagcatctggtggcagatcccccagtacctgctgattggcatcagcgagatctttgccagcatccctggcctggagtttgcctacagcgaggcccccaggtccatgcagggcgccatcatgggcatcttcttctgcctgtctggagtgggcagcctgctgggcagcagcctggtggccctgctgagcctgcccggcggctggctgcactgccccaaggactttggaaacatcaacaactgcaggatggacctgtacttcttcctgctggccggcatccaggccgtgacagccctgctgtttgtgtggattgctggccgctatgagcgggccagccagggccctgccagccacagccgcttcagccgggaccggggctag

SEQ ID NO: 169017 - DNA, 363 bp, Artificial Sequence
  Description of Artificial Sequence: Synthetic coding sequence
atgaagctgctgatggtgctgatgctggccgccctgagccagcactgctacgccggcagcggctgccccctgctggagaatgtcatcagcaagaccatcaacccccaggtgtccaagacagagtacaaggagctgctgcaggagttcattgatgacaatgccaccaccaatgccattgatgagctgaaggagtgcttcctgaaccagacagatgagaccctgagcaatgtggaggtgttcatggtgatctccttcagcagctacaagctgttcaagagcccagaccagggccaggtgggcagcagcttcctgacagacaatgccaaggccaccagcgagcaggccttctcctacatcggctag

SEQ ID NO: 169018 - DNA, 315 bp, Artificial Sequence
  Description of Artificial Sequence: Synthetic coding sequence
atgaagctggccgccctgctgggcctgtgtgtggccctgagctgcagcagcgctgctgccttcctggtgggcagcgccaagcctgtggcccagcctgtggccgccctggagagcgctgctgaggccggggccggcaccctggccaaccccctgggcaccctgaaccccctgaagctgctgctgagcagcctgggcatccctgtgaaccacctgattgagggcagccagaagtgtgtggccgagctgggcccccaggccgtgggcgctgtgaaggccctgaaggccctgctgggcgccctgactgtgtttggatag

SEQ ID NO: 169019 - DNA, 282 bp, Artificial Sequence
  Description of Artificial Sequence: Synthetic coding sequence
atgaagctggtgaccatcttcctgctggtgaccatcagcctgtgcagctacagcgccacagccttcctgatcaacaaggtgcccctgcctgtggacaagctggcccccctgcccctggacaacatcctgcccttcatggaccccctgaagctgctgctgaagaccctgggcatctctgtggagcacctggtggagggcctgaggaaatgtgtgaatgagctgggccctgaggccagcgaggccgtgaagaagctgctggaggccctgagccacctggtgtag

SEQ ID NO: 169020 - DNA, 1854 bp, Artificial Sequence
  Description of Artificial Sequence: Synthetic coding sequence
atggccgaggccaagacccactggctgggcgccgccctgagcctcatccccctcatcttcctgatctctggagctgaggccgccagcttccagaggaaccagctgctgcagaaggagccagacctgcggctggagaatgtgcagaagttccccagccctgagatgatccgggccctggagtacatcgagaacctgcggcagcaggcccacaaggaggagagcagcccagactacaacccctaccagggcgtgtctgtgcccctgcagcagaaggaaaatggagatgagagccacctgcctgagcgggacagcctgtctgaggaggactggatgaggatcatcctggaggccctgcggcaggccgagaatgagccccagagcgcccccaaggagaacaagccctatgccctgaacagcgagaagaacttccccatggacatgtctgatgattatgagacccagcagtggccagagaggaagctgaagcacatgcagtttcctcccatgtatgaggagaacagccgggacaaccccttcaagaggaccaatgaaattgtggaggagcagtacaccccccagagcctggccaccctggagagcgtcttccaggagctgggcaagctgaccggccccaacaaccagaagcgggagaggatggatgaggagcagaagctgtacacagatgatgaagatgacatctacaaggccaacaacatcgcctatgaagatgtggtgggcggggaggactggaaccctgtggaggagaagattgagagccagacccaggaggaggtgcgggacagcaaggagaacatcgagaagaatgagcagatcaatgatgagatgaagaggagcggccagctgggcatccaggaggaggacctgaggaaggagagcaaggaccagctgagtgatgatgtgtccaaggtgattgcctacctgaagaggctggtgaatgctgctggcagcggccgcctgcagaatggccagaatggagagcgggccacccggctgtttgagaagcccctggacagccagagcatctaccagctgattgagatcagcaggaacctgcagatccccccagaagatctcatcgagatgctgaagacaggagagaagcccaacggctctgtggagcctgagcgggagctggacctgcctgtggacctggatgacatcagcgaggccgacctggaccacccagacctcttccagaacaggatgctgagcaagagcggctaccccaagaccccaggccgggccggcacagaggccctgcctgatggcctgtctgtggaggacatcctgaacctgctgggcatggagagcgctgccaaccagaagaccagctacttccccaacccctacaaccaggagaaggtgctgccccggctgccctacggggccggccgcagccgcagcaaccagctgcccaaggccgcctggatcccccacgtggagaaccggcagatggcctatgagaacctgaatgacaaggaccaggagctgggggagtacctggccaggatgctggtgaagtacccagagatcatcaacagcaaccaggtgaagagggtgcccggccagggcagcagtgaagatgacctgcaggaggaggagcagatcgagcaggccatcaaggagcacctgaaccagggcagcagccaggagacagacaagctggcccctgtgtccaagcgcttccctgtgggcccccccaagaatgatgacacccccaaccggcagtactgggatgaggacctgctgatgaaggtgctggagtacctgaaccaggagaaggccgagaagggccgggagcacatcgccaagagggccatggagaacatgtag

SEQ ID NO: 169021 - DNA, 435 bp, Artificial Sequence
  Description of Artificial Sequence: Synthetic coding sequence
atggccgaggccaagacccactggctgggcgccgccctgagcctcatccccctcatcttcctgatctctggagctgaggccgccagcttccagaggaaccagctgctgcagaaggagccagacctgcggctggagaatgtgcagaagttccccagccctgagatgatccgggccctggagtacatcgagaacctgcggcagcaggcccacaaggaggagagcagcccagactacaacccctaccagggcgtgtctgtgcccctgcagcagaaggaaaatggagatgagagccacctgcctgagcgggacagcctgtctgaggaggactggatgaggatcatcctggaggccctgcggcaggccgagaatgagccccagagcgcccccaaggagaacaagccctatgccctgaacagcgagaagaacttcccctag

SEQ ID NO: 169022 - DNA, 378 bp, Artificial Sequence
  Description of Artificial Sequence: Synthetic coding sequence
atggccgaggccaagacccactggctgggcgccgccctgagcctcatccccctcatcttcctgatctctggagctgaggccgccagcttccagaggaaccagctgctgcagaaggagccagacctgcggctggagaatgtgcagaagttccccagccctgagatgatccgggccctggagtacatcgagaacctgcggcagcaggcccacaaggaggagagcagcccagactacaacccctaccagggcgtgtctgtgcccctgcagcagaaggaaaatggagatgagagccacctgcctgagcgggacagcctgtctgaggaggactggatgaggatcatcctggaggccctgcggcaggccgagaatgagccctag

SEQ ID NO: 169023 - DNA, 1434 bp, Artificial Sequence
  Description of Artificial Sequence: Synthetic coding sequence
atggccgaggccaagacccactggctgggcgccgccctgagcctcatccccctcatcttcctgatctctggagctgaggccgccagcttccagaggaaccagctgctgcagaaggagccagacctgcggctggagaatgtgcagaagttccccagccctgagatgatccgggccctggagtacatcgagaacctgcggcagcaggcccacaaggaggagagcagcccagactacaacccctaccagggcgtgtctgtgcccctgcagcagaaggaaaatggagatgagagccacctgcctgagcgggacagcctgcggggggaggactggaaccctgtggaggagaagattgagagccagacccaggaggaggtgcgggacagcaaggagaacatcgagaagaatgagcagatcaatgatgagatgaagaggagcggccagctgggcatccaggaggaggacctgaggaaggagagcaaggaccagctgagtgatgatgtgtccaaggtgattgcctacctgaagaggctggtgaatgctgctggcagcggccgcctgcagaatggccagaatggagagcgggccacccggctgtttgagaagcccctggacagccagagcatctaccagctgattgagatcagcaggaacctgcagatccccccagaagatctcatcgagatgctgaagacaggagagaagcccaacggctctgtggagcctgagcgggagctggacctgcctgtggacctggatgacatcagcgaggccgacctggaccacccagacctcttccagaacaggatgctgagcaagagcggctaccccaagaccccaggccgggccggcacagaggccctgcctgatggcctgtctgtggaggacatcctgaacctgctgggcatggagagcgctgccaaccagaagaccagctacttccccaacccctacaaccaggagaaggtgctgccccggctgccctacggggccggccgcagccgcagcaaccagctgcccaaggccgcctggatcccccacgtggagaaccggcagatggcctatgagaacctgaatgacaaggaccaggagctgggggagtacctggccaggatgctggtgaagtacccagagatcatcaacagcaaccaggtgaagagggtgcccggccagggcagcagtgaagatgacctgcaggaggaggagcagatcgagcaggccatcaaggagcacctgaaccagggcagcagccaggagacagacaagctggcccctgtgtccaagcgcttccctgtgggcccccccaagaatgatgacacccccaaccggcagtactgggatgaggacctgctgatgaaggtgctggagtacctgaaccaggagaaggccgagaagggccgggagcacatcgccaagagggccatggagaacatgtag

SEQ ID NO: 169024 - DNA, 390 bp, Artificial Sequence; identical to SEQ ID NO: 144893
  Description of Artificial Sequence: Synthetic coding sequence

SEQ ID NO: 169025 - DNA, 711 bp, Artificial Sequence
  Description of Artificial Sequence: Synthetic coding sequence
atggccgccatccaggacggcctggccaagggggagaatgatgagaccgtgagcaacaccctgaccctgaccaacggcctggagaggaggaccaagacctacagcgaggacaactttgaggagctgcagtacttccccaacttctacgccctgctgaagagcattgattctgagaaggaggccaaggagaaggagaccctcatcaccatcatgaagaccctgattgactttgtgaagatgatggtgaagtatggcaccatcagccctgaggagggcgtgtcctacctggagaacctggatgagatgattgccctgcagaccaagaacaagctggagaagaatgccacagacaacatcagcaagctgtttcctgcccccagcgagaagagccatgaggagacagacagcaccaaggaggaggccgccaagatggagaaggagtatggcagcctgaaggacagcaccaaggatgacaacagcaaccctgggggcaagacagatgagcccaagggcaagacagaggcctacctggaggccatcaggaagaacatcgagtggctgaagaagcatgacaagaagggcaacaaggaggactatgacctgagcaagatgagggacttcatcaacaagcaggctgatgcctacgtggagaagggcatcctggacaaggaggaggccgaggccatcaagaggatctacagcagcctgtag

SEQ ID NO: 169026 - DNA, 174 bp, Artificial Sequence
  Description of Artificial Sequence: Synthetic coding sequence
atggccgccatccaggacggcctggccaagggggagaatgatgagaccgtgagcaacaccctgaccctgaccaacggcctggagaggaggaccaagacctacagcgaggacaactttgaggagctgcagtacttccccaacttctacgccctgctgaagagcattgacagctag

SEQ ID NO: 169027 - DNA, 990 bp, Artificial Sequence
  Description of Artificial Sequence: Synthetic coding sequence
atgtctgcctttgacaccaacccctttgctgaccctgtggatgtgaaccccttccaggaccccagcgtgacccagctgaccaatgccccccagggcggcctggccgagttcaaccccttcagcgagaccaatgctgccaccaccgtgcctgtgacccagctgcccggcagcagccagcctgctgtgctgcagcccagcgtggagcccacccagcccaccccccaggccgtggtgtctgctgcccaggccggcctgctgcggcagcaggaggagctggacaggaaggctgctgagctggagaggaaggagcgggagctgcagaacacagtggccaacctgcacgtgcggcagaacaactggccacccctgcccagctggtgccctgtgaagccctgcttctaccaggacttcagcacagagatcccagctgactaccagaggatctgcaagatgctgtactacctgtggatgctgcacagcgtgaccctcttcctgaacctgctggcctgcctggcctggttcagcggcaacagcagcaagggcgtggactttggcctgagcatcctgtggttcctgatcttcaccccctgtgccttcctgtgctggtaccggcccatctacaaggccttcagaagtgacaacagcttctccttctttgtgttcttctttgtgttcttctgccagatcggcatctacatcatccagctggtgggcatccctggcctgggggacagcggctggattgctgccctgagcaccctggacaaccacagcctggccatcagcgtcatcatgatggtggtggccggcttcttcaccctgtgtgctgtgctgtctgtgttcctgctgcagagggtgcacagcctgtacagaagaactggagccagcttccagcaggcccaggaggagttcagccagggcatcttcagcagcaggaccttccacagagctgccagcagcgctgcccagggcgccttccagggcaactag

SEQ ID NO: 169028 - DNA, 864 bp, Artificial Sequence
  Description of Artificial Sequence: Synthetic coding sequence
atgtctgcctttgacaccaacccctttgctgacaccaatgctgccaccaccgtgcctgtgacccagctgcccggcagcagccagcctgctgtgctgcagcccagcgtggagcccacccagcccaccccccaggccgtggtgtctgctgcccaggccggcctgctgcggcagcaggaggagctggacaggaaggctgctgagctggagaggaaggagcgggagctgcagaacacagtggccaacctgcacgtgcggcagaacaactggccacccctgcccagctggtgccctgtgaagccctgcttctaccaggacttcagcacagagatcccagctgactaccagaggatctgcaagatgctgtactacctgtggatgctgcacagcgtgaccctcttcctgaacctgctggcctgcctggcctggttcagcggcaacagcagcaaaggagtggactttggcctgagcatcctgtggttcctgatcttcaccccctgtgccttcctgtgctggtaccggcccatctacaaggccttcagaagtgacaacagcttctccttctttgtgttcttctttgtgttcttctgccagatcggcatctacatcatccagctggtgggcatccctggcctgggggacagcggctggattgctgccctgagcaccctggacaaccacagcctggccatcagcgtcatcatgatggtggtggccggcttcttcaccctgtgtgctgtgctgagcgtcttcctgctgcagagggtgtctggagtgggccgggctgacagcaagtgggaggaggccggcaaccgcttcctgcccctgcccagagatgtgttccaccactgctcctgggccagctag

SEQ ID NO: 169029 - DNA, 1044 bp, Artificial Sequence
  Description of Artificial Sequence: Synthetic coding sequence
atggcccagagcagagatggcggcaacccctttgctgagcccagcgagctggacaaccccttccaggaccctgctgtgatccagcaccggcccagccggcagtatgccaccctggatgtgtacaacccctttgagacccgggagcccccaccagcctatgagcccccagccccagcccccctgcccccaccttctgcccccagcctgcagcccagcaggaagctgagccccacagagcccaagaactacggcagctacagcacccaggccagcgctgctgctgccacagctgagctgctgaagaagcaggaggagctgaacaggaaggccgaggagctggacagaagagagcgggagctgcagcacgccgccctgggcggcacagccacccggcagaacaactggccacccctgcccagcttctgccctgtgcagccctgcttcttccaggacatctccatggagatcccccaggagttccagaagacagtgtccaccatgtactacctgtggatgtgcagcaccctggccctgctgctgaacttcctggcctgcctggccagcttctgtgtggagaccaacaatggagctggcttcggcctgagcatcctgtgggtgctgctcttcaccccctgcagctttgtgtgctggtaccggcccatgtacaaggccttcagaagtgacagcagcttcaacttctttgtgttcttcttcatcttctttgtgcaggatgtgctgtttgtgctgcaggccatcggcatccctggctggggcttcagcggctggatcagcgccctggtggtgcccaagggcaacacagctgtgtctgtgctgatgctgctggtggccctgctcttcaccggcattgctgtgctgggcatcgtgatgctgaagaggatccacagcctgtacagaagaactggagccagcttccagaaggcccagcaggagtttgctgctggggtcttcagcaacccagctgtgaggacagctgctgccaatgctgctgctggagctgctgaaaatgccttccgggccccctag

SEQ ID NO: 169030 - DNA, 966 bp, Artificial Sequence
  Description of Artificial Sequence: Synthetic coding sequence
atggcccagagcagagatggcggcaacccctttgctgagcccagcgagctggacaaccccttccagcccccaccagcctatgagcccccagccccagcccccctgcccccaccttctgcccccagcctgcagcccagcaggaagctgagccccacagagcccaagaactacggcagctacagcacccaggccagcgctgctgctgccacagctgagctgctgaagaagcaggaggagctgaacaggaaggccgaggagctggacagaagagagcgggagctgcagcacgccgccctgggcggcacagccacccggcagaacaactggccacccctgcccagcttctgccctgtgcagccctgcttcttccaggacatctccatggagatcccccaggagttccagaagacagtgtccaccatgtactacctgtggatgtgcagcaccctggccctgctgctgaacttcctggcctgcctggccagcttctgtgtggagaccaacaatggagctggcttcggcctgagcatcctgtgggtgctgctcttcaccccctgcagctttgtgtgctggtaccggcccatgtacaaggccttcagaagtgacagcagcttcaacttctttgtgttcttcttcatcttctttgtgcaggatgtgctgtttgtgctgcaggccatcggcatccctggctggggcttcagcggctggatcagcgccctggtggtgcccaagggcaacacagctgtgtctgtgctgatgctgctggtggccctgctcttcaccggcattgctgtgctgggcatcgtgatgctgaagaggatccacagcctgtacagaagaactggagccagcttccagaaggcccagcaggagtttgctgctggggtcttcagcaacccagctgtgaggacagctgctgccaatgctgctgctggagctgctgaaaatgccttccgggccccctag

SEQ ID NO: 169031 - DNA, 690 bp, Artificial Sequence
  Description of Artificial Sequence: Synthetic coding sequence
atgtctgagaaggagaacaacttcccccccctgcccaagttcatccctgtgaagccctgcttctaccagaacttcagtgatgagatccctgtggagcaccaggtgctggtgaagaggatctaccgcctgtggatgttctactgtgccaccctgggcgtgaacctgattgcctgcctggcctggtggattggaggcggcagcggcaccaactttggcctggcctttgtgtggctgctgctcttcaccccctgtggctacgtgtgctggttccggcctgtgtacaaggccttccgggctgacagcagcttcaacttcatggccttcttcttcatctttggagcccagtttgtgctgaccgtcatccaggccatcggcttcagcggctggggcgcctgtggctggctgagcgccatcggcttcttccagtacagccctggagctgctgtggtgatgctgctgcctgccatcatgttttctgtgtctgctgccatgatggccatcgccatcatgaaggtgcaccgcatctacagaggagctgggggcagcttccagaaggcccagacagagtggaacacaggcacctggaggaacccccccagccgggaggcccagtacaacaacttcagcggcaacagcctgcctgagtaccccaccgtgcccagctacccaggcagcggccagtggccctag

SEQ ID NO: 169032 - DNA, 588 bp, Artificial Sequence
  Description of Artificial Sequence: Synthetic coding sequence
atgtctgagaaggagaacaacttcccccccctgcccaagttcatccctgtgaagccctgcttctaccagaacttcagtgatgagatccctgtggagcaccaggtgctggtgaagaggatctaccgcctgtggatgttctactgtgccaccctgggcgtgaacctgattgcctgcctggcctggtggattggaggcggcagcggcaccaactttggcctggcctttgtgtggctgctgctcttcaccccctgtggctacgtgtgctggttccggcctgtgtacaaggccttccggggctggctgagcgccatcggcttcttccagtacagccctggagctgctgtggtgatgctgctgcctgccatcatgttttctgtgtctgctgccatgatggccatcgccatcatgaaggtgcaccgcatctacagaggagctgggggcagcttccagaaggcccagacagagtggaacacaggcacctggaggaacccccccagccgggaggcccagtacaacaacttcagcggcaacagcctgcctgagtaccccaccgtgcccagctacccaggcagcggccagtggccctag

SEQ ID NO: 169033 - DNA, 588 bp, Artificial Sequence
  Description of Artificial Sequence: Synthetic coding sequence
atgatccagaggcacatccctgtgtgtggccgcagccggccctaccagaggggctgtgtggtgcaggccggcagcagcggcagccctggctggagccacttcaagatcatctgtggcctggccccagcccccagcgaggccgtgctgagcgccaggaacaactgtgagcacactggaggctgccgcctgcagcctgccctggtgggggagacagagatgtctgagaaggagaacaacttcccccccctgcccaagttcatccctgtgaagccctgcttctaccagaacttcagtgatgagatccctgtggagcaccaggtgctggtgaagaggatctaccgcctgtggatgttctactgtgccaccctgggcgtgaacctgattgcctgcctggcctggtggattggaggcggcagcggcaccaactttggcctggcctttgtgtggctgctgctcttcaccccctgtggctacgtgtgctggttccggcctgtgtacaaggccttccgggctgacagcagcttcaacttcatggccttcttcttcatctttggagcccagtttgtgctgaccgtcatccaggcctag

SEQ ID NO: 169034 - DNA, 708 bp, Artificial Sequence
  Description of Artificial Sequence: Synthetic coding sequence
atggccgagaaggtgaacaacttcccccccctgcccaagttcatccccctgaagccctgcttctaccaggactttgaagctgacatccccccccagcacgtgtccatgaccaagaggctgtactacctgtggatgctgaacagcgtgaccctggccgtgaacctggtgggctgcctggcctggctgattggaggcggcggggccaccaactttggcctggccttcctgtggctgatcctcttcaccccctgcagctatgtgtgctggttccggcccatctacaaggccttcaagacagacagcagcttctccttcatggccttcttcttcaccttcatggcccagctggtgatcagcatcatccaggccgtgggcatccctggctggggcgtgtgtggctggatcgccaccatctccttcttcggcaccaacatcggcagcgctgtggtgatgctgatccccaccgtgatgttcaccgtgatggctgtgttctccttcatcgccctgtccatggtgcacaagttctaccggggcagcggcggcagcttcagcaaggcccaggaggagtggaccaccggggcctggaagaacccccacgtgcagcaggccgcccagaatgctgccatgggcgccgcccagggcgccatgaaccagccccagacccagtacagcgccacccccaactacacctacagcaatgagatgtag

SEQ ID NO: 169035 - DNA, 708 bp, Artificial Sequence; identical to SEQ ID NO: 169034
  Description of Artificial Sequence: Synthetic coding sequence

SEQ ID NO: 169036 - DNA, 495 bp, Artificial Sequence
  Description of Artificial Sequence: Synthetic coding sequence
atgttcctgccccggctgcggggccgctacagcagccctgcctgccagcacgaccaggcccccctgctgcccctggatgtgacagacagcagcttctccttcatggccttcttcttcaccttcatggcccagctggtgatcagcatcatccaggccgtgggcatccctggctggggcgtgtgtggctggatcgccaccatctccttcttcggcaccaacatcggcagcgctgtggtgatgctgatccccaccgtgatgttcaccgtgatggctgtgttctccttcatcgccctgtccatggtgcacaagttctaccggggcagcggcggcagcttcagcaaggcccaggaggagtggaccactggagcctggaagaacccccacgtgcagcaggccgcccagaatgctgccatgggcgccgcccagggcgccatgaaccagccccagacccagtacagcgccacccccaactacacctacagcaatgagatgtag

SEQ ID NO: 169037 - DNA, 1083 bp, Artificial Sequence
  Description of Artificial Sequence: Synthetic coding sequence
atgtttgtggcccggagcattgctgctgaccacaaggacctgattcatgatgtgtcctttgacttccatggaagaaggatggccacctgcagcagtgaccagagcgtgaaggtgtgggacaagtctgagagcggggactggcactgcacagcctcctggaagacccacagcggctctgtgtggagggtgacctgggcccaccctgagtttggccaggtgctggccagctgcagctttgacagaacagctgctgtgtgggaggagatcgtgggggagagcaatgacaagctgcggggccagagccactgggtgaagaggaccaccctggtggacagcaggacctctgtgacagatgtgaagtttgcccccaagcacatgggcctgatgctggccacctgcagcgcagatggcatcgtgcgcatctatgaggccccagatgtgatgaacctgagccagtggagcctgcagcacgagatcagctgcaagctgagctgcagctgcatctcctggaaccccagcagcagccgggcccacagccccatgattgctgtgggcagtgatgacagcagccccaatgccatggccaaggtgcagatctttgagtacaatgaaaacaccaggaaatatgccaaggccgagaccctgatgacagtgacagatcctgtgcatgacatcgcctttgcccccaacctgggccgctccttccacatcctggccatcgccaccaaggatgtgcgcatcttcaccctgaagcctgtgaggaaggagctgaccagcagcggcggccccaccaagtttgagatccacatcgtggcccagtttgacaaccacaacagccaggtgtggagggtgtcctggaacatcactggaacagtgctggccagcagtggagatgatggctgtgtgcggctgtggaaggccaactacatggacaactggaagtgcaccggcatcctgaagggaaatggcagccctgtgaatggcagcagccagcagggcaccagcaaccccagcctgggcagcaccatccccagcctgcagaacagcctgaatggcagcagcgctggcaggaagcacagctag

SEQ ID NO: 169038 - DNA, 1266 bp, Artificial Sequence
  Description of Artificial Sequence: Synthetic coding sequence
atgtttgtggcccggagcattgctgctgaccacaaggacctgattcatgatgtgtcctttgacttccatggaagaaggatggccacctgcagcagtgaccagagcgtgaaggtgtgggacaagtctgagagcggggactggcactgcacagcctcctggaagacccacagcggctctgtgtggagggtgacctgggcccaccctgagtttggccaggtgctggccagctgcagctttgacagaacagctgctgtgtgggaggagatcgtgggggagagcaatgacaagctgcggggccagagccactgggtgaagaggaccaccctggtggacagcaggacctctgtgacagatgtgaagtttgcccccaagcacatgggcctgatgctggccacctgcagcgcagatggcatcgtgcgcatctatgaggccccagatgtgatgaacctgagccagtggagcctgcagcacgagatcagctgcaagctgagctgcagctgcatctcctggaaccccagcagcagccgggcccacagccccatgattgctgtgggcagtgatgacagcagccccaatgccatggccaaggtgcagatctttgagtacaatgaaaacaccaggaaatatgccaaggccgagaccctgatgacagtgacagatcctgtgcatgacatcgcctttgcccccaacctgggccgctccttccacatcctggccatcgccaccaaggatgtgcgcatcttcaccctgaagcctgtgaggaaggagctgaccagcagcggcggccccaccaagtttgagatccacatcgtggcccagtttgacaaccacaacagccaggtgtggagggtgtcctggaacatcactggaacagtgctggccagcagtggagatgatggctgtgtgcggctgtggaaggccaactacatggacaactggaagtgcaccggcatcctgaagggaaatggcagccctgtgaatggcagcagccagcagggcaccagcaaccccagcctgggcagcaccatccccagcctgcagaacagcctgaatggcagcagcgctggccgctacttcttcacccccctggacagcccccgggccggcagccgctggagcagctatgcccagctgctgcccccacctcctccacccctggtggagcacagctgtgatgctgacacagccaacctgcagtacccccacccccggcggcgctacctgagccggcccctgaaccccctgcctgaaaatgaaggcatctag

SEQ ID NO: 169039 - DNA, 3075 bp, Artificial Sequence
  Description of Artificial Sequence: Synthetic coding sequence
atgcctgctgcccggcccccagctgctggcctgcggggcatcagcctcttcctggccctgctgctgggcagccctgctgctgccctggagagagatgccctgcctgaaggagatgccagccccctgggcccctacctgctgcccagcggggcccctgagcggggcagccctgggaaggagcaccctgaggagcgggtggtgacagccccacccagcagcagccagagcgctgaggtgctgggggagctggtgctggatggaacagcccccagcgcccaccacgacatcccagccctgagccccctgctgcctgaggaggcccggcccaagcacgccctgccccccaagaagaagctgcccagcctgaagcaggtgaacagcgccaggaagcagctgcggcccaaggccaccagcgctgccaccgtgcagagagctggcagccagcctgccagccagggcctggacctgctgagcagcagcacagagaagccaggccccccaggggaccctgaccccatcgtggccagcgaggaggccagcgaggtgcccctgtggctggacaggaaggagagcgctgtgcccaccaccccagcccccctgcagatcagccccttcaccagccagccctacgtggcccacaccctgccccagaggcctgagcctggagagcccggccctgacatggcccaggaggccccccaggaggacaccagccccatggccctgatggacaagggagaaaatgagctgactggaagtgccagcgaggagagccaggagaccaccaccagcaccatcatcaccaccaccgtcatcaccacagagcaggccccagccctgtgcagcgtgtccttcagcaaccctgagggctacatcgacagcagtgactaccccctgctgcccctgaacaacttcctggagtgcacctacaacgtgacagtgtacacaggctacggcgtggagctgcaggtgaagtctgtgaacctgagtgatggagagctgctgagcatccggggcgtggatggccccaccctgactgtgctggccaaccagaccctgctggtggagggccaggtgatccgcagccccaccaacaccatctctgtgtacttccgcaccttccaggatgatggcctgggcaccttccagctgcactaccaggccttcatgctgagctgcaacttccccaggaggccagattctggagatgtgacagtgatggacctgcacagcggaggagtggcccacttccactgccacctgggctatgagctgcagggcgccaagatgctgacctgcatcaatgccagcaagccccactggagcagccaggagcccatctgcagcgccccctgtggcggcgctgtgcacaatgccaccatcggccgggtgctgagccccagctacccagagaacaccaacggcagccagttctgcatctggaccatcgaggcccctgagggccagaagctgcacctgcactttgagcggctgctgctgcatgacaaggacaggatgacagtgcacagcggccagaccaacaagagcgccctgctgtatgacagcctgcagacagaatctgtgccctttgagggcctgctgtctgagggcaacaccatccgcatcgagttcaccagtgaccaggcccgggccgccagcaccttcaacatccgctttgaggcctttgagaagggccactgctatgagccctacatccagaatggaaacttcaccaccagtgaccccacctacaacatcggcaccatcgtggagttcacctgtgaccccggccacagcctggagcagggccctgccatcatcgagtgcatcaacgtgcgggacccctactggaatgacacagagcccctgtgccgggccatgtgtggcggggagctgtctgctgtggccggcgtggtgctgagccccaactggccagagccctacgtggagggggaggactgcatctggaagatccacgtgggggaggagaagaggatcttcctggacatccagttcctgaacctgagcaacagcgacatcctgaccatctatgatggagatgaggtgatgccccacatcctgggccagtacctgggcaacagcggcccccagaagctgtacagcagcaccccagacctgaccatccagttccacagcgaccctgctggcctcatctttgggaagggccagggcttcatcatgaactacatcgaggtgtccagaaatgacagctgcagcgacctgcctgagatccagaatggctggaagaccaccagccacacagagctggtgcggggggcccgcatcacctaccagtgtgaccccggctatgacatcgtgggcagtgacaccctgacctgccagtgggacctgtcctggagcagtgacccccccttctgtgagaagatcatgtactgcacagatcctggagaggtggaccacagcaccaggctcatcagtgaccctgtgctgctggtgggcaccaccatccagtacacctgcaaccctggctttgtgctggagggcagcagcctgctgacctgctacagccgggagaccggcacccccatctggaccagccggctgccccactgtgtgtctgaggagagcctggcctgtgacaaccctggcctgcctgaaaatggctaccagatcctgtacaagaggctgtacctgcctggagagagcctgaccttcatgtgctatgagggctttgagctgatgggagaggtgaccatccgctgcatcctgggccagcccagccactggaatggccccctgcctgtgtgcaaggtgaaccaggacagctttgaacatgccctggaggtggccgaggccgctgctgagaccagcctggagggcggcaacatggccctggccatcttcatccctgtgctgatcatcagcctgctgctgggcggggcctacatctacatcacccgctgccgctactacagcaacctgcggctgcccctgatgtacagccacccctacagccagatcaccgtggagacagaatttgacaaccccatctatgagaccggggagacccgggagtatgaggtgtccatctag

SEQ ID NO: 169040 - DNA, 2847 bp, Artificial Sequence
  Description of Artificial Sequence: Synthetic coding sequence
atgcctgctgcccggcccccagctgctggcctgcggggcatcagcctcttcctggccctgctgctgggcagccctgctgctgccctggagagagatgccctgcctgaaggagatgccagccccctgggcccctacctgctgcccagcggggcccctgagcggggcagccctgggaaggagcaccctgaggagcgggtggtgacagccccacccagcagcagccagagcgctgaggtgctgggggagctggtgctggatggaacagcccccagcgcccaccacgacatcccagccctgagccccctgctgcctgaggaggcccggcccaagcacgccctgccccccaagaagaagctgcccagcctgaagcaggtgaacagcgccaggaagcagctgcggcccaaggccaccagcgctgccaccgtgcagagagctggcagccagcctgccagccagggcctggacctgctgagcagcagcacagagaagccaggccccccaggggaccctgaccccatcgtggccagcgaggaggccagcgaggtgcccctgtggctggacaggaaggagagcgctgtgcccaccaccccagcccccctgcagatcagccccttcaccagccagccctacgtggcccacaccctgccccagaggcctgagcctggagagcccggccctgacatggcccaggaggccccccaggaggacaccagccccatggccctgatggacaagggagaaaatgagctgactggaagtgccagcgaggagagccaggagaccaccaccagcaccatcatcaccaccaccgtcatcaccacagagcaggccccagccctgtgcagcgtgtccttcagcaaccctgagggctacatcgacagcagtgactaccccctgctgcccctgaacaacttcctggagtgcacctacaacgtgacagtgtacacaggctacggcgtggagctgcaggtgaagtctgtgaacctgagtgatggagagctgctgagcatccggggcgtggatggccccaccctgactgtgctggccaaccagaccctgctggtggagggccaggtgatccgcagccccaccaacaccatctctgtgtacttccgcaccttccaggatgatggcctgggcaccttccagctgcactaccaggccttcatgctgagctgcaacttccccaggaggccagattctggagatgtgacagtgatggacctgcacagcggaggagtggcccacttccactgccacctgggctatgagctgcagggcgccaagatgctgacctgcatcaatgccagcaagccccactggagcagccaggagcccatctgcagcgccccctgtggcggcgctgtgcacaatgccaccatcggccgggtgctgagccccagctacccagagaacaccaacggcagccagttctgcatctggaccatcgaggcccctgagggccagaagctgcacctgcactttgagcggctgctgctgcatgacaaggacaggatgacagtgcacagcggccagaccaacaagagcgccctgctgtatgacagcctgcagacagaatctgtgccctttgagggcctgctgtctgagggcaacaccatccgcatcgagttcaccagtgaccaggcccgggccgccagcaccttcaacatccgctttgaggcctttgagaagggccactgctatgagccctacatccagaatggaaacttcaccaccagtgaccccacctacaacatcggcaccatcgtggagttcacctgtgaccccggccacagcctggagcagggccctgccatcatcgagtgcatcaacgtgcgggacccctactggaatgacacagagcccctgtgccgggccatgtgtggcggggagctgtctgctgtggccggcgtggtgctgagccccaactggccagagccctacgtggagggggaggactgcatctggaagatccacgtgggggaggagaagaggatcttcctggacatccagttcctgaacctgagcaacagcgacatcctgaccatctatgatggagatgaggtgatgccccacatcctgggccagtacctgggcaacagcggcccccagaagctgtacagcagcaccccagacctgaccatccagttccacagcgaccctgctggcctcatctttgggaagggccagggcttcatcatgaactacatcgaggtgtccagaaatgacagctgcagcgacctgcctgagatccagaatggctggaagaccaccagccacacagagctggtgcggggggcccgcatcacctaccagtgtgaccccggctatgacatcgtgggcagtgacaccctgacctgccagtgggacctgtcctggagcagtgacccccccttctgtgagaagatcatgtactgcacagatcctggagaggtggaccacagcaccaggctcatcagtgaccctgtgctgctggtgggcaccaccatccagtacacctgcaaccctggctttgtgctggagggcagcagcctgctgacctgctacagccgggagaccggcacccccatctggaccagccggctgccccactgtgtgctggccgaggccgctgctgagaccagcctggagggcggcaacatggccctggccatcttcatccctgtgctgatcatcagcctgctgctgggcggggcctacatctacatcacccgctgccgctactacagcaacctgcggctgcccctgatgtacagccacccctacagccagatcaccgtggagacagaatttgacaaccccatctatgagaccggggagacccgggagtatgaggtgtccatctag

SEQ ID NO: 169041 - DNA, 2850 bp, Artificial Sequence
  Description of Artificial Sequence: Synthetic coding sequence
atgcctgctgcccggcccccagctgctggcctgcggggcatcagcctcttcctggccctgctgctgggcagccctgctgctgccctggagagagatgccctgcctgaaggagatgccagccccctgggcccctacctgctgcccagcggggcccctgagcggggcagccctgggaaggagcaccctgaggagcgggtggtgacagccccacccagcagcagccagagcgctgaggtgctgggggagctggtgctggatggaacagcccccagcgcccaccacgacatcccagccctgagccccctgctgcctgaggaggcccggcccaagcacgccctgccccccaagaagaagctgcccagcctgaagcaggtgaacagcgccaggaagcagctgcggcccaaggccaccagcgctgccaccgtgcagagagctggcagccagcctgccagccagggcctggacctgctgagcagcagcacagagaagccaggccccccaggggaccctgaccccatcgtggccagcgaggaggccagcgaggtgcccctgtggctggacaggaaggagagcgctgtgcccaccaccccagcccccctgcagatcagccccttcaccagccagccctacgtggcccacaccctgccccagaggcctgagcctggagagcccggccctgacatggcccaggaggccccccaggaggacaccagccccatggccctgatggacaagggagaaaatgagctgactggaagtgccagcgaggagagccaggagaccaccaccagcaccatcatcaccaccaccgtcatcaccacagagcaggccccagccctgtgcagcgtgtccttcagcaaccctgagggctacatcgacagcagtgactaccccctgctgcccctgaacaacttcctggagtgcacctacaacgtgacagtgtacacaggctacggcgtggagctgcaggtgaagtctgtgaacctgagtgatggagagctgctgagcatccggggcgtggatggccccaccctgactgtgctggccaaccagaccctgctggtggagggccaggtgatccgcagccccaccaacaccatctctgtgtacttccgcaccttccaggatgatggcctgggcaccttccagctgcactaccaggccttcatgctgagctgcaacttccccaggaggccagattctggagatgtgacagtgatggacctgcacagcggaggagtggcccacttccactgccacctgggctatgagctgcagggcgccaagatgctgacctgcatcaatgccagcaagccccactggagcagccaggagcccatctgcagcgccccctgtggcggcgctgtgcacaatgccaccatcggccgggtgctgagccccagctacccagagaacaccaacggcagccagttctgcatctggaccatcgaggcccctgagggccagaagctgcacctgcactttgagcggctgctgctgcatgacaaggacaggatgacagtgcacagcggccagaccaacaagagcgccctgctgtatgacagcctgcagacagaatctgtgccctttgagggcctgctgtctgagggcaacaccatccgcatcgagttcaccagtgaccaggcccgggccgccagcaccttcaacatccgctttgaggcctttgagaagggccactgctatgagccctacatccagaatggaaacttcaccaccagtgaccccacctacaacatcggcaccatcgtggagttcacctgtgaccccggccacagcctggagcagggccctgccatcatcgagtgcatcaacgtgcgggacccctactggaatgacacagagcccctgtgccgggccatgtgtggcggggagctgtctgctgtggccggcgtggtgctgagccccaactggccagagccctacgtggagggggaggactgcatctggaagatccacgtgggggaggagaagaggatcttcctggacatccagttcctgaacctgagcaacagcgacatcctgaccatctatgatggagatgaggtgatgccccacatcctgggccagtacctgggcaacagcggcccccagaagctgtacagcagcaccccagacctgaccatccagttccacagcgaccctgctggcctcatctttgggaagggccagggcttcatcatgaactacatcgaggtgtccagaaatgacagctgcagcgacctgcctgagatccagaatggctggaagaccaccagccacacagagctggtgcggggggcccgcatcacctaccagtgtgaccccggctatgacatcgtgggcagtgacaccctgacctgccagtgggacctgtcctggagcagtgacccccccttctgtgagaagacagaggagagcctggcctgtgacaaccctggcctgcctgaaaatggctaccagatcctgtacaagaggctgtacctgcctggagagagcctgaccttcatgtgctatgagggctttgagctgatgggagaggtgaccatccgctgcatcctgggccagcccagccactggaatggccccctgcctgtgtgcaaggtggccgaggccgctgctgagaccagcctggagggcggcaacatggccctggccatcttcatccctgtgctgatcatcagcctgctgctgggcggggcctacatctacatcacccgctgccgctactacagcaacctgcggctgcccctgatgtacagccacccctacagccagatcaccgtggagacagaatttgacaaccccatctatgaaacaggagagacccgggagtatgaggtgtccatctag

SEQ ID NO: 169042 - DNA, 420 bp, Artificial Sequence
  Description of Artificial Sequence: Synthetic coding sequence
atgtactgcacagaccccggggaggtggaccacagcaccaggctcatcagtgaccctgtgctgctggtgggcaccaccatccagtacacctgcaaccctggctttgtgctggagggcagcagcctgctgacctgctacagccgggagaccggcacccccatctggaccagccggctgccccactgtgtgtctgaggagagcctggcctgtgacaaccctggcctgcctgaaaatggctaccagatcctgtacaagaggctgtacctgcccggggagagcctgaccttcatgtgctatgagggctttgagctgatgggagaggtgaccatccgctgcatcctgggccagcccagccactggaatggccccctgcctgtgtgcaaggatgtggccaccatccccaccagcgcctgcctgtag

SEQ ID NO: 169043 - DNA, 3042 bp, Artificial Sequence
  Description of Artificial Sequence: Synthetic coding sequence
atgcctgctgcccggcccccagctgctggcctgcggggcatcagcctcttcctggccctgctgctgggcagccctgctgctgccctggagagagatgccctgcctgaaggagatgccagccccctgggcccctacctgctgcccagcggggcccctgagcggggcagccctgggaaggagcaccctgaggagcgggtggtgacagccccacccagcagcagccagagcgctgaggtgctgggggagctggtgctggatggaacagcccccagcgcccaccacgacatcccagccctgagccccctgctgcctgaggaggcccggcccaagcacgccctgccccccaagaagaagctgcccagcctgaagcaggtgaacagcgccaggaagcagctgcggcccaaggccaccagcgctgccaccgtgcagagagctggcagccagcctgccagccagggcctggacctgctgagcagcagcacagagaagccaggccccccaggggaccctgaccccatcgtggccagcgaggaggccagcgaggtgcccctgtggctggacaggaaggagagcgctgtgcccaccaccccagcccccctgcagatcagccccttcaccagccagccctacgtggcccacaccctgccccagaggcctgagcctggagagcccggccctgacatggcccaggaggccccccaggaggacaccagccccatggccctgatggacaagggagaaaatgagctgactggaagtgccagcgaggagagccaggagaccaccaccagcaccatcatcaccaccaccgtcatcaccacagagcaggccccagccctgtgcagcgtgtccttcagcaaccctgagggctacatcgacagcagtgactaccccctgctgcccctgaacaacttcctggagtgcacctacaacgtgacagtgtacacaggctacggcgtggagctgcaggtgaagtctgtgaacctgagtgatggagagctgctgagcatccggggcgtggatggccccaccctgactgtgctggccaaccagaccctgctggtggagggccaggtgatccgcagccccaccaacaccatctctgtgtacttccgcaccttccaggatgatggcctgggcaccttccagctgcactaccaggccttcatgctgagctgcaacttccccaggaggccagattctggagatgtgacagtgatggacctgcacagcggaggagtggcccacttccactgccacctgggctatgagctgcagggcgccaagatgctgacctgcatcaatgccagcaagccccactggagcagccaggagcccatctgcagcgccccctgtggcggcgctgtgcacaatgccaccatcggccgggtgctgagccccagctacccagagaacaccaacggcagccagttctgcatctggaccatcgaggcccctgagggccagaagctgcacctgcactttgagcggctgctgctgcatgacaaggacaggatgacagtgcacagcggccagaccaacaagagcgccctgctgtatgacagcctgcagacagaatctgtgccctttgagggcctgctgtctgagggcaacaccatccgcatcgagttcaccagtgaccaggcccgggccgccagcaccttcaacatccgctttgaggcctttgagaagggccactgctatgagccctacatccagaatggaaacttcaccaccagtgaccccacctacaacatcggcaccatcgtggagttcacctgtgaccccggccacagcctggagcagggccctgccatcatcgagtgcatcaacgtgcgggacccctactggaatgacacagagcccctgtgccgggccatgtgtggcggggagctgtctgctgtggccggcgtggtgctgagccccaactggccagagccctacgtggagggggaggactgcatctggaagatccacgtgggggaggagaagaggatcttcctggacatccagttcctgaacctgagcaacagcgacatcctgaccatctatgatggagatgaggtgatgccccacatcctgggccagtacctgggcaacagcggcccccagaagctgtacagcagcaccccagacctgaccatccagttccacagcgaccctgctggcctcatctttgggaagggccagggcttcatcatgaactacatcgaggtgtccagaaatgacagctgcagcgacctgcctgagatccagaatggctggaagaccaccagccacacagagctggtgcggggggcccgcatcacctaccagtgtgaccccggctatgacatcgtgggcagtgacaccctgacctgccagtgggacctgtcctggagcagtgacccccccttctgtgagaagatcatgtactgcacagatcctggagaggtggaccacagcaccaggctcatcagtgaccctgtgctgctggtgggcaccaccatccagtacacctgcaaccctggctttgtgctggagggcagcagcctgctgacctgctacagccgggagaccggcacccccatctggaccagccggctgccccactgtgtgtctgaggagagcctggcctgtgacaaccctggcctgcctgaaaatggctaccagatcctgtacaagaggctgtacctgcctggagagagcctgaccttcatgtgctatgagggctttgagctgatgggagaggtgaccatccgctgcatcctgggccagcccagccactggaatggccccctgcctgtgtgcaaggtggccgaggccgctgctgagaccagcctggagggcggcaacatggccctggccatcttcatccctgtgctgatcatcagcctgctgctgggcggggcctacatctacatcacccgctgccgctactacagcaacctgcggctgcccctgatgtacagccacccctacagccagatcaccgtggagacagaatttgacaaccccatctatgaaacaggagagacccgggagtatgaggtgtccatctag

SEQ ID NO: 169044 - DNA, 3072 bp, Artificial Sequence
  Description of Artificial Sequence: Synthetic coding sequence
atgcctgctgcccggcccccagctgctggcctgcggggcatcagcctcttcctggccctgctgctgggcagccctgctgctgccctggagagagatgccctgcctgaaggagatgccagccccctgggcccctacctgctgcccagcggggcccctgagcggggcagccctgggaaggagcaccctgaggagcgggtggtgacagccccacccagcagcagccagagcgctgaggtgctgggggagctggtgctggatggaacagcccccagcgcccaccacgacatcccagccctgagccccctgctgcctgaggaggcccggcccaagcacgccctgccccccaagaagaagctgcccagcctgaagcaggtgaacagcgccaggaagcagctgcggcccaaggccaccagcgctgccaccgtgcagagagctggcagccagcctgccagccagggcctggacctgctgagcagcagcacagagaagccaggccccccaggggaccctgaccccatcgtggccagcgaggaggccagcgaggtgcccctgtggctggacaggaaggagagcgctgtgcccaccaccccagcccccctgcagatcagccccttcaccagccagccctacgtggcccacaccctgccccagaggcctgagcctggagagcccggccctgacatggcccaggaggccccccaggaggacaccagccccatggccctgatggacaagggagaaaatgagctgactggaagtgccagcgaggagagccaggagaccaccaccagcaccatcatcaccaccaccgtcatcaccacagagcaggccccagccctgtgcagcgtgtccttcagcaaccctgagggctacatcgacagcagtgactaccccctgctgcccctgaacaacttcctggagtgcacctacaacgtgacagtgtacacaggctacggcgtggagctgcaggtgaagtctgtgaacctgagtgatggagagctgctgagcatccggggcgtggatggccccaccctgactgtgctggccaaccagaccctgctggtggagggccaggtgatccgcagccccaccaacaccatctctgtgtacttccgcaccttccaggatgatggcctgggcaccttccagctgcactaccaggccttcatgctgagctgcaacttccccaggaggccagattctggagatgtgacagtgatggacctgcacagcggaggagtggcccacttccactgccacctgggctatgagctgcagggcgccaagatgctgacctgcatcaatgccagcaagccccactggagcagccaggagcccatctgcagcgccccctgtggcggcgctgtgcacaatgccaccatcggccgggtgctgagccccagctacccagagaacaccaacggcagccagttctgcatctggaccatcgaggcccctgagggccagaagctgcacctgcactttgagcggctgctgctgcatgacaaggacaggatgacagtgcacagcggccagaccaacaagagcgccctgctgtatgacagcctgcagacagaatctgtgccctttgagggcctgctgtctgagggcaacaccatccgcatcgagttcaccagtgaccaggcccgggccgccagcaccttcaacatccgctttgaggcctttgagaagggccactgctatgagccctacatccagaatggaaacttcaccaccagtgaccccacctacaacatcggcaccatcgtggagttcacctgtgaccccggccacagcctggagcagggccctgccatcatcgagtgcatcaacgtgcgggacccctactggaatgacacagagcccctgtgccgggccatgtgtggcggggagctgtctgctgtggccggcgtggtgctgagccccaactggccagagccctacgtggagggggaggactgcatctggaagatccacgtgggggaggagaagaggatcttcctggacatccagttcctgaacctgagcaacagcgacatcctgaccatctatgatggagatgaggtgatgccccacatcctgggccagtacctgggcaacagcggcccccagaagctgtacagcagcaccccagacctgaccatccagttccacagcgaccctgctggcctcatctttgggaagggccagggcttcatcatgaactacatcgaggtgtccagaaatgacagctgcagcgacctgcctgagatccagaatggctggaagaccaccagccacacagagctggtgcggggggcccgcatcacctaccagtgtgaccccggctatgacatcgtgggcagtgacaccctgacctgccagtgggacctgtcctggagcagtgacccccccttctgtgagaagatcatgtactgcacagatcctggagaggtggaccacagcaccaggctcatcagtgaccctgtgctgctggtgggcaccaccatccagtacacctgcaaccctggctttgtgctggagggcagcagcctgctgacctgctacagccgggagaccggcacccccatctggaccagccggctgccccactgtgtgtctgaggagagcctggcctgtgacaaccctggcctgcctgaaaatggctaccagatcctgtacaagaggctgtacctgcctggagagagcctgaccttcatgtgctatgagggctttgagctgatgggagaggtgaccatccgctgcatcctgggccagcccagccactggaatggccccctgcctgtgtgcaaggtgaaccaggacagctttgaacatgccctggaggccgaggccgctgctgagaccagcctggagggcggcaacatggccctggccatcttcatccctgtgctgatcatcagcctgctgctgggcggggcctacatctacatcacccgctgccgctactacagcaacctgcggctgcccctgatgtacagccacccctacagccagatcaccgtggagacagaatttgacaaccccatctatgaaacaggagagacccgggagtatgaggtgtccatctag

SEQ ID NO: 169045 - DNA, 258 bp, Artificial Sequence
  Description of Artificial Sequence: Synthetic coding sequence
ggcttcggcacagatgtggactatgaaacagccttcatccactaccgcctggccagcgagcagcagcacagcgcccaggccatgttcaacctgggctacatgcatgagaagggcctgggcatcaagcaggacatccacctggccaagcgcttctatgacatggccgccagccagccccgctgcaccagcagcagcctgcccagccccctgcagatcggccggcggctcttcctggccgtgcacacaggcaacaagtag

SEQ ID NO: 169046 - DNA, 2385 bp, Artificial Sequence
  Description of Artificial Sequence: Synthetic coding sequence
atgagggtgagaattggcctgaccctgctgctgtgtgctgtgctgctgagcctggccagcgccagcagtgatgaggagggcagccaggatgagagcctggacagcaagaccaccctgaccagtgatgagagcgtgaaggaccacaccacagctggccgggtggtggccggccagatcttcctggacagcgaggagagcgagctggagagcagcatccaggaggaggaggacagcctgaagagccaggagggggagagcgtgacagaggacatctccttcctggagagccccaaccctgagaacaaggactatgaggagcccaagaaggtgaggaagccagccctgacagccatcgagggcacagcccatggagagccctgccacttccccttcctgttcctggacaaggagtatgatgagtgcaccagtgatggaagagaagatggccgcctgtggtgtgccaccacctatgactacaaggcagatgagaagtggggcttctgtgaaacagaggaggaggccgccaagaggcggcagatgcaggaggccgagatgatgtaccagacaggcatgaagatcctgaatggcagcaacaagaagagccagaagcgggaggcctaccgctacctgcagaaggccgcctccatgaaccacaccaaggccctggagcgggtgtcctatgccctgctgtttggagactacctgccccagaacatccaggccgcccgggagatgtttgagaagctgacagaggagggcagccccaagggccagacagccctgggcttcctgtatgccagcggcctgggcgtgaacagcagccaggccaaggccctggtgtactacaccttcggggccctgggcggcaacctgattgcccacatggtgctgggctaccgctactgggccggcattggagtgctgcagagctgtgagagcgccctgacccactaccgcctggtggccaaccacgtggccagtgacatcagcctgaccggcggctctgtggtgcagaggatccggctgcctgatgaggtggagaaccctggcatgaacagcggcatgctggaggaggacctgatccagtactaccagttcctggccgagaagggagatgtgcaggcccaggtgggcctgggccagctgcacctgcatggaggccggggcgtggagcagaaccaccagagggcctttgactacttcaacctggccgccaatgccggcaacagccacgccatggccttcctgggcaagatgtacagcgagggcagtgacatcgtgccccagagcaatgaaacagccctgcactacttcaagaaggctgctgacatgggcaaccctgtgggccagagcggcctgggcatggcctacctgtatggccggggcgtgcaggtgaactatgacctggccctgaagtacttccagaaggctgctgagcagggctgggtggatggccagctgcagctgggctccatgtactacaatggaattggagtgaagagggactacaagcaggccctgaagtacttcaacctggccagccagggcggccacatcctggccttctacaacctggcccagatgcacgccagcggcactggagtgatgaggagctgccacacagctgtggagctgttcaagaatgtgtgtgagcggggccgctggagcgagcggctgatgacagcctacaacagctacaaggatggagactacaatgctgctgtgatccagtacctgctgctggccgagcagggctatgaggtggcccagagcaatgctgccttcatcctggaccagcgggaggccagcatcgtgggagaaaatgagacctacccccgggccctgctgcactggaacagagctgccagccagggctacacagtggcccgcatcaagctgggggactaccacttctacggctttggaacagatgtggactatgaaacagccttcatccactaccgcctggccagcgagcagcagcacagcgcccaggccatgttcaacctgggctacatgcatgagaagggcctgggcatcaagcaggacatccacctggccaagcgcttctatgacatggctgctgaggccagcccagatgcccaggtgcctgtgttcctggccctgtgcaagctgggcgtggtgtacttcctgcagtacatccgggagaccaacatccgggacatgttcacccagctggacatggaccagctgctgggccctgagtgggacctgtacctgatgaccatcatcgccctgctgctgggcaccgtgattgcctaccggcagaggcagcaccaggacatgcctgccccccggcccccaggccccaggcctgccccaccccagcaggagggccccccagagcagcagcccccccagtag

SEQ ID NO: 169047 - DNA, 906 bp, Artificial Sequence
  Description of Artificial Sequence: Synthetic coding sequence
atgagggtgagaattggcctgaccctgctgctgtgtgctgtgctgctgagcctggccagcgccagcagtgatgaggagggcagccaggatgagagcctggacagcaagaccaccctgaccagtgatgagagcgtgaaggaccacaccacagctggccgggtggtggccggccagatcttcctggacagcgaggagagcgagctggagagcagcatccaggaggaggaggacagcctgaagagccaggagggggagagcgtgacagaggacatctccttcctggagagccccaaccctgagaacaaggactatgaggagcccaagaaggtgaggaagccagccctgacagccatcgagggcacagcccatggagagccctgccacttccccttcctgttcctggacaaggagtatgatgagtgcaccagtgatggaagagaagatggccgcctgtggtgtgccaccacctatgactacaaggcagatgagaagtggggcttctgtgaaacagaggaggaggccgccaagaggcggcagatgcaggaggccgagatgatgtaccagacaggcatgaagatcctgaatggcagcaacaagaagagccagaagcgggaggcctaccgctacctgcagaaggccgcctccatgaaccacaccaaggccctggagcgggtgtcctatgccctgctgtttggagactacctgccccagaacatccaggccgcccgggagatgtttgagaagctgacagaggagggcagccccaagggccagacagccctgggcttcctgtatgccagcggcctgggcgtgaacagcagccaggccaaggccctggtgtactacaccttcggggccctgggcggcaacctgattgcccacatggtgctggtgtcccggctgtag

SEQ ID NO: 169048 - DNA, 2067 bp, Artificial Sequence
  Description of Artificial Sequence: Synthetic coding sequence
atgaagcccctgagcctgctgattgagatcctgatcatcctgggcgtgaccatcaagaccatcaaggccgaggagcacaacaagaggcagaaggagagaaatgtgaccacccaggtgtctgtgaatgagatcaagcagtacctgagccacatcctggagcagaggaccagcagcaatgtcatcaacaagcgggagaacctgctggagaagaagaagaaccagaggaagatccgcatcaagggcatccagaacaaggacatcctgaagaggaacaagaaccacctgcagaagcaggccgagaagaacttcacagatgaaggagaccagctgttcaagatgggcatcaaggtgctgcagcagagcaagagccagaagcagaaggaggaggcctacctgctgtttgccaaggctgctgacatgggcaacctgaaggccatggagaagatggctgatgccctgctgtttggaaactttggagtgcagaacatcacagctgccatccagctgtatgagagcctggccaaggagggcagctgcaaggcccagaatgccctgggcttcctgagcagctatggaattggcatggagtatgaccaggccaaggccctgatctactacaccttcggcagcgctgggggcaacatgatgagccagatgatcctgggctaccgctacctgagcggcatcaacgtgctgcagaactgtgaggtggccctgagctactacaagaaggtggccgactacatcgctgacacctttgagaagtctgagggcgtgcctgtggagaaggtgcggctgacagagaggcctgagaacctgagcagcaacagcgagatcctggactgggacatctaccagtactacaagttcctggccgagagaggagatgtgcagatccaggtgtccctgggccagctgcacctgattggaaggaagggcctggaccaggactactacaaggccctgcactacttcctgaaggccgccaaggccggcagcgccaatgccatggccttcatcggcaagatgtacctggagggcaatgctgctgtgccccagaacaatgccacagccttcaagtacttctccatggccgccagcaaaggaaatgccatcggcctgcacggcctgggcctgctgtacttccatggaaaaggagtgcccctgaactatgcagaggccctgaagtacttccagaaggctgctgagaagggctggccagatgcccagttccagctgggcttcatgtactacagcggcagcggcatctggaaggactacaagctggccttcaagtacttctacctggccagccagagcggccagcccctggccatctactacctggccaagatgtatgccactggaactggagtggtgcgcagctgcaggacagctgtggagctgtacaagggcgtgtgtgagctgggccactgggccgagaagttcctgacagcctactttgcctacaaggatggagacatcgacagcagcctggtgcagtatgccctgctggccgagatgggctatgaggtggcccagagcaacagcgccttcatcctggagagcaagaaggccaacatcctggagaaggagaagatgtaccccatggccctgctgctgtggaacagagctgccatccagggcaatgcctttgcccgggtgaagattggagactaccactactacggctacggcaccaagaaggactaccagacagctgccacccactacagcattgctgccaacaagtaccacaatgcccaggccatgttcaacctggcctacatgtatgagcacggcctgggcatcaccaaggacatccacctggcccggcggctgtatgacatggccgcccagaccagcccagatgcccacatccctgtgctgtttgctgtgatgaagctggagaccacccacctgctgcgggacatcctcttcttcaacttcaccacccgctggaactggctgaagctggacaacaccatcggcccccactgggacctcttcgtcatcggcctgattgtgcccggcctcatcctgctgctgaggaaccaccacggctag

SEQ ID NO: 169049 - DNA, 1728 bp, Artificial Sequence
  Description of Artificial Sequence: Synthetic coding sequence
atgaagcccctgagcctgctgattgagatcctgatcatcctgggcgtgaccatcaagaccatcaaggccgaggagcacaacaagaggcagaaggagagaaatgtgaccacccaggtgtctgtgaatgagatcaagcagtacctgagccacatcctggagcagaggaccagcagcaatgtcatcaacaagcgggagaacctgctggagaagaagaagaaccagaggaagatccgcatcaagggcatccagaacaaggacatcctgaagaggaacaagaaccacctgcagaagcaggccgagaagaacttcacagatgaaggagaccagctgttcaagatgggcatcaaggtgctgcagcagagcaagagccagaagcagaaggaggaggcctacctgctgtttgccaaggctgctgacatgggcaacctgaaggccatggagaagatggctgatgccctgctgtttggaaactttggagtgcagaacatcacagctgccatccagctgtatgagagcctggccaaggagggcagctgcaaggcccagaatgccctgggcttcctgagcagctatggaattggcatggagtatgaccaggccaaggccctgatctactacaccttcggcagcgctgggggcaacatgatgagccagatgatcctgggctaccgctacctgagcggcatcaacgtgctgcagaactgtgaggtggccctgagctactacaagaaggtggccgactacatcgctgacacctttgagaagtctgagggcgtgcctgtggagaaggtgcggctgacagagaggcctgagaacctgagcagcaacagcgagatcctggactgggacatctaccagtactacaagttcctggccgagagaggagatgtgcagatccaggtgtccctgggccagctgcacctgattggaaggaagggcctggaccaggactactacaaggccctgcactacttcctgaaggccgccaaggccggcagcgccaatgccatggccttcatcggcaagatgtacctggagggcaatgctgctgtgccccagaacaatgccacagccttcaagtacttctccatggccgccagcaaaggaaatgccatcggcctgcacggcctgggcctgctgtacttccatggaaaaggagtgcccctgaactatgcagaggccctgaagtacttccagaaggctgctgagaagggctggccagatgcccagttccagctgggcttcatgtactacagcggcagcggcatctggaaggactacaagctggccttcaagtacttctacctggccagccagagcggccagcccctggccatctactacctggccaagatgtatgccactggaactggagtggtgcgcagctgcaggacagctgtggagaagaggctgaccttcctgaagaagaggcgctgcatccagtggaggttctcctatggcatcgagctgcccttcaaggacatccacctggcccggcggctgtatgacatggccgcccagaccagcccagatgcccacatccctgtgctgtttgctgtgatgaagctggagaccacccacctgctgcgggacatcctcttcttcaacttcaccacccgctggaactggctgaagctggacaacaccatcggcccccactgggacctgtttgtgattggcctcatcgtgcccggcctcatcctgctgctgaggaaccaccacggctag

SEQ ID NO: 169050 - DNA, 1833 bp, Artificial Sequence
  Description of Artificial Sequence: Synthetic coding sequence
atgattgccagccagttcctgagcgccctgaccctggtgctgctgatcaaggagagcggggcctggagctacaacaccagcacagaggccatgacctatgatgaggccagcgcctactgccagcagcgctacacccacctggtggccatccagaacaaggaggagattgagtacctgaacagcatcctgagctacagccccagctactactggattggcatcaggaaggtgaacaacgtgtgggtgtgggtgggcacccagaagcccctgacagaggaggccaagaactgggcccctggagagcccaacaaccggcagaaggatgaggactgtgtggagatctacatcaagcgggagaaggatgtgggcatgtggaatgatgagcgctgcagcaagaagaagctggccctgtgctacacagctgcctgcaccaacaccagctgcagcggccatggagaatgtgtggagaccatcaacaactacacctgcaagtgtgaccccggcttcagcggcctgaagtgtgagcagatcgtgaactgcacagccctggagagccctgagcacggcagcctggtgtgcagccaccccctgggcaacttctcctacaacagcagctgcagcatcagctgtgaccggggctacctgcccagctccatggagaccatgcagtgcatgagcagtggagagtggagcgcccccatcccagcctgcaatgtggtggagtgtgatgctgtgaccaacccagccaacggctttgtggagtgcttccagaaccctggcagcttcccctggaacaccacctgcacctttgactgtgaggagggctttgagctgatgggcgcccagagcctgcagtgcaccagcagcggcaactgggacaatgagaagcccacctgcaaggctgtgacctgcagagctgtgcggcagccccagaatggatctgtgcgctgcagccacagccctgctggggagttcaccttcaagagcagctgcaacttcacctgtgaggagggcttcatgctgcagggccctgcccaggtggagtgcaccacccagggccagtggacccagcagatccctgtgtgtgaggccttccagtgcacagccctgagcaaccctgagcggggctacatgaactgcctgcccagcgccagcggcagcttccgctatggcagcagctgtgagttcagctgtgagcagggctttgtgctgaagggcagcaagaggctgcagtgtggccccactggagagtgggacaatgagaagcccacctgtgaggccgtgcgctgtgatgctgtgcaccagccccccaagggcctggtgcgctgtgcccacagccccatcggggagttcacctacaagagcagctgtgccttcagctgtgaggagggctttgagctgcacggcagcacccagctggagtgcaccagccagggccagtggacagaggaggtgcccagctgccaggtggtgaagtgcagcagcctggccgtgcctgggaagatcaacatgagctgcagcggggagcctgtgtttggcaccgtgtgcaagtttgcctgcccagagggctggaccctgaatggatctgctgcccggacctgtggggccaccggccactggagcggcctgctgcccacctgtgaggcccccacagagagcaacatccccctggtggccggcctgtctgctgctggcctgagcctgctgaccctggcccccttcctgctgtggctgaggaagtgcctgaggaaggccaagaagtttgtgcctgccagcagctgccagagcctggagagtgatggcagctaccagaagcccagctacatcctgtag

SEQ ID NO: 169051 - DNA, 1455 bp, Artificial Sequence
  Description of Artificial Sequence: Synthetic coding sequence
atgattgccagccagttcctgagcgccctgaccctggtgctgctgatcaaggagagcggggcctggagctacaacaccagcacagaggccatgacctatgatgaggccagcgcctactgccagcagcgctacacccacctggtggccatccagaacaaggaggagattgagtacctgaacagcatcctgagctacagccccagctactactggattggcatcaggaaggtgaacaacgtgtgggtgtgggtgggcacccagaagcccctgacagaggaggccaagaactgggcccctggagagcccaacaaccggcagaaggatgaggactgtgtggagatctacatcaagcgggagaaggatgtgggcatgtggaatgatgagcgctgcagcaagaagaagctggccctgtgctacacagctgcctgcaccaacaccagctgcagcggccatggagaatgtgtggagaccatcaacaactacacctgcaagtgtgaccccggcttcagcggcctgaagtgtgagcagatcgtgaactgcacagccctggagagccctgagcacggcagcctggtgtgcagccaccccctgggcaacttctcctacaacagcagctgcagcatcagctgtgaccggggctacctgcccagctccatggagaccatgcagtgcatgagcagtggagagtggagcgcccccatcccagcctgcaatgtggtggagtgtgatgctgtgaccaacccagccaacggctttgtggagtgcttccagaaccctggcagcttcccctggaacaccacctgcacctttgactgtgaggagggctttgagctgatgggcgcccagagcctgcagtgcaccagcagcggcaactgggacaatgagaagcccacctgcaaggctgtgacctgcagagctgtgcggcagccccagaatggatctgtgcgctgcagccacagccctgctggggagttcaccttcaagagcagctgcaacttcacctgtgaggagggcttcatgctgcagggccctgcccaggtggagtgcaccacccagggccagtggacccagcagatccctgtgtgtgaggtggtgaagtgcagcagcctggccgtgcctgggaagatcaacatgagctgcagcggggagcctgtgtttggcaccgtgtgcaagtttgcctgcccagagggctggaccctgaatggatctgctgcccggacctgtggggccaccggccactggagcggcctgctgcccacctgtgaggcccccacagagagcaacatccccctggtggccggcctgtctgctgctggcctgagcctgctgaccctggcccccttcctgctgtggctgaggaagtgcctgaggaaggccaagaagtttgtgcctgccagcagctgccagagcctggagagtgatggcagctaccagaagcccagctacatcctgtag

SEQ ID NO: 169052 - DNA, 1458 bp, Artificial Sequence
  Description of Artificial Sequence: Synthetic coding sequence
atgattgccagccagttcctgagcgccctgaccctggtgctgctgatcaaggagagcggggcctggagctacaacaccagcacagaggccatgacctatgatgaggccagcgcctactgccagcagcgctacacccacctggtggccatccagaacaaggaggagattgagtacctgaacagcatcctgagctacagccccagctactactggattggcatcaggaaggtgaacaacgtgtgggtgtgggtgggcacccagaagcccctgacagaggaggccaagaactgggcccctggagagcccaacaaccggcagaaggatgaggactgtgtggagatctacatcaagcgggagaaggatgtgggcatgtggaatgatgagcgctgcagcaagaagaagctggccctgtgctacacagctgcctgcaccaacaccagctgcagcggccatggagaatgtgtggagaccatcaacaactacacctgcaagtgtgaccccggcttcagcggcctgaagtgtgagcagatggtggagtgtgatgctgtgaccaacccagccaacggctttgtggagtgcttccagaaccctggcagcttcccctggaacaccacctgcacctttgactgtgaggagggctttgagctgatgggcgcccagagcctgcagtgcaccagcagcggcaactgggacaatgagaagcccacctgcaaggctgtgacctgcagagctgtgcggcagccccagaatggatctgtgcgctgcagccacagccctgctggggagttcaccttcaagagcagctgcaacttcacctgtgaggagggcttcatgctgcagggccctgcccaggtggagtgcaccacccagggccagtggacccagcagatccctgtgtgtgaggccgtgcgctgtgatgctgtgcaccagccccccaagggcctggtgcgctgtgcccacagccccatcggggagttcacctacaagagcagctgtgccttcagctgtgaggagggctttgagctgcacggcagcacccagctggagtgcaccagccagggccagtggacagaggaggtgcccagctgccaggtggtgaagtgcagcagcctggccgtgcctgggaagatcaacatgagctgcagcggggagcctgtgtttggaacagtgtgcaagtttgcctgcccagagggctggaccctgaatggcagcgctgcccggacctgtggggccaccggccactggagcggcctgctgcccacctgtgaggcccccacagagagcaacatccccctggtggccggcctgtctgctgctggcctgagcctgctgaccctggcccccttcctgctgtggctgaggaagtgcctgaggaaggccaagaagtttgtgcctgccagcagctgccagagcctggagagtgatggcagctaccagaagcccagctacatcctgtag

SEQ ID NO: 169053 - DNA, 1644 bp, Artificial Sequence
  Description of Artificial Sequence: Synthetic coding sequence
atgattgccagccagttcctgagcgccctgaccctggtgctgctgatcaaggagagcggggcctggagctacaacaccagcacagaggccatgacctatgatgaggccagcgcctactgccagcagcgctacacccacctggtggccatccagaacaaggaggagattgagtacctgaacagcatcctgagctacagccccagctactactggattggcatcaggaaggtgaacaacgtgtgggtgtgggtgggcacccagaagcccctgacagaggaggccaagaactgggcccctggagagcccaacaaccggcagaaggatgaggactgtgtggagatctacatcaagcgggagaaggatgtgggcatgtggaatgatgagcgctgcagcaagaagaagctggccctgtgctacacagctgcctgcaccaacaccagctgcagcggccatggagaatgtgtggagaccatcaacaactacacctgcaagtgtgaccccggcttcagcggcctgaagtgtgagcagatcgtgaactgcacagccctggagagccctgagcacggcagcctggtgtgcagccaccccctgggcaacttctcctacaacagcagctgcagcatcagctgtgaccggggctacctgcccagctccatggagaccatgcagtgcatgagcagtggagagtggagcgcccccatcccagcctgcaatgtggtggagtgtgatgctgtgaccaacccagccaacggctttgtggagtgcttccagaaccctggcagcttcccctggaacaccacctgcacctttgactgtgaggagggctttgagctgatgggcgcccagagcctgcagtgcaccagcagcggcaactgggacaatgagaagcccacctgcaaggctgtgacctgcagagctgtgcggcagccccagaatggatctgtgcgctgcagccacagccctgctggggagttcaccttcaagagcagctgcaacttcacctgtgaggagggcttcatgctgcagggccctgcccaggtggagtgcaccacccagggccagtggacccagcagatccctgtgtgtgaggccgtgcgctgtgatgctgtgcaccagccccccaagggcctggtgcgctgtgcccacagccccatcggggagttcacctacaagagcagctgtgccttcagctgtgaggagggctttgagctgcacggcagcacccagctggagtgcaccagccagggccagtggacagaggaggtgcccagctgccaggtggtgaagtgcagcagcctggccgtgcctgggaagatcaacatgagctgcagcggggagcctgtgtttggaacagtgtgcaagtttgcctgcccagagggctggaccctgaatggcagcgctgcccggacctgtggggccaccggccactggagcggcctgctgcccacctgtgaggcccccacagagagcaacatccccctggtggccggcctgtctgctgctggcctgagcctgctgaccctggcccccttcctgctgtggctgaggaagtgcctgaggaaggccaagaagtttgtgcctgccagcagctgccagagcctggagagtgatggcagctaccagaagcccagctacatcctgtag

SEQ ID NO: 169054 - DNA, 1644 bp, Artificial Sequence
  Description of Artificial Sequence: Synthetic coding sequence
atgattgccagccagttcctgagcgccctgaccctggtgctgctgatcaaggagagcggggcctggagctacaacaccagcacagaggccatgacctatgatgaggccagcgcctactgccagcagcgctacacccacctggtggccatccagaacaaggaggagattgagtacctgaacagcatcctgagctacagccccagctactactggattggcatcaggaaggtgaacaacgtgtgggtgtgggtgggcacccagaagcccctgacagaggaggccaagaactgggcccctggagagcccaacaaccggcagaaggatgaggactgtgtggagatctacatcaagcgggagaaggatgtgggcatgtggaatgatgagcgctgcagcaagaagaagctggccctgtgctacacagctgcctgcaccaacaccagctgcagcggccatggagaatgtgtggagaccatcaacaactacacctgcaagtgtgaccccggcttcagcggcctgaagtgtgagcagatcgtgaactgcacagccctggagagccctgagcacggcagcctggtgtgcagccaccccctgggcaacttctcctacaacagcagctgcagcatcagctgtgaccggggctacctgcccagctccatggagaccatgcagtgcatgagcagtggagagtggagcgcccccatcccagcctgcaatgtggtggagtgtgatgctgtgaccaacccagccaacggctttgtggagtgcttccagaaccctggcagcttcccctggaacaccacctgcacctttgactgtgaggagggctttgagctgatgggcgcccagagcctgcagtgcaccagcagcggcaactgggacaatgagaagcccacctgcaaggctgtgacctgcagagctgtgcggcagccccagaatggatctgtgcgctgcagccacagccctgctggggagttcaccttcaagagcagctgcaacttcacctgtgaggagggcttcatgctgcagggccctgcccaggtggagtgcaccacccagggccagtggacccagcagatccctgtgtgtgaggccttccagtgcacagccctgagcaaccctgagcggggctacatgaactgcctgcccagcgccagcggcagcttccgctatggcagcagctgtgagttcagctgtgagcagggctttgtgctgaagggcagcaagaggctgcagtgtggccccactggagagtgggacaatgagaagcccacctgtgaggtggtgaagtgcagcagcctggccgtgcctgggaagatcaacatgagctgcagcggggagcctgtgtttggaacagtgtgcaagtttgcctgcccagagggctggaccctgaatggcagcgctgcccggacctgtggggccaccggccactggagcggcctgctgcccacctgtgaggcccccacagagagcaacatccccctggtggccggcctgtctgctgctggcctgagcctgctgaccctggcccccttcctgctgtggctgaggaagtgcctgaggaaggccaagaagtttgtgcctgccagcagctgccagagcctggagagtgatggcagctaccagaagcccagctacatcctgtag

SEQ ID NO: 169055 - DNA, 1455 bp, Artificial Sequence; identical to SEQ ID NO: 169051
  Description of Artificial Sequence: Synthetic coding sequence

SEQ ID NO: 169056 - DNA, 1458 bp, Artificial Sequence; identical to SEQ ID NO: 169052
  Description of Artificial Sequence: Synthetic coding sequence

SEQ ID NO: 169057 - DNA, 1644 bp, Artificial Sequence; identical to SEQ ID NO: 169053
  Description of Artificial Sequence: Synthetic coding sequence

SEQ ID NO: 169058 - DNA, 1644 bp, Artificial Sequence; identical to SEQ ID NO: 169054
  Description of Artificial Sequence: Synthetic coding sequence

SEQ ID NO: 169059 - DNA, 1158 bp, Artificial Sequence
  Description of Artificial Sequence: Synthetic coding sequence
atgggctgcaggaggacccgggagggccccagcaaggccatgatcttcccctggaagtgccagagcacccagagggacctgtggaacatcttcaagctgtggggctggaccatgctgtgctgtgacttcctggcccaccacggcacagactgctggacctaccactacagcgagaagcccatgaactggcagagggcccggcgcttctgccgggacaactacacagacctggtggccatccagaacaaggccgagattgagtacctggagaagaccctgcccttcagccgcagctactactggattggcatcaggaagattggaggcatctggacctgggtgggcaccaacaagagcctgacagaggaggccgagaactggggagatggagagcccaacaacaagaagaacaaggaggactgtgtggagatctacatcaagaggaacaaggatgctgggaagtggaatgatgatgcctgccacaagctgaaggccgccctgtgctacacagccagctgccagccctggagctgcagcggccatggagaatgtgtggagatcatcaacaactacacctgcaactgtgatgtgggctactacggcccccagtgccagtttgtgatccagtgtgagcccctggaggcccctgagctgggcaccatggactgcacccaccccctgggcaacttctccttcagcagccagtgtgccttcagctgcagcgagggcaccaacctgactggaattgaggagaccacctgtggcccctttggaaactggagcagccctgagcccacctgccaggtgatccagtgtgagcccctgagcgccccagacctgggcatcatgaactgcagccaccccctggccagcttctccttcaccagcgcctgcaccttcatctgcagcgagggcacagagctgattggcaagaagaagaccatctgtgagagcagcggcatctggagcaaccccagccccatctgccagaagctggacaagagcttctccatgatcaaggagggggactacaaccccctcttcatccctgtggccgtgatggtgacagccttcagcggcctggccttcatcatctggctggcccggcggctgaagaagggcaagaagagcaagaggtccatgaatgacccctactag

SEQ ID NO: 169060 - DNA, 2493 bp, Artificial Sequence
  Description of Artificial Sequence: Synthetic coding sequence
atggccaactgccagatcgccatcctgtaccagcgcttccagagggtggtgtttggcatcagccagctgctgtgcttcagcgccctgatcagcgagctgaccaaccagaaggaggtggccgcctggacctaccactacagcaccaaggcctacagctggaacatcagcaggaagtactgccagaaccgctacacagacctggtggccatccagaacaagaatgaaattgactacctgaacaaggtgctgccctactacagcagctactactggattggcatcaggaagaacaacaagacctggacctgggtgggcaccaagaaggccctgaccaatgaagctgagaactgggccgacaatgagcccaacaacaagaggaacaatgaagactgtgtggagatctacatcaagagccccagcgcccctgggaagtggaatgatgagcactgcctgaagaagaagcacgccctgtgctacacagccagctgccaggacatgagctgcagcaagcagggagaatgtctggagaccatcggcaactacacctgcagctgctacccaggcttctacggcccagaatgtgaatatgtgagagaatgtggggagctggagctgccccagcacgtgctgatgaactgcagccaccccctgggcaacttctccttcaacagccagtgcagcttccactgcacagatggctaccaggtgaatggccccagcaagctggagtgcctggccagcggcatctggaccaacaagccaccccagtgcctggccgcccagtgcccccccctgaagatccctgagcggggcaacatgacctgcctgcacagcgccaaggccttccagcaccagagcagctgcagcttcagctgtgaggagggctttgccctggtgggccctgaggtggtgcagtgcacagccagcggcgtgtggacagccccagcccctgtgtgcaaggctgtgcagtgccagcacctggaggcccccagcgagggcaccatggactgtgtgcaccccctgacagcctttgcctacggcagcagctgcaagtttgagtgccagcccggctacagagtgcggggcctggacatgctgcgctgcattgattctggccactggagcgcccccctgcccacctgtgaggccatcagctgtgagcccctggagagccctgtgcacggctccatggactgcagccccagcctgcgggccttccagtatgacaccaactgcagcttccgctgtgccgagggcttcatgctgcggggagctgacatcgtgcgctgtgacaacctgggccagtggacagccccagcccctgtgtgccaggccctgcagtgccaggacctgcctgtgcccaatgaggcccgggtgaactgcagccacccctttggagccttccgctaccagagcgtgtgcagcttcacctgcaatgaaggcctgctgctggtgggcgcctctgtgctgcagtgcctggccactggaaactggaacagcgtgcccccagagtgccaggccatcccctgcacccccctgctgagcccccagaatggcaccatgacctgtgtgcagcccctgggcagcagcagctacaagagcacctgccagttcatctgtgatgagggctacagcctgagcggccctgagcggctggactgcaccaggagcggccgctggacagacagcccccccatgtgtgaggccatcaagtgcccagagctgtttgcccctgagcagggcagcctggactgcagcgacaccagaggagagttcaacgtgggcagcacctgccacttcagctgtgacaatggcttcaagctggagggccccaacaacgtggagtgcaccaccagcggccgctggagcgccaccccacccacctgcaagggcatcgccagcctgcccaccccaggagtgcagtgcccagccctgaccaccccaggccagggcaccatgtactgccgccaccaccctggcaccttcggcttcaacaccacctgctacttcggctgcaatgccggcttcaccctgattggagacagcaccctgagctgccggcccagcggccagtggacagctgtgaccccagcctgcagagctgtgaagtgcagcgagctgcacgtgaacaagcccatcgccatgaactgcagcaacctgtggggcaacttctcctatggcagcatctgcagcttccactgcctggagggccagctgctgaatggaagtgcccagacagcctgccaggagaatggccactggagcaccaccgtgcccacctgccaggccggccccctgaccatccaggaggccctgacctactttggaggagctgtggccagcaccatcggcctcatcatgggcggcaccctgctggccctgctgaggaagcgcttccggcagaaggatgatggcaagtgccccctgaacccccacagccacctgggcacctacggcgtcttcaccaatgctgcctttgaccccagcccctag

SEQ ID NO: 169061 - DNA, 2307 bp, Artificial Sequence
  Description of Artificial Sequence: Synthetic coding sequence
atggccaactgccagatcgccatcctgtaccagcgcttccagagggtggtgtttggcatcagccagctgctgtgcttcagcgccctgatcagcgagctgaccaaccagaaggaggtggccgcctggacctaccactacagcaccaaggcctacagctggaacatcagcaggaagtactgccagaaccgctacacagacctggtggccatccagaacaagaatgaaattgactacctgaacaaggtgctgccctactacagcagctactactggattggcatcaggaagaacaacaagacctggacctgggtgggcaccaagaaggccctgaccaatgaagctgagaactgggccgacaatgagcccaacaacaagaggaacaatgaagactgtgtggagatctacatcaagagccccagcgcccctgggaagtggaatgatgagcactgcctgaagaagaagcacgccctgtgctacacagccagctgccaggacatgagctgcagcaagcagggagaatgtctggagaccatcggcaactacacctgcagctgctacccaggcttctacggcccagaatgtgaatatgtgagagaatgtggggagctggagctgccccagcacgtgctgatgaactgcagccaccccctgggcaacttctccttcaacagccagtgcagcttccactgcacagatggctaccaggtgaatggccccagcaagctggagtgcctggccagcggcatctggaccaacaagccaccccagtgcctggccgcccagtgcccccccctgaagatccctgagcggggcaacatgacctgcctgcacagcgccaaggccttccagcaccagagcagctgcagcttcagctgtgaggagggctttgccctggtgggccctgaggtggtgcagtgcacagccagcggcgtgtggacagccccagcccctgtgtgcaaggccatcagctgtgagcccctggagagccctgtgcacggctccatggactgcagccccagcctgcgggccttccagtatgacaccaactgcagcttccgctgtgccgagggcttcatgctgcggggagctgacatcgtgcgctgtgacaacctgggccagtggacagccccagcccctgtgtgccaggccctgcagtgccaggacctgcctgtgcccaatgaggcccgggtgaactgcagccacccctttggagccttccgctaccagagcgtgtgcagcttcacctgcaatgaaggcctgctgctggtgggcgcctctgtgctgcagtgcctggccactggaaactggaacagcgtgcccccagagtgccaggccatcccctgcacccccctgctgagcccccagaatggcaccatgacctgtgtgcagcccctgggcagcagcagctacaagagcacctgccagttcatctgtgatgagggctacagcctgagcggccctgagcggctggactgcaccaggagcggccgctggacagacagcccccccatgtgtgaggccatcaagtgcccagagctgtttgcccctgagcagggcagcctggactgcagcgacaccagaggagagttcaacgtgggcagcacctgccacttcagctgtgacaatggcttcaagctggagggccccaacaacgtggagtgcaccaccagcggccgctggagcgccaccccacccacctgcaagggcatcgccagcctgcccaccccaggagtgcagtgcccagccctgaccaccccaggccagggcaccatgtactgccgccaccaccctggcaccttcggcttcaacaccacctgctacttcggctgcaatgccggcttcaccctgattggagacagcaccctgagctgccggcccagcggccagtggacagctgtgaccccagcctgcagagctgtgaagtgcagcgagctgcacgtgaacaagcccatcgccatgaactgcagcaacctgtggggcaacttctcctatggcagcatctgcagcttccactgcctggagggccagctgctgaatggaagtgcccagacagcctgccaggagaatggccactggagcaccaccgtgcccacctgccaggccggccccctgaccatccaggaggccctgacctactttggaggagctgtggccagcaccatcggcctcatcatgggcggcaccctgctggccctgctgaggaagcgcttccggcagaaggatgatggcaagtgccccctgaacccccacagccacctgggcacctacggcgtcttcaccaatgctgcctttgaccccagcccctag

SEQ ID NO: 169062 - DNA, 2307 bp, Artificial Sequence
  Description of Artificial Sequence: Synthetic coding sequence
atggccaactgccagatcgccatcctgtaccagcgcttccagagggtggtgtttggcatcagccagctgctgtgcttcagcgccctgatcagcgagctgaccaaccagaaggaggtggccgcctggacctaccactacagcaccaaggcctacagctggaacatcagcaggaagtactgccagaaccgctacacagacctggtggccatccagaacaagaatgaaattgactacctgaacaaggtgctgccctactacagcagctactactggattggcatcaggaagaacaacaagacctggacctgggtgggcaccaagaaggccctgaccaatgaagctgagaactgggccgacaatgagcccaacaacaagaggaacaatgaagactgtgtggagatctacatcaagagccccagcgcccctgggaagtggaatgatgagcactgcctgaagaagaagcacgccctgtgctacacagccagctgccaggacatgagctgcagcaagcagggagaatgtctggagaccatcggcaactacacctgcagctgctacccaggcttctacggcccagaatgtgaatatgtgagagaatgtggggagctggagctgccccagcacgtgctgatgaactgcagccaccccctgggcaacttctccttcaacagccagtgcagcttccactgcacagatggctaccaggtgaatggccccagcaagctggagtgcctggccagcggcatctggaccaacaagccaccccagtgcctggccgtgcagtgccagcacctggaggcccccagcgagggcaccatggactgtgtgcaccccctgacagcctttgcctacggcagcagctgcaagtttgagtgccagcccggctacagagtgcggggcctggacatgctgcgctgcattgattctggccactggagcgcccccctgcccacctgtgaggccatcagctgtgagcccctggagagccctgtgcacggctccatggactgcagccccagcctgcgggccttccagtatgacaccaactgcagcttccgctgtgccgagggcttcatgctgcggggagctgacatcgtgcgctgtgacaacctgggccagtggacagccccagcccctgtgtgccaggccctgcagtgccaggacctgcctgtgcccaatgaggcccgggtgaactgcagccacccctttggagccttccgctaccagagcgtgtgcagcttcacctgcaatgaaggcctgctgctggtgggcgcctctgtgctgcagtgcctggccactggaaactggaacagcgtgcccccagagtgccaggccatcccctgcacccccctgctgagcccccagaatggcaccatgacctgtgtgcagcccctgggcagcagcagctacaagagcacctgccagttcatctgtgatgagggctacagcctgagcggccctgagcggctggactgcaccaggagcggccgctggacagacagcccccccatgtgtgaggccatcaagtgcccagagctgtttgcccctgagcagggcagcctggactgcagcgacaccagaggagagttcaacgtgggcagcacctgccacttcagctgtgacaatggcttcaagctggagggccccaacaacgtggagtgcaccaccagcggccgctggagcgccaccccacccacctgcaagggcatcgccagcctgcccaccccaggagtgcagtgcccagccctgaccaccccaggccagggcaccatgtactgccgccaccaccctggcaccttcggcttcaacaccacctgctacttcggctgcaatgccggcttcaccctgattggagacagcaccctgagctgccggcccagcggccagtggacagctgtgaccccagcctgcagagctgtgaagtgcagcgagctgcacgtgaacaagcccatcgccatgaactgcagcaacctgtggggcaacttctcctatggcagcatctgcagcttccactgcctggagggccagctgctgaatggaagtgcccagacagcctgccaggagaatggccactggagcaccaccgtgcccacctgccaggccggccccctgaccatccaggaggccctgacctactttggaggagctgtggccagcaccatcggcctcatcatgggcggcaccctgctggccctgctgaggaagcgcttccggcagaaggatgatggcaagtgccccctgaacccccacagccacctgggcacctacggcgtcttcaccaatgctgcctttgaccccagcccctag

SEQ ID NO: 169063 - DNA, 1941 bp, Artificial Sequence
  Description of Artificial Sequence: Synthetic coding sequence
atggccaactgccagatcgccatcctgtaccagcgcttccagagggtggtgtttggcatcagccagctgctgtgcttcagcgccctgatcagcgagctgaccaaccagaaggaggtggccgcctggacctaccactacagcaccaaggcctacagctggaacatcagcaggaagtactgccagaaccgctacacagacctggtggccatccagaacaagaatgaaattgactacctgaacaaggtgctgccctactacagcagctactactggattggcatcaggaagaacaacaagacctggacctgggtgggcaccaagaaggccctgaccaatgaagctgagaactgggccgacaatgagcccaacaacaagaggaacaatgaagactgtgtggagatctacatcaagagccccagcgcccctgggaagtggaatgatgagcactgcctgaagaagaagcacgccctgtgctacacagccagctgccaggacatgagctgcagcaagcagggagaatgtctggagaccatcggcaactacacctgcagctgctacccaggcttctacggcccagaatgtgaatatgtgagagaatgtggggagctggagctgccccagcacgtgctgatgaactgcagccaccccctgggcaacttctccttcaacagccagtgcagcttccactgcacagatggctaccaggtgaatggccccagcaagctggagtgcctggccagcggcatctggaccaacaagccaccccagtgcctggccgcccagtgcccccccctgaagatccctgagcggggcaacatgacctgcctgcacagcgccaaggccttccagcaccagagcagctgcagcttcagctgtgaggagggctttgccctggtgggccctgaggtggtgcagtgcacagccagcggcgtgtggacagccccagcccctgtgtgcaaggccatcagctgtgagcccctggagagccctgtgcacggctccatggactgcagccccagcctgcgggccttccagtatgacaccaactgcagcttccgctgtgccgagggcttcatgctgcggggagctgacatcgtgcgctgtgacaacctgggccagtggacagccccagcccctgtgtgccaggccctgcagtgccaggacctgcctgtgcccaatgaggcccgggtgaactgcagccacccctttggagccttccgctaccagagcgtgtgcagcttcacctgcaatgaaggcctgctgctggtgggcgcctctgtgctgcagtgcctggccactggaaactggaacagcgtgcccccagagtgccagggcaagagcatcgccagcctgcccaccccaggagtgcagtgcccagccctgaccaccccaggccagggcaccatgtactgccgccaccaccctggcaccttcggcttcaacaccacctgctacttcggctgcaatgccggcttcaccctgattggagacagcaccctgagctgccggcccagcggccagtggacagctgtgaccccagcctgcagagctgtgaagtgcagcgagctgcacgtgaacaagcccatcgccatgaactgcagcaacctgtggggcaacttctcctatggcagcatctgcagcttccactgcctggagggccagctgctgaatggaagtgcccagacagcctgccaggagaatggccactggagcaccaccgtgcccacctgccaggccggccccctgaccatccaggaggccctgacctactttggaggagctgtggccagcaccatcggcctcatcatgggcggcaccctgctggccctgctgaggaagcgcttccggcagaaggatgatggcaagtgccccctgaacccccacagccacctgggcacctacggcgtcttcaccaatgctgcctttgaccccagcccctag

SEQ ID NO: 169064 - DNA, 2493 bp, Artificial Sequence; identical to SEQ ID NO: 169060
  Description of Artificial Sequence: Synthetic coding sequence

SEQ ID NO: 169065 - DNA, 1935 bp, Artificial Sequence
  Description of Artificial Sequence: Synthetic coding sequence
atggccaactgccagatcgccatcctgtaccagcgcttccagagggtggtgtttggcatcagccagctgctgtgcttcagcgccctgatcagcgagctgaccaaccagaaggaggtggccgcctggacctaccactacagcaccaaggcctacagctggaacatcagcaggaagtactgccagaaccgctacacagacctggtggccatccagaacaagaatgaaattgactacctgaacaaggtgctgccctactacagcagctactactggattggcatcaggaagaacaacaagacctggacctgggtgggcaccaagaaggccctgaccaatgaagctgagaactgggccgacaatgagcccaacaacaagaggaacaatgaagactgtgtggagatctacatcaagagccccagcgcccctgggaagtggaatgatgagcactgcctgaagaagaagcacgccctgtgctacacagccagctgccaggacatgagctgcagcaagcagggagaatgtctggagaccatcggcaactacacctgcagctgctacccaggcttctacggcccagaatgtgaatatgtgagagaatgtggggagctggagctgccccagcacgtgctgatgaactgcagccaccccctgggcaacttctccttcaacagccagtgcagcttccactgcacagatggctaccaggtgaatggccccagcaagctggagtgcctggccagcggcatctggaccaacaagccaccccagtgcctggccgcccagtgcccccccctgaagatccctgagcggggcaacatgacctgcctgcacagcgccaaggccttccagcaccagagcagctgcagcttcagctgtgaggagggctttgccctggtgggccctgaggtggtgcagtgcacagccagcggcgtgtggacagccccagcccctgtgtgcaaggccctgcagtgccaggacctgcctgtgcccaatgaggcccgggtgaactgcagccacccctttggagccttccgctaccagagcgtgtgcagcttcacctgcaatgaaggcctgctgctggtgggcgcctctgtgctgcagtgcctggccactggaaactggaacagcgtgcccccagagtgccaggccatcccctgcacccccctgctgagcccccagaatggcaccatgacctgtgtgcagcccctgggcagcagcagctacaagagcacctgccagttcatctgtgatgagggctacagcctgagcggccctgagcggctggactgcaccaggagcggccgctggacagacagcccccccatgtgtgagggcatcgccagcctgcccaccccaggagtgcagtgcccagccctgaccaccccaggccagggcaccatgtactgccgccaccaccctggcaccttcggcttcaacaccacctgctacttcggctgcaatgccggcttcaccctgattggagacagcaccctgagctgccggcccagcggccagtggacagctgtgaccccagcctgcagagctgtgaagtgcagcgagctgcacgtgaacaagcccatcgccatgaactgcagcaacctgtggggcaacttctcctatggcagcatctgcagcttccactgcctggagggccagctgctgaatggaagtgcccagacagcctgccaggagaatggccactggagcaccaccgtgcccacctgccaggccggccccctgaccatccaggaggccctgacctactttggaggagctgtggccagcaccatcggcctcatcatgggcggcaccctgctggccctgctgaggaagcgcttccggcagaaggatgatggcaagtgccccctgaacccccacagccacctgggcacctacggcgtcttcaccaatgctgcctttgaccccagcccctag

SEQ ID NO: 169066 - DNA, 1941 bp, Artificial Sequence; identical to SEQ ID NO: 169063
  Description of Artificial Sequence: Synthetic coding sequence

SEQ ID NO: 169067 - DNA, 2307 bp, Artificial Sequence; identical to SEQ ID NO: 169062
  Description of Artificial Sequence: Synthetic coding sequence

SEQ ID NO: 169068 - DNA, 2307 bp, Artificial Sequence; identical to SEQ ID NO: 169061
  Description of Artificial Sequence: Synthetic coding sequence

SEQ ID NO: 169069 - DNA, 1935 bp, Artificial Sequence; identical to SEQ ID NO: 169065
  Description of Artificial Sequence: Synthetic coding sequence

SEQ ID NO: 169070 - DNA, 2490 bp, Artificial Sequence
  Description of Artificial Sequence: Synthetic coding sequence
gccaactgccagatcgccatcctgtaccagcgcttccagagggtggtgtttggcatcagccagctgctgtgcttcagcgccctgatcagcgagctgaccaaccagaaggaggtggccgcctggacctaccactacagcaccaaggcctacagctggaacatcagcaggaagtactgccagaaccgctacacagacctggtggccatccagaacaagaatgaaattgactacctgaacaaggtgctgccctactacagcagctactactggattggcatcaggaagaacaacaagacctggacctgggtgggcaccaagaaggccctgaccaatgaagctgagaactgggccgacaatgagcccaacaacaagagaaataatgaagactgtgtggagatctacatcaagagccccagcgcccctgggaagtggaatgatgagcactgcctgaagaagaagcacgccctgtgctacacagccagctgccaggacatgagctgcagcaagcagggcgagtgcctggagaccatcggcaactacacctgcagctgctacccaggcttctacggcccagaatgtgaatatgtgcgggagtgtggggagctggagctgccccagcacgtgctgatgaactgcagccaccccctgggcaacttctccttcaacagccagtgcagcttccactgcacagatggctaccaggtgaatggccccagcaagctggagtgcctggccagcggcatctggaccaacaagccaccccagtgcctggccgcccagtgcccccccctgaagatccctgagcggggcaacatgacctgcctgcacagcgccaaggccttccagcaccagagcagctgcagcttcagctgtgaggagggctttgccctggtgggccctgaggtggtgcagtgcacagccagcggcgtgtggacagccccagcccctgtgtgcaaggctgtgcagtgccagcacctggaggcccccagcgagggcaccatggactgtgtgcaccccctgacagcctttgcctacggcagcagctgcaagtttgagtgccagcccggctacagagtgcggggcctggacatgctgcgctgcatcgacagcggccactggagcgcccccctgcccacctgtgaggccatcagctgtgagcccctggagagccctgtgcacggctccatggactgcagccccagcctgcgggccttccagtatgacaccaactgcagcttccgctgtgccgagggcttcatgctgcggggagctgacatcgtgcgctgtgacaacctgggccagtggacagccccagcccctgtgtgccaggccctgcagtgccaggacctgcctgtgcccaatgaggcccgggtgaactgcagccacccctttggagccttccgctaccagagcgtgtgcagcttcacctgcaatgaaggcctgctgctggtgggcgcctctgtgctgcagtgcctggccaccggcaactggaacagcgtgcccccagagtgccaggccatcccctgcacccccctgctgagcccccagaatggcaccatgacctgtgtgcagcccctgggcagcagcagctacaagagcacctgccagttcatctgtgatgagggctacagcctgagcggccctgagcggctggactgcaccaggagcggccgctggacagacagcccccccatgtgtgaggccatcaagtgcccagagctgtttgcccctgagcagggcagcctggactgcagcgacaccagaggagagttcaacgtgggcagcacctgccacttcagctgtgacaatggcttcaagctggagggccccaacaacgtggagtgcaccaccagcggccgctggagcgccaccccacccacctgcaagggcatcgccagcctgcccaccccaggagtgcagtgcccagccctgaccaccccaggccagggcaccatgtactgccgccaccaccctggcaccttcggcttcaacaccacctgctacttcggctgcaatgccggcttcaccctcatcggggacagcaccctgagctgccggcccagcggccagtggacagctgtgaccccagcctgcagagctgtgaagtgcagcgagctgcacgtgaacaagcccatcgccatgaactgcagcaacctgtggggcaacttctcctatggcagcatctgcagcttccactgcctggagggccagctgctgaatggcagcgcccagacagcctgccaggagaatggccactggagcaccaccgtgcccacctgccaggccggccccctgaccatccaggaggccctgacctactttggaggagctgtggccagcaccatcggcctcatcatgggcggcaccctgctggccctgctgaggaagcgcttccggcagaaggatgatggaaaatgtcccctgaacccccacagccacctgggcacctatggagtcttcaccaatgctgcctttgaccccagcccctag

SEQ ID NO: 169071 - DNA, 1941 bp, Artificial Sequence
  Description of Artificial Sequence: Synthetic coding sequence
tgagccaactgccagatcgccatcctgtaccagcgcttccagagggtggtgtttggcatcagccagctgctgtgcttcagcgccctgatcagcgagctgaccaaccagaaggaggtggccgcctggacctaccactacagcaccaaggcctacagctggaacatcagcaggaagtactgccagaaccgctacacagacctggtggccatccagaacaagaatgaaattgactacctgaacaaggtgctgccctactacagcagctactactggattggcatcaggaagaacaacaagacctggacctgggtgggcaccaagaaggccctgaccaatgaagctgagaactgggccgacaatgagcccaacaacaagaggaacaatgaagactgtgtggagatctacatcaagagccccagcgcccctgggaagtggaatgatgagcactgcctgaagaagaagcacgccctgtgctacacagccagctgccaggacatgagctgcagcaagcagggagaatgtctggagaccatcggcaactacacctgcagctgctacccaggcttctacggcccagaatgtgaatatgtgagagaatgtggggagctggagctgccccagcacgtgctgatgaactgcagccaccccctgggcaacttctccttcaacagccagtgcagcttccactgcacagatggctaccaggtgaatggccccagcaagctggagtgcctggccagcggcatctggaccaacaagccaccccagtgcctggccgcccagtgcccccccctgaagatccctgagcggggcaacatgacctgcctgcacagcgccaaggccttccagcaccagagcagctgcagcttcagctgtgaggagggctttgccctggtgggccctgaggtggtgcagtgcacagccagcggcgtgtggacagccccagcccctgtgtgcaaggccatcagctgtgagcccctggagagccctgtgcacggctccatggactgcagccccagcctgcgggccttccagtatgacaccaactgcagcttccgctgtgccgagggcttcatgctgcggggagctgacatcgtgcgctgtgacaacctgggccagtggacagccccagcccctgtgtgccaggccctgcagtgccaggacctgcctgtgcccaatgaggcccgggtgaactgcagccacccctttggagccttccgctaccagagcgtgtgcagcttcacctgcaatgaaggcctgctgctggtgggcgcctctgtgctgcagtgcctggccactggaaactggaacagcgtgcccccagagtgccagggcaagagcatcgccagcctgcccaccccaggagtgcagtgcccagccctgaccaccccaggccagggcaccatgtactgccgccaccaccctggcaccttcggcttcaacaccacctgctacttcggctgcaatgccggcttcaccctgattggagacagcaccctgagctgccggcccagcggccagtggacagctgtgaccccagcctgcagagctgtgaagtgcagcgagctgcacgtgaacaagcccatcgccatgaactgcagcaacctgtggggcaacttctcctatggcagcatctgcagcttccactgcctggagggccagctgctgaatggaagtgcccagacagcctgccaggagaatggccactggagcaccaccgtgcccacctgccaggccggccccctgaccatccaggaggccctgacctactttggaggagctgtggccagcaccatcggcctcatcatgggcggcaccctgctggccctgctgaggaagcgcttccggcagaaggatgatggcaagtgccccctgaacccccacagccacctgggcacctacggcgtcttcaccaatgctgcctttgaccccagcccctag

SEQ ID NO: 169072 - DNA, 2262 bp, Artificial Sequence
  Description of Artificial Sequence: Synthetic coding sequence
gtggtgtttggcatcagccagctgctgtgcttcagcgccctgatcagcgagctgaccaaccagaaggaggtggccgcctggacctaccactacagcaccaaggcctacagctggaacatcagcaggaagtactgccagaaccgctacacagacctggtggccatccagaacaagaatgaaattgactacctgaacaaggtgctgccctactacagcagctactactggattggcatcaggaagaacaacaagacctggacctgggtgggcaccaagaaggccctgaccaatgaagctgagaactgggccgacaatgagcccaacaacaagagaaataatgaagactgtgtggagatctacatcaagagccccagcgcccctgggaagtggaatgatgagcactgcctgaagaagaagcacgccctgtgctacacagccagctgccaggacatgagctgcagcaagcagggcgagtgcctggagaccatcggcaactacacctgcagctgctacccaggcttctacggcccagaatgtgaatatgtgcgggagtgtggggagctggagctgccccagcacgtgctgatgaactgcagccaccccctgggcaacttctccttcaacagccagtgcagcttccactgcacagatggctaccaggtgaatggccccagcaagctggagtgcctggccagcggcatctggaccaacaagccaccccagtgcctggccgcccagtgcccccccctgaagatccctgagcggggcaacatgacctgcctgcacagcgccaaggccttccagcaccagagcagctgcagcttcagctgtgaggagggctttgccctggtgggccctgaggtggtgcagtgcacagccagcggcgtgtggacagccccagcccctgtgtgcaaggccatcagctgtgagcccctggagagccctgtgcacggctccatggactgcagccccagcctgcgggccttccagtatgacaccaactgcagcttccgctgtgccgagggcttcatgctgcggggagctgacatcgtgcgctgtgacaacctgggccagtggacagccccagcccctgtgtgccaggccctgcagtgccaggacctgcctgtgcccaatgaggcccgggtgaactgcagccacccctttggagccttccgctaccagagcgtgtgcagcttcacctgcaatgaaggcctgctgctggtgggcgcctctgtgctgcagtgcctggccaccggcaactggaacagcgtgcccccagagtgccaggccatcccctgcacccccctgctgagcccccagaatggcaccatgacctgtgtgcagcccctgggcagcagcagctacaagagcacctgccagttcatctgtgatgagggctacagcctgagcggccctgagcggctggactgcaccaggagcggccgctggacagacagcccccccatgtgtgaggccatcaagtgcccagagctgtttgcccctgagcagggcagcctggactgcagcgacaccagaggagagttcaacgtgggcagcacctgccacttcagctgtgacaatggcttcaagctggagggccccaacaacgtggagtgcaccaccagcggccgctggagcgccaccccacccacctgcaagggcatcgccagcctgcccaccccaggagtgcagtgcccagccctgaccaccccaggccagggcaccatgtactgccgccaccaccctggcaccttcggcttcaacaccacctgctacttcggctgcaatgccggcttcaccctcatcggggacagcaccctgagctgccggcccagcggccagtggacagctgtgaccccagcctgcagagctgtgaagtgcagcgagctgcacgtgaacaagcccatcgccatgaactgcagcaacctgtggggcaacttctcctatggcagcatctgcagcttccactgcctggagggccagctgctgaatggcagcgcccagacagcctgccaggagaatggccactggagcaccaccgtgcccacctgccaggccggccccctgaccatccaggaggccctgacctactttggaggagctgtggccagcaccatcggcctcatcatgggcggcaccctgctggccctgctgaggaagcgcttccggcagaaggatgatggaaaatgtcccctgaacccccacagccacctgggcacctatggagtcttcaccaatgctgcctttgaccccagcccctag

SEQ ID NO: 169073 - DNA, 2373 bp, Artificial Sequence
  Description of Artificial Sequence: Synthetic coding sequence
atggccaactgccagatcgccatcctgtaccagcgcttccagagggtggtgtttggcatcagccagctgctgtgcttcagcgccctgatcagcgagctgaccaaccagaaggaggtggccgcctggacctaccactacagcaccaaggcctacagctggaacatcagcaggaagtactgccagaaccgctacacagacctggtggccatccagaacaagaatgaaattgactacctgaacaaggtgctgccctactacagcagctactactggattggcatcaggaagaacaacaagacctggacctgggtgggcaccaagaaggccctgaccaatgaagctgagaactgggccgacaatgagcccaacaacaagaggaacaatgaagactgtgtggagatctacatcaagagccccagcgcccctgggaagtggaatgatgagcactgcctgaagaagaagcacgccctgtgctacacagccagctgccaggacatgagctgcagcaagcagggagaatgtctggagaccatcggcaactacacctgcagctgctacccaggcttctacggcccagaatgtgaatatgtgagagaatgtggggagctggagctgccccagcacgtgctgatgaactgcagccaccccctgggcaacttctccttcaacagccagtgcagcttccactgcacagatggctaccaggtgaatggccccagcaagctggagtgcctggccagcggcatctggaccaacaagccaccccagtgcctggccgcccagtgcccccccctgaagatccctgagcggggcaacatgacctgcctgcacagcgccaaggccttccagcaccagagcagctgcagcttcagctgtgaggagggctttgccctggtgggccctgaggtggtgcagtgcacagccagcggcgtgtggacagccccagcccctgtgtgcaaggctgtgcagtgccagcacctggaggcccccagcgagggcaccatggactgtgtgcaccccctgacagcctttgcctacggcagcagctgcaagtttgagtgccagcccggctacagagtgcggggcctggacatgctgcgctgcattgattctggccactggagcgcccccctgcccacctgtgaggccatcagctgtgagcccctggagagccctgtgcacggctccatggactgcagccccagcctgcgggccttccagtatgacaccaactgcagcttccgctgtgccgagggcttcatgctgcggggagctgacatcgtgcgctgtgacaacctgggccagtggacagccccagcccctgtgtgccaggccctgcagtgccaggacctgcctgtgcccaatgaggcccgggtgaactgcagccacccctttggagccttccgctaccagagcgtgtgcagcttcacctgcaatgaaggcctgctgctggtgggcgcctctgtgctgcagtgcctggccactggaaactggaacagcgtgcccccagagtgccaggccatcccctgcacccccctgctgagcccccagaatggcaccatgacctgtgtgcagcccctgggcagcagcagctacaagagcacctgccagttcatctgtgatgagggctacagcctgagcggccctgagcggctggactgcaccaggagcggccgctggacagacagcccccccatgtgtgaggccatcaagtgcccagagctgtttgcccctgagcagggcagcctggactgcagcgacaccagaggagagttcaacgtgggcagcacctgccacttcagctgtgacaatggcttcaagctggagggccccaacaacgtggagtgcaccaccagcggccgctggagcgccaccccacccacctgcaagggcatcgccagcctgcccaccccaggagtgcagtgcccagccctgaccaccccaggccagggcaccatgtactgccgccaccaccctggcaccttcggcttcaacaccacctgctacttcggctgcaatgccggcttcaccctgattggagacagcaccctgagctgccggcccagcggccagtggacagctgtgaccccagcctgcagagctgtgaagtgcagcgagctgcacgtgaacaagcccatcgccatgaactgcagcaacctgtggggcaacttctcctatggcagcatctgcagcttccactgcctggagggccagctgctgaatggaagtgcccagacagcctgccaggagaatggccactggagcaccaccgtgcccacctgccaggatgatggcaagtgccccctgaacccccacagccacctgggcacctacggcgtcttcaccaatgctgcctttgaccccagcccctag

SEQ ID NO: 169074 - DNA, 450 bp, Artificial Sequence
  Description of Artificial Sequence: Synthetic coding sequence
atgatgaccaagcacaagaagtgcttcatcatcgtgggcgtgctgatcaccaccaacatcatcaccctcatcgtgaagctgacccgggacagccagagcctgtgcccctatgactggattggcttccagaacaagtgctactacttcagcaaggaggagggggactggaacagcagcaagtacaactgcagcacccagcacgccgacctgaccatcatcgacaacatcgaggagatgaacttcctgcggcgctacaagtgcagcagtgaccactggattggcctgaagatggccaagaacagaacaggccagtgggtggatggagccaccttcaccaagagctttggcatgaggggcagcgagggctgtgcctacctgagtgatgatggagctgccacagcccgctgctacacagagaggaagtggatctgcaggaagaggatccactag

SEQ ID NO: 169075 - DNA, 1209 bp, Artificial Sequence
  Description of Artificial Sequence: Synthetic coding sequence
atgcccctgcagctgctgctgctgctgatcctgctgggccctggcaacagcctgcagctgtgggacacctgggcagatgaggccgagaaggccctgggccccctgctggcccgggaccggcggcaggccacagaatatgagtacctggactatgacttcctgcctgagacagagcccccagagatgctgaggaacagcacagacaccacccccctgactggacctggcaccccagagagcaccaccgtggagcctgctgcccggcgcagcacaggcctggatgctggaggagctgtgacagagctgaccacagagctggccaacatgggcaacctgagcacagacagcgctgccatggagatccagaccacccagcctgctgccacagaggcccagaccacccccctggccgccacagaggcccagaccacccggctgacagccacagaggcccagaccacccccctggccgccacagaggcccagaccaccccacctgctgccacagaggcccagaccacccagcccaccggcctggaggcccagaccacagccccagctgccatggaggcccagaccacagccccagctgccatggaggcccagaccaccccacctgctgccatggaggcccagaccacccagaccacagccatggaggcccagaccacagcccctgaggccacagaggcccagaccacccagcccacagccacagaggcccagaccacccccctggccgccatggaggccctgagcacagagcccagcgccacagaggccctgtccatggagcccaccaccaagaggggcctcttcatccccttctctgtgtcctctgtgacccacaagggcatccccatggccgccagcaacctgtctgtgaactaccctgtgggcgccccagaccacatctctgtgaagcagtgcctgctggccatcctgatcctggccctggtggccaccatcttctttgtgtgcaccgtggtgctggccgtgcggctgagcaggaagggccacatgtaccctgtgaggaactacagccccacagagatggtgtgcatcagcagcctgctgcctgatggaggagagggccccagcgccacagccaatggaggcctgagcaaggccaagagccctggcctgaccccagagccccgggaggaccgggagggagatgacctgaccctgcacagcttcctgccctag

SEQ ID NO: 169076 - DNA, 1239 bp, Artificial Sequence
  Description of Artificial Sequence: Synthetic coding sequence
atgcccctgcagctgctgctgctgctgatcctgctgggccctggcaacagcctgcagctgtgggacacctgggcagatgaggccgagaaggccctgggccccctgctggcccgggaccggcggcaggccacagaatatgagtacctggactatgacttcctgcctgagacagagcccccagagatgctgaggaacagcacagacaccacccccctgactggacctggcaccccagagagcaccaccgtggagcctgctgcccggcgcagcacaggcctggatgctggaggagctgtgacagagctgaccacagagctggccaacatgggcaacctgagcacagacagcgctgccatggagatccagaccacccagcctgctgccacagaggcccagaccacccagcctgtgcccacagaggcccagaccacccccctggccgccacagaggcccagaccacccggctgacagccacagaggcccagaccacccccctggccgccacagaggcccagaccaccccacctgctgccacagaggcccagaccacccagcccaccggcctggaggcccagaccacagccccagctgccatggaggcccagaccacagccccagctgccatggaggcccagaccaccccacctgctgccatggaggcccagaccacccagaccacagccatggaggcccagaccacagcccctgaggccacagaggcccagaccacccagcccacagccacagaggcccagaccacccccctggccgccatggaggccctgagcacagagcccagcgccacagaggccctgtccatggagcccaccaccaagaggggcctcttcatccccttctctgtgtcctctgtgacccacaagggcatccccatggccgccagcaacctgtctgtgaactaccctgtgggcgccccagaccacatctctgtgaagcagtgcctgctggccatcctgatcctggccctggtggccaccatcttctttgtgtgcaccgtggtgctggccgtgcggctgagcaggaagggccacatgtaccctgtgaggaactacagccccacagagatggtgtgcatcagcagcctgctgcctgatggaggagagggccccagcgccacagccaatggaggcctgagcaaggccaagagccctggcctgaccccagagccccgggaggaccgggagggagatgacctgaccctgcacagcttcctgccctag

SEQ ID NO: 169077 - DNA, 1419 bp, Artificial Sequence
  Description of Artificial Sequence: Synthetic coding sequence
atggccaccaagtgtggcaactgtggccctggctacagcacccccctggaggccatgaagggcccccgggaggagatcgtgtacctgccctgcatctacagaaacacaggaacagaggccccagactacctggccaccgtggatgtggaccccaagagcccccagtactgccaggtgatccaccggctgcccatgcccaacctgaaggatgagctgcaccacagcggctggaacacctgcagcagctgcttcggggacagcaccaagagcaggaccaagctggtgctgcccagcctcatcagcagccgcatctacgtggtggatgtgggcagcgagccccgggcccccaagctgcacaaggtgattgagcccaaggacatccacgccaagtgtgagctggccttcctgcacaccagccactgcctggccagcggggaggtgatgatcagcagcctgggagatgtgaagggaaatggcaagggcggctttgtgctgctggatggagagacctttgaggtgaagggcacctgggagaggcctgggggcgccgcccccctgggctatgacttctggtaccagcccaggcacaacgtgatgatcagcacagagtgggccgcccccaacgtgctgagagatggcttcaacccagcagatgtggaggccggcctgtatggcagccacctgtatgtgtgggactggcagagacatgagatcgtgcagaccctgagcctgaaggatggcctcatccccctggagatccgcttcctgcacaacccagatgctgcccagggctttgtgggctgtgccctgagcagcaccatccagcgcttctacaagaatgaaggaggcacctggagcgtggagaaggtgatccaggtgccccccaagaaggtgaagggctggctgctgcctgagatgcctggcctcatcacagacatcctgctgagcctggatgaccgcttcctgtacttcagcaactggctgcatggagacctgcggcagtatgacatcagtgacccccagaggccccggctgaccggccagctgttcctgggcggcagcatcgtgaagggcggccctgtgcaggtgctggaggatgaggagctgaagagccagcctgagcccctggtggtgaagggcaagagggtggccggcggcccccagatgatccagctgagcctggatggcaagaggctgtacatcaccaccagcctgtacagcgcctgggacaagcagttctacccagacctgatccgggagggctctgtgatgctgcaggtggatgtggacacagtgaagggcggcctgaagctgaaccccaacttcctggtggactttgggaaggagcccctgggccctgccctggcccacgagctgcgctacccaggaggagactgcagcagtgacatctggatctag

SEQ ID NO: 169078 - DNA, 1227 bp, Artificial Sequence
  Description of Artificial Sequence: Synthetic coding sequence
atgcccaacctgaaggatgagctgcaccacagcggctggaacacctgcagcagctgcttcggggacagcaccaagagcaggaccaagctggtgctgcccagcctcatcagcagccgcatctacgtggtggatgtgggcagcgagccccgggcccccaagctgcacaaggtgattgagcccaaggacatccacgccaagtgtgagctggccttcctgcacaccagccactgcctggccagcggggaggtgatgatcagcagcctgggagatgtgaagggaaatggcaagggcggctttgtgctgctggatggagagacctttgaggtgaagggcacctgggagaggcctgggggcgccgcccccctgggctatgacttctggtaccagcccaggcacaacgtgatgatcagcacagagtgggccgcccccaacgtgctgagagatggcttcaacccagcagatgtggaggccggcctgtatggcagccacctgtatgtgtgggactggcagagacatgagatcgtgcagaccctgagcctgaaggatggcctcatccccctggagatccgcttcctgcacaacccagatgctgcccagggctttgtgggctgtgccctgagcagcaccatccagcgcttctacaagaatgaaggaggcacctggagcgtggagaaggtgatccaggtgccccccaagaaggtgaagggctggctgctgcctgagatgcctggcctcatcacagacatcctgctgagcctggatgaccgcttcctgtacttcagcaactggctgcatggagacctgcggcagtatgacatcagtgacccccagaggccccggctgaccggccagctgttcctgggcggcagcatcgtgaagggcggccctgtgcaggtgctggaggatgaggagctgaagagccagcctgagcccctggtggtgaagggcaagagggtggccggcggcccccagatgatccagctgagcctggatggcaagaggctgtacatcaccaccagcctgtacagcgcctgggacaagcagttctacccagacctgatccgggagggctctgtgatgctgcaggtggatgtggacacagtgaagggcggcctgaagctgaaccccaacttcctggtggactttgggaaggagcccctgggccctgccctggcccacgagctgcgctacccaggaggagactgcagcagtgacatctggatctag

SEQ ID NO: 169079 - DNA, 1233 bp, Artificial Sequence
  Description of Artificial Sequence: Synthetic coding sequence
atggccaccaagtgtggcaactgtggccctggctacagcacccccctggaggccatgaagggcccccgggaggagatcgtgtacctgccctgcatctacagaaacacaggaacagaggccccagactacctggccaccgtggatgtggaccccaagagcccccagtactgccaggtgattgagcccaaggacatccacgccaagtgtgagctggccttcctgcacaccagccactgcctggccagcggggaggtgatgatcagcagcctgggagatgtgaagggaaatggcaagggcggctttgtgctgctggatggagagacctttgaggtgaagggcacctgggagaggcctgggggcgccgcccccctgggctatgacttctggtaccagcccaggcacaacgtgatgatcagcacagagtgggccgcccccaacgtgctgagagatggcttcaacccagcagatgtggaggccggcctgtatggcagccacctgtatgtgtgggactggcagagacatgagatcgtgcagaccctgagcctgaaggatggcctcatccccctggagatccgcttcctgcacaacccagatgctgcccagggctttgtgggctgtgccctgagcagcaccatccagcgcttctacaagaatgaaggaggcacctggagcgtggagaaggtgatccaggtgccccccaagaaggtgaagggctggctgctgcctgagatgcctggcctcatcacagacatcctgctgagcctggatgaccgcttcctgtacttcagcaactggctgcatggagacctgcggcagtatgacatcagtgacccccagaggccccggctgaccggccagctgttcctgggcggcagcatcgtgaagggcggccctgtgcaggtgctggaggatgaggagctgaagagccagcctgagcccctggtggtgaagggcaagagggtggccggcggcccccagatgatccagctgagcctggatggcaagaggctgtacatcaccaccagcctgtacagcgcctgggacaagcagttctacccagacctgatccgggagggctctgtgatgctgcaggtggatgtggacacagtgaagggcggcctgaagctgaaccccaacttcctggtggactttgggaaggagcccctgggccctgccctggcccacgagctgcgctacccaggaggagactgcagcagtgacatctggatctag

SEQ ID NO: 169080 - DNA, 1362 bp, Artificial Sequence
  Description of Artificial Sequence: Synthetic coding sequence
atgcctggcagcagtggagctggcatggaggccgctgtggcccctggaagagatgccccagccccagctgccagccagcccagcggctgtgggaagcacaacagccctgagaggaaggtgtacatggactacaatgccaccacccccctggagcctgaggtgatccaggccatgaccaaggccatgtgggaggcctggggcaaccccagcagcccctacagcgctggcaggaaggccaaggacatcatcaatgctgcccgggagagcctggccaagatgattggaggcaagccccaggacatcatcttcaccagcggcggcacagagagcaacaacctggtgatccacagcgtggtgaagcacttccacgccaaccagaccagcaagggccacactggaggccaccacagccctgtgaagggggccaagccccacttcatcaccagctctgtggagcatgacagcatccggctgcccctggagcacctggtggaggagcaggtggccgctgtgacctttgtgcctgtgtccaaggtgtctggccaggccgaggtggatgacatcctggccgctgtgcggcccaccacccggctggtgaccatcatgctggccaacaatgagaccggcatcgtgatgcctgtgcctgagatcagccagaggatcaaggccctgaaccaggagcgggtggccgccggcctgccccccatcctggtgcacacagatgctgcccaggccctgggcaagcagagggtggatgtggaggacctgggcgtggacttcctgaccatcgtgggccacaagttctacggccccagaattggagccctgtacatccggggcctgggggagttcacccccctgtaccccatgctgtttggaggcggccaggagaggaacttccggcccggcacagagaacacccccatgattgctggcctgggcaaggctgctgagctggtgacccagaactgtgaggcctatgaggcccacatgagagatgtgcgggactacctggaggagcggctggaggccgagtttggccagaagaggatccacctgaacagccagtttcctggcacccagaggctgcccaacacctgcaacttcagcatccggggcccccggctgcagggccacgtggtgctggcccagtgccgggtgctgatggcctctgtgggcgccgcctgccacagcgaccacggggaccagcccagccctgtgctgctgtcctatggagtgccctttgatgtggccagaaatgccctgcggctgtctgtgggccgcagcaccaccagggctgaggtggacctggtggtgcaggacctgaagcaggccgtggcccagctggaggaccaggcctag

SEQ ID NO: 169081 - DNA, 708 bp, Artificial Sequence
  Description of Artificial Sequence: Synthetic coding sequence
ttcagcaaccccttctgtggggagaccttccccaggaagccagacctgaagggcacccaccgctgggccccccagcccagcgagggcggccaggcccccttccactacttcctgggcggcacccggctgcaccctgctgcccctggggcccctgggggccgcaccagcggcagcctgctgaatgtgaagatgatgaagatgaagaccttcatgatgatctgcttccacctgatcaacacagtgacctttgtgcctgtgtccaaggtgtctggccaggccgaggtggatgacatcctggccgctgtgcggcccaccacccggctggtgaccatcatgctggccaacaatgagaccggcatcgtgatgcctgtgcctgagatcagccagaggatcaaggccctgaaccaggagcgggtggccgccggcctgccccccatcctggtgcacacagatgctgcccaggccctgggcaagcagagggtggatgtggaggacctgggcgtggacttcctgaccatcgtgggccacaagttctacggccccagaattggagccctgtacatccggggcctgggggagttcacccccctgtaccccatgctgtttggaggcggccaggagaggaacttccggcccggcacagagaacacccccatgattgctggcctgggcaaggtgtccccaggagagctggaggagatgtcctag

SEQ ID NO: 169082 - DNA, 954 bp, Artificial Sequence
  Description of Artificial Sequence: Synthetic coding sequence
atggaggccgctgtggcccctggaagagatgccccagccccagctgccagccagcccagcggctgtgggaagcacaacagccctgagaggaaggtgtacatggactacaatgccaccacccccctggagcctgaggtgatccaggccatgaccaaggccatgtgggaggcctggggcaaccccagcagcccctacagcgctggcaggaaggccaaggacatcatcaatgctgcccgggagagcctggccaagatgattggaggcaagccccaggacatcatcttcaccagcggcggcacagagagcaacaacctggtgatccacagcgtggtgaagcacttccacgccaaccagaccagcaagggccacactggaggccaccacagccctgtgaagggggccaagccccacttcatcaccagctctgtggagcatgacagcatccggctgcccctggagcacctggtggaggagcaggtggccgctgtgacctttgtgcctgtgtccaaggtgtctggccaggccgaggtggatgacatcctggccgctgtgcggcccaccacccggctggtgaccatcatgctggccaacaatgagaccggcatcgtgatgcctgtgcctgagatcagccagaggatcaaggccctgaaccaggagcgggtggccgccggcctgccccccatcctggtgcacacagatgctgcccaggccctgggcaagcagagggtggatgtggaggacctgggcgtggacttcctgaccatcgtgggccacaagttctacggccccagaattggagccctgtacatccggggcctgggggagttcacccccctgtaccccatgctgtttggaggcggccaggagaggaacttccggcccggcacagagaacacccccatgattgctggcctgggcaaggtgtccccaggagagctggaggagatgtcctag

SEQ ID NO: 169083 - DNA, 1056 bp, Artificial Sequence
  Description of Artificial Sequence: Synthetic coding sequence
atggaggccgctgtggcccctggaagagatgccccagccccagctgccagccagcccagcggctgtgggaagcacaacagccctgagaggaaggtgtacatggactacaatgccaccacccccctggagcctgaggtgatccaggccatgaccaaggccatgtgggaggcctggggcaaccccagcagcccctacagcgctgctgtgacctttgtgcctgtgtccaaggtgtctggccaggccgaggtggatgacatcctggccgctgtgcggcccaccacccggctggtgaccatcatgctggccaacaatgagaccggcatcgtgatgcctgtgcctgagatcagccagaggatcaaggccctgaaccaggagcgggtggccgccggcctgccccccatcctggtgcacacagatgctgcccaggccctgggcaagcagagggtggatgtggaggacctgggcgtggacttcctgaccatcgtgggccacaagttctacggccccagaattggagccctgtacatccggggcctgggggagttcacccccctgtaccccatgctgtttggaggcggccaggagaggaacttccggcccggcacagagaacacccccatgattgctggcctgggcaaggctgctgagctggtgacccagaactgtgaggcctatgaggcccacatgagagatgtgcgggactacctggaggagcggctggaggccgagtttggccagaagaggatccacctgaacagccagtttcctggcacccagaggctgcccaacacctgcaacttcagcatccggggcccccggctgcagggccacgtggtgctggcccagtgccgggtgctgatggcctctgtgggcgccgcctgccacagcgaccacggggaccagcccagccctgtgctgctgtcctatggagtgccctttgatgtggccagaaatgccctgcggctgtctgtgggccgcagcaccaccagggctgaggtggacctggtggtgcaggacctgaagcaggccgtggcccagctggaggaccaggcctag

SEQ ID NO: 169084 - DNA, 720 bp, Artificial Sequence
  Description of Artificial Sequence: Synthetic coding sequence
atggaggccgctgtggcccctggaagagatgccccagccccagctgccagccagcccagcggctgtgggaagcacaacagccctgagaggaaggtgtacatggactacaatgccaccacccccctggagcctgaggtgatccaggccatgaccaaggccatgtgggaggcctggggcaaccccagcagcccctacagcgctggcaggaaggccaaggacatcatcaatgctgcccgggagagcctggccaagatgattggaggcaagccccaggacatcatcttcaccagcggcggcacagaggccgctgagctggtgacccagaactgtgaggcctatgaggcccacatgagagatgtgcgggactacctggaggagcggctggaggccgagtttggccagaagaggatccacctgaacagccagtttcctggcacccagaggctgcccaacacctgcaacttcagcatccggggcccccggctgcagggccacgtggtgctggcccagtgccgggtgctgatggcctctgtgggcgccgcctgccacagcgaccacggggaccagcccagccctgtgctgctgtcctatggagtgccctttgatgtggccagaaatgccctgcggctgtctgtgggccgcagcaccaccagggctgaggtggacctggtggtgcaggacctgaagcaggccgtggcccagctggaggaccaggcctag

SEQ ID NO: 169085 - DNA, 1338 bp, Artificial Sequence
  Description of Artificial Sequence: Synthetic coding sequence
atggaggccgctgtggcccctggaagagatgccccagccccagctgccagccagcccagcggctgtgggaagcacaacagccctgagaggaaggtgtacatggactacaatgccaccacccccctggagcctgaggtgatccaggccatgaccaaggccatgtgggaggcctggggcaaccccagcagcccctacagcgctggcaggaaggccaaggacatcatcaatgctgcccgggagagcctggccaagatgattggaggcaagccccaggacatcatcttcaccagcggcggcacagagagcaacaacctggtgatccacagcgtggtgaagcacttccacgccaaccagaccagcaagggccacactggaggccaccacagccctgtgaagggggccaagccccacttcatcaccagctctgtggagcatgacagcatccggctgcccctggagcacctggtggaggagcaggtggccgctgtgacctttgtgcctgtgtccaaggtgtctggccaggccgaggtggatgacatcctggccgctgtgcggcccaccacccggctggtgaccatcatgctggccaacaatgagaccggcatcgtgatgcctgtgcctgagatcagccagaggatcaaggccctgaaccaggagcgggtggccgccggcctgccccccatcctggtgcacacagatgctgcccaggccctgggcaagcagagggtggatgtggaggacctgggcgtggacttcctgaccatcgtgggccacaagttctacggccccagaattggagccctgtacatccggggcctgggggagttcacccccctgtaccccatgctgtttggaggcggccaggagaggaacttccggcccggcacagagaacacccccatgattgctggcctgggcaaggctgctgagctggtgacccagaactgtgaggcctatgaggcccacatgagagatgtgcgggactacctggaggagcggctggaggccgagtttggccagaagaggatccacctgaacagccagtttcctggcacccagaggctgcccaacacctgcaacttcagcatccggggcccccggctgcagggccacgtggtgctggcccagtgccgggtgctgatggcctctgtgggcgccgcctgccacagcgaccacggggaccagcccagccctgtgctgctgtcctatggagtgccctttgatgtggccagaaatgccctgcggctgtctgtgggccgcagcaccaccagggctgaggtggacctggtggtgcaggacctgaagcaggccgtggcccagctggaggaccaggcctag

SEQ ID NO: 169086 - DNA, 966 bp, Artificial Sequence
  Description of Artificial Sequence: Synthetic coding sequence
atgagcacccgggagagcttcaaccctgagagctatgagctggacaagagcttccggctgacccgcttcacagagctgaagggcaccggctgcaaggtgccccaggatgtgctgcagaagctgctggagagcctgcaggagaaccacttccaggaggatgagcagttcctgggcgctgtgatgccccggctgggcatcggcatggacacctgtgtgatccccctgcggcatggaggcctgagcctggtgcagaccacagactacatctaccccatcgtggatgacccctacatgatgggccgcatcgcctgtgccaacgtgctgagtgacctgtatgccatgggcgtgacagaatgtgacaacatgctgatgctgctgggcgtgagcaacaagatgacagaccgggagcgggacaaggtgatgcccctcatcatccagggcttcaaggatgctgctgaggaggccggcacctctgtgactggaggccagacagtgctgaacccctggatcgtgctgggcggcgtggccaccaccgtgtgccagcccaatgagttcatcatgccagacaatgctgtgcctggagatgtgctggtgctgaccaagcccctgggcacccaggtggccgtggccgtgcaccagtggctggacatccctgagaagtggaacaagatcaagctggtggtgacccaggaggatgtggagctggcctaccaggaggccatgatgaacatggcccggctgaacagaactggaggcctgctgatctgcctgccccgggagcaggccgcccgcttctgtgccgagatcaagagccccaagtacggggagggccaccaggcctggatcattggaattgtggagaagggcaacagaacagcccgcatcatcgacaagccccgcatcatcgaggtggccccccaggtggccacccagaatgtgaaccccacccctggggccaccagctag

SEQ ID NO: 169087 - DNA, 1179 bp, Artificial Sequence
  Description of Artificial Sequence: Synthetic coding sequence
atgagcacccgggagagcttcaaccctgagagctatgagctggacaagagcttccggctgacccgcttcacagagctgaagggcaccggctgcaaggtgccccaggatgtgctgcagaagctgctggagagcctgcaggagaaccacttccaggaggatgagcagttcctgggcgctgtgatgccccggctgggcatcggcatggacacctgtgtgatccccctgcggcatggaggcctgagcctggtgcagaccacagactacatctaccccatcgtggatgacccctacatgatgggccgcatcgcctgtgccaacgtgctgagtgacctgtatgccatgggcgtgacagaatgtgacaacatgctgatgctgctgggcgtgagcaacaagatgacagaccgggagcgggacaaggtgatgcccctcatcatccagggcttcaaggatgctgctgaggaggccggcacctctgtgactggaggccagacagtgctgaacccctggatcgtgctgggcggcgtggccaccaccgtgtgccagcccaatgagttcatcatgccagacaatgctgtgcctggagatgtgctggtgctgaccaagcccctgggcacccaggtggccgtggccgtgcaccagtggctggacatccctgagaagtggaacaagatcaagctggtggtgacccaggaggatgtggagctggcctaccaggaggccatgatgaacatggcccggctgaacagaacagctgctggcctgatgcacaccttcaatgcccacgccgccacagacatcactggatttggcatcctgggccacgcccagaacctggccaagcagcagagaaatgaggtgtcctttgtgatccacaacctgcctgtgctggccaagatggctgctgtgtccaaggcctgtggcaacatgtttggcctgatgcacggcacctgcccagagaccagcggcggcctgctgatctgcctgccccgggagcaggccgcccgcttctgtgccgagatcaagagccccaagtatggagagggccaccaggcctggatcatcggcatcgtggagaagggcaacagaacagcccgcatcatcgacaagccccgcatcatcgaggtggccccccaggtggccacccagaatgtgaaccccacccctggggccaccagctag

SEQ ID NO: 169088 - DNA, 966 bp, Artificial Sequence; identical to SEQ ID NO: 169086
  Description of Artificial Sequence: Synthetic coding sequence

SEQ ID NO: 169089 - DNA, 501 bp, Artificial Sequence
  Description of Artificial Sequence: Synthetic coding sequence
atgagcacccgggagagcttcaaccctgagagctatgagctggacaagagcttccggctgacccgcttcacagagctgaagggcaccggctgcaaggtgccccaggatgtgctgcagaagctgctggagagcctgcaggagaaccacttccaggaggatgagcagttcctgggcgctgtgatgccccggctgggcatcggcatggacacctgtgtgatccccctgcggcatggaggcctgagcctggtgcagaccacagactacatctaccccatcgtggatgacccctacatgatgggccgcatcgcctgtgccaacgtgctgagtgacctgtatgccatgggcgtgacagaatgtgacaacatgctgatgctgctgggcgtgagcaacaagatgacagaccgggagcgggacaaggtgatgcccctcatcatccagggcttcaaggatgctgctgaggaggccggcacctctgtgactggaggccagacagtgctgtag

SEQ ID NO: 169090 - DNA, 279 bp, Artificial Sequence
  Description of Artificial Sequence: Synthetic coding sequence
atggacacctgtgtgatccccctgcggcacggcggcctgagcctggtgcagaccacagactacatctaccccatcgtggatgacccctacatgatgggcagaattgcctgtgccaacgtgctgagtgacctgtatgccatgggcgtgacagaatgtgacaacatgctgatgctgctgggcgtgagcaacaagatgacagaccgggagcgggacaaggtgatgcccctcatcatccagggcttcaaggatgctgctgaggaggccggcacctctgtgtag

SEQ ID NO: 169091 - DNA, 978 bp, Artificial Sequence
  Description of Artificial Sequence: Synthetic coding sequence
atggacacctgtgtgatccccctgcggcacggcggcctgagcctggtgcagaccacagactacatctaccccatcgtggatgacccctacatgatgggcagaattgcctgtgccaacgtgctgagtgacctgtatgccatgggcgtgacagaatgtgacaacatgctgatgctgctgggcgtgagcaacaagatgacagaccgggagcgggacaaggtgatgcccctcatcatccagggcttcaaggatgctgctgaggaggccggcacctctgtgactggaggccagacagtgctgaacccctggatcgtgctgggcggcgtggccaccaccgtgtgccagcccaatgagttcatcatgccagacaatgctgtgcctggagatgtgctggtgctgaccaagcccctgggcacccaggtggccgtggccgtgcaccagtggctggacatccctgagaagtggaacaagatcaagctggtggtgacccaggaggatgtggagctggcctaccaggaggccatgatgaacatggcccggctgaacagaacagctgctggcctgatgcacaccttcaatgcccatgctgccacagacatcaccggcttcggcatcctgggccacgcccagaacctggccaagcagcagagaaatgaggtgtcctttgtgatccacaacctgcctgtgctggccaagatggctgctgtgtccaaggcctgtggcaacatgtttggcctgatgcacggcacctgcccagagaccagcggcggcctgctgatctgcctgccccgggagcaggccgcccgcttctgtgccgagatcaagagccccaagtacggggagggccaccaggcctggatcattggaattgtggagaagggcaacagaacagcccgcatcatcgacaagccccgcatcatcgaggtggccccccaggtggccacccagaatgtgaaccccacccctggggccaccagctag

SEQ ID NO: 169092 - DNA, 975 bp, Artificial Sequence
  Description of Artificial Sequence: Synthetic coding sequence
atgagcacccgggagagcttcaaccctgagagctatgagctggacaagagcttccggctgacccgcttcacagagctgaagggcaccggctgcaaggtgccccaggatgtgctgcagaagctgctggagagcctgcaggagaaccacttccaggaggatgagcagttcctgggcgctgtgatgccccggctgggcatcggcatggacacctgtgtgatccccctgcggcatggaggcctgagcctggtgcagaccacagactacatctaccccatcgtggatgacccctacatgatgggccgcatcgcctgtgccaacgtgctgagtgacctgtatgccatgggcgtgacagaatgtgacaacatgctgatgctgctgggcgtgagcaacaagatgacagaccgggagcgggacaaggtgatgcccctcatcatccagggcttcaaggatgctgctgaggaggccggcacctctgtgactggaggccagacagtgctgaacccctggatcgtgctgggcggcgtggccaccaccgtgtgccagcccaatgagttcatcatgccagacaatgctgtgcctggagatgtgctggtgctgaccaagcccctgggcacccaggtggccgtggccgtgcaccagtggctggacatccctgagaagtggaacaagatcaagctggtggtgacccaggaggatgtggagctggcctaccaggaggccatgatgaacatggcccggctgaacagaacagctgctggcctgatgcacaccttcaatgcccacgccgccacagacatcactggatttggcatcctgggccacgcccagaacctggccaagcagcagagaaatgaggtgtcctttgtgatccacaacctgcctgtgctggccaagatggctgctgtgtccaaggcctgtggcaacatgtttggcctgatgcacggcacctgcccagagaccagtgatgtgcagtag

SEQ ID NO: 169093 - DNA, 1200 bp, Artificial Sequence
  Description of Artificial Sequence: Synthetic coding sequence
atggccgaggccagcgccactggagcctgtggggaggccatggctgctgctgagggcagcagcggccctgctggcctgaccctgggccgcctgaccggcttcagcggcatgaagggcctggtgggcggccaggaggaggccagccaggaggccggcctgcctgctggagctggccccagccccaccttccctgccctgggcatcggcatggacagctgtgtgatccccctgcggcatggaggcctgagcctggtgcagaccacagacttcttctaccccctggtggaggacccctacatgatgggccgcatcgcctgtgccaacgtgctgagtgacctgtatgccatgggcatcacagaatgtgacaacatgctgatgctgctgtctgtgtcccagagcatgtctgaggaggagcgggagaaggtgacccccctgatggtgaagggcttcagagatgctgctgaggagggcggcacagctgtgactggaggccagacagtggtgaacccctggatcatcatcggcggcgtggccaccgtggtgtgccagcccaatgagttcatcatgccagacagcgctgtggtgggagatgtgctggtgctgaccaagcccctgggcacccaggtggccgtgaatgcccaccagtggctggacaaccctgagcgctggaacaaggtgaagatggtggtgtcccgggaggaggtggagctggcctaccaggaggccatgttcaacatggccaccctgaacagaacagctgctggcctgatgcacaccttcaatgcccacgccgccacagacatcactggatttggcatcctgggccacagccagaacctggccaagcagcagagaaatgaggtgtcctttgtgatccacaacctgcccatcatcgccaagatggctgctgtgtccaaggccagcggccgcttcggcctgctgcagggcaccagcgctgagaccagcggcggcctgctgatctgcctgccccgggagcaggccgcccgcttctgcagcgagatcaagagcagcaagtacggggagggccaccaggcctggatcgtgggcatcgtggagaagggcaacagaacagcccgcatcatcgacaagcccagggtcatcgaggtgctgcccaggggggccacagctgctgtgctggccccagacagcagcaatgccagcagcgagcccagcagctag

SEQ ID NO: 169094 - DNA, 1440 bp, Artificial Sequence
  Description of Artificial Sequence: Synthetic coding sequence
atggccgaggccagcgccactggagcctgtggggaggccatggctgctgctgagggcagcagcggccctgctggcctgaccctgggccgctccttcagcaactaccggccctttgagccccaggccctgggcctgagccccagctggaggctgaccggcttcagcggcatgaagggctgcaaggtgccccaggaggccctgctgaagctgctggccggcctgaccaggccagatgtgcggccccccctgggccggggcctggtgggcggccaggaggaggccagccaggaggccggcctgcctgctggggccggccccagccccaccttccctgccctgggcatcggcatggacagctgtgtgatccccctgcggcacggcggcctgagcctggtgcagaccacagacttcttctaccccctggtggaggacccctacatgatgggcagaattgcctgtgccaacgtgctgagtgacctgtatgccatgggcatcacagaatgtgacaacatgctgatgctgctgtctgtgtcccagagcatgtctgaggaggagcgggagaaggtgacccccctgatggtgaagggcttcagagatgctgctgaggagggcggcacagctgtgactggaggccagacagtggtgaacccctggatcatcattggaggagtggccaccgtggtgtgccagcccaatgagttcatcatgccagattctgctgtggtgggagatgtgctggtgctgaccaagcccctgggcacccaggtggccgtgaatgcccaccagtggctggacaaccctgagcgctggaacaaggtgaagatggtggtgtcccgggaggaggtggagctggcctaccaggaggccatgttcaacatggccaccctgaacagaacagctgctggcctgatgcacaccttcaatgcccatgctgccacagacatcaccggcttcggcatcctgggccacagccagaacctggccaagcagcagagaaatgaggtgtcctttgtgatccacaacctgcccatcatcgccaagatggctgctgtgtccaaggccagcggccgcttcggcctgctgcagggcaccagcgctgagaccagcggcggcctgctgatctgcctgccccgggagcaggccgcccgcttctgcagcgagatcaagagcagcaaatatggagagggccaccaggcctggatcgtgggcatcgtggagaagggcaacagaacagcccgcatcatcgacaagccccgggtgattgaggtgctgcccaggggggccacagctgctgtgctggccccagacagcagcaatgccagcagcgagcccagcagcgagaggacagaggtggtgtggaccctggagcccctgagcaccatcacagatggcagccaggagctgattgtgaggaacttccagaggcggctgcctgcctag

SEQ ID NO: 169095 - DNA, 1341 bp, Artificial Sequence
  Description of Artificial Sequence: Synthetic coding sequence
atggccgaggccagcgccactggagcctgtggggaggccatggctgctgctgagggcagcagcggccctgctggcctgaccctgggccgctccttcagcaactaccggccctttgagccccaggccctgggcctgagccccagctggaggctgaccggcttcagcggcatgaagggctgcaaggtgccccaggaggccctgctgaagctgctggccggcctgaccaggccagatgtgcggccccccctgggccggggcctggtgggcggccaggaggaggccagccaggaggccggcctgcctgctggggccggccccagccccaccttccctgccctgggcatcggcatggacagctgtgtgatccccctgcggcacggcggcctgagcctggtgcagaccacagacttcttctaccccctggtggaggacccctacatgatgggcagaattgcctgtgccaacgtgctgagtgacctgtatgccatgggcatcacagaatgtgacaacatgctgatgctgctgtctgtgtcccagagcatgtctgaggaggagcgggagaaggtgacccccctgatggtgaagggcttcagagatgctgctgaggagggcggcacagctgtgactggaggccagacagtggtgaacccctggatcatcattggaggagtggccaccgtggtgtgccagcccaatgagttcatcatgccagattctgctgtggtgggagatgtgctggtgctgaccaagcccctgggcacccaggtggccgtgaatgcccaccagtggctggacaaccctgagcgctggaacaaggtgaagatggtggtgtcccgggaggaggtggagctggcctaccaggaggccatgttcaacatggccaccctgaacagaacagctgctggcctgatgcacaccttcaatgcccatgctgccacagacatcaccggcttcggcatcctgggccacagccagaacctggccaagcagcagagaaatgaggtgtcctttgtgatccacaacctgcccatcatcgccaagatggctgctgtgtccaaggccagcggccgcttcggcctgctgcagggcaccagcgctgagaccagcggcggcctgctgatctgcctgccccgggagcaggccgcccgcttctgcagcgagatcaagagcagcaaatatggagagggccaccaggcctggatcgtgggcatcgtggagaagggcaacagaacagcccgcatcatcgacaagccccgggtgattgaggtgctgcccaggggggccacagctgctgtgctggccccagacagcagcaatgccagcagcgagcccagcagctag

SEQ ID NO: 169096 - DNA, 1176 bp, Artificial Sequence
  Description of Artificial Sequence: Synthetic coding sequence
atggccgaggccagcgccactggagcctgtggggaggccatggctgctgctgagggcagcagcggccctgctggcctgaccctgggccgctccttcagcaactaccggccctttgagccccaggaggccggcctgcctgctggagctggccccagccccaccttccctgccctgggcatcggcatggacagctgtgtgatccccctgcggcatggaggcctgagcctggtgcagaccacagacttcttctaccccctggtggaggacccctacatgatgggccgcatcgcctgtgccaacgtgctgagtgacctgtatgccatgggcatcacagaatgtgacaacatgctgatgctgctgtctgtgtcccagagcatgtctgaggaggagcgggagaaggtgacccccctgatggtgaagggcttcagagatgctgctgaggagggcggcacagctgtgactggaggccagacagtggtgaacccctggatcatcatcggcggcgtggccaccgtggtgtgccagcccaatgagttcatcatgccagacagcgctgtggtgggagatgtgctggtgctgaccaagcccctgggcacccaggtggccgtgaatgcccaccagtggctggacaaccctgagcgctggaacaaggtgaagatggtggtgtcccgggaggaggtggagctggcctaccaggaggccatgttcaacatggccaccctgaacagaacagctgctggcctgatgcacaccttcaatgcccacgccgccacagacatcactggatttggcatcctgggccacagccagaacctggccaagcagcagagaaatgaggtgtcctttgtgatccacaacctgcccatcatcgccaagatggctgctgtgtccaaggccagcggccgcttcggcctgctgcagggcaccagcgctgagaccagcggcggcctgctgatctgcctgccccgggagcaggccgcccgcttctgcagcgagatcaagagcagcaagtacggggagggccaccaggcctggatcgtgggcatcgtggagaagggcaacagaacagcccgcatcatcgacaagcccagggtcatcgaggtgctgcccaggggggccacagctgctgtgctggccccagacagcagcaatgccagcagcgagcccagcagctag

SEQ ID NO: 169097 - DNA, 1671 bp, Artificial Sequence
  Description of Artificial Sequence: Synthetic coding sequence
atgggccgggcccggcccggccagaggggcccccccagccctggccctgctgcccagcccccagcccccccaagaagaagagcccggagcctggccctgctgggcgccctgctggccgctgctgctgctgctgctgtgcgggtgtgtgcccggcatgctgaggcccaggccgccgcccggcaggagctggccctgaagaccctgggcacagatggcctcttcctgttcagcagcctggacacagatggagacatgtacatcagccctgaggagttcaagcccatcgccgagaagctgaccggcagcaccccagctgccagctgtgaggaggaggagctgcccccagaccccagcgaggagaccctgaccatcgaggcccgcttccagcccctgctgcctgagaccatgaccaagagcaaggatggcttcctgggcgtgtcccggctggccctgagcggcctgaggaactggacagctgctgccagccccagcgctgtgtttgccaccaggcacttccagcccttcctgcccccacctggccaggagctgggggagccctggtggatcatccccagcgagctgtccatgttcaccggctacctgagcaacaaccgcttctacccacctccacccaagggcaaggaggtgatcatccaccggctgctgtccatgttccacccccggccctttgtgaagaccaggtttgccccccagggcgctgtggcctgcctgacagccatcagtgacttctactacacagtgatgttccgcatccacgccgagttccagctgtctgagcccccagacttccccttctggttcagccctgcccagttcaccggccacatcatcctgagcaaggatgccacccacgtgcgggacttccggctgtttgtgcccaaccacaggagcctgaatgtggacatggagtggctgtatggagccagcgagagcagcaacatggaggtggacatcggctacatcccccagatggagctggaggccaccggccccagcgtgcccagcgtcatcctggatgaagatggctccatgattgacagccacctgcccagcggggagcccctgcagtttgtgtttgaggagatcaagtggcagcaggagctgtcctgggaggaggccgcccggcggctggaggtggccatgtaccccttcaagaaggtgtcctacctgcccttcacagaggcctttgaccgggccaaggccgagaacaagctggtgcacagcatcctgctgtggggcgccctggatgaccagagctgccactgcagcggccgcaccctgcgggagaccgtgctggagagcagccccatcctgaccctgctgaatgaaagcttcatcagcacctggagcctggtgaaggagctggaggagctgcagaacaaccaggagaacagcagccaccagaagctggccggcctgcacctggagaagtacagcttccctgtggagatgatgatctgcctgcccaatggaacagtggtgcaccacatcaatgccaactacttcctggacatcacctctgtgaagccagaggagattgagagcaacctcttctccttcagcagcacctttgaggaccccagcacagccacctacatgcagttcctgaaggagggcctgcggcggggcctgcccctgctgcagccctag

SEQ ID NO: 169098 - DNA, 1761 bp, Artificial Sequence
  Description of Artificial Sequence: Synthetic coding sequence
atgggccgggcccggcccggccagaggggcccccccagccctggccctgctgcccagcccccagcccccccaagaagaagagcccggagcctggccctgctgggcgccctgctggccgctgctgctgctgctgctgtgcgggtgtgtgcccggcatgctgaggcccaggccgccgcccggcaggagctggccctgaagaccctgggcacagatggcctcttcctgttcagcagcctggacacagatggagacatgtacatcagccctgaggagttcaagcccatcgccgagaagctgaccggcagctgcagcgtgacccagacaggagtgcagtggtgcagccacagcagcctgcagccccagctgccctggctgaacagctgcctgagcctgctgcggagcaccccagctgccagctgtgaggaggaggagctgcccccagaccccagcgaggagaccctgaccatcgaggcccgcttccagcccctgctgcctgagaccatgaccaagagcaaggatggcttcctgggcgtgtcccggctggccctgagcggcctgaggaactggacagctgctgccagccccagcgctgtgtttgccaccaggcacttccagcccttcctgcccccacctggccaggagctgggggagccctggtggatcatccccagcgagctgtccatgttcaccggctacctgagcaacaaccgcttctacccacctccacccaagggcaaggaggtgatcatccaccggctgctgtccatgttccacccccggccctttgtgaagaccaggtttgccccccagggcgctgtggcctgcctgacagccatcagtgacttctactacacagtgatgttccgcatccacgccgagttccagctgtctgagcccccagacttccccttctggttcagccctgcccagttcaccggccacatcatcctgagcaaggatgccacccacgtgcgggacttccggctgtttgtgcccaaccacaggagcctgaatgtggacatggagtggctgtatggagccagcgagagcagcaacatggaggtggacatcggctacatcccccagatggagctggaggccaccggccccagcgtgcccagcgtcatcctggatgaagatggctccatgattgacagccacctgcccagcggggagcccctgcagtttgtgtttgaggagatcaagtggcagcaggagctgtcctgggaggaggccgcccggcggctggaggtggccatgtaccccttcaagaaggtgtcctacctgcccttcacagaggcctttgaccgggccaaggccgagaacaagctggtgcacagcatcctgctgtggggcgccctggatgaccagagcggcagcggccgcaccctgcgggagaccgtgctggagagcagccccatcctgaccctgctgaatgaaagcttcatcagcacctggagcctggtgaaggagctggaggagctgcagaacaaccaggagaacagcagccaccagaagctggccggcctgcacctggagaagtacagcttccctgtggagatgatgatctgcctgcccaatggaacagtggtgcaccacatcaatgccaactacttcctggacatcacctctgtgaagccagaggagattgagagcaacctcttctccttcagcagcacctttgaggaccccagcacagccacctacatgcagttcctgaaggagggcctgcggcggggcctgcccctgctgcagccctag

SEQ ID NO: 169099 - DNA, 1665 bp, Artificial Sequence
  Description of Artificial Sequence: Synthetic coding sequence
atgggccgggcccggcccggccagaggggcccccccagccctggccctgctgcccagcccccagcccccccaagaagaagagcccggagcctggccctgctgggcgccctgctggccgctgctgctgctgctgctgtgcgggtgtgtgcccggcatgctgaggcccaggccgccgcccggcaggagctggccctgaagaccctgggcacagatggcctcttcctgttcagcagcctggacacagatggagacatgtacatcagccctgaggagttcaagcccatcgccgagaagctgaccggcagcaccccagctgccagctgtgaggaggaggagctgcccccagaccccagcgaggagaccctgaccatcgaggcccgcttccagcccctgctgcctgagaccatgaccaagagcaaggatggcttcctgggcgtgtcccggctggccctgagcggcctgaggaactggacagctgctgccagccccagcgctgtgtttgccaccaggcacttccagcccttcctgcccccacctggccaggagctgggggagccctggtggatcatccccagcgagctgtccatgttcaccggctacctgagcaacaaccgcttctacccacctccacccaagggcaaggaggtgatcatccaccggctgctgtccatgttccacccccggccctttgtgaagaccaggtttgccccccagggcgctgtggcctgcctgacagccatcagtgacttctactacacagtgatgttccgcatccacgccgagttccagctgtctgagcccccagacttccccttctggttcagccctgcccagttcaccggccacatcatcctgagcaaggatgccacccacgtgcgggacttccggctgtttgtgcccaaccacaggagcctgaatgtggacatggagtggctgtatggagccagcgagagcagcaacatggaggtggacatcggctacatcccccagatggagctggaggccaccggccccagcgtgcccagcgtcatcctggatgaagatggctccatgattgacagccacctgcccagcggggagcccctgcagtttgtgtttgaggagatcaagtggcagcaggagctgtcctgggaggaggccgcccggcggctggaggtggccatgtaccccttcaagaaggtgtcctacctgcccttcacagaggcctttgaccgggccaaggccgagaacaagctggtgcacagcatcctgctgtggggcgccctggatgaccagagcggcagcggccgcaccctgcgggagaccgtgctggagagcagccccatcctgaccctgctgaatgaaagcttcatcagcacctggagcctggtgaaggagctggaggagctgcagaacaaccaggagaacagcagccaccagaagctggccggcctgcacctggagaagtacagcttccctgtggagatgatgatctgcctgcccaatggaacagtggtgcaccacatcaatgccaactacttcctggacatcacctctgtgaagccagaggagattgagagcaacctcttctccttcagcagcacctttgaggaccccagcacagccacctacatgcagttcctgaaggagggcctgcggcggggcctgcccctgctgcagccctag

SEQ ID NO: 169100 - DNA, 1086 bp, Artificial Sequence
  Description of Artificial Sequence: Synthetic coding sequence
atgtggaggagcctgggcctggccctggccctgtgcctgctgcccagcggcggcacagagagccaggaccagagcagcctgtgcaagcagcccccagcctggagcatccgggaccaggaccccatgctgaacagcaatggatctgtgacagtggtggccctgctgcaggccagcctgtgcatcctgcaggccagcaagctggaggacctgcgggtgaagctgaagaaggagggctacagcaacatctcctacatcgtggtgaaccaccagggcatcagcagccggctgaagtacacccacctgaagaacaaggtgtctgagcacatccctgtgtaccagcaggaggagaaccagacagatgtgtggaccctgctgaatggcagcaaggatgacttcctgatctatgacagatgtggccgcctggtgtaccacctgggcctgcccttctccttcctgaccttcccctacgtggaggaggccatcaagatcgcctactgtgagaagaagtgtggcaactgcagcctgaccaccctgaaggatgaggacttctgcaagagggtgtccctggccaccgtggacaagacagtggagacccccagcccccactaccaccacgagcaccaccacaaccacggccaccagcacctgggcagcagcgagctgtctgagaaccagcagcccggggccccaaatgcccccacccacccagcccctcctggcctgcaccaccaccacaagcacaagggccagcaccggcagggccacccagaaaatagagacatgcctgccagcgaggacctgcaggacctgcagaagaagctgtgcaggaagcgctgcatcaaccagctgctgtgcaagctgcccacagattctgagctggccccccgctgctgccactgccgccacctgatctttgagaagacaggcagcgccatccagtgcaaggagaacctgcccagcctgtgccagggcctgcgggcagaggagaacatcacagagagctgccagctgcccccagcccagatcagccagcagctgatccccacagaggccagcgccagcaaccaggccaagcccagcaactag

SEQ ID NO: 169101 - DNA, 624 bp, Artificial Sequence
  Description of Artificial Sequence: Synthetic coding sequence
atgtggaggagcctgggcctggccctggccctgtgcctgctgcccagcggcggcacagagagccaggaccagagcagcctgtgcaagcagcccccagcctggagcatccgggaccaggaccccatgctgaacagcaatggatctgtgacagtggtggccctgctgcaggccagcctgtgcatcctgcaggccagcaagctggaggacctgcgggtgaagctgaagaaggagggctacagcaacatctcctacatcgtggtgaaccaccagggcatcagcagccggctgaagtacacccacctgaagaacaaggtgtctgagcacatccctgtgtaccagcaggaggagaaccagacagatgtgtggaccctgctgaatggcagcaaggatgacttcctgatctatgacagatgtggccgcctggtgtaccacctgggcctgcccttctccttcctgaccttcccctacgtggaggaggccatcaagatcgcctactgtgagaagaagtgtggcaactgcagcctgaccaccctgaaggatgaggacttctgcaagagggtgtccctggccaccgtggacaagacagtggagacccccagcccccactaccaccacgagcactag

SEQ ID NO: 169102 - DNA, 1086 bp, Artificial Sequence; identical to SEQ ID NO: 169100
  Description of Artificial Sequence: Synthetic coding sequence

SEQ ID NO: 169103 - DNA, 921 bp, Artificial Sequence
  Description of Artificial Sequence: Synthetic coding sequence
atgtggaggagcctgggcctggccctggccctgtgcctgctgcccagcggcggcacagagagccaggaccagagcagcctgtgcaagcagcccccagcctggagcatccgggaccaggaccccatgctgaacagcaatggatctgtgacagtggtggccctgctgcaggccagcctgtgcatcctgcaggccagcaagctggaggacctgcgggtgaagctgaagaaggagggctacagcaacatctcctacatcgtggtgaaccaccagggcatcagcagccggctgaagtacacccacctgaagaacaaggtgtctgagcacatccctgtgtaccagcaggaggagaaccagacagatgtgtggaccctgctgaatggcagcaaggatgacttcctgatctatgacagatgtggccgcctggtgtaccacctgggcctgcccttctccttcctgaccttcccctacgtggaggaggccatcaagatcgcctactgtgagaagaagtgtggcaactgcagcctgaccaccctgaaggatgaggacttctgcaagagggtgtccctggccaccgtggacaagacagtggagacccccagcccccactaccaccacgagcaccaccacaaccacggccaccagcacctgggcagcagcgagctgtctgagaaccagcagcccggggccccaaatgcccccacccacccagcccctcctggcctgcaccaccaccacaagcacaagggccagcaccggcagggccacccagaaaatagagacatgcctgccagcgaggacctgcaggacctgcagaagaagctgtgcaggaagcgctgcatcaaccagctgctgtgcaagctgcccacagattctgagctggccccccgctgctgccactgccgccacctgatctttgaatag

SEQ ID NO: 169104 - DNA, 1086 bp, Artificial Sequence; identical to SEQ ID NO: 169100
  Description of Artificial Sequence: Synthetic coding sequence

SEQ ID NO: 169105 - DNA, 258 bp, Artificial Sequence
  Description of Artificial Sequence: Synthetic coding sequence
atggccctggccgtgcgggtggtgtactgtggggcctacaagagcaagtacctgcagctgaagaagaagctggaggatgagttccctggccgcctggacatctgtggggagggcaccccccaggccaccggcttctttgaggtgatggtggccggcaagctgatccacagcaagaagaagggagatggctacgtggacacagagagcaagttcctgaagctggtggccgccatcaaggccgccctggcccagggctag

SEQ ID NO: 169106 - DNA, 267 bp, Artificial Sequence
  Description of Artificial Sequence: Synthetic coding sequence
atggccctggccgtgcgggtggtgtactgctgcggggccggcggctacaagagcaagtacctgcagctgaagaagaagctggaggatgagttccctggccgcctggacatctgtggggagggcaccccccaggccaccggcttctttgaggtgatggtggccggcaagctgatccacagcaagaagaagggagatggctacgtggacacagagagcaagttcctgaagctggtggccgccatcaaggccgccctggcccagggctag

SEQ ID NO: 169107 - DNA, 345 bp, Artificial Sequence
  Description of Artificial Sequence: Synthetic coding sequence
atgtccttctgcagcttctttggaggagaggtgttccagaaccactttgagcccggggtgtatgtgtgtgccaagtgtggctatgagctgttcagcagccgcagcaaatatgcccacagcagcccctggccagccttcacagagaccatccacgccgacagcgtggccaagaggcctgagcacaacagaagtgaggccctgaaggtgtcctgtgggaaatgtggaaatggcctgggccacgagttcctgaatgatggccccaagccaggccagagccgcttcttcagcagcagcctgaagtttgtgcccaagggcaaggagaccagcgccagccagggccactag

SEQ ID NO: 169108 - DNA, 681 bp, Artificial Sequence
  Description of Artificial Sequence: Synthetic coding sequence
atgtccttctgcagcttctttggaggagaggtgttccagaaccactttgagcccggggtgtatgtgtgtgccaagtgtggctatgagctgttcagcagccgcagcaaatatgcccacagcagcccctggccagccttcacagagaccatccacgccgacagcgtggccaagaggcctgagcacaacagaagtgaggccctgaaggtgcggggccaccggggcggcggcggcaccggggccgcccgggagagccgggagcctgtgccccccagcagcctgtgcctgccccacagcagccggggcctggaggccagcatccctggcctgctgcccctgcccggcagctgccacccccggctgtctggagagcccggcctgctggtgcagatgtgggagaccggccaggtgtcctgcaccggcagcaggaccaaggtgaacctgctgtgccgccgcagcgcctgggagattggagtgtgggaggagacccccagcgccagccccagcaagggcctgcactgcggctgcatcatggcccggagcagccccagctgcctggtgatcttccctggggtgctgtggcaggtgtggcagtgggtgggcccccgggtgcctgagcggcggccccaggccggggctgtgcccatcctgaacatccagcagctggccgaggtgtgcccctag

SEQ ID NO: 169109 - DNA, 2328 bp, Artificial Sequence
  Description of Artificial Sequence: Synthetic coding sequence
atggccagcgctggccacatcatcaccctgctgctgtggggctacctgctggagctgtggacaggaggccacacagctgacaccacccacccccggctgcggctgagccacaaggagctgctgaacctgaacagaaccagcatcttccacagccccttcggcttcctggacctgcacaccatgctgctggatgagtaccaggagcggctgtttgtgggcggccgggacctggtgtacagcctgagcctggagcgcatcagtgatggctacaaggagatccactggcccagcacagccctgaagatggaggagtgcatcatgaagggcaaggatgctggggagtgtgccaactacgtgcgggtgctgcaccactacaacagaacccacctgctgacctgtggcactggagcctttgatcctgtgtgtgccttcatccgggtgggctaccacctggaggaccccctcttccacctggagagccccaggtctgagcggggccggggccgctgcccctttgaccccagcagcagcttcatcagcaccctgattggcagcgagctgtttgctggcctgtacagcgactactggagcagagatgctgccatcttccgctccatgggccgcctggcccacatcagaacagaacatgatgatgagcggctgctgaaggagcccaagtttgtgggcagctacatgatcccagacaatgaagatagagatgacaacaaggtgtacttcttcttcacagagaaggccctggaggccgagaacaatgcccacgccatctacaccagggtgggccgcctgtgtgtgaatgatgtgggcggccagaggatcctggtgaacaagtggagcaccttcctgaaggcccggctggtgtgcagcgtgcccggcatgaatggcatcgacacctactttgatgagctggaggatgtgttcctgctgcccacccgggaccacaagaaccctgtgatcttcggcctcttcaacaccaccagcaacatcttccggggccacgccatctgtgtgtaccacatgagcagcatccgggccgccttcaacggcccctatgcccacaaggagggccctgagtaccactggagcgtgtatgagggcaaggtgccctaccccaggcctggcagctgtgccagcaaggtgaatggaggccgctatggcaccaccaaggactacccagatgatgccatccgctttgcccggagccaccccctgatgtaccaggccatcaagccagcccacaagaagcccatcctggtgaagacagatggcaagtacaacctgaagcagattgctgtggacagagtggaggccgaggatggccagtatgatgtgctcttcatcggcacagacaatggaattgtgctgaaggtgatcaccatctacaaccaggagatggagagcatggaggaggtgatcctggaggagctgcagatcttcaaggaccctgtgcccatcatctccatggagatcagcagcaagaggcagcagctgtacatcggcagcgccagcgctgtggcccaggtgcgcttccaccactgtgacatgtatggcagcgcctgtgccgactgctgcctggcccgggacccctactgtgcctgggatggcatcagctgcagccgctactaccccaccggcacccacgccaagaggcgcttccggcggcaggatgtgagacatggaaatgctgcccagcagtgcttcggccagcagtttgtgggagatgccctggacaagacagaggagcacctggcctatggaattgagaacaacagcaccctgctggagtgcacccccaggagcctgcaggccaaggtgatctggtttgtgcagaagggccgggagaccaggaaggaggaggtgaagacagatgacagagtggtgaagatggacctgggcctgctcttcctgcggctgcacaagagtgatgctggcacctacttctgccagacagtggagcacagctttgtgcacacagtgaggaagatcaccctggaggtggtggaggaggagaaggtggaggacatgttcaacaaggatgatgaggaggacagacaccacaggatgccctgcccagcccagagcagcatcagccagggcgccaagccctggtacaaggagttcctgcagctgattggctacagcaacttccagagggtggaggagtactgtgagaaggtgtggtgcacagacaggaagaggaagaagctgaagatgagccccagcaagtggaagtatgccaacccccaggagaagaagctgcggagcaagccagagcactaccgcctgcccaggcacaccctggacagctag

SEQ ID NO: 169110 - DNA, 2148 bp, Artificial Sequence
  Description of Artificial Sequence: Synthetic coding sequence
atgctgctggatgagtaccaggagcggctgtttgtgggcggccgggacctggtgtacagcctgagcctggagcgcatcagtgatggctacaaggagatccactggcccagcacagccctgaagatggaggagtgcatcatgaagggcaaggatgctggggagtgtgccaactacgtgcgggtgctgcaccactacaacagaacccacctgctgacctgtggcactggagcctttgatcctgtgtgtgccttcatccgggtgggctaccacctggaggaccccctcttccacctggagagccccaggtctgagcggggccggggccgctgcccctttgaccccagcagcagcttcatcagcaccctgattggcagcgagctgtttgctggcctgtacagcgactactggagcagagatgctgccatcttccgctccatgggccgcctggcccacatcagaacagaacatgatgatgagcggctgctgaaggagcccaagtttgtgggcagctacatgatcccagacaatgaagatagagatgacaacaaggtgtacttcttcttcacagagaaggccctggaggccgagaacaatgcccacgccatctacaccagggtgggccgcctgtgtgtgaatgatgtgggcggccagaggatcctggtgaacaagtggagcaccttcctgaaggcccggctggtgtgcagcgtgcccggcatgaatggcatcgacacctactttgatgagctggaggatgtgttcctgctgcccacccgggaccacaagaaccctgtgatcttcggcctcttcaacaccaccagcaacatcttccggggccacgccatctgtgtgtaccacatgagcagcatccgggccgccttcaacggcccctatgcccacaaggagggccctgagtaccactggagcgtgtatgagggcaaggtgccctaccccaggcctggcagctgtgccagcaaggtgaatggaggccgctatggcaccaccaaggactacccagatgatgccatccgctttgcccggagccaccccctgatgtaccaggccatcaagccagcccacaagaagcccatcctggtgaagacagatggcaagtacaacctgaagcagattgctgtggacagagtggaggccgaggatggccagtatgatgtgctcttcatcggcacagacaatggaattgtgctgaaggtgatcaccatctacaaccaggagatggagagcatggaggaggtgatcctggaggagctgcagatcttcaaggaccctgtgcccatcatctccatggagatcagcagcaagaggcagcagctgtacatcggcagcgccagcgctgtggcccaggtgcgcttccaccactgtgacatgtatggcagcgcctgtgccgactgctgcctggcccgggacccctactgtgcctgggatggcatcagctgcagccgctactaccccaccggcacccacgccaagaggcgcttccggcggcaggatgtgagacatggaaatgctgcccagcagtgcttcggccagcagtttgtgggagatgccctggacaagacagaggagcacctggcctatggaattgagaacaacagcaccctgctggagtgcacccccaggagcctgcaggccaaggtgatctggtttgtgcagaagggccgggagaccaggaaggaggaggtgaagacagatgacagagtggtgaagatggacctgggcctgctcttcctgcggctgcacaagagtgatgctggcacctacttctgccagacagtggagcacagctttgtgcacacagtgaggaagatcaccctggaggtggtggaggaggagaaggtggaggacatgttcaacaaggatgatgaggaggacagacaccacaggatgccctgcccagcccagagcagcatcagccagggcgccaagccctggtacaaggagttcctgcagctgattggctacagcaacttccagagggtggaggagtactgtgagaaggtgtggtgcacagacaggaagaggaagaagctgaagatgagccccagcaagtggaagtatgccaacccccaggagaagaagctgcggagcaagccagagcactaccgcctgcccaggcacaccctggacagctag

SEQ ID NO: 169111 - DNA, 2301 bp, Artificial Sequence
  Description of Artificial Sequence: Synthetic coding sequence
atggccagcgctggccacatcatcaccctgctgctgtggggctacctgctggagctgtggacaggaggccacacagctgacaccacccacccccggctgcggctgagccacaaggagctgctgaacctgaacagaaccagcatcttccacagccccttcggcttcctggacctgcacaccatgctgctggatgagtaccaggagcggctgtttgtgggcggccgggacctggtgtacagcctgagcctggagcgcatcagtgatggctacaaggagatccactggcccagcacagccctgaagatggaggagtgcatcatgaagggcaaggatgctggggagtgtgccaactacgtgcgggtgctgcaccactacaacagaacccacctgctgacctgtggcactggagcctttgatcctgtgtgtgccttcatccgggtgggctaccacctggaggaccccctcttccacctggagagccccaggtctgagcggggccggggccgctgcccctttgaccccagcagcagcttcatcagcaccctgattggcagcgagctgtttgctggcctgtacagcgactactggagcagagatgctgccatcttccgctccatgggccgcctggcccacatcagaacagaacatgatgatgagcggctgctgaaggagcccaagtttgtgggcagctacatgatcccagacaatgaagatagagatgacaacaaggtgtacttcttcttcacagagaaggccctggaggccgagaacaatgcccacgccatctacaccagggtgggccgcctgtgtgtgaatgatgtgggcggccagaggatcctggtgaacaagtggagcaccttcctgaaggcccggctggtgtgcagcgtgcccggcatgaatggcatcgacacctactttgatgagctggaggatgtgttcctgctgcccacccgggaccacaagaaccctgtgatcttcggcctcttcaacaccaccagcaacatcttccggggccacgccatctgtgtgtaccacatgagcagcatccgggccgccttcaacggcccctatgcccacaaggagggccctgagtaccactggagcgtgtatgagggcaaggtgccctaccccaggcctggcagctgtgccagcaaggtgaatggaggccgctatggcaccaccaaggactacccagatgatgccatccgctttgcccggagccaccccctgatgtaccaggccatcaagccagcccacaagaagcccatcctggtgaagacagatggcaagtacaacctgaagcagattgctgtggacagagtggaggccgaggatggccagtatgatgtgctcttcatcggcacagacaatggaattgtgctgaaggtgatcaccatctacaaccaggagatggagagcatggaggaggtgatcctggaggagctgcagatcttcaaggaccctgtgcccatcatctccatggagatcagcagcaagaggcagcagctgtacatcggcagcgccagcgctgtggcccaggtgcgcttccaccactgtgacatgtatggcagcgcctgtgccgactgctgcctggcccgggacccctactgtgcctgggatggcatcagctgcagccgctactaccccaccggcacccacgccaagaggcgcttccggcggcaggatgtgagacatggaaatgctgcccagcagtgcttcggccagcagtttgtgggagatgccctggacaagacagaggagcacctggcctatggaattgagaacaacagcaccctgctggagtgcacccccaggagcctgcaggccaaggtgatctggtttgtgcagaagggccgggagaccaggaaggaggaggtgaagacagatgacagagtggtgaagatggacctgggcctgctcttcctgcggctgcacaagagtgatgctggcacctacttctgccagacagtggagcacagctttgtgcacacagtgaggaagatcaccctggaggtggtggaggaggagaaggtggaggacatgttcaacaaggatgatgaggaggacagacaccacaggatgccctgcccagcccagagcagcatcagccagggcgccaagccctggtacaaggagttcctgcagctgattggctacagcaacttccagagggtggaggagtactgtgagaaggtgtggtgcacagacaggaagaggaagaagctgaagatgagccccagcaagtggaagtatgccaacccccagcactaccgcctgcccaggcacaccctggacagctag

SEQ ID NO: 169112 - DNA, 2286 bp, Artificial Sequence
  Description of Artificial Sequence: Synthetic coding sequence
atggccctgcctgccctgggcctggacccctggagcctgctgggcctcttcctgttccagctgctgcagctgctgctgcccaccaccacagctgggggcggcggccagggccccatgccccgggtgcgctactatgctggagatgagcggcgggccctgtccttcttccaccagaagggcctgcaggactttgacaccctgctgctgtctggagatggcaacaccctgtatgtgggcgcccgggaggccatcctggccctggacatccaggaccccggggtgccccggctgaagaacatgatcccctggccagccagtgacaggaagaagtcagaatgtgccttcaagaagaagagcaatgagacccagtgcttcaacttcatccgggtgctggtgtcctacaacgtgacccacctgtacacctgtggcacctttgccttctccccagcctgcaccttcatcgagctgcaggacagctacctgctgcccatcagcgaggacaaggtgatggagggcaagggccagagcccctttgatcctgcccacaagcacacagctgtgctggtggatggcatgctgtacagcggcaccatgaacaacttcctgggcagcgagcccatcctgatgaggaccctgggcagccagcctgtgctgaagacagacaacttcctgcgctggctgcaccatgatgccagctttgtggccgccatccccagcacccaggtggtgtacttcttctttgaggagacagccagcgagtttgacttctttgagcggctgcacaccagccgggtggcccgggtgtgcaagaatgatgtgggcggggagaagctgctgcagaagaagtggaccaccttcctgaaggcccagctgctgtgcacccagcccggccagctgcccttcaacgtcatcagacatgctgtgctgctgcctgctgacagccccacagccccccacatctatgctgtgttcaccagccagtggcaggtgggcggcaccaggagcagcgctgtgtgtgccttcagcctgctggacatcgagagggtcttcaagggcaagtacaaggagctgaacaaggagaccagccgctggaccacctaccggggccctgagaccaacccccggcccggcagctgcagcgtgggccccagcagtgacaaggccctgaccttcatgaaggaccacttcctgatggatgagcaggtggtgggcacccccctgctggtgaagtctggagtggagtacacccggctggccgtggagacagcccagggcctggatggccacagccacctggtgatgtacctgggcaccaccaccggcagcctgcacaaggctgtggtgtctggggacagcagcgcccacctggtggaggagatccagctgttcccagaccctgagcctgtgaggaacctgcagctggcccccacccagggcgctgtgtttgtgggcttcagcggcggcgtgtggagggtgccccgggccaactgcagcgtgtatgagagctgtgtggactgtgtgctggcccgggacccccactgtgcctgggaccctgagagcaggacctgctgcctgctgagcgcccccaacctgaacagctggaagcaggacatggagcggggcaaccctgagtgggcctgtgccagcggccccatgagccgcagcctgcggccccagagccggccccagatcatcaaggaggtgctggccgtgcccaacagcatcctggagctgccctgcccccacctgagcgccctggccagctactactggagccacggccctgctgctgtgcctgaggccagcagcacagtgtacaacggcagcctgctgctgattgtgcaggatggagtgggcggcctgtaccagtgctgggccacagaaaatggcttctcctaccctgtgatctcctactgggtggacagccaggaccagaccctggccctggaccctgagctggccggcatcccccgggagcacgtgaaggtgcccctgaccagggtgtctggaggagctgccctggccgcccagcagagctactggccccactttgtgacagtgacagtgctgtttgccctggtgctgagcggggccctgatcatcctggtggccagccccctgcgggccctgcgggcccggggcaaggtgcagggctgtgagaccctgcggcctggagagaaggcccccctgagccgggagcagcacctgcagagccccaaggaatgtaggaccagcgccagtgatgtggatgctgacaacaactgcctgggcacagaggtggcctag

SEQ ID NO: 169113 - DNA, 2286 bp, Artificial Sequence; identical to SEQ ID NO: 169112
  Description of Artificial Sequence: Synthetic coding sequence

SEQ ID NO: 169114 - DNA, 2172 bp, Artificial Sequence
  Description of Artificial Sequence: Synthetic coding sequence
atgccccgggtgcgctactatgctggagatgagcggcgggccctgtccttcttccaccagaagggcctgcaggactttgacaccctgctgctgtctggagatggcaacaccctgtatgtgggcgcccgggaggccatcctggccctggacatccaggaccccggggtgccccggctgaagaacatgatcccctggccagccagtgacaggaagaagtcagaatgtgccttcaagaagaagagcaatgagacccagtgcttcaacttcatccgggtgctggtgtcctacaacgtgacccacctgtacacctgtggcacctttgccttctccccagcctgcaccttcatcgagctgcaggacagctacctgctgcccatcagcgaggacaaggtgatggagggcaagggccagagcccctttgatcctgcccacaagcacacagctgtgctggtggatggcatgctgtacagcggcaccatgaacaacttcctgggcagcgagcccatcctgatgaggaccctgggcagccagcctgtgctgaagacagacaacttcctgcgctggctgcaccatgatgccagctttgtggccgccatccccagcacccaggtggtgtacttcttctttgaggagacagccagcgagtttgacttctttgagcggctgcacaccagccgggtggcccgggtgtgcaagaatgatgtgggcggggagaagctgctgcagaagaagtggaccaccttcctgaaggcccagctgctgtgcacccagcccggccagctgcccttcaacgtcatcagacatgctgtgctgctgcctgctgacagccccacagccccccacatctatgctgtgttcaccagccagtggcaggtgggcggcaccaggagcagcgctgtgtgtgccttcagcctgctggacatcgagagggtcttcaagggcaagtacaaggagctgaacaaggagaccagccgctggaccacctaccggggccctgagaccaacccccggcccggcagctgcagcgtgggccccagcagtgacaaggccctgaccttcatgaaggaccacttcctgatggatgagcaggtggtgggcacccccctgctggtgaagtctggagtggagtacacccggctggccgtggagacagcccagggcctggatggccacagccacctggtgatgtacctgggcaccaccaccggcagcctgcacaaggctgtggtgtctggggacagcagcgcccacctggtggaggagatccagctgttcccagaccctgagcctgtgaggaacctgcagctggcccccacccagggcgctgtgtttgtgggcttcagcggcggcgtgtggagggtgccccgggccaactgcagcgtgtatgagagctgtgtggactgtgtgctggcccgggacccccactgtgcctgggaccctgagagcaggacctgctgcctgctgagcgcccccaacctgaacagctggaagcaggacatggagcggggcaaccctgagtgggcctgtgccagcggccccatgagccgcagcctgcggccccagagccggccccagatcatcaaggaggtgctggccgtgcccaacagcatcctggagctgccctgcccccacctgagcgccctggccagctactactggagccacggccctgctgctgtgcctgaggccagcagcacagtgtacaacggcagcctgctgctgattgtgcaggatggagtgggcggcctgtaccagtgctgggccacagaaaatggcttctcctaccctgtgatctcctactgggtggacagccaggaccagaccctggccctggaccctgagctggccggcatcccccgggagcacgtgaaggtgcccctgaccagggtgtctggaggagctgccctggccgcccagcagagctactggccccactttgtgacagtgacagtgctgtttgccctggtgctgagcggggccctgatcatcctggtggccagccccctgcgggccctgcgggcccggggcaaggtgcagggctgtgagaccctgcggcctggagagaaggcccccctgagccgggagcagcacctgcagagccccaaggaatgtaggaccagcgccagtgatgtggatgctgacaacaactgcctgggcacagaggtggcctag

SEQ ID NO: 169115 - DNA, 1890 bp, Artificial Sequence
  Description of Artificial Sequence: Synthetic coding sequence
atgatcccctggccagccagtgacaggaagaagtcagaatgtgccttcaagaagaagagcaatgaggagctgcaggacagctacctgctgcccatcagcgaggacaaggtgatggagggcaagggccagagcccctttgatcctgcccacaagcacacagctgtgctggtggatggcatgctgtacagcggcaccatgaacaacttcctgggcagcgagcccatcctgatgaggaccctgggcagccagcctgtgctgaagacagacaacttcctgcgctggctgcaccatgatgccagctttgtggccgccatccccagcacccaggtggtgtacttcttctttgaggagacagccagcgagtttgacttctttgagcggctgcacaccagccgggtggcccgggtgtgcaagaatgatgtgggcggggagaagctgctgcagaagaagtggaccaccttcctgaaggcccagctgctgtgcacccagcccggccagctgcccttcaacgtcatcagacatgctgtgctgctgcctgctgacagccccacagccccccacatctatgctgtgttcaccagccagtggcaggtgggcggcaccaggagcagcgctgtgtgtgccttcagcctgctggacatcgagagggtcttcaagggcaagtacaaggagctgaacaaggagaccagccgctggaccacctaccggggccctgagaccaacccccggcccggcagctgcagcgtgggccccagcagtgacaaggccctgaccttcatgaaggaccacttcctgatggatgagcaggtggtgggcacccccctgctggtgaagtctggagtggagtacacccggctggccgtggagacagcccagggcctggatggccacagccacctggtgatgtacctgggcaccaccaccggcagcctgcacaaggctgtggtgtctggggacagcagcgcccacctggtggaggagatccagctgttcccagaccctgagcctgtgaggaacctgcagctggcccccacccagggcgctgtgtttgtgggcttcagcggcggcgtgtggagggtgccccgggccaactgcagcgtgtatgagagctgtgtggactgtgtgctggcccgggacccccactgtgcctgggaccctgagagcaggacctgctgcctgctgagcgcccccaacctgaacagctggaagcaggacatggagcggggcaaccctgagtgggcctgtgccagcggccccatgagccgcagcctgcggccccagagccggccccagatcatcaaggaggtgctggccgtgcccaacagcatcctggagctgccctgcccccacctgagcgccctggccagctactactggagccacggccctgctgctgtgcctgaggccagcagcacagtgtacaacggcagcctgctgctgattgtgcaggatggagtgggcggcctgtaccagtgctgggccacagaaaatggcttctcctaccctgtgatctcctactgggtggacagccaggaccagaccctggccctggaccctgagctggccggcatcccccgggagcacgtgaaggtgcccctgaccagggtgtctggaggagctgccctggccgcccagcagagctactggccccactttgtgacagtgacagtgctgtttgccctggtgctgagcggggccctgatcatcctggtggccagccccctgcgggccctgcgggcccggggcaaggtgcagggctgtgagaccctgcggcctggagagaaggcccccctgagccgggagcagcacctgcagagccccaaggaatgtaggaccagcgccagtgatgtggatgctgacaacaactgcctgggcacagaggtggcctag

SEQ ID NO: 169116 - DNA, 2286 bp, Artificial Sequence; identical to SEQ ID NO: 169112
  Description of Artificial Sequence: Synthetic coding sequence

SEQ ID NO: 169117 - DNA, 1890 bp, Artificial Sequence; identical to SEQ ID NO: 169115
  Description of Artificial Sequence: Synthetic coding sequence

SEQ ID NO: 169118 - DNA, 663 bp, Artificial Sequence
  Description of Artificial Sequence: Synthetic coding sequence
atgatcccctggccagccagtgacaggaagaagtcagaatgtgccttcaagaagaagagcaatgagacccagtgcttcaacttcatccgggtgctggtgtcctacaacgtgacccacctgtacacctgtggcacctttgccttcagccctgcctgcaccttcatcgagctgcaggacagctacctgctgcccatcagcgaggacaaggtgatggagggcaagggccagagcccctttgatcctgcccacaagcacacagctgtgctggtggatggcatgctgtacagcggcaccatgaacaacttcctgggcagcgagcccatcctgatgaggaccctgggcagccagcctgtgctgaagacagacaacttcctgcgctggctgcaccatgatgccagctttgtggccgccatccccagcacccaggtggtgtacttcttctttgaggagacagccagcgagtttgacttctttgagcggctgcacaccagccgggtggcccgggtgtgcaagaatgatgtgggcggggagaagctgctgcagaagaagtggaccaccttcctgaaggcccagctgctgtgcacccagcccggccagctgcccttcaacgtcatcagacatgctgtgctgctgcctgctgacagccccacagccccccactag

SEQ ID NO: 169119 - DNA, 966 bp, Artificial Sequence
  Description of Artificial Sequence: Synthetic coding sequence
atggccctgcctgccctgggcctggacccctggagcctgctgggcctcttcctgttccagctgctgcagctgctgctgcccaccaccacagctgggggcggcggccagggccccatgccccgggtgcgctactatgctggagatgagcggcgggccctgtccttcttccaccagaagggcctgcaggactttgacaccctgctgctgtctggagatggcaacaccctgtatgtgggcgcccgggaggccatcctggccctggacatccaggaccccggggtgccccggctgaagaacatgatcccctggccagccagtgacaggaagaagtcagaatgtgccttcaagaagaagagcaatgagacccagtgcttcaacttcatccgggtgctggtgtcctacaacgtgacccacctgtacacctgtggcacctttgccttctccccagcctgcaccttcatcgagctgcaggacagctacctgctgcccatcagcgaggacaaggtgatggagggcaagggccagagcccctttgatcctgcccacaagcacacagctgtgctggtggatggcatgctgtacagcggcaccatgaacaacttcctgggcagcgagcccatcctgatgaggaccctgggcagccagcctgtgctgaagacagacaacttcctgcgctggctgcaccatgatgccagctttgtggccgccatccccagcacccaggtggtgtacttcttctttgaggagacagccagcgagtttgacttctttgagcggctgcacaccagccgggtggcccgggtgtgcaagaatgatgtgggcggggagaagctgctgcagaagaagtggaccaccttcctgaaggcccagctgctgtgcacccagcccggccagctgcccttcaacgtcatcagacatgctgtgctgctgcctgctgacagccccacagccccccacatctactag

SEQ ID NO: 169120 - DNA, 711 bp, Artificial Sequence
  Description of Artificial Sequence: Synthetic coding sequence
atggccctgcctgccctgggcctggacccctggagcctgctgggcctcttcctgttccagctgctgcagctgctgctgcccaccaccacagctgggggcggcggccagggccccatgccccgggtgcgctactatgctggagatgagcggcgggccctgtccttcttccaccagaagggcctgcaggactttgacaccctgctgctgtctggagatggcaacaccctgtatgtgggcgcccgggaggccatcctggccctggacatccaggaccccggggtgccccggctgaagaacatgatcccctggccagccagtgacaggaagaagtcagaatgtgccttcaagaagaagagcaatgaggagctgcaggacagctacctgctgcccatcagcgaggacaaggtgatggagggcaagggccagagcccctttgatcctgcccacaagcacacagctgtgctggtggatggcatgctgtacagcggcaccatgaacaacttcctgggcagcgagcccatcctgatgaggaccctgggcagccagcctgtgctgaagacagacaacttcctgcgctggctgcaccatgatgccagctttgtggccgccatccccagcacccaggtggtgtacttcttctttgaggagacagccagcgagtttgacttctttgagcggctgcacaccagccgggtggcccgggtgtgctag

SEQ ID NO: 169121 - DNA, 2172 bp, Artificial Sequence; identical to SEQ ID NO: 169114
  Description of Artificial Sequence: Synthetic coding sequence

SEQ ID NO: 169122 - DNA, 3225 bp, Artificial Sequence
  Description of Artificial Sequence: Synthetic coding sequence
atgaagggcacctgtgtgattgcctggctgttcagcagcctgggcctgtggaggctggcccaccctgaggcccagggcaccacccagtgccagaggacagagcaccctgtgatctcctacaaggagatcggcccctggctgcgggagttccgggccaagaatgctgtggacttcagccagctgacctttgatcctggccagaaggagctggtggtgggcgccaggaactacctgttccggctgcagctggaggacctgagcctcatccaggccgtggagtgggagtgtgatgaggccaccaagaaggcctgctacagcaagggcaagagcaaggaggagtgccagaactacatccgggtgctgctggtgggcggggacaggctcttcacctgtggcaccaatgccttcacccctgtgtgcaccaacagaagcctgagcaacctgacagagatccatgaccagatcagcggcatggcccgctgcccctacagcccccagcacaacagcacagccctgctgacagctggaggagagctgtatgctgccacagccatggacttccctggccgggaccctgccatctaccgcagcctgggcatcctgccccccctgaggacagcccagtacaacagcaagtggctgaatgagcccaactttgtgagcagctatgacatcggcaacttcacctacttcttcttcagagaaaatgctgtggagcatgactgtgggaagacagtgttcagccgggccgcccgggtgtgcaagaatgacatcggcggccgcttcctgctggaggacacctggaccaccttcatgaaggcccggctgaactgcagcaggcctggagaggtgcccttctactacaatgagctgcagagcaccttcttcctgcctgagctggacctgatctacggcatcttcaccaccaacgtgaacagcattgctgccagcgctgtgtgtgtgttcaacctgagcgccatcgcccaggccttcagcggccccttcaagtaccaggagaacagccgcagcgcctggctgccctaccccaaccccaacccccacttccagtgtggcaccgtggaccagggcctgtatgtgaacctgacagaaagaaacctgcaggatgcccagaagttcatcctgatgcatgaggtggtgcagcctgtgaccaccgtgcccagcttcatggaggacaacagccgcttcagccacgtggccgtggatgtggtgcagggccgggaggccctggtgcacatcatctacctggccacagattatggcaccatcaagaaggtgcgggtgcccctgaaccagaccagcagcagctgcctgctggaggagattgagctgtttcctgagaggagaagagagcccatccgcagcctgcagatcctgcacagccagagcgtgctgtttgtgggcctgcgggagcacgtggtgaagatccccctgaagcgctgccagttctaccgcaccaggagcacctgcattggagcccaggacccctactgcggctgggatgtggtgatgaagaagtgcaccagcctggaggagagcctgtccatgacccagtgggagcagagcatcagcgcctgccccaccaggaacctgactgtggatggccactttggagtgtggagcccctggaccccctgcacccacacagatggcagcgctgtgggcagctgcctgtgcaggaccaggagctgtgacagccctgccccccagtgtggcggctggcagtgtgagggccctggcatggagatcgccaactgcagcagaaatggaggctggaccccctggacctcctggagcccctgcagcaccacctgtggcatcggcttccaggtgcggcagaggagctgcagcaaccccacccccaggcatggaggccgggtgtgtgtgggccagaaccgggaggagcgctactgcaatgagcacctgctgtgccccccccacatgttctggacaggctggggcccctgggagcgctgcacagcccagtgtggcggcggcatccaggcccggcggcgcatctgtgaaaatggaccagactgtgccggctgcaatgtggagtaccagagctgcaacaccaacccctgcccagagctgaagaagaccaccccctggaccccctggacccctgtgaacatcagtgacaatggaggccactatgagcagcgcttccgctacacctgcaaggcccggctggccgaccccaacctgctggaggtgggccggcagagaattgagatgagatactgcagcagtgatggcaccagcggctgcagcacagatggcctgagcggggacttcctgcgggccggccgctacagcgcccacacagtgaatggagcctggagcgcctggacctcctggagccagtgcagccgggactgcagccggggcatccggaacaggaagagggtgtgcaacaaccctgagcccaagtatggaggcatgccctgcctgggccccagcctggagtaccaggagtgcaacatcctgccctgccctgtggatggagtgtggagctgctggagcccctggaccaagtgcagcgccacctgtggcggcggccactacatgaggaccaggagctgcagcaacccagccccagcctatggaggagacatctgcctgggcctgcacacagaggaggccctgtgcaacacccagccctgcccagagagctggagcgagtggagcgactggagcgaatgtgaggccagcggcgtgcaggtgcgggcccggcagtgcatcctgctcttccccatgggcagccagtgcagcggcaacaccacagagagccggccctgtgtgtttgacagcaacttcatccctgaggtgtctgtggcccggagcagctctgtggaggagaagagatgtggggagttcaacatgttccacatgattgctgtgggcctgagcagcagcatcctgggctgcctgctgaccctgctggtgtacacctactgccagcgctaccagcagcagagccatgatgccaccgtcatccaccctgtgtccccagcccccctgaacaccagcatcaccaaccacatcaacaagctggacaagtatgacagcgtggaggccatcaaggccttcaacaagaacaacctgatcctggaggagaggaacaagtacttcaacccccacctgaccgggaagacctacagcaatgcctacttcacagacctgaacaactatgatgagtactag

SEQ ID NO: 169123 - DNA, 765 bp, Artificial Sequence
  Description of Artificial Sequence: Synthetic coding sequence
atgaagggcacctgtgtgattgcctggctgttcagcagcctgggcctgtggaggctggcccaccctgaggcccagggcaccacccagtgccagaggacagagcaccctgtgatctcctacaaggagatcggcccctggctgcgggagttccgggccaagaatgctgtggacttcagccagctgacctttgatcctggccagaaggagctggtggtgggcgccaggaactacctgttccggctgcagctggaggacctgagcctcatccaggccgtggagtgggagtgtgatgaggccaccaagaaggcctgctacagcaagggcaagagcaaggaggagtgccagaactacatccgggtgctgctggtgggcggggacaggctcttcacctgtggcaccaatgccttcacccctgtgtgcaccaacagaagcctgagcaacctgacagagatccatgaccagatcagcggcatggcccgctgcccctacagcccccagcacaacagcacagccctgctgacagctggaggagagctgtatgctgccacagccatggacttccctggccgggaccctgccatctaccgcagcctgggcatcctgccccccctgaggacagcccagtacaacagcaagtggctgaatgagcccaactttgtgagcagctatgacatcggcaacttcacctacttcttcttcagagaaaatgctgtggagcatgactgtgggaagacagtgttcagccgggccgcccgggtgtgctag

SEQ ID NO: 169124 - DNA, 2001 bp, Artificial Sequence
  Description of Artificial Sequence: Synthetic coding sequence
atgaccccacctcctcctggccgggccgcccccagcgccccccgggcccgggtgcccggccccccagcccggctgggcctgcccctgcggctgcggctgctgctgctgctgtgggccgctgctgccagcgcccagggccacctgcggagcggcccccgcatctttgctgtgtggaagggccacgtgggccaggacagagtggactttggccagacagagccccacacagtgctcttccacgagcccggcagcagctctgtgtgggtgggcggccggggcaaggtgtacctgtttgacttccctgagggcaagaatgcctctgtgaggacagtgaacatcggcagcaccaagggcagctgcctggacaagagggactgtgagaactacatcaccctgctggagaggagaagtgagggcctgctggcctgtggcaccaatgcccggcaccccagctgctggaacctggtgaatggaacagtggtgcccctgggggagatgaggggctacgcccccttctccccagatgagaacagcctggtgctgtttgaaggagatgaggtgtacagcaccatcaggaagcaggagtacaacgggaagatcccccgcttccgccgcatccggggggagagcgagctgtacaccagtgacacagtgatgcagaacccccagttcatcaaggccaccatcgtgcaccaggaccaggcctatgatgacaagatctactacttcttccgggaggacaacccagacaagaaccctgaggcccccctgaatgtgtcccgggtggcccagctgtgccgcggggaccagggcggggagagcagcctgtctgtgtccaagtggaacaccttcctgaaggccatgctggtgtgcagtgatgctgccaccaacaagaacttcaaccggctgcaggatgtgttcctgctgcctgaccccagcggccagtggagggacaccagggtgtatggagtcttcagcaacccctggaactacagcgctgtgtgtgtgtacagcctgggggacatcgacaaggtgttccgcaccagcagcctgaagggctaccacagcagcctgcccaaccccaggcctgggaagtgcctgcctgaccagcagcccatccccacagagaccttccaggtggccgacagacaccctgaggtggcccagagggtggagcccatgggccccctgaagacccccctcttccacagcaagtaccactaccagaaggtggccgtgcacaggatgcaggccagccacggggagaccttccacgtgctgtacctgaccacagaccggggcaccatccacaaggtggtggagcccggggagcaggagcacagctttgccttcaacatcatggagatccagcccttccggcgggctgctgccatccagaccatgagcctggatgctgagaggaggaagctgtatgtgagcagccagtgggaggtgtcccaggtgcccctggacctgtgtgaggtgtatggaggcggctgccacggctgcctgatgagccgggacccctactgcggctgggaccagggccgctgcatcagcatctacagcagcgagaggtctgtgctgcagagcatcaacccagctgagccccacaaggagtgccccaaccccaagccagacaaggcccccctgcagaaggtgtccctggcccccaacagccgctactacctgagctgccccatggagagcagacatgccacctacagctggaggcacaaggaaaatgtggagcagagctgtgagcccggccaccagagccccaactgcatcctcttcatcgagaacctgacagcccagcagtatggccactacttctgtgaggcccaggagggcagctacttccgggaggcccagcactggcagctgctgcctgaagatggcatcatggccgagcacctgctgggccacgcctgtgccctggccgccagcctgtggctgggcgtgctgcccaccctgaccctgggcctgctggtgcactag

SEQ ID NO: 169125 - DNA, 1506 bp, Artificial Sequence
  Description of Artificial Sequence: Synthetic coding sequence
atgaggggctacgcccccttctccccagatgagaacagcctggtgctgtttgaaggagatgaggtgtacagcaccatcaggaagcaggagtacaacgggaagatcccccgcttccgccgcatccggggggagagcgagctgtacaccagtgacacagtgatgcagaacccccagttcatcaaggccaccatcgtgcaccaggaccaggcctatgatgacaagatctactacttcttccgggaggacaacccagacaagaaccctgaggcccccctgaatgtgtcccgggtggcccagctgtgccgcggggaccagggcggggagagcagcctgtctgtgtccaagtggaacaccttcctgaaggccatgctggtgtgcagtgatgctgccaccaacaagaacttcaaccggctgcaggatgtgttcctgctgcctgaccccagcggccagtggagggacaccagggtgtatggagtcttcagcaacccctggaactacagcgctgtgtgtgtgtacagcctgggggacatcgacaaggtgttccgcaccagcagcctgaagggctaccacagcagcctgcccaaccccaggcctgggaagtgcctgcctgaccagcagcccatccccacagagaccttccaggtggccgacagacaccctgaggtggcccagagggtggagcccatgggccccctgaagacccccctcttccacagcaagtaccactaccagaaggtggccgtgcacaggatgcaggccagccatggagagaccttccacgtgctgtacctgaccacagaccggggcaccatccacaaggtggtggagcctggagagcaggagcacagctttgccttcaacatcatggagatccagcccttcagaagagctgctgccatccagaccatgagcctggatgctgagaggaggaagctgtatgtgagcagccagtgggaggtgtcccaggtgcccctggacctgtgtgaggtgtatggaggcggctgccacggctgcctgatgagccgggacccctactgcggctgggaccagggccgctgcatcagcatctacagcagcgagaggtctgtgctgcagagcatcaacccagctgagccccacaaggaatgtcccaaccccaagccagacaaggcccccctgcagaaggtgtccctggcccccaacagccgctactacctgagctgccccatggagagcagacatgccacctacagctggaggcacaaggaaaatgtggagcagagctgtgagcccggccaccagagccccaactgcatcctcttcatcgagaacctgacagcccagcagtatggccactacttctgtgaggcccaggagggcagctacttccgggaggcccagcactggcagctgctgcctgaagatggcatcatggccgagcacctgctgggccacgcctgtgccctggccgccagcctgtggctgggcgtgctgcccaccctgaccctgggcctgctggtgcactag

SEQ ID NO: 169126 - DNA, 1959 bp, Artificial Sequence
  Description of Artificial Sequence: Synthetic coding sequence
atgaccccacctcctcctggccgggccgcccccagcgccccccgggcccgggtgcccggccccccagcccggctgggcctgcccctgcggctgcggctgctgctgctgctgtgggccgctgctgccagcgcccagggccacctgcggagcggcccccgcatctttgctgtgtggaagggccacgtgggccaggacagagtggactttggccagacagagccccacacagtgctcttccacgagcccggcagcagctctgtgtgggtgggcggccggggcaaggtgtacctgtttgacttccctgagggcaagaatgcctctgtgaggacagactgtgagaactacatcaccctgctggagaggagaagtgagggcctgctggcctgtggcaccaatgcccggcaccccagctgctggaacctggtgaatggaacagtggtgcccctgggggagatgaggggctacgcccccttctccccagatgagaacagcctggtgctgtttgaaggagatgaggtgtacagcaccatcaggaagcaggagtacaacgggaagatcccccgcttccgccgcatccggggggagagcgagctgtacaccagtgacacagtgatgcagaacccccagttcatcaaggccaccatcgtgcaccaggaccaggcctatgatgacaagatctactacttcttccgggaggacaacccagacaagaaccctgaggcccccctgaatgtgtcccgggtggcccagctgtgccgcggggaccagggcggggagagcagcctgtctgtgtccaagtggaacaccttcctgaaggccatgctggtgtgcagtgatgctgccaccaacaagaacttcaaccggctgcaggatgtgttcctgctgcctgaccccagcggccagtggagggacaccagggtgtatggagtcttcagcaacccctggaactacagcgctgtgtgtgtgtacagcctgggggacatcgacaaggtgttccgcaccagcagcctgaagggctaccacagcagcctgcccaaccccaggcctgggaagtgcctgcctgaccagcagcccatccccacagagaccttccaggtggccgacagacaccctgaggtggcccagagggtggagcccatgggccccctgaagacccccctcttccacagcaagtaccactaccagaaggtggccgtgcacaggatgcaggccagccacggggagaccttccacgtgctgtacctgaccacagaccggggcaccatccacaaggtggtggagcccggggagcaggagcacagctttgccttcaacatcatggagatccagcccttccggcgggctgctgccatccagaccatgagcctggatgctgagaggaggaagctgtatgtgagcagccagtgggaggtgtcccaggtgcccctggacctgtgtgaggtgtatggaggcggctgccacggctgcctgatgagccgggacccctactgcggctgggaccagggccgctgcatcagcatctacagcagcgagaggtctgtgctgcagagcatcaacccagctgagccccacaaggagtgccccaaccccaagccagacaaggcccccctgcagaaggtgtccctggcccccaacagccgctactacctgagctgccccatggagagcagacatgccacctacagctggaggcacaaggaaaatgtggagcagagctgtgagcccggccaccagagccccaactgcatcctcttcatcgagaacctgacagcccagcagtatggccactacttctgtgaggcccaggagggcagctacttccgggaggcccagcactggcagctgctgcctgaagatggcatcatggccgagcacctgctgggccacgcctgtgccctggccgccagcctgtggctgggcgtgctgcccaccctgaccctgggcctgctggtgcactag

SEQ ID NO: 169127 - DNA, 1209 bp, Artificial Sequence
  Description of Artificial Sequence: Synthetic coding sequence
atgaagcccaacatcatctttgtgctgagcctgctgctgatcctggagaagcaggccgctgtgatgggccagaagggcggcagcaagggccgcctgcccagcgagttcagccagttcccccacggccagaagggccagcactacagcggccagaagggcaagcagcagacagagagcaagggcagcttcagcatccagtacacctaccacgtggatgccaatgaccatgaccagagcaggaagagccagcagtatgacctgaatgccctgcacaagaccaccaagagccagaggcacctgggcggcagccagcagctgctgcacaacaagcaggagggccgggaccatgacaagagcaagggccacttccaccgggtggtgatccaccacaagggcggcaaggcccaccggggcacccagaaccccagccaggaccagggcaacagccccagcggcaagggcatcagcagccagtacagcaacacagaggagcggctgtgggtgcacggcctgagcaaggagcagacctctgtgtctggggcccagaagggcaggaagcagggcggcagccagagcagctatgtgctgcagacagaggagctggtggccaacaagcagcagcgggagaccaagaacagccaccagaacaagggccactaccagaatgtggtggaggtgcgggaggagcacagcagcaaggtgcagaccagcctgtgcccagcccaccaggacaagctgcagcacggcagcaaggacatcttcagcacccaggatgagctgctggtgtacaacaagaaccagcaccagaccaagaacctgaaccaggaccagcagcacggcaggaaggccaacaagatctcctaccagagcagcagcacagaggagcggcggctgcactacggggagaatggagtgcagaaggatgtgtcccagaggagcatctacagccagacagagaagctggtggccggcaagagccagatccaggcccccaaccccaagcaggagccctggcatggagaaaatgccaagggggagagcggccagagcaccaaccgggagcaggacctgctgagccatgagcagaagggccgccaccagcacggcagccatggaggcctggacatcgtcatcatcgagcaggaggatgacagcgacagacacctggcccagcacctgaacaatgacaggaaccccctcttcacctag

SEQ ID NO: 169128 - DNA, 1389 bp, Artificial Sequence
  Description of Artificial Sequence: Synthetic coding sequence
atgaagcccaacatcatctttgtgctgagcctgctgctgatcctggagaagcaggccgctgtgatgggccagaagggcggcagcaagggccgcctgcccagcgagttcagccagttcccccacggccagaagggccagcactacagcggccagaagggcaagcagcagacagagagcaagggcagcttcagcatccagtacacctaccacgtggatgccaatgaccatgaccagagcaggaagagccagcagtatgacctgaatgccctgcacaagaccaccaagagccagaggcacctgggcggcagccagcagctgctgcacaacaagcaggagggccgggaccatgacaagagcaagggccacttccaccgggtggtgatccaccacaagggcggcaaggcccaccggggcacccagaaccccagccaggaccagggcaacagccccagcggcaagggcatcagcagccagtacagcaacacagaggagcggctgtgggtgcacggcctgagcaaggagcagacctctgtgtctggggcccagaagggcaggaagcagggcggcagccagagcagctatgtgctgcagacagaggagctggtggccaacaagcagcagcgggagaccaagaacagccaccagaacaagggccactaccagaatgtggtggaggtgcgggaggagcacagcagcaaggtgcagaccagcctgtgcccagcccaccaggacaagctgcagcacggcagcaaggacatcttcagcacccaggatgagctgctggtgtacaacaagaaccagcaccagaccaagaacctgaaccaggaccagcagcacggcaggaaggccaacaagatctcctaccagagcagcagcacagaggagcggcggctgcactacggggagaatggagtgcagaaggatgtgtcccagagcagcatctacagccagacagaggagaaggcccagggcaagagccagaagcagatcaccatccccagccaggagcaggagcacagccagaaggccaacaagatctcctaccagagcagcagcacagaggagcggcggctgcactacggggagaatggagtgcagaaggatgtgtcccagaggagcatctacagccagacagagaagctggtggccggcaagagccagatccaggcccccaaccccaagcaggagccctggcatggagaaaatgccaagggggagagcggccagagcaccaaccgggagcaggacctgctgagccatgagcagaagggccgccaccagcacggcagccatggaggcctggacatcgtcatcatcgagcaggaggatgacagcgacagacacctggcccagcacctgaacaatgacaggaaccccctcttcacctag

SEQ ID NO: 169129 - DNA, 1749 bp, Artificial Sequence
  Description of Artificial Sequence: Synthetic coding sequence
atgaagagcatcatcctgtttgtgctgagcctgctgctgatcctggagaagcaggccgctgtgatgggccagaagggcggcagcaagggccagctgcccagcggcagcagccagttcccccacggccagaagggccagcactacttcggccagaaggaccagcagcacaccaagagcaagggcagcttcagcatccagcacacctaccacgtggacatcaatgaccatgactggaccaggaagagccagcagtatgacctgaatgccctgcacaaggccaccaagagcaagcagcacctgggcggcagccagcagctgctgaactacaagcaggagggccgggaccatgacaagagcaagggccacttccacatgatcgtcatccaccacaagggcggccaggcccaccacggcacccagaaccccagccaggaccagggcaacagccccagcggcaagggcctgagcagccagtgcagcaacacagagaagaggctgtgggtgcacggcctgagcaaggagcaggccagcgccagcggggcccagaagggccgcacccagggcggcagccagagcagctatgtgctgcagacagaggagctggtggtgaacaagcagcagcgggagaccaagaacagccaccagaacaagggccactaccagaatgtggtggatgtgcgggaggagcacagcagcaagctgcagaccagcctgcacccagcccaccaggaccggctgcagcacggccccaaggacatcttcaccacccaggatgagctgctggtgtacaacaagaaccagcaccagaccaagaacctgagccaggaccaggagcacggcaggaaggcccacaagatctcctaccccagcagcaggacagaggagcggcagctgcaccacggggagaagtctgtgcagaaggatgtgtccaagggcagcatcagcatccagacagaggagaagatccacggcaagagccagaaccaggtgaccatccacagccaggaccaggagcacggccacaaggagaacaagatctcctaccagagcagcagcacagaggagcggcacctgaactgtggggagaagggcatccagaagggcgtgtccaagggcagcatcagcatccagacagaggagcagatccacggcaagagccagaaccaggtgcgcatccccagccaggcccaggagtatggccacaaggagaacaagatctcctaccagagcagcagcacagaggagcggcggctgaacagcggggagaaggatgtgcagaagggcgtgtccaagggcagcatcagcatccagacagaggagaagatccacggcaagagccagaaccaggtgaccatccccagccaggaccaggagcacggccacaaggagaacaagatgagctaccagagcagcagcacagaggagcggcggctgaactacggcggcaagagcacccagaaggatgtgtcccagagcagcatctccttccagatcgagaagctggtggagggcaagagccagatccagacccccaaccccaaccaggaccagtggagcggccagaatgccaagggcaagagcggccagagcgctgacagcaagcaggacctgctgagccatgagcagaagggccgctacaagcaggagagcagcgagagccacaacatcgtcatcacagaacatgaggtggcccaggatgaccacctgacccagcagtacaatgaagatagaaaccccatcagcacctag

SEQ ID NO: 169130 - DNA, 447 bp, Artificial Sequence
  Description of Artificial Sequence: Synthetic coding sequence
atggccgagagtgactgggacacagtgacagtgctgaggaagaagggccccacagctgcccaggccaagagcaagcaggccatcctggccgcccagaggagaggagaagatgtggagaccagcaagaagtgggccgccggccagaacaagcagcacagcatcaccaagaacacagccaagctggaccgggagacagaggagctgcaccacgacagagtgaccctggaggtgggcaaggtgatccagcagggccggcagagcaagggcctgacccagaaggacctggccaccaagatcaatgagaagccccaggtgattgctgactatgaaagtggccgggccatccccaacaaccaggtgctgggcaagattgaaagagccatcggcctgaagctgcggggcaaggacatcggcaagcccatcgagaagggcccccgggccaagtag

SEQ ID NO: 169131 - DNA, 8121 bp, Artificial Sequence
  Description of Artificial Sequence: Synthetic coding sequence
atgagcacctgctgctggtgcaccccaggaggagccagcaccatcgacttcctgaagagatatgccagcaacaccccatctggagagttccagacagcagatgaggacctgtgctactgcctggagtgtgtggccgagtaccacaaggccagagatgagctgcccttcctgcacgaggtgctgtgggagctggagaccctgcggctcatcaaccactttgagaagtccatgaaggccgagattggagatgatgatgagctgtacatcgtggacaacaatggagagatgcccctgtttgacatcaccggccaggactttgagaacaagctgcgggtgcccctgctggagatcctgaagtacccctacctgctgctgcacgagcgggtgaatgagctgtgtgtggaggccctgtgcaggatggagcaggccaactgcagcttccaggtgtttgacaagcaccctggcatctacctgttcctggtgcaccccaatgagatggtgcggcgctgggccatcctgacagccaggaacctgggcaaggtggacagagatgactactatgacctgcaggaggtgctgctgtgcctcttcaaggtgattgagctgggcctgctggagagcccagacatctacaccagctctgtgctggagaagggcaagctgatcctgctgcccagccacatgtatgacaccaccaactacaagagctactggctgggcatctgcatgctgctgaccatcctggaggagcaggccatggacagcctgctgctgggcagtgacaagcagaatgacttcatgcagagcatcctgcacaccatggagcgggaggctgatgatgacagcgtggaccccttctggccagccctgcactgcttcatggtgatcctggaccggctgggcagcaaggtgtggggccagctgatggaccccatcgtggccttccagaccatcatcaacaatgccagctacaaccgggagatccgccacatccggaacagctctgtgaggaccaagctggagcctgagagctacctggatgacatggtgacctgcagccagatcgtgtacaactacaaccctgagaagaccaagaaggacagcggctggaggacagccatctgcccagactactgccccaacatgtatgaggagatggagaccctggcctctgtgctgcagagcgacatcggccaggacatgagggtgcacaacagcaccttcctgtggttcatcccctttgtgcagagcctgatggacctgaaggacctgggcgtggcctacatcgcccaggtggtgaaccacctgtacagcgaggtgaaggaggtgctgaaccagacagatgctgtgtgtgacaaggtgacagagttcttcctgctgatcctggtgtctgtcatcgagctgcacaggaacaagaagtgcctgcacctgctgtgggtgagcagccagcagtgggtggaggccgtggtgaagtgtgccaagctgcccaccacagccttcaccaggagcagcgagaagagcagcggcaactgcagcaaaggaacagccatgatcagcagcctgagcctgcacagcatgcccagcaacagcgtgcagctggcctacgtgcagctgatccgcagcctgctgaaggagggctaccagctgggccagcagagcctgtgcaagcgcttctgggacaagctgaacctcttcctgcggggcaacctgagcctgggctggcagctgaccagccaggagacccatgagctgcagagctgcctgaagcagatcatccggaacatcaagttcaaggccccaccctgcaacacctttgtggacctgaccagcgcctgcaagatcagccctgccagctacaacaaggaggagagcgagcagatgggcaagaccagcaggaaggacatgcactgcctggaggccagcagccccaccttcagcaaggagcccatgaaggtgcaggacagcgtgctgatcaaggctgacaacaccatcgagggggacaacaatgagcagaactacatcaaggatgtgaagctggaggaccacctgctggccggcagctgcctgaagcagagcagcaagaacatcttcacagaaagagctgaggaccagatcaagatcagcaccaggaagcagaagtctgtgaaggagatcagcagctacacccccaaggactgcaccagcagaaatggacctgagcggggctgtgaccggggcatcatcgtgtccacccggctgctgacagacagcagcacagatgccctggagaaggtgtccaccagcaatgaagacttcagcctgaaggatgatgccctggccaagaccagcaagaggaagaccaaggtgcagaaggatgagatctgtgccaagctgagccacgtgatcaagaagcagcacaggaagagcaccctggtggacaacaccatcaacctggatgagaacctgactgtgagcaacatcgagagcttctacagcaggaaggacacaggagtgcagaagggagatggcttcatccacaacctgagcctggaccccagcggcgtgctggatgacaagaatggagagcagaagagccagaacaacgtgctgcccaaggagaagcagctgaagaatgaggagctggtgatcttctccttccacgagaacaactgcaagatccaggagttccacgtggatggcaaggagctgatccccttcacagagatgaccaatgccagcgagaagaagagcagccccttcaaggacctgatgacagtgcctgagagcagagatgaggagatgagcaacagcaccagcgtcatctacagcaacctgacccgggagcaggccccagacatcagccccaagagtgacaccctgacagacagccagattgaccgggacctgcacaagctgagcctgctggcccaggccagcgtcatcaccttccccagcgacagcccccagaacagcagccagctgcagaggaaggtgaaggaggacaagcgctgcttcaccgccaaccagaacaacgtgggggacaccagccggggccaggtgatcatcatcagtgacagtgatgatgatgatgatgagcgcatcctgagcctggagaagctgaccaagcaggacaagatctgcctggagcgggagcaccctgagcagcacgtgtccacagtgaacagcaaggaggagaagaaccctgtgaaggaggagaagacagagaccctcttccagtttgaggagagtgacagccagtgctttgaatttgagagcagcagcgaggtgttttctgtgtggcaggaccacccagatgacaacaacagcgtgcaggatggagagaagaagtgcctggcccccatcgccaacaccaccaacggccagggctgcacagattatgtgtctgaggtggtgaagaagggagctgagggcatcgaggagcacacccggcccaggagcatctctgtggaggagttctgtgaaattgaggtgaagaagcccaagaggaagaggtctgagaagcccatggctgaagatcctgtgcggcccagcagctctgtgagaaatgaaggccagagcgacaccaacaagagggacctggtgggcaatgacttcaagagcattgacaggaggaccagcacccccaacagccgcatccagagggccaccaccgtgtcccagaagaagagcagcaagctgtgcacctgcacagagcccatcaggaaggtgcctgtgtccaagacccccaagaagacccacagtgatgccaagaagggccagaacagaagcagcaactacctgagctgcaggaccaccccagccatcgtgccccccaagaagttccggcagtgcccagagcccaccagcacagctgagaagctgggcctgaagaagggccccaggaaggcctatgagctgagccagaggagcctggactatgtggcccagctgcgggaccacggcaagacagtgggcgtggtggacaccaggaagaagaccaagctgatcagcccccagaacctgtctgtgaggaacaacaagaagctgctgaccagccaggagctgcagatgcagaggcagatccggcccaagagccagaagaacagaagaaggctgagtgactgtgagagcacagatgtgaagagagctggcagccacacagcccagaacagcgacatctttgtgcctgagagtgacagaagtgactacaactgcacaggaggaacagaggtgctggccaacagcaacaggaagcagctgatcaagtgcatgcccagcgagcctgagaccatcaaggccaagcacggcagccctgccacagatgatgcctgccccctgaaccagtgtgacagcgtggtgctgaatggcaccgtgcccaccaatgaggtgattgtgtccaccagcgaggaccccctgggcggcggggaccccacagcccggcacatcgagatggccgccctgaaggagggggagccagacagcagcagtgatgctgaggaggacaacctcttcctgacccagaatgaccctgaggacatggacctgtgcagccagatggagaatgacaactacaagctgattgagctgatccacggcaaggacacagtggaggtggaggaggacagcgtgtcccggccccagctggagagcctgagcggcaccaagtgcaagtacaaggactgcctggagaccaccaagaaccagggcgagtactgccccaagcacagcgaggtgaaggccgcagatgaagatgtgttcaggaagccaggcctgcccccaccagccagcaagcccctgcggcccaccaccaagatcttcagcagcaagagcaccagcagaattgctggcctgagcaagagcctggagaccagcagcgccctgagccccagcctgaagaacaagagcaagggcatccagagcatcctgaaggtgccccagcctgtgcccctcatcgcccagaagcctgtgggggagatgaagaacagctgcaatgtgctgcacccccagagccccaacaacagcaaccggcagggctgcaaggtgccctttggagagagcaagtacttccccagcagcagccctgtgaacatcctgctgagcagccagagcgtgtctgacacctttgtgaaggaggtgctgaagtggaagtatgagatgttcctgaactttggccagtgtggccccccagccagcctgtgccagagcatcagcaggcctgtgcctgtgcgcttccacaactacggggactacttcaacgtgttcttccccctgatggtgctgaacacctttgagaccgtggcccaggagtggctgaacagccccaaccgggagaacttctaccagctgcaggtgaggaagtttcctgctgactacatcaagtactgggagtttgctgtgtacctggaggagtgtgagctggccaagcagctgtaccccaaggaaaatgacctggtgttcctggcccctgagcgcatcaatgaggagaagaaggacacagaaagaaatgacatccaggacctgcacgagtaccacagcggctacgtgcacaagttccggaggacctctgtgatgagaaatggcaagacagagtgctacctgagcatccagacccaggagaacttccctgccaacctgaatgagctggtgaactgcatcgtcatcagcagcctggtgaccacccagaggaagctgaaggccatgagcctgctgggcagcaggaaccagctggcccgggctgtgctgaaccccaaccccatggacttctgcaccaaggacctgctgaccaccaccagcgagcgcatcatcgcctacctgcgggacttcaatgaagaccagaagaaggccatcgagacagcctatgccatggtgaagcacagccccagcgtggccaagatctgcctgatccacggccccccaggcaccgggaagagcaagaccatcgtgggcctgctgtaccgcctgctgacagagaaccagaggaagggccacagtgatgagaacagcaatgccaagatcaagcagaacagagtgctggtgtgtgcccccagcaatgctgctgtggatgagctgatgaagaagatcatcctggagttcaaggagaagtgcaaggacaagaagaaccccctgggcaactgtggggacatcaacctggtgcggctgggccctgagaagagcatcaacagcgaggtgctgaagttcagcctggacagccaggtgaaccacaggatgaagaaggagctgcccagccacgtgcaggccatgcacaagaggaaggagttcctggactaccagctggatgagctgagccggcagagggccctgtgccggggcggccgggagatccagaggcaggagctggatgagaacatcagcaaggtgtccaaggagcggcaggagctggccagcaagatcaaggaggtgcagggccggccccagaagacccagagcatcatcatcctggagagccacatcatctgctgcaccctgagcaccagcggcggcctgctgctggagagcgccttccggggccagggcggcgtgcccttcagctgtgtgattgtggatgaagctggccagagctgtgaaattgagaccctgacccccctcatccaccgctgcaacaagctgatcctggtgggggaccccaagcagctgccccccaccgtcatctccatgaaggcccaggagtatggctatgaccagagcatgatggcccgcttctgccgcctgctggaggagaatgtggagcacaacatgatcagccggctgcccatcctgcagctgactgtgcagtacaggatgcacccagacatctgcctcttccccagcaactacgtgtacaacagaaacctgaagaccaaccggcagacagaggccatccgctgcagcagtgactggcccttccagccctacctggtgtttgatgtgggagatggcagcgagcggcgggacaatgacagctacatcaacgtgcaggagatcaagctggtgatggagatcatcaagctgatcaaggacaagaggaaggatgtgtccttcaggaacatcggcatcatcacccactacaaggcccagaagaccatgatccagaaggacctggacaaggagtttgacaggaagggccctgctgaggtggacacagtggatgccttccagggccggcagaaggactgtgtgattgtgacctgtgtgcgggccaacagcatccagggcagcatcggcttcctggccagcctgcagaggctgaatgtgaccatcacccgggccaagtacagcctcttcatcctgggccacctgcggaccctgatgcagctgctgcccaggagcttctgtgtgcacgtgaaccacagccccttcttcagccctgagcccaagtacctgcactgggccctgaaggagaaccagcactggaaccagctgatccaggatgcccagaagagaggagccatcatcaagacctgtgacaagaactacagacatgatgctgtgaagatcctgaagctgaagcctgtgctgcagaggagcctgacccacccccccaccatcgcccctgagggcagccggccccagggcggcctgcccagcagcaagctggacagcggctttgccaagacctctgtggccgccagcctgtaccacacccccagcgacagcaaggagatcaccctgactgtgaccagcaaggaccctgagaggcctcctgtgcatgaccagctgcaggacccccggctgctgaagaggatgggcatcgaggtgaagggcggcatcttcctgtgggacccccagcccagcagcccccagcaccctggggccaccccacccactggagagcccggcttccctgtggtgcaccaggacctgagccacatccagcagcctgctgctgtggtggccgccctgagcagccacaagccccctgtgcggggggagcccccagctgccagccctgaggccagcacctgccagagcaaatgtgatgatcctgaggaggagctgtgccacagaagagaggcccgggccttcagcgagggggagcaggagaagtgtggcagcgagacccaccacaccaggaggaacagccgctgggacaagaggaccctggagcaggaggacagcagcagcaagaagaggaagctgctgtag

SEQ ID NO: 169132 - DNA, 7935 bp, Artificial Sequence
  Description of Artificial Sequence: Synthetic coding sequence
atgagcacctgctgctggtgcaccccaggaggagccagcaccatcgacttcctgaagagatatgccagcaacaccccatctggagagttccagacagcagatgaggacctgtgctactgcctggagtgtgtggccgagtaccacaaggccagagatgagctgcccttcctgcacgaggtgctgtgggagctggagaccctgcggctcatcaaccactttgagaagtccatgaaggccgagattggagatgatgatgagctgtacatcgtggacaacaatggagagatgcccctgtttgacatcaccggccaggactttgagaacaagctgcgggtgcccctgctggagatcctgaagtacccctacctgctgctgcacgagcgggtgaatgagctgtgtgtggaggccctgtgcaggatggagcaggccaactgcagcttccaggtgtttgacaagcaccctggcatctacctgttcctggtgcaccccaatgagatggtgcggcgctgggccatcctgacagccaggaacctgggcaaggtggacagagatgactactatgacctgcaggaggtgctgctgtgcctcttcaaggtgattgagctgggcctgctggagagcccagacatctacaccagctctgtgctggagaagggcaagctgatcctgctgcccagccacatgtatgacaccaccaactacaagagctactggctgggcatctgcatgctgctgaccatcctggaggagcaggccatggacagcctgctgctgggcagtgacaagcagaatgacttcatgcagagcatcctgcacaccatggagcgggaggctgatgatgacagcgtggaccccttctggccagccctgcactgcttcatggtgatcctggaccggctgggcagcaaggtgtggggccagctgatggaccccatcgtggccttccagaccatcatcaacaatgccagctacaaccgggagatccgccacatccggaacagctctgtgaggaccaagctggagcctgagagctacctggatgacatggtgacctgcagccagatcgtgtacaactacaaccctgagaagaccaagaaggacagcggctggaggacagccatctgcccagactactgccccaacatgtatgaggagatggagaccctggcctctgtgctgcagagcgacatcggccaggacatgagggtgcacaacagcaccttcctgtggttcatcccctttgtgcagagcctgatggacctgaaggacctgggcgtggcctacatcgcccaggtggtgaaccacctgtacagcgaggtgaaggaggtgctgaaccagacagatgctgtgtgtgacaaggtgacagagttcttcctgctgatcctggtgtctgtcatcgagctgcacaggaacaagaagtgcctgcacctgctgtgggtgagcagccagcagtgggtggaggccgtggtgaagtgtgccaagctgcccaccacagccttcaccaggagcagcgagaagagcagcggcaactgcagcaaaggaacagccatgatcagcagcctgagcctgcacagcatgcccagcaacagcgtgcagctggcctacgtgcagctgatccgcagcctgctgaaggagggctaccagctgggccagcagagcctgtgcaagcgcttctgggacaagctgaacctcttcctgcggggcaacctgagcctgggctggcagctgaccagccaggagacccatgagctgcagagctgcctgaagcagatcatccggaacatcaagttcaaggccccaccctgcaacacctttgtggacctgaccagcgcctgcaagatcagccctgccagctacaacaaggaggagagcgagcagatgggcaagaccagcaggaaggacatgcactgcctggaggccagcagccccaccttcagcaaggagcccatgaaggtgcaggacagcgtgctgatcaaggctgacaacaccatcgagggggacaacaatgagcagaactacatcaaggatgtgaagctggaggaccacctgctggccggcagctgcctgaagcagagcagcaagaacatcttcacagaaagagctgaggaccagatcaagatcagcaccaggaagcagaagtctgtgaaggagatcagcagctacacccccaaggactgcaccagcagaaatggacctgagcggggctgtgaccggggcatcatcgtgtccacccggctgctgacagacagcagcacagatgccctggagaaggtgtccaccagcaatgaagacttcagcctgaaggatgatgccctggccaagaccagcaagaggaagaccaaggtgcagaaggatgagatctgtgccaagctgagccacgtgatcaagaagcagcacaggaagagcaccctggtggacaacaccatcaacctggatgagaacctgactgtgagcaacatcgagagcttctacagcaggaaggacacaggagtgcagaagggagatggcttcatccacaacctgagcctggaccccagcggcgtgctggatgacaagaatggagagcagaagagccagaacaacgtgctgcccaaggagaagcagctgaagaatgaggagctggtgatcttctccttccacgagaacaactgcaagatccaggagttccacgtggatggcaaggagctgatccccttcacagagatgaccaatgccagcgagaagaagagcagccccttcaaggacctgatgacagtgcctgagagcagagatgaggagatgagcaacagcaccagcgtcatctacagcaacctgacccgggagcaggccccagacatcagccccaagagtgacaccctgacagacagccagattgaccgggacctgcacaagctgagcctgctggcccaggccagcgtcatcaccttccccagcgacagcccccagaacagcagccagctgcagaggaaggtgaaggaggacaagcgctgcttcaccgccaaccagaacaacgtgggggacaccagccggggccaggtgatcatcatcagtgacagtgatgatgatgatgatgagcgcatcctgagcctggagaagctgaccaagcaggacaagatctgcctggagcgggagcaccctgagcagcacgtgtccacagtgaacagcaaggaggagaagaaccctgtgaaggaggagaagacagagaccctcttccagtttgaggagagtgacagccagtgctttgaatttgagagcagcagcgaggtgttttctgtgtggcaggaccacccagatgacaacaacagcgtgcaggatggagagaagaagtgcctggcccccatcgccaacaccaccaacggccagggctgcacagattatgtgtctgaggtggtgaagaagggagctgagggcatcgaggagcacacccggcccaggagcatctctgtggaggagttctgtgaaattgaggtgaagaagcccaagaggaagaggtctgagaagcccatggctgaagatcctgtgcggcccagcagctctgtgagaaatgaaggccagagcgacaccaacaagagggacctggtgggcaatgacttcaagagcattgacaggaggaccagcacccccaacagccgcatccagagggccaccaccgtgtcccagaagaagagcagcaagctgtgcacctgcacagagcccatcaggaaggtgcctgtgtccaagacccccaagaagacccacagtgatgccaagaagggccagaacagaagcagcaactacctgagctgcaggaccaccccagccatcgtgccccccaagaagttccggcagtgcccagagcccaccagcacagctgagaagctgggcctgaagaagggccccaggaaggcctatgagctgagccagaggagcctggactatgtggcccagctgcgggaccacggcaagacagtgggcgtggtggacaccaggaagaagaccaagctgatcagcccccagaacctgtctgtgaggaacaacaagaagctgctgaccagccaggagctgcagatgcagaggcagatccggcccaagagccagaagaacagaagaaggctgagtgactgtgagagcacagatgtgaagagagctggcagccacacagcccagaacagcgacatctttgtgcctgagagtgacagaagtgactacaactgcacaggaggaacagaggtgctggccaacagcaacaggaagcagctgatcaagtgcatgcccagcgagcctgagaccatcaaggccaagcacggcagccctgccacagatgatgcctgccccctgaaccagtgtgacagcgtggtgctgaatggcaccgtgcccaccaatgaggtgattgtgtccaccagcgaggaccccctgggcggcggggaccccacagcccggcacatcgagatggccgccctgaaggagggggagccagacagcagcagtgatgctgaggaggacaacctcttcctgacccagaatgaccctgaggacatggacctgtgcagccagatggagaatgacaactacaagctgattgagctgatccacggcaaggacacagtggaggtggaggaggacagcgtgtcccggccccagctggagagcctgagcggcaccaagtgcaagtacaaggactgcctggagaccaccaagaaccagggcgagtactgccccaagcacagcgaggtgaaggccgcagatgaagatgtgttcaggaagccaggcctgcccccaccagccagcaagcccctgcggcccaccaccaagatcttcagcagcaagagcaccagcagaattgctggcctgagcaagagcctggagaccagcagcgccctgagccccagcctgaagaacaagagcaagggcatccagagcatcctgaaggtgccccagcctgtgcccctcatcgcccagaagcctgtgggggagatgaagaacagctgcaatgtgctgcacccccagagccccaacaacagcaaccggcagggctgcaaggtgccctttggagagagcaagtacttccccagcagcagccctgtgaacatcctgctgagcagccagagcgtgtctgacacctttgtgaaggaggtgctgaagtggaagtatgagatgttcctgaactttggccagtgtggccccccagccagcctgtgccagagcatcagcaggcctgtgcctgtgcgcttccacaactacggggactacttcaacgtgttcttccccctgatggtgctgaacacctttgagaccgtggcccaggagtggctgaacagccccaaccgggagaacttctaccagctgcaggtgaggaagtttcctgctgactacatcaagtactgggagtttgctgtgtacctggaggagtgtgagctggccaagcagctgtaccccaaggaaaatgacctggtgttcctggcccctgagcgcatcaatgaggagaagaaggacacagaaagaaatgacatccaggacctgcacgagtaccacagcggctacgtgcacaagttccggaggacctctgtgatgagaaatggcaagacagagtgctacctgagcatccagacccaggagaacttccctgccaacctgaatgagctggtgaactgcatcgtcatcagcagcctggtgaccacccagaggaagctgaaggccatgagcctgctgggcagcaggaaccagctggcccgggctgtgctgaaccccaaccccatggacttctgcaccaaggacctgctgaccaccaccagcgagcgcatcatcgcctacctgcgggacttcaatgaagaccagaagaaggccatcgagacagcctatgccatggtgaagcacagccccagcgtggccaagatctgcctgatccacggccccccaggcaccgggaagagcaagaccatcgtgggcctgctgtaccgcctgctgacagagaaccagaggaagggccacagtgatgagaacagcaatgccaagatcaagcagaacagagtgctggtgtgtgcccccagcaatgctgctgtggatgagctgatgaagaagatcatcctggagttcaaggagaagtgcaaggacaagaagaaccccctgggcaactgtggggacatcaacctggtgcggctgggccctgagaagagcatcaacagcgaggtgctgaagttcagcctggacagccaggtgaaccacaggatgaagaaggagctgcccagccacgtgcaggccatgcacaagaggaaggagttcctggactaccagctggatgagctgagccggcagagggccctgtgccggggcggccgggagatccagaggcaggagctggatgagaacatcagcaaggtgtccaaggagcggcaggagctggccagcaagatcaaggaggtgcagggccggccccagaagacccagagcatcatcatcctggagagccacatcatctgctgcaccctgagcaccagcggcggcctgctgctggagagcgccttccggggccagggcggcgtgcccttcagctgtgtgattgtggatgaagctggccagagctgtgaaattgagaccctgacccccctcatccaccgctgcaacaagctgatcctggtgggggaccccaagcagctgccccccaccgtcatctccatgaaggcccaggagtatggctatgaccagagcatgatggcccgcttctgccgcctgctggaggagaatgtggagcacaacatgatcagccggctgcccatcctgcagctgactgtgcagtacaggatgcacccagacatctgcctcttccccagcaactacgtgtacaacagaaacctgaagaccaaccggcagacagaggccatccgctgcagcagtgactggcccttccagccctacctggtgtttgatgtgggagatggcagcgagcggcgggacaatgacagctacatcaacgtgcaggagatcaagctggtgatggagatcatcaagctgatcaaggacaagaggaaggatgtgtccttcaggaacatcggcatcatcacccactacaaggcccagaagaccatgatccagaaggacctggacaaggagtttgacaggaagggcttcctggccagcctgcagaggctgaatgtgaccatcacccgggccaagtacagcctcttcatcctgggccacctgcggaccctgatggagaaccagcactggaaccagctgatccaggatgcccagaagagaggagccatcatcaagacctgtgacaagaactacagacatgatgctgtgaagatcctgaagctgaagcctgtgctgcagaggagcctgacccacccccccaccatcgcccctgagggcagccggccccagggcggcctgcccagcagcaagctggacagcggctttgccaagacctctgtggccgccagcctgtaccacacccccagcgacagcaaggagatcaccctgactgtgaccagcaaggaccctgagaggcctcctgtgcatgaccagctgcaggacccccggctgctgaagaggatgggcatcgaggtgaagggcggcatcttcctgtgggacccccagcccagcagcccccagcaccctggggccaccccacccactggagagcccggcttccctgtggtgcaccaggacctgagccacatccagcagcctgctgctgtggtggccgccctgagcagccacaagccccctgtgcggggggagcccccagctgccagccctgaggccagcacctgccagagcaaatgtgatgatcctgaggaggagctgtgccacagaagagaggcccgggccttcagcgagggggagcaggagaagtgtggcagcgagacccaccacaccaggaggaacagccgctgggacaagaggaccctggagcaggaggacagcagcagcaagaagaggaagctgctgtag

SEQ ID NO: 169133 - DNA, 2847 bp, Artificial Sequence
  Description of Artificial Sequence: Synthetic coding sequence
gtggcccaggagtggctgaacagccccaaccgggagaacttctaccagctgcaggtgaggaagtttcctgctgactacatcaagtactgggagtttgctgtgtacctggaggagtgtgagctggccaagcagctgtaccccaaggaaaatgacctggtgttcctggcccctgagcgcatcaatgaggagaagaaggacacagaaagaaatgacatccaggacctgcacgagtaccacagcggctacgtgcacaagttccggaggacctctgtgatgagaaatggcaagacagagtgctacctgagcatccagacccaggagaacttccctgccaacctgaatgagctggtgaactgcatcgtcatcagcagcctggtgaccacccagaggaagctgaaggccatgagcctgctgggcagcaggaaccagctggcccgggctgtgctgaaccccaaccccatggacttctgcaccaaggacctgctgaccaccaccagcgagcgcatcatcgcctacctgcgggacttcaatgaagaccagaagaaggccatcgagacagcctatgccatggtgaagcacagccccagcgtggccaagatctgcctgatccacggccccccaggcaccgggaagagcaagaccatcgtgggcctgctgtaccgcctgctgacagagaaccagaggaagggccacagtgatgagaacagcaatgccaagatcaagcagaacagagtgctggtgtgtgcccccagcaatgctgctgtggatgagctgatgaagaagatcatcctggagttcaaggagaagtgcaaggacaagaagaaccccctgggcaactgtggggacatcaacctggtgcggctgggccctgagaagagcatcaacagcgaggtgctgaagttcagcctggacagccaggtgaaccacaggatgaagaaggagctgcccagccacgtgcaggccatgcacaagaggaaggagttcctggactaccagctggatgagctgagccggcagagggccctgtgccggggcggccgggagatccagaggcaggagctggatgagaacatcagcaaggtgtccaaggagcggcaggagctggccagcaagatcaaggaggtgcagggccggccccagaagacccagagcatcatcatcctggagagccacatcatctgctgcaccctgagcaccagcggcggcctgctgctggagagcgccttccggggccagggcggcgtgcccttcagctgtgtgattgtggatgaagctggccagagctgtgaaattgagaccctgacccccctcatccaccgctgcaacaagctgatcctggtgggggaccccaagcagctgccccccaccgtcatctccatgaaggcccaggagtatggctatgaccagagcatgatggcccgcttctgccgcctgctggaggagaatgtggagcacaacatgatcagccggctgcccatcctgcagctgactgtgcagtacaggatgcacccagacatctgcctcttccccagcaactacgtgtacaacagaaacctgaagaccaaccggcagacagaggccatccgctgcagcagtgactggcccttccagccctacctggtgtttgatgtgggagatggcagcgagcggcgggacaatgacagctacatcaacgtgcaggagatcaagctggtgatggagatcatcaagctgatcaaggacaagaggaaggatgtgtccttcaggaacatcggcatcatcacccactacaaggcccagaagaccatgatccagaaggacctggacaaggagtttgacaggaagggccctgctgaggtggacacagtggatgccttccagggccggcagaaggactgtgtgattgtgacctgtgtgcgggccaacagcatccagggcagcatcggcttcctggccagcctgcagaggctgaatgtgaccatcacccgggccaagtacagcctcttcatcctgggccacctgcggaccctgatgcagctgctgcccaggagcttctgtgtgcacgtgaaccacagccccttcttcagccctgagcccaagtacctgcactgggccctgaaggagaaccagcactggaaccagctgatccaggatgcccagaagagaggagccatcatcaagacctgtgacaagaactacagacatgatgctgtgaagatcctgaagctgaagcctgtgctgcagaggagcctgacccacccccccaccatcgcccctgagggcagccggccccagggcggcctgcccagcagcaagctggacagcggctttgccaagacctctgtggccgccagcctgtaccacacccccagcgacagcaaggagatcaccctgactgtgaccagcaaggaccctgagaggcctcctgtgcatgaccagctgcaggacccccggctgctgaagaggatgggcatcgaggtgaagggcggcatcttcctgtgggacccccagcccagcagcccccagcaccctggggccaccccacccactggagagcccggcttccctgtggtgcaccaggacctgagccacatccagcagcctgctgctgtggtggccgccctgagcagccacaagccccctgtgcggggggagcccccagctgccagccctgaggccagcacctgccagagcaaatgtgatgatcctgaggaggagctgtgccacagaagagaggcccgggccttcagcgagggggagcaggagaagtgtggcagcgagacccaccacaccaggaggaacagccgctgggacaagaggaccctggagcaggaggacagcagcagcaagaagaggaagctgctgtag

SEQ ID NO: 169134 - DNA, 1269 bp, Artificial Sequence
  Description of Artificial Sequence: Synthetic coding sequence
atgagcaccagctatggctgcttctggaggcgcttcatccacggcatcggccgcagcggggacatctctgctgtgcagcccaaggccgccggcagcagcctgctgaacaagatcaccaacagcctggtgctggacatcatcaagctggccggcgtgcacacagtggccaactgctttgtggtgcccatggccaccggcatgagcctgaccctgtgcttcctgaccctgcggcacaagaggcccaaggccaagtacatcatctggcccagaattgaccagaagagctgcttcaagtccatgatcacagctggctttgagcctgtggtgattgaaaatgtgctggagggagatgagctgaggacagacctgaaggctgtggaggccaaggtgcaggagctgggccctgactgcatcctgtgcatccacagcaccaccagctgctttgccccccgggtgcctgaccggctggaggagctggccgtcatctgtgccaactatgacatcccccacatcgtgaacaatgcctacggcgtgcagagcagcaagtgcatgcacctgatccagcagggcgcccgggtgggcagaattgatgcctttgtgcagagcctggacaagaacttcatggtgcctgtgggcggggccatcatcgccggcttcaatgacagcttcatccaggagatcagcaagatgtacccaggccgggccagcgccagccccagcctggatgtgctgatcaccctgctgagcctgggcagcaatggctacaagaagctgctgaaggagaggaaggagatgttctcctacctgagcaaccagatcaagaagctgtctgaggcctacaatgaaaggctgctgcacaccccccacaaccccatcagcctggccatgaccctgaagaccctggatgagcaccgggacaaggctgtgacccagctgggctccatgctgttcacccggcaggtgtctggggcccgggtggtgcccctgggctccatgcagacagtgtctggctacaccttccggggcttcatgagccacaccaacaactacccctgtgcctacctgaatgctgccagcgccatcggcatgaagatgcaggatgtggacctcttcatcaagaggctggaccgctgcctgaaggctgtgaggaaggagaggagcaaggagagtgatgacaactatgacaagacagaagatgtggacatcgaggagatggccctgaagctggacaacgtgctgctggacacctaccaggatgccagcagctag

SEQ ID NO: 169135 - DNA, 1506 bp, Artificial Sequence
  Description of Artificial Sequence: Synthetic coding sequence
atgaaccgggagagctttgctgctggggagcggctggtgtccccagcctacgtgcggcagggctgtgaggcccggcgcagccatgagcacctgatccggctgctgctggagaagggcaagtgcccagaaaatggctgggatgagagcaccctggagctgttcctgcacgagctggccatcatggacagcaacaacttcctgggcaactgtggggtgggggagcgggagggccgggtggccagcgccctggtggcccggcggcactaccgcttcatccatggaattggccgcagcggggacatctctgctgtgcagcccaaggctgctggcagcagcctgctgaacaagatcaccaacagcctggtgctggacatcatcaagctggccggcgtgcacacagtggccaactgctttgtggtgcccatggccaccggcatgagcctgaccctgtgcttcctgaccctgcggcacaagaggcccaaggccaagtacatcatctggcccagaattgaccagaagagctgcttcaagtccatgatcacagctggctttgagcctgtggtgattgaaaatgtgctggagggagatgagctgaggacagacctgaaggctgtggaggccaaggtgcaggagctgggccctgactgcatcctgtgcatccacagcaccaccagctgctttgccccccgggtgcctgaccggctggaggagctggccgtcatctgtgccaactatgacatcccccacatcgtgaacaatgcctatggagtgcagagcagcaagtgcatgcacctgatccagcagggcgcccgggtgggcagaattgatgcctttgtgcagagcctggacaagaacttcatggtgcctgtgggcggggccatcatcgccggcttcaatgacagcttcatccaggagatcagcaagatgtacccaggccgggccagcgccagccccagcctggatgtgctgatcaccctgctgagcctgggcagcaatggctacaagaagctgctgaaggagaggaaggagatgttctcctacctgagcaaccagatcaagaagctgtctgaggcctacaatgaaaggctgctgcacaccccccacaaccccatcagcctggccatgaccctgaagaccctggatgagcaccgggacaaggctgtgacccagctgggctccatgctgttcacccggcaggtgtctggggcccgggtggtgcccctgggctccatgcagacagtgtctggctacaccttccggggcttcatgagccacaccaacaactacccctgtgcctacctgaatgctgccagcgccatcggcatgaagatgcaggatgtggacctcttcatcaagaggctggaccgctgcctgaaggctgtgaggaaggagaggagcaaggagagtgatgacaactatgacaagacagaagatgtggacatcgaggagatggccctgaagctggacaacgtgctgctggacacctaccaggatgccagcagctag

SEQ ID NO: 169136 - DNA, 903 bp, Artificial Sequence
  Description of Artificial Sequence: Synthetic coding sequence
atggagggcgtgctgtacaagtggaccaactacctgaccggctggcagccccgctggtttgtgctggacaatggcatcctgagctactatgacagccaggatgatgtgtgcaagggcagcaagggcagcatcaagatggctgtgtgtgagatcaaggtgcacagcgctgacaacaccaggatggagctgatcatccctggagagcagcacttctacatgaaggctgtgaatgctgctgagcggcagcgctggctggtggccctgggcagcagcaaggcctgcctgacagacaccaggaccaagaaggagaaggagatcagcgagaccagcgagagcctgaagaccaagatgtctgagctgcggctgtactgtgacctgctgatgcagcaggtgcacaccatccaggagtttgtgcaccatgatgagaaccacagcagccccagcgctgagaacatgaatgaggccagcagcctgctgagcgccacctgcaacaccttcatcaccaccctggaggagtgtgtgaagatcgccaatgccaagttcaagccagagatgttccagctgcaccacccagaccccctggtgtcccctgtgagccccagccctgtgcagatgatgaagaggtctgtgagccaccctggcagctgcagcagcgagaggagcagccacagcatcaaggagcctgtgtccaccctgcaccggctgagccagaggagaagaaggacctacagcgacacagacagctgcagcgacatccccctggaggaccctgacaggcctgtgcactgcagcaagaacaccctgaatggagacctggccagcgccaccatccctgaggagagccggctgatggccaagaagcagagcgagagcgaggacaccctgcccagcttcagcagctag

SEQ ID NO: 169137 - DNA, 1104 bp, Artificial Sequence
  Description of Artificial Sequence: Synthetic coding sequence
atggacaaggagtatgtgggctttgctgccctgcccaaccagctgcacaggaagtctgtgaagaagggctttgacttcaccctgatggtggccggggagagcggcctgggcaagagcaccctcatcaacagcctcttcctgaccaacctgtatgaggaccggcaggtgcctgaggccagcgcccggctgacccagaccctggccattgaaagaagaggagtggagattgaggagggcggcgtgaaggtgaagctgaccctggtggacaccccaggctttggagacagcgtggactgcagcgactgctggctgcctgtggtgaagttcatcgaggagcagtttgagcagtacctgagagatgagagcggcctgaacaggaagaacatccaggacagccgggtgcactgctgcctgtacttcatcagccccttcggccggggcctgcggcccctggatgtggccttcctgcgggctgtgcatgagaaggtgaacatcatccctgtgattggcaaggcagatgccctgatgccccaggagacccaggccctgaagcagaagatccgggaccagctgaaggaggaggagatccacatctaccagttcccagaatgtgacagtgatgaagatgaggacttcaagaggcaggatgctgagatgaaggagagcatcccctttgctgtggtgggcagctgtgaggtggtgagagatggcggcaacagacctgtgcggggccgccgctacagctggggcaccgtggaggtggagaacccccaccactgtgacttcctgaacctgcggaggatgctggtgcagacccacctgcaggacctgaaggaggtgacccatgacctgctgtatgagggctaccgggcccgctgcctgcagagcctggcccggcctggggcccgggaccgggccagccgcagcaagctgagccggcagagcgccacagagatccccctgcccatgctgcccctggccgacacagagaagctgatccgggagaaggatgaggagctgcggaggatgcaggagatgctggagaagatgcaggcccagatgcagcagagccaggcccagggcgagcagagtgatgccctgtag

SEQ ID NO: 169138 - DNA, 1104 bp, Artificial Sequence; identical to SEQ ID NO: 169137
  Description of Artificial Sequence: Synthetic coding sequence

SEQ ID NO: 169139 - DNA, 966 bp, Artificial Sequence
  Description of Artificial Sequence: Synthetic coding sequence
atgatgaaccgctactaccagcccatcgtggactacattgatgcccagtttgaggcctacctgcaggaggagctgaagatcaagaggagcctcttcacctaccatgacagccgcatccacgtgtgcctgtacttcatcagccccaccggccacagcctgaagaccctggacctgctgaccatgaagaacctggacagcaaggtgaacatcatccctgtgattgccaaggctgacacagtgtccaagacagagctgcagaagttcaagatcaagctgatgtctgagctggtgtccaatggagtgcagatctaccagttccccacagatgatgacaccatcgccaaggtgaatgctgccatgaatggccagctgccctttgctgtggtgggctccatggatgaggtgaaggtgggcaacaagatggtgaaggcccggcagtacccctggggcgtggtgcaggtggagaatgaaaaccactgtgactttgtgaagctgcgggagatgctgatctgcaccaacatggaggacctgcgggagcagacccacaccaggcactatgagctgtaccgccgctgcaagctggaggagatgggcttcacagatgtgggccctgagaacaagcctgtgtctgtgcaggagacctatgaggccaagagacatgagttccatggagagcggcagaggaaggaggaggagatgaagcagatgtttgtgcagagggtgaaggagaaggaggccatcctgaaggaggccgagcgggagctgcaggccaagtttgagcacctgaagaggctgcaccaggaggagaggatgaagctggaggagaagaggcggctgctggaggaggagatcatcgccttcagcaagaagaaggccaccagcgagatcttccacagccagagcttcctggccaccggcagcaacctgaggaaggacaaggacaggaagaacagcaacttcctgtag

SEQ ID NO: 169140 - DNA, 954 bp, Artificial Sequence
  Description of Artificial Sequence: Synthetic coding sequence
atgagcggccacgtgggctttgagagcctgcctgaccagctggtgaacagaagcatccagcagggcttctgcttcaacatcctgtgtgtgggggagactggaattggcaagagcaccctgattgacaccctcttcaacaccaactttgaggactatgagagcagccacttctgccccaacgtgaagctgaaggcccagacctatgagctgcaggagagcaatgtgcagctgaagctgaccatcgtgaacacagtgggctttggagaccagatcaacaaggaggagagctaccagcccatcgtggactacattgatgcccagtttgaggcctacctgcaggaggagctgaagatcaagaggagcctcttcacctaccatgacagccgcatccacgtgtgcctgtacttcatcagccccaccggccacagcctgaagaccctggacctgctgaccatgaagaacctggacagcaaggtgaacatcatccctgtgattgccaaggctgacacagtgtccaagacagagctgcagaagttcaagatcaagctgatgtctgagctggtgtccaatggagtgcagatctaccagttccccacagatgatgacaccatcgccaaggtgaatgctgccatgaatggccagctgccctttgctgtggtgggctccatggatgaggtgaaggtgggcaacaagatggtgaaggcccggcagtacccctggggcgtggtgcaggtggagaatgaaaaccactgtgactttgtgaagctgcgggagatgctgatctgcaccaacatggaggacctgcgggagcagacccacaccaggcactatgagctgtaccgccgctgcaagctggaggagatgggcttcacagatgtgggccctgagaacaagcctgtgtcctaccggcccaacctgagcaccctgcgggacttcaccaagaagcgggagtag

SEQ ID NO: 169141 - DNA, 1635 bp, Artificial Sequence
  Description of Artificial Sequence: Synthetic coding sequence
atggccagcagcgaggtggcccggcacctgctcttccagagccacatggccaccaagaccacctgcatgagcagccagggcagtgatgatgagcagatcaagcgggagaacatccgcagcctgaccatgagcggccacgtgggctttgagagcctgcctgaccagctggtgaacagaagcatccagcagggcttctgcttcaacatcctgtgtgtgggggagactggaattggcaagagcaccctgattgacaccctcttcaacaccaactttgaggactatgagagcagccacttctgccccaacgtgaagctgaaggcccagacctatgagctgcaggagagcaatgtgcagctgaagctgaccatcgtgaacacagtgggctttggagaccagatcaacaaggaggagagctaccagcccatcgtggactacattgatgcccagtttgaggcctacctgcaggaggagctgaagatcaagaggagcctcttcacctaccatgacagccgcatccacgtgtgcctgtacttcatcagccccaccggccacagcctgaagaccctggacctgctgaccatgaagaacctggacagcaaggtgaacatcatccctgtgattgccaaggctgacacagtgtccaagacagagctgcagaagttcaagatcaagctgatgtctgagctggtgtccaatggagtgcagatctaccagttccccacagatgatgacaccatcgccaaggtgaatgctgccatgaatggccagctgccctttgctgtggtgggctccatggatgaggtgaaggtgggcaacaagatggtgaaggcccggcagtacccctggggcgtggtgcaggtggagaatgaaaaccactgtgactttgtgaagctgcgggagatgctgatctgcaccaacatggaggacctgcgggagcagacccacaccaggcactatgagctgtaccgccgctgcaagctggaggagatgggcttcacagatgtgggccctgagaacaagcctgtgtctgtgcaggagacctatgaggccaagagacatgagttccacggggagcggcagaggaaggaggaggagatgaagcagatgtttgtgcagagggtgaaggagaaggaggccatcctgaaggaggccgagcgggagctgcaggccaagtttgagcacctgaagaggctgcaccaggaggagaggatgaagctggaggagaagaggcggctgctggaggaggagatcatcgccttcagcaagaagaaggccaccagcgagatcttccacagccagagcttcctggccaccggcagcaacctgaggaaggacaaggacaggaagaaggagcccggctgccgctttgagctgctgtgcattgatgtgcgggcctgtgagaccaatggaggcaggaaggatgctgagaaggcccccatcttctgcaagacagaggtgcctgagcaccggcgcagcagcagccaggccaacttcatcaagaagaagctggaggtgtgctttgattttgctgtgatctgcttcatcaccagcatctttggagagcagccccagctgctgatcttcatggagaagtacttccaggtgcagggccagtacatcagccagagcgagtag

SEQ ID NO: 169142 - DNA, 1365 bp, Artificial Sequence
  Description of Artificial Sequence: Synthetic coding sequence
atggccagcagcgaggtggcccggcacctgctcttccagagccacatggccaccaagaccacctgcatgagcagccagggcagtgatgatgagcagatcaagcgggagaacatccgcagcctgaccatgagcggccacgtgggctttgagagcctgcctgaccagctggtgaacagaagcatccagcagggcttctgcttcaacatcctgtgtgtgggggagactggaattggcaagagcaccctgattgacaccctcttcaacaccaactttgaggactatgagagcagccacttctgccccaacgtgaagctgaaggcccagacctatgagctgcaggagagcaatgtgcagctgaagctgaccatcgtgaacacagtgggctttggagaccagatcaacaaggaggagagctaccagcccatcgtggactacattgatgcccagtttgaggcctacctgcaggaggagctgaagatcaagaggagcctcttcacctaccatgacagccgcatccacgtgtgcctgtacttcatcagccccaccggccacagcctgaagaccctggacctgctgaccatgaagaacctggacagcaaggtgaacatcatccctgtgattgccaaggctgacacagtgtccaagacagagctgcagaagttcaagatcaagctgatgtctgagctggtgtccaatggagtgcagatctaccagttccccacagatgatgacaccatcgccaaggtgaatgctgccatgaatggccagctgccctttgctgtggtgggctccatggatgaggtgaaggtgggcaacaagatggtgaaggcccggcagtacccctggggcgtggtgcaggtggagaatgaaaaccactgtgactttgtgaagctgcgggagatgctgatctgcaccaacatggaggacctgcgggagcagacccacaccaggcactatgagctgtaccgccgctgcaagctggaggagatgggcttcacagatgtgggccctgagaacaagcctgtgtctgtgcaggagacctatgaggccaagagacatgagttccacggggagcggcagaggaaggaggaggagatgaagcagatgtttgtgcagagggtgaaggagaaggaggccatcctgaaggaggccgagcgggagctgcaggccaagtttgagcacctgaagaggctgcaccaggaggagaggatgaagctggaggagaagaggcggctgctggaggaggagatcatcgccttcagcaagaagaaggccaccagcgagatcttccacagccagagcttcctggccaccggcagcaacctgaggaaggacaaggacaggaagaacagcaacttcctgtag

SEQ ID NO: 169143 - DNA, 1296 bp, Artificial Sequence
  Description of Artificial Sequence: Synthetic coding sequence
atggccagcagcgaggtggcccggcacctgaagcgggagaacatccgcagcctgaccatgagcggccacgtgggctttgagagcctgcctgaccagctggtgaacagaagcatccagcagggcttctgcttcaacatcctgtgtgtgggggagaccggcatcggcaagagcaccctgattgacaccctcttcaacaccaactttgaagattatgagagcagccacttctgccccaacgtgaagctgaaggcccagacctatgagctgcaggagagcaatgtgcagctgaagctgaccatcgtgaacacagtgggctttggagaccagatcaacaaggaggagagctaccagcccatcgtggactacattgatgcccagtttgaggcctacctgcaggaggagctgaagatcaagaggagcctcttcacctaccatgacagccgcatccacgtgtgcctgtacttcatcagccccaccggccacagcctgaagaccctggacctgctgaccatgaagaacctggacagcaaggtgaacatcatccctgtgattgccaaggctgacacagtgtccaagacagagctgcagaagttcaagatcaagctgatgtctgagctggtgtccaatggagtgcagatctaccagttccccacagatgatgacaccatcgccaaggtgaatgctgccatgaatggccagctgccctttgctgtggtgggctccatggatgaggtgaaggtgggcaacaagatggtgaaggcccggcagtacccctggggcgtggtgcaggtggagaatgaaaaccactgtgactttgtgaagctgcgggagatgctgatctgcaccaacatggaggacctgcgggagcagacccacaccaggcactatgagctgtaccgccgctgcaagctggaggagatgggcttcacagatgtgggccctgagaacaagcctgtgtctgtgcaggagacctatgaggccaagagacatgagttccatggagagcggcagaggaaggaggaggagatgaagcagatgtttgtgcagagggtgaaggagaaggaggccatcctgaaggaggccgagcgggagctgcaggccaagtttgagcacctgaagaggctgcaccaggaggagaggatgaagctggaggagaagaggcggctgctggaggaggagatcatcgccttcagcaagaagaaggccaccagcgagatcttccacagccagagcttcctggccaccggcagcaacctgaggaaggacaaggacaggaagaacagcaacttcctgtag

SEQ ID NO: 169144 - DNA, 1353 bp, Artificial Sequence
  Description of Artificial Sequence: Synthetic coding sequence
atggccagcagcgaggtggcccggcacctgctcttccagagccacatggccaccaagaccacctgcatgagcagccagggcagtgatgatgagcagatcaagcgggagaacatccgcagcctgaccatgagcggccacgtgggctttgagagcctgcctgaccagctggtgaacagaagcatccagcagggcttctgcttcaacatcctgtgtgtgggggagactggaattggcaagagcaccctgattgacaccctcttcaacaccaactttgaggactatgagagcagccacttctgccccaacgtgaagctgaaggcccagacctatgagctgcaggagagcaatgtgcagctgaagctgaccatcgtgaacacagtgggctttggagaccagatcaacaaggaggagagctaccagcccatcgtggactacattgatgcccagtttgaggcctacctgcaggaggagctgaagatcaagaggagcctcttcacctaccatgacagccgcatccacgtgtgcctgtacttcatcagccccaccggccacagcctgaagaccctggacctgctgaccatgaagaacctggacagcaaggtgaacatcatccctgtgattgccaaggctgacacagtgtccaagacagagctgcagaagttcaagatcaagctgatgtctgagctggtgtccaatggagtgcagatctaccagttccccacagatgatgacaccatcgccaaggtgaatgctgccatgaatggccagctgccctttgctgtggtgggctccatggatgaggtgaaggtgggcaacaagatggtgaaggcccggcagtacccctggggcgtggtgcaggtggagaatgaaaaccactgtgactttgtgaagctgcgggagatgctgatctgcaccaacatggaggacctgcgggagcagacccacaccaggcactatgagctgtaccgccgctgcaagctggaggagatgggcttcacagatgtgggccctgagaacaagcctgtgtctgtgcaggagacctatgaggccaagagacatgagttccacggggagcggcagaggaaggaggaggagatgaagcagatgtttgtgcagagggtgaaggagaaggaggccatcctgaaggaggccgagcgggagctgcaggccaagtttgagcacctgaagaggctgcaccaggaggagaggatgaagctggaggagaagaggcggctgctggaggaggagatcatcgccttcagcaagaagaaggccaccagcgagatcttccacagccagagcttcctggccaccggcagcaacctgaggaaggacaaggacaggaagaagtag

SEQ ID NO: 169145 - DNA, 1422 bp, Artificial Sequence
  Description of Artificial Sequence: Synthetic coding sequence
atggccaccaagaccacctgcatgagcagccagggcagtgatgatgagcagatcaagcgggagaacatccgcagcctgaccatgagcggccacgtgggctttgagagcctgcctgaccagctggtgaacagaagcatccagcagggcttctgcttcaacatcctgtgtgtgggggagaccggcatcggcaagagcaccctgattgacaccctcttcaacaccaactttgaagattatgagagcagccacttctgccccaacgtgaagctgaaggcccagacctatgagctgcaggagagcaatgtgcagctgaagctgaccatcgtgaacacagtgggctttggagaccagatcaacaaggaggagagctaccagcccatcgtggactacattgatgcccagtttgaggcctacctgcaggaggagctgaagatcaagaggagcctcttcacctaccatgacagccgcatccacgtgtgcctgtacttcatcagccccaccggccacagcctgaagaccctggacctgctgaccatgaagaacctggacagcaaggtgaacatcatccctgtgattgccaaggctgacacagtgtccaagacagagctgcagaagttcaagatcaagctgatgtctgagctggtgtccaatggagtgcagatctaccagttccccacagatgatgacaccatcgccaaggtgaatgctgccatgaatggccagctgccctttgctgtggtgggctccatggatgaggtgaaggtgggcaacaagatggtgaaggcccggcagtacccctggggcgtggtgcaggtggagaatgaaaaccactgtgactttgtgaagctgcgggagatgctgatctgcaccaacatggaggacctgcgggagcagacccacaccaggcactatgagctgtaccgccgctgcaagctggaggagatgggcttcacagatgtgggccctgagaacaagcctgtgtctgtgcaggagacctatgaggccaagagacatgagttccatggagagcggcagaggaaggaggaggagatgaagcagatgtttgtgcagagggtgaaggagaaggaggccatcctgaaggaggccgagcgggagctgcaggccaagtttgagcacctgaagaggctgcaccaggaggagaggatgaagctggaggagaagaggcggctgctggaggaggagatcatcgccttcagcaagaagaaggccaccagcgagatcttccacagccagagcttcctggccaccggcagcaacctgaggaaggacaaggacaggaagaaggagcccggctgccgctttgagctgctgtgcattgatgtgcgggcctgtgagaccaacggcggcaggaaggatgctgagaagggccgggagggccacagcgcccggggccagccctag

SEQ ID NO: 169146 - DNA, 852 bp, Artificial Sequence
  Description of Artificial Sequence: Synthetic coding sequence
atggccagcagcgaggtggcccggcacctgctcttccagagccacatggccaccaagaccacctgcatgagcagccagggcagtgatgatgagcagatcgtgaacatcatccctgtgattgccaaggctgacacagtgtccaagacagagctgcagaagttcaagatcaagctgatgtctgagctggtgtccaatggagtgcagatctaccagttccccacagatgatgacaccatcgccaaggtgaatgctgccatgaatggccagctgccctttgctgtggtgggctccatggatgaggtgaaggtgggcaacaagatggtgaaggcccggcagtacccctggggcgtggtgcaggtggagaatgaaaaccactgtgactttgtgaagctgcgggagatgctgatctgcaccaacatggaggacctgcgggagcagacccacaccaggcactatgagctgtaccgccgctgcaagctggaggagatgggcttcacagatgtgggccctgagaacaagcctgtgtctgtgcaggagacctatgaggccaagagacatgagttccatggagagcggcagaggaaggaggaggagatgaagcagatgtttgtgcagagggtgaaggagaaggaggccatcctgaaggaggccgagcgggagctgcaggccaagtttgagcacctgaagaggctgcaccaggaggagaggatgaagctggaggagaagaggcggctgctggaggaggagatcatcgccttcagcaagaagaaggccaccagcgagatcttccacagccagagcttcctggccaccggcagcaacctgaggaaggacaaggacaggaagaagtag

SEQ ID NO: 169147 - DNA, 1290 bp, Artificial Sequence
  Description of Artificial Sequence: Synthetic coding sequence
atggctgtggccgtgggccggcccagcaatgaggagctgaggaacctgagcctgagcggccacgtgggctttgacagcctgcctgaccagctggtgaacaagagcaccagccagggcttctgcttcaacatcctgtgtgtgggggagaccggcatcggcaagagcaccctgatggacaccctcttcaacaccaagtttgaaagtgaccctgccacccacaatgagcccggggtgcggctgaaggcccggagctatgagctgcaggagagcaatgtgcggctgaagctgaccatcgtggacacagtgggctttggagaccagatcaacaaggatgacagctacaagcccatcgtggagtacattgatgcccagtttgaggcctacctgcaggaggagctgaagatcaagaggagcctcttcaactaccatgacacccgcatccacgcctgcctgtacttcatcgcccccaccggccacagcctgaagagcctggacctggtgaccatgaagaagctggacagcaaggtgaacatcatccccatcatcgccaaggctgacaccatcgccaagaatgagctgcacaagttcaagagcaagatcatgtctgagctggtgtccaatggagtgcagatctaccagttccccacagatgaggagaccgtggccgagatcaatgccaccatgtctgtgcacctgccctttgctgtggtgggcagcacagaggaggtgaagattggcaacaagatggccaaggcccggcagtacccctggggcgtggtgcaggtggagaatgaaaaccactgtgactttgtgaagctgcgggagatgctgatccgggtgaacatggaggacctgcgggagcagacccacaccaggcactatgagctgtaccgccgctgcaagctggaggagatgggcttcaaggacacagatcctgacagcaagcccttcagcctgcaggagacctatgaggccaagagaaatgagttcctgggggagctgcagaagaaggaggaggagatgaggcagatgtttgtgatgagggtgaaggagaaggaggccgagctgaaggaggccgagaaggagctgcacgagaagtttgacctgctgaagaggacccaccaggaggagaagaagaaggtggaggacaagaagaaggagctggaggaggaggtgaacaacttccagaagaagaaggctgctgcccagctgctgcagagccaggcccagcagagcggggcccagcagaccaagaaggacaaggacaagaagaatgccagcttcacctag

SEQ ID NO: 169148 - DNA, 1278 bp, Artificial Sequence
  Description of Artificial Sequence: Synthetic coding sequence
atggctgtggccgtgggccggcccagcaatgaggagctgaggaacctgagcctgagcggccacgtgggctttgacagcctgcctgaccagctggtgaacaagagcaccagccagggcttctgcttcaacatcctgtgtgtgggggagaccggcatcggcaagagcaccctgatggacaccctcttcaacaccaagtttgaaagtgaccctgccacccacaatgagcccggggtgcggctgaaggcccggagctatgagctgcaggagagcaatgtgcggctgaagctgaccatcgtggacacagtgggctttggagaccagatcaacaaggatgacagctacaagcccatcgtggagtacattgatgcccagtttgaggcctacctgcaggaggagctgaagatcaagaggagcctcttcaactaccatgacacccgcatccacgcctgcctgtacttcatcgcccccaccggccacagcctgaagagcctggacctggtgaccatgaagaagctggacagcaaggtgaacatcatccccatcatcgccaaggctgacaccatcgccaagaatgagctgcacaagttcaagagcaagatcatgtctgagctggtgtccaatggagtgcagatctaccagttccccacagatgaggagaccgtggccgagatcaatgccaccatgtctgtgcacctgccctttgctgtggtgggcagcacagaggaggtgaagattggcaacaagatggccaaggcccggcagtacccctggggcgtggtgcaggtggagaatgaaaaccactgtgactttgtgaagctgcgggagatgctgatccgggtgaacatggaggacctgcgggagcagacccacaccaggcactatgagctgtaccgccgctgcaagctggaggagatgggcttcaaggacacagatcctgacagcaagcccttcagcctgcaggagacctatgaggccaagagaaatgagttcctgggggagctgcagaagaaggaggaggagatgaggcagatgtttgtgatgagggtgaaggagaaggaggccgagctgaaggaggccgagaaggagctgcacgagaagtttgacctgctgaagaggacccaccaggaggagaagaagaaggtggaggacaagaagaaggagctggaggaggaggtgaacaacttccagaagaagaaggctgctgcccagctgctgcagagccaggcccagcagagcggggcccagcagaccaagaaggacaaggacaagaagaagtag

SEQ ID NO: 169149 - DNA, 1320 bp, Artificial Sequence
  Description of Artificial Sequence: Synthetic coding sequence
atggaggagaggaagccagcccacgtgctgcggagcttcaagtatgctgccttcatgaatgaggagctgaggaacctgagcctgagcggccacgtgggctttgacagcctgcctgaccagctggtgaacaagagcaccagccagggcttctgcttcaacatcctgtgtgtgggggagaccggcatcggcaagagcaccctgatggacaccctcttcaacaccaagtttgaaagtgaccctgccacccacaatgagcccggggtgcggctgaaggcccggagctatgagctgcaggagagcaatgtgcggctgaagctgaccatcgtggacacagtgggctttggagaccagatcaacaaggatgacagctacaagcccatcgtggagtacattgatgcccagtttgaggcctacctgcaggaggagctgaagatcaagaggagcctcttcaactaccatgacacccgcatccacgcctgcctgtacttcatcgcccccaccggccacagcctgaagagcctggacctggtgaccatgaagaagctggacagcaaggtgaacatcatccccatcatcgccaaggctgacaccatcgccaagaatgagctgcacaagttcaagagcaagatcatgtctgagctggtgtccaatggagtgcagatctaccagttccccacagatgaggagaccgtggccgagatcaatgccaccatgtctgtgcacctgccctttgctgtggtgggcagcacagaggaggtgaagattggcaacaagatggccaaggcccggcagtacccctggggcgtggtgcaggtggagaatgaaaaccactgtgactttgtgaagctgcgggagatgctgatccgggtgaacatggaggacctgcgggagcagacccacaccaggcactatgagctgtaccgccgctgcaagctggaggagatgggcttcaaggacacagatcctgacagcaagcccttcagcctgcaggagacctatgaggccaagagaaatgagttcctgggggagctgcagaagaaggaggaggagatgaggcagatgtttgtgatgagggtgaaggagaaggaggccgagctgaaggaggccgagaaggagctgcacgagaagtttgacctgctgaagaggacccaccaggaggagaagaagaaggtggaggacaagaagaaggagctggaggaggaggtgaacaacttccagaagaagaaggctgctgcccagctgctgcagagccaggcccagcagagcggggcccagcagaccaagaaggacaaggacaagaagaatgccagcttcacctag

SEQ ID NO: 169150 - DNA, 1077 bp, Artificial Sequence
  Description of Artificial Sequence: Synthetic coding sequence
atggaccccctgcggcgcagccccagcccctgcctgagcagccagcccagcagccccagcaccccaccctgtgagatgctgggccctgtgggcatcgaggccgtgctggaccagctgaagatcaaggccatgaagatgggctttgagttcaacatcatggtggtgggccagagcggcctgggcaagagcaccatggtgaacaccctcttcaagagcaaggtgtggaagagcaaccccccaggcctgggcgtgcccaccccccagaccctgcagctgcacagcctgacccacgtgattgaggagaagggcgtgaagctgaagctgactgtgacagacaccccaggctttggagaccagatcaacaatgacaactgctgggaccccatcctgggctacatcaatgagcagtatgagcagtacctgcaggaggagatcctgatcacccggcagaggcacatcccagacaccagggtgcactgctgcgtgtactttgtgccccccaccggccactgcctgcggcccctggacatcgagttcctgcagaggctgtgcaggacagtgaatgtggtgcctgtgattgcccgggctgacagcctgaccatggaggagcgggaggccttcagaagacgcatccagcagaacctgcggacccactgcattgatgtgtacccccagatgtgctttgatgaggacatcaatgacaagatcctgaacagcaagctgcgggaccgcatcccctttgctgtggtgggcgctgaccaggagcacctggtgaatggccgctgtgtgctgggcaggaagaccaagtggggcatcatcgaggtggagaacatggcccactgtgagttccccctgctgcgggacctgctgatccgcagccacctgcaggacctgaaggacatcacccacaacatccactatgagaactacagagtcatccggctgaatgaaagccacctgctgccccggggccctggctgggtgaacctggccccagccagccctggccagctgaccacccccaggaccttcaaggtgtgccgcggggcccatgatgacagtgatgatgagttctag

SEQ ID NO: 169151 - DNA, 939 bp, Artificial Sequence
  Description of Artificial Sequence: Synthetic coding sequence
atggaccccctgcggcgcagccccagcccctgcctgagcagccagcccagcagccccagcaccccaccctgtgagatgctgggccctgtgggcatcgaggccgtgctggaccagctgaagatcaaggccatgaagatgggctttgagttcaacatcatggtggtgggccagagcggcctgggcaagagcaccatggtgaacaccctcttcaagagcaaggtgtggaagagcaaccccccaggcctgggcgtgcccaccccccagaccctgcagctgcacagcctgacccacgtgattgaggagaagggcgtgaagctgaagctgactgtgacagacaccccaggctttggagaccagatcaacaatgacaactgcctgcggcccctggacatcgagttcctgcagaggctgtgcaggacagtgaatgtggtgcctgtgattgcccgggctgacagcctgaccatggaggagcgggaggccttcagaagacgcatccagcagaacctgcggacccactgcattgatgtgtacccccagatgtgctttgatgaggacatcaatgacaagatcctgaacagcaagctgcgggaccgcatcccctttgctgtggtgggcgctgaccaggagcacctggtgaatggccgctgtgtgctgggcaggaagaccaagtggggcatcatcgaggtggagaacatggcccactgtgagttccccctgctgcgggacctgctgatccgcagccacctgcaggacctgaaggacatcacccacaacatccactatgagaactacagagtcatccggctgaatgaaagccacctgctgccccggggccctggctgggtgaacctggccccagccagccctggccagctgaccacccccaggaccttcaaggtgtgccgcggggcccatgatgacagtgatgatgagttctag

SEQ ID NO: 169152 - DNA, 1299 bp, Artificial Sequence
  Description of Artificial Sequence: Synthetic coding sequence
atggccgagaggaccatggccatgcccacccagatcccagcagatggagacacccagaaggagaacaacatccgctgcctgaccaccatcggccactttggatttgagtgcctgcccaaccagctggtgagccgcagcatccggcagggcttcaccttcaacatcctgtgtgtgggggagactggaattggcaagagcaccctgattgacaccctcttcaacaccaacctgaaggacaacaagagcagccacttctacagcaatgtgggcctgcagatccagacctatgagctgcaggagagcaatgtgcagctgaagctgactgtggtggagaccgtgggctatggagaccagattgacaaggaggccagctaccagcccatcgtggactacattgatgcccagtttgaggcctacctgcaggaggagctgaagatcaagaggagcctgtttgagtaccatgacagccgggtgcacgtgtgcctgtacttcatcagccccaccggccacagcctgaagagcctggacctgctgaccatgaagaacctggacagcaaggtgaacatcatccccctgattgccaaggctgacaccatcagcaagaatgacctgcagaccttcaagaacaagatcatgtctgagctgatcagcaatggcatccagatctaccagctgcccacagatgaggagacagctgcccaggccaacagctctgtgtctggcctgctgccctttgctgtggtgggcagcacagatgaggtgaaggtgggcaagaggatggtgcggggccgccactacccctggggcgtgctgcaggtggagaatgaaaaccactgtgactttgtgaagctgcgggacatgctgctgtgcaccaacatggagaacctgaaggagaagacccacacccagcactatgagtgctaccgctaccagaagctgcagaagatgggcttcacagatgtgggccccaacaaccagcctgtgtccttccaggagatctttgaggccaagaggcaggagttctatgaccagtgccagcgggaggaggaggagctgaagcagcgcttcatgcagagggtgaaggagaaggaggccaccttcaaggaggccgagaaggagctgcaggacaagtttgagcacctgaagatgatccagcaggaggagatcaggaagctggaggaggagaagaagcagctggagggggagatcatcgacttctacaagatgaaggccgccagcgaggccctgcagacccagctgagcacagacaccaagaaggacaagcacaggaagaagtag

SEQ ID NO: 169153 - DNA, 1086 bp, Artificial Sequence
  Description of Artificial Sequence: Synthetic coding sequence
atgagcaagcagcagcccacccagttcatcaaccctgagaccccaggctacgtgggctttgccaacctgcccaaccaggtgcacaggaagtctgtgaagaagggctttgagttcaccctgatggtggtgggggagagcggcctgggcaagagcaccctcatcaacagcctcttcctgacagacctgtacccagagagggtcatccctggagctgctgagaagattgaaagaacagtgcagatcgaggccagcacagtggagattgaggagcggggcgtgaagctgcggctgactgtggtggacaccccaggctatggagatgccatcaactgccgggactgcttcaagaccatcatctcctacattgatgagcagtttgagcgctacctgcatgatgagagcggcctgaacagaagacacatcatcgacaacagagtgcactgctgcttctacttcatcagccccttcggccacggcctgaagcccctggatgtggccttcatgaaggccatccacaacaaggtgaacatcgtgcctgtgattgccaaggctgacaccctgaccctgaaggagcgggagcggctgaagaagaggatcctggatgaaattgaggagcacaacatcaagatctaccacctgcctgatgctgagagtgatgaagatgaggacttcaaggagcagacccggctgctgaaggccagcatccccttctctgtggtgggcagcaaccagctgattgaggccaagggcaagaaggtgcggggccgcctgtacccctggggcgtggtggaggtggagaaccctgagcacaatgacttcctgaagctgcggaccatgctgatcacccacatgcaggacctgcaggaggtgacccaggacctgcactatgagaacttccgctctgagcggctgaagagaggaggcaggaaggtggagaatgaagacatgaacaaggaccagatcctgctggagaaggaggccgagctgcggaggatgcaggagatgattgccaggatgcaggcccagatgcagatgcagatgcagggcggagatggagatggaggagccctgggccaccacgtgtag

SEQ ID NO: 169154 - DNA, 1086 bp, Artificial Sequence; identical to SEQ ID NO: 169153
  Description of Artificial Sequence: Synthetic coding sequence

SEQ ID NO: 169155 - DNA, 1191 bp, Artificial Sequence
  Description of Artificial Sequence: Synthetic coding sequence
atgccctggatcagcgagggccgggccacccggccctgcctgcgggtgcccagcgccaggagaggagatgagggcctgcaccagagagatgaggccagccagaagatgagcaagcagcagcccacccagttcatcaaccctgagaccccaggctacgtgggctttgccaacctgcccaaccaggtgcacaggaagtctgtgaagaagggctttgagttcaccctgatggtggtgggggagagcggcctgggcaagagcaccctcatcaacagcctcttcctgacagacctgtacccagagagggtcatccctggagctgctgagaagattgaaagaacagtgcagatcgaggccagcacagtggagattgaggagcggggcgtgaagctgcggctgactgtggtggacaccccaggctatggagatgccatcaactgccgggactgcttcaagaccatcatctcctacattgatgagcagtttgagcgctacctgcatgatgaaagtggcctgaacagaagacacatcatcgacaacagagtgcactgctgcttctacttcatcagcccctttggacatggcctgaagcccctggatgtggccttcatgaaggccatccacaacaaggtgaacatcgtgcctgtgattgccaaggctgacaccctgaccctgaaggagcgggagcggctgaagaagaggatcctggatgaaattgaggagcacaacatcaagatctaccacctgcctgatgctgagagtgatgaagatgaggacttcaaggagcagacccggctgctgaaggccagcatccccttctctgtggtgggcagcaaccagctgattgaggccaagggcaagaaggtgcggggccgcctgtacccctggggcgtggtggaggtggagaaccctgagcacaatgacttcctgaagctgcggaccatgctgatcacccacatgcaggacctgcaggaggtgacccaggacctgcactatgagaacttccgctctgagcggctgaagaggggcggcaggaaggtggagaatgaagacatgaacaaggaccagatcctgctggagaaggaggccgagctgcggaggatgcaggagatgattgccaggatgcaggcccagatgcagatgcagatgcagggcggagatggagatggaggagccctgggccaccacgtgtag

SEQ ID NO: 169156 - DNA, 1086 bp, Artificial Sequence; identical to SEQ ID NO: 169153
  Description of Artificial Sequence: Synthetic coding sequence

SEQ ID NO: 169157 - DNA, 1086 bp, Artificial Sequence; identical to SEQ ID NO: 169153
  Description of Artificial Sequence: Synthetic coding sequence

SEQ ID NO: 169158 - DNA, 159 bp, Artificial Sequence
  Description of Artificial Sequence: Synthetic coding sequence
atgagcaagcagcagcccacccagttcatcaaccctgagaccccaggctacgtgggctttgccaacctgcccaaccaggtgcacaggaagtctgtgaagaagggctttgagttcaccctgatggtggtgggggagagcggcctgggcaagagcacctag

SEQ ID NO: 169159 - DNA, 153 bp, Artificial Sequence
  Description of Artificial Sequence: Synthetic coding sequence
atgagcaagcagcagcccacccagttcatcaaccctgagaccccaggctacgtgggctttgccaacctgcccaaccaggtgcacaggaagtctgtgaagaagggctttgagttcaccctgatggtggtgggggagagcggcctgggcaagtag

SEQ ID NO: 169160 - DNA, 72 bp, Artificial Sequence
  Description of Artificial Sequence: Synthetic coding sequence
atgagcaagcagcagcccacccagttcatcaaccctgagaccccaggctacgtgggctttgccaacctgtag

SEQ ID NO: 169161 - DNA, 447 bp, Artificial Sequence
  Description of Artificial Sequence: Synthetic coding sequence
atgagcaagcagcagcccacccagttcatcaaccctgagaccccaggctacgtgggctttgccaacctgcccaaccaggtgcacaggaagtctgtgaagaagggctttgagttcaccctgatggtggtgggggagagcggcctgggcaagagcaccctcatcaacagcctcttcctgacagacctgtacccagagagggtcatccctggagctgctgagaagattgaaagaacagtgcagatcgaggccagcacagtggagattgaggagcggggcgtgaagctgcggctgactgtggtggacaccccaggctatggagatgccatcaactgccgggactgcttcaagaccatcatctcctacattgatgagcagtttgagcgctacctgcatgatgagagcggcctgaacagaagacacatcatcgacaacagagtgcactgctag

SEQ ID NO: 169162 - DNA, 396 bp, Artificial Sequence
  Description of Artificial Sequence: Synthetic coding sequence
atgagcaagcagcagcccacccagttcatcaaccctgagaccccaggctacgtgggctttgccaacctgcccaaccaggtgcacaggaagtctgtgaagaagggctttgagttcaccctgatggtggtgggggagagcggcctgggcaagagcaccctcatcaacagcctcttcctgacagacctgtacccagagagggtcatccctggagctgctgagaagattgaaagaacagtgcagatcgaggccagcacagtggagattgaggagcggggcgtgaagctgcggctgactgtggtggacaccccaggctatggagatgccatcaactgccgggactgcttcaagaccatcatctcctacattgatgagcagtttgagcgctacctgcactag

SEQ ID NO: 169163 - DNA, 219 bp, Artificial Sequence
  Description of Artificial Sequence: Synthetic coding sequence
atgagcaagcagcagcccacccagttcatcaaccctgagaccccaggctacgtgggctttgccaacctgcccaaccaggtgcacaggaagtctgtgaagaagggctttgagttcaccctgatggtggtgggggagagcggcctgggcaagagcaccctcatcaacagcctcttcctgacagacctgtacccagagagggtcatccctggagctgcctag

SEQ ID NO: 169164 - DNA, 219 bp, Artificial Sequence; identical to SEQ ID NO: 169163
  Description of Artificial Sequence: Synthetic coding sequence

SEQ ID NO: 169165 - DNA, 522 bp, Artificial Sequence
  Description of Artificial Sequence: Synthetic coding sequence
atgagcaagcagcagcccacccagttcatcaaccctgagaccccaggctacgtgggctttgccaacctgcccaaccaggtgcacaggaagtctgtgaagaagggctttgagttcaccctgatggtggtgggggagagcggcctgggcaagagcaccctcatcaacagcctcttcctgacagacctgtacccagagagggtcatccctggagctgctgagaagattgaaagaacagtgcagatcgaggccagcacagtggagattgaggagcggggcgtgaagctgcggctgactgtggtggacaccccaggctatggagatgccatcaactgccgggactgcttcaagaccatcatctcctacattgatgagcagtttgagcgctacctgcatgatgagagcggcctgaacagaagacacatcatcgacaacagagtgcactgctgcttctacttcatcagccccttcggccacggcctgaagcccctggatgtggccttcatgaaggccatccacaactag

SEQ ID NO: 169166 - DNA, 90 bp, Artificial Sequence
  Description of Artificial Sequence: Synthetic coding sequence
tgagaaatgattgccaggatgcaggcccagatgcagatgcagatgcagggcggagatggagatggaggagccctgggccaccacgtgtag

SEQ ID NO: 169167 - DNA, 861 bp, Artificial Sequence
  Description of Artificial Sequence: Synthetic coding sequence
atgagcaagggccagagcggcctgggcaagagcaccctggtgaacaccctcttcaagagccaggtgtccaggaaggccagctcctggaaccgggaggagaagatccccaagacagtggagatcaaggccatcggccacgtgattgaggagggcggcgtgaagatgaagctgaccgtcatcgacaccccaggctttggagaccagatcaacaatgaaaactgctgggagcccatcgagaagtacatcaatgagcagtatgagaagttcctgaaggaggaggtgaacatcgccaggaagaagaggatcccagacaccagggtgcactgctgcctgtacttcatcagccccaccggccacagcctgcggcccctggacctggagttcatgaagcacctgagcaaggtggtgaacatcatccctgtgattgccaaggctgacaccatgaccctggaggagaagtctgagttcaagcagagggtgaggaaggagctggaggtgaatggaattgagttctacccccagaaggagtttgatgaggacctggaggacaagacagaaaatgacaagatccggcaggagagcatgccctttgctgtggtgggcagtgacaaggagtaccaggtgaatggcaagagggtgctgggcaggaagaccccctggggcatcatcgaggtggagaacctgaaccactgtgaatttgccctgctgcgggactttgtgatccgcacccacctgcaggacctgaaggaggtgacccacaacatccactatgagacctaccgggccaagaggctgaatgacaatggaggcctgccccctgtgtctgtggacacagaggagagccatgacagcaacccctag

SEQ ID NO: 169168 - DNA, 252 bp, Artificial Sequence
  Description of Artificial Sequence: Synthetic coding sequence
atgagcaagggcctgcctgagaccaggacagatgctgccatgtctgagctggtgcctgagccccggcccaagccagctgtgcccatgaagcccatgagcatcaacagcaacctgctgggctacatcggcatcgacaccatcatcgagcagatgaggaagaagaccatgaagacaggctttgacttcaacatcatggtggtggccggcagccccctgcggagcacctccatgagcagcaccaggagcagctag

SEQ ID NO: 169169 - DNA, 1053 bp, Artificial Sequence
  Description of Artificial Sequence: Synthetic coding sequence
atgagcaagggcctgcctgagaccaggacagatgctgccatgtctgagctggtgcctgagccccggcccaagccagctgtgcccatgaagcccatgagcatcaacagcaacctgctgggctacatcggcatcgacaccatcatcgagcagatgaggaagaagaccatgaagacaggctttgacttcaacatcatggtggtgggccagagcggcctgggcaagagcaccctggtgaacaccctcttcaagagccaggtgtccaggaaggccagctcctggaaccgggaggagaagatccccaagacagtggagatcaaggccatcggccacgtgattgaggagggcggcgtgaagatgaagctgaccgtcatcgacaccccaggctttggagaccagatcaacaatgaaaactgctgggagcccatcgagaagtacatcaatgagcagtatgagaagttcctgaaggaggaggtgaacatcgccaggaagaagaggatcccagacaccagggtgcactgctgcctgtacttcatcagccccaccggccacagcctgcggcccctggacctggagttcatgaagcacctgagcaaggtggtgaacatcatccctgtgattgccaaggctgacaccatgaccctggaggagaagtctgagttcaagcagagggtgaggaaggagctggaggtgaatggaattgagttctacccccagaaggagtttgatgaggacctggaggacaagacagaaaatgacaagatccggcaggagagcatgccctttgctgtggtgggcagtgacaaggagtaccaggtgaatggcaagagggtgctgggcaggaagaccccctggggcatcatcgaggtggagaacctgaaccactgtgaatttgccctgctgcgggactttgtgatccgcacccacctgcaggacctgaaggaggtgacccacaacatccactatgagacctaccgggccaagaggctgaatgacaatggaggcctgccccctgtgtctgtggacacagaggagagccatgacagcaacccctag

SEQ ID NO: 169170 - DNA, 1077 bp, Artificial Sequence
  Description of Artificial Sequence: Synthetic coding sequence
atgagcaagggcctgcctgagaccaggacagatgctgccatgtctgagctggtgcctgagccccggcccaagccagctgtgcccatgaagcccatgagcatcaacagcaacctgctgggctacatcggcatcgacaccatcatcgagcagatgaggaagaagaccatgaagacaggctttgacttcaacatcatggtggtgggccagagcggcctgggcaagagcaccctggtgaacaccctcttcaagagccaggtgtccaggaaggccagctcctggaaccgggaggagaagatccccaagacagtggagatcaaggccatcggccacgtgattgaggagggcggcgtgaagatgaagctgaccgtcatcgacaccccaggctttggagaccagatcaacaatgaaaactgctgggagcccatcgagaagtacatcaatgagcagtatgagaagttcctgaaggaggaggtgaacatcgccaggaagaagaggatcccagacaccagggtgcactgctgcctgtacttcatcagccccaccggccacagcctgcggcccctggacctggagttcatgaagcacctgagcaaggtggtgaacatcatccctgtgattgccaaggctgacaccatgaccctggaggagaagtctgagttcaagcagagggtgaggaaggagctggaggtgaatggaattgagttctacccccagaaggagtttgatgaggacctggaggacaagacagaaaatgacaagatccggcaggagagcatgccctttgctgtggtgggcagtgacaaggagtaccaggtgaatggcaagagggtgctgggcaggaagaccccctggggcatcatcgaggtggagaacctgaaccactgtgaatttgccctgctgcgggactttgtgatccgcacccacctgcaggacctgaaggaggtgacccacaacatccactatgagacctaccgggccaagaggctgaatgacaatggaggcctgcccccaggagagggcctgctgggcaccgtgctgccccctgtgcctgccaccccctgccccacagctgagtag

SEQ ID NO: 169171 - DNA, 885 bp, Artificial Sequence
  Description of Artificial Sequence: Synthetic coding sequence
atgagcaagggccagagcggcctgggcaagagcaccctggtgaacaccctcttcaagagccaggtgtccaggaaggccagctcctggaaccgggaggagaagatccccaagacagtggagatcaaggccatcggccacgtgattgaggagggcggcgtgaagatgaagctgaccgtcatcgacaccccaggctttggagaccagatcaacaatgaaaactgctgggagcccatcgagaagtacatcaatgagcagtatgagaagttcctgaaggaggaggtgaacatcgccaggaagaagaggatcccagacaccagggtgcactgctgcctgtacttcatcagccccaccggccacagcctgcggcccctggacctggagttcatgaagcacctgagcaaggtggtgaacatcatccctgtgattgccaaggctgacaccatgaccctggaggagaagtctgagttcaagcagagggtgaggaaggagctggaggtgaatggaattgagttctacccccagaaggagtttgatgaggacctggaggacaagacagaaaatgacaagatccggcaggagagcatgccctttgctgtggtgggcagtgacaaggagtaccaggtgaatggcaagagggtgctgggcaggaagaccccctggggcatcatcgaggtggagaacctgaaccactgtgaatttgccctgctgcgggactttgtgatccgcacccacctgcaggacctgaaggaggtgacccacaacatccactatgagacctaccgggccaagaggctgaatgacaatggaggcctgcccccaggagagggcctgctgggcaccgtgctgccccctgtgcctgccaccccctgccccacagctgagtag

SEQ ID NO: 169172 - DNA, 537 bp, Artificial Sequence
  Description of Artificial Sequence: Synthetic coding sequence
atgtctgagctggtgcctgagccccggcccaagccagctgtgcccatgaagcccatgagcatcaacagcaacctgctgggctacatcggcatcgacaccatcatcgagcagatgaggaagaagaccatgaagacaggctttgacttcaacatcatggtggtgggccagagcggcctgggcaagagcaccctggtgaacaccctcttcaagagccaggtgtccaggaaggccagctcctggaaccgggaggagaagatccccaagacagtggagatcaaggccatcggccacgtgattgaggagggcggcgtgaagatgaagctgactgtgattgacaccccaggctttggagaccagatcaacaatgaaaactgctgggagcccatcgagaagtacatcaatgagcagtatgagaagttcctgaaggaggaggtgaacatcgccaggaagaagaggatcccagacaccagggtgcactgctgcctgtacttcatcagccccaccggccacagcctgcggcccctggacctggagtag

SEQ ID NO: 169173 - DNA, 1137 bp, Artificial Sequence
  Description of Artificial Sequence: Synthetic coding sequence
atggacagcctggccgccccccaggaccggctggtggagcagctgctgagccccaggacccaggcccagaggcggctgaaggacatcgacaagcagtatgtgggctttgccaccctgcccaaccaggtgcacaggaagtctgtgaagaagggctttgacttcaccctgatggtggccggggagagcggcctgggcaagagcaccctggtgcacagcctcttcctgacagacctgtacaaggacaggaagctgctgtctgctgaggagcgcatcagccagacagtggagatcctgaagcacacagtggacatcgaggagaagggcgtgaagctgaagctgaccatcgtggacaccccaggctttggagatgctgtgaacaacacagagtgctggaagcccatcacagattatgtggaccagcagtttgagcagtacttcagagatgagagcggcctgaacaggaagaacatccaggacaacagagtgcactgctgcctgtacttcatcagccccttcggccacggcctgcggcctgtggatgtgggcttcatgaaggccctgcacgagaaggtgaacatcgtgcccctgattgccaaggctgactgcctggtgcccagcgagatcaggaagctgaaggagcgcatccgggaggagattgacaagtttggcatccacgtgtaccagttcccagaatgtgacagtgatgaagatgaggacttcaagcagcaggaccgggagctgaaggagagcgccccctttgctgtgattggcagcaacacagtggtggaggccaagggccagagggtgcggggccgcctgtacccctggggcatcgtggaggtggagaaccaggcccactgtgactttgtgaagctgaggaacatgctgatccgcacccacatgcatgacctgaaggatgtgacctgtgatgtgcactatgagaactaccgggcccactgcatccagcagatgaccagcaagctgacccaggacagcaggatggagagccccatccccatcctgcccctgcccaccccagatgctgagacagagaagctgatccgcatgaaggatgaggagctgcggaggatgcaggagatgctgcagaggatgaagcagcagatgcaggaccagtag

SEQ ID NO: 169174 - DNA, 969 bp, Artificial Sequence
  Description of Artificial Sequence: Synthetic coding sequence
atggtggccggggagagcggcctgggcaagagcaccctggtgcacagcctcttcctgacagacctgtacaaggacaggaagctgctgtctgctgaggagcgcatcagccagacagtggagatcctgaagcacacagtggacatcgaggagaagggcgtgaagctgaagctgaccatcgtggacaccccaggctttggagatgctgtgaacaacacagagtgctggaagcccatcacagattatgtggaccagcagtttgagcagtacttcagagatgagagcggcctgaacaggaagaacatccaggacaacagagtgcactgctgcctgtacttcatcagccccttcggccacggcctgcggcctgtggatgtgggcttcatgaaggccctgcacgagaaggtgaacatcgtgcccctgattgccaaggctgactgcctggtgcccagcgagatcaggaagctgaaggagcgcatccgggaggagattgacaagtttggcatccacgtgtaccagttcccagaatgtgacagtgatgaagatgaggacttcaagcagcaggaccgggagctgaaggagagcgccccctttgctgtgattggcagcaacacagtggtggaggccaagggccagagggtgcggggccgcctgtacccctggggcatcgtggaggtggagaaccaggcccactgtgactttgtgaagctgaggaacatgctgatccgcacccacatgcatgacctgaaggatgtgacctgtgatgtgcactatgagaactaccgggcccactgcatccagcagatgaccagcaagctgacccaggacagcaggatggagagccccatccccatcctgcccctgcccaccccagatgctgagacagagaagctgatccgcatgaaggatgaggagctgcggaggatgcaggagatgctgcagaggatgaagcagcagatgcaggaccagtag

SEQ ID NO: 169175 - DNA, 1041 bp, Artificial Sequence
  Description of Artificial Sequence: Synthetic coding sequence
atggacagcctggccgccccccaggaccggctggtggagcagctgctgagccccaggacccaggcccagaggcggctgaaggacatcgacaagcagtatgtgggctttgccaccctgcccaaccaggtgcacaggaagtctgtgaagaagggctttgacttcaccctgatggtggccggggagagcggcctgggcaagagcaccctggtgcacagcctcttcctgacagacctgtacaaggacaggaagctgctgtctgctgaggagcgcatcagccagacagtggagatcctgaagcacacagtggacatcgaggagaagggcgtgaagctgaagctgaccatcgtggacaccccaggctttggagatgctgtgaacaacacagagtgctggaagcccatcacagattatgtggaccagcagtttgagcagtacttcagagatgagagcggcctgaacaggaagaacatccaggacaacagagtgcactgctgcctgtacttcatcagccccttcggccacggcctgcggcctgtggatgtgggcttcatgaaggccctgcacgagaaggtgaacatcgtgcccctgattgccaaggctgactgcctggtgcccagcgagatcaggaagctgaaggagcgcatccgggaggagattgacaagtttggcatccacgtgtaccagttcccagaatgtgacagtgatgaagatgaggacttcaagcagcaggaccgggagctgaaggagagcgccccctttgctgtgattggcagcaacacagtggtggaggccaagggccagagggtgcggggccgcctgtacccctggggcatcgtggagggcgccctgcggctgcgggaggccgcccagcacgcccacccccacgcctatgcccggccccagggcagagatgtgcggcgggccctgcgggagctgccccgggccctgcacccagcagatgaccagcagacagaccccggccagccccacggggagccccacccagaccctgctgctgcccaccctggccggcgggactag

SEQ ID NO: 169176 - DNA, 450 bp, Artificial Sequence
  Description of Artificial Sequence: Synthetic coding sequence
ctgcccaaccaggtgcacaggaagtctgtgaagaagggctttgacttcaccctgatggtggccggggagagcggcctgggcaagagcaccctggtgcacagcctcttcctgacagacctgtacaaggacaggaagctgctgtctgctgaggagcgcatcagccagacagtggagatcctgaagcacacagtggacatcgaggagaagggcgtgaagctgaagctgaccatcgtggacaccccaggctttggagatgctgtgaacaacacagagtgctggaagcccatcacagattatgtggaccagcagtttgagcagtacttcagagatgagagcggcctgaacaggaagaacatccaggacaacagagtgcactgctgcctgtacttcatcagccccttcggccacggcctgcggcctgtggatggcttccacgagggcatcgcctag

SEQ ID NO: 169177 - DNA, 1110 bp, Artificial Sequence
  Description of Artificial Sequence: Synthetic coding sequence
atgagcacaggcctgcgctacaagagcaagctggccaccccagaggacaagcaggacatcgacaagcagtatgtgggctttgccaccctgcccaaccaggtgcacaggaagtctgtgaagaagggctttgacttcaccctgatggtggccggggagagcggcctgggcaagagcaccctggtgcacagcctcttcctgacagacctgtacaaggacaggaagctgctgtctgctgaggagcgcatcagccagacagtggagatcctgaagcacacagtggacatcgaggagaagggcgtgaagctgaagctgaccatcgtggacaccccaggctttggagatgctgtgaacaacacagagtgctggaagcccatcacagattatgtggaccagcagtttgagcagtacttcagagatgaaagtggcctgaacaggaagaacatccaggacaacagagtgcactgctgcctgtacttcatcagcccctttggacatggcctgcggcctgtggatgtgggcttcatgaaggccctgcacgagaaggtgaacatcgtgcccctcatcgccaaggctgactgcctggtgcccagcgagatcaggaagctgaaggagcgcatccgggaggagattgacaagtttggcatccacgtgtaccagtttcctgaatgtgacagtgatgaagatgaggacttcaagcagcaggaccgggagctgaaggagagcgccccctttgctgtgattggcagcaacacagtggtggaggccaagggccagagggtgcggggccgcctgtacccctggggcatcgtggaggtggagaaccaggcccactgtgactttgtgaagctgaggaacatgctgatccgcacccacatgcatgacctgaaggatgtgacctgtgatgtgcactatgagaactaccgggcccactgcatccagcagatgaccagcaagctgacccaggacagcaggatggagagccccatccccatcctgcccctgcccaccccagatgctgagacagagaagctgatccgcatgaaggatgaggagctgcggaggatgcaggagatgctgcagaggatgaagcagcagatgcaggaccagtag

SEQ ID NO: 169178 - DNA, 1137 bp, Artificial Sequence; identical to SEQ ID NO: 169173
  Description of Artificial Sequence: Synthetic coding sequence

SEQ ID NO: 169179 - DNA, 1305 bp, Artificial Sequence
  Description of Artificial Sequence: Synthetic coding sequence
atggccgccacagacatcgcccggcaggtgggggagggctgcaggacagtgcccctggccggccacgtgggctttgacagcctgcctgaccagctggtgaacaagtctgtgtcccagggcttctgcttcaacatcctgtgtgtgggggagaccggcctgggcaagagcaccctgatggacaccctcttcaacaccaagtttgaaggagagcccgccacccacacccagcccggggtgcagctgcagagcaacacctatgacctgcaggagagcaatgtgcggctgaagctgaccatcgtgtccacagtgggctttggagaccagatcaacaaggaggacagctacaagcccatcgtggagttcattgatgcccagtttgaggcctacctgcaggaggagctgaagatcagaagagtgctgcacacctaccatgacagccgcatccacgtgtgcctgtacttcatcgcccccaccggccacagcctgaagagcctggacctggtgaccatgaagaagctggacagcaaggtgaacatcatccccatcatcgccaaggcagatgccatcagcaagtctgagctgaccaagttcaagatcaagatcaccagcgagctggtgtccaatggagtgcagatctaccagttccccacagatgatgaatctgtggccgagatcaatggcaccatgaatgcccacctgccctttgctgtgattggcagcacagaggagctgaagattggcaacaagatgatgagggcccggcagtacccctggggcaccgtgcaggtggagaatgaggcccactgtgactttgtgaagctgcgggagatgctgatccgggtgaacatggaggacctgcgggagcagacccacaccaggcactatgagctgtaccgccgctgcaagctggaggagatgggcttcaaggacacagatcctgacagcaagcccttcagcctgcaggagacctatgaggccaagagaaatgagttcctgggggagctgcagaagaaggaggaggagatgaggcagatgtttgtgcagagggtgaaggagaaggaggccgagctgaaggaggccgagaaggagctgcacgagaagtttgaccggctgaagaagctgcaccaggatgagaagaagaagctggaggacaagaagaagagcctggatgatgaggtgaatgccttcaagcagaggaagacagctgctgagctgctgcagagccagggcagccaggccggcggcagccagaccctgaagagggacaaggagaagaagaacaacccctggctgtgcacagaatag

SEQ ID NO: 169180 - DNA, 1290 bp, Artificial Sequence
  Description of Artificial Sequence: Synthetic coding sequence
atggccgccacagacatcgcccggcaggtgggggagggctgcaggacagtgcccctggccggccacgtgggctttgacagcctgcctgaccagctggtgaacaagtctgtgtcccagggcttctgcttcaacatcctgtgtgtgggggagaccggcctgggcaagagcaccctgatggacaccctcttcaacaccaagtttgaaggagagcccgccacccacacccagcccggggtgcagctgcagagcaacacctatgacctgcaggagagcaatgtgcggctgaagctgaccatcgtgtccacagtgggctttggagaccagatcaacaaggaggacagctacaagcccatcgtggagttcattgatgcccagtttgaggcctacctgcaggaggagctgaagatcagaagagtgctgcacacctaccatgacagccgcatccacgtgtgcctgtacttcatcgcccccaccggccacagcctgaagagcctggacctggtgaccatgaagaagctggacagcaaggtgaacatcatccccatcatcgccaaggcagatgccatcagcaagtctgagctgaccaagttcaagatcaagatcaccagcgagctggtgtccaatggagtgcagatctaccagttccccacagatgatgaatctgtggccgagatcaatggcaccatgaatgcccacctgccctttgctgtgattggcagcacagaggagctgaagattggcaacaagatgatgagggcccggcagtacccctggggcaccgtgcaggtggagaatgaggcccactgtgactttgtgaagctgcgggagatgctgatccgggtgaacatggaggacctgcgggagcagacccacaccaggcactatgagctgtaccgccgctgcaagctggaggagatgggcttcaaggacacagatcctgacagcaagcccttcagcctgcaggagacctatgaggccaagagaaatgagttcctgggggagctgcagaagaaggaggaggagatgaggcagatgtttgtgcagagggtgaaggagaaggaggccgagctgaaggaggccgagaaggagctgcacgagaagtttgaccggctgaagaagctgcaccaggatgagaagaagaagctggaggacaagaagaagagcctggatgatgaggtgaatgccttcaagcagaggaagacagctgctgagctgctgcagagccagggcagccaggccggcggcagccagaccctgaagagggacaaggagaagaagaacttcttctag

SEQ ID NO: 169181 - DNA, 1296 bp, Artificial Sequence
  Description of Artificial Sequence: Synthetic coding sequence
atggccgccacagacatcgcccggcaggtgggggagggctgcaggacagtgcccctggccggccacgtgggctttgacagcctgcctgaccagctggtgaacaagtctgtgtcccagggcttctgcttcaacatcctgtgtgtgggggagaccggcctgggcaagagcaccctgatggacaccctcttcaacaccaagtttgaaggagagcccgccacccacacccagcccggggtgcagctgcagagcaacacctatgacctgcaggagagcaatgtgcggctgaagctgaccatcgtgtccacagtgggctttggagaccagatcaacaaggaggacagctacaagcccatcgtggagttcattgatgcccagtttgaggcctacctgcaggaggagctgaagatcagaagagtgctgcacacctaccatgacagccgcatccacgtgtgcctgtacttcatcgcccccaccggccacagcctgaagagcctggacctggtgaccatgaagaagctggacagcaaggtgaacatcatccccatcatcgccaaggcagatgccatcagcaagtctgagctgaccaagttcaagatcaagatcaccagcgagctggtgtccaatggagtgcagatctaccagttccccacagatgatgaatctgtggccgagatcaatggcaccatgaatgcccacctgccctttgctgtgattggcagcacagaggagctgaagattggcaacaagatgatgagggcccggcagtacccctggggcaccgtgcaggtggagaatgaggcccactgtgactttgtgaagctgcgggagatgctgatccgggtgaacatggaggacctgcgggagcagacccacaccaggcactatgagctgtaccgccgctgcaagctggaggagatgggcttcaaggacacagatcctgacagcaagcccttcagcctgcaggagacctatgaggccaagagaaatgagttcctgggggagctgcagaagaaggaggaggagatgaggcagatgtttgtgcagagggtgaaggagaaggaggccgagctgaaggaggccgagaaggagctgcacgagaagtttgaccggctgaagaagctgcaccaggatgagaagaagaagctggaggacaagaagaagagcctggatgatgaggtgaatgccttcaagcagaggaagacagctgctgagctgctgcagagccagggcagccaggccggcggcagccagaccctgaagagggacaaggagaagaagaacctgggcttcctgtag

SEQ ID NO: 169182 - DNA, 1284 bp, Artificial Sequence
  Description of Artificial Sequence: Synthetic coding sequence
atggccgccacagacatcgcccggcaggtgggggagggctgcaggacagtgcccctggccggccacgtgggctttgacagcctgcctgaccagctggtgaacaagtctgtgtcccagggcttctgcttcaacatcctgtgtgtgggggagaccggcctgggcaagagcaccctgatggacaccctcttcaacaccaagtttgaaggagagcccgccacccacacccagcccggggtgcagctgcagagcaacacctatgacctgcaggagagcaatgtgcggctgaagctgaccatcgtgtccacagtgggctttggagaccagatcaacaaggaggacagctacaagcccatcgtggagttcattgatgcccagtttgaggcctacctgcaggaggagctgaagatcagaagagtgctgcacacctaccatgacagccgcatccacgtgtgcctgtacttcatcgcccccaccggccacagcctgaagagcctggacctggtgaccatgaagaagctggacagcaaggtgaacatcatccccatcatcgccaaggcagatgccatcagcaagtctgagctgaccaagttcaagatcaagatcaccagcgagctggtgtccaatggagtgcagatctaccagttccccacagatgatgaatctgtggccgagatcaatggcaccatgaatgcccacctgccctttgctgtgattggcagcacagaggagctgaagattggcaacaagatgatgagggcccggcagtacccctggggcaccgtgcaggtggagaatgaggcccactgtgactttgtgaagctgcgggagatgctgatccgggtgaacatggaggacctgcgggagcagacccacaccaggcactatgagctgtaccgccgctgcaagctggaggagatgggcttcaaggacacagatcctgacagcaagcccttcagcctgcaggagacctatgaggccaagagaaatgagttcctgggggagctgcagaagaaggaggaggagatgaggcagatgtttgtgcagagggtgaaggagaaggaggccgagctgaaggaggccgagaaggagctgcacgagaagtttgaccggctgaagaagctgcaccaggatgagaagaagaagctggaggacaagaagaagagcctggatgatgaggtgaatgccttcaagcagaggaagacagctgctgagctgctgcagagccagggcagccaggccggcggcagccagaccctgaagagggacaaggagaagaagaactag

SEQ ID NO: 169183 - DNA, 1284 bp, Artificial Sequence; identical to SEQ ID NO: 169182
  Description of Artificial Sequence: Synthetic coding sequence

SEQ ID NO: 169184 - DNA, 1110 bp, Artificial Sequence
  Description of Artificial Sequence: Synthetic coding sequence
atggacaccctcttcaacaccaagtttgaaggagagcccgccacccacacccagcccggggtgcagctgcagagcaacacctatgacctgcaggagagcaatgtgcggctgaagctgaccatcgtgtccacagtgggctttggagaccagatcaacaaggaggacagctacaagcccatcgtggagttcattgatgcccagtttgaggcctacctgcaggaggagctgaagatcagaagagtgctgcacacctaccatgacagccgcatccacgtgtgcctgtacttcatcgcccccaccggccacagcctgaagagcctggacctggtgaccatgaagaagctggacagcaaggtgaacatcatccccatcatcgccaaggcagatgccatcagcaagtctgagctgaccaagttcaagatcaagatcaccagcgagctggtgtccaatggagtgcagatctaccagttccccacagatgatgaatctgtggccgagatcaatggcaccatgaatgcccacctgccctttgctgtgattggcagcacagaggagctgaagattggcaacaagatgatgagggcccggcagtacccctggggcaccgtgcaggtggagaatgaggcccactgtgactttgtgaagctgcgggagatgctgatccgggtgaacatggaggacctgcgggagcagacccacaccaggcactatgagctgtaccgccgctgcaagctggaggagatgggcttcaaggacacagatcctgacagcaagcccttcagcctgcaggagacctatgaggccaagagaaatgagttcctgggggagctgcagaagaaggaggaggagatgaggcagatgtttgtgcagagggtgaaggagaaggaggccgagctgaaggaggccgagaaggagctgcacgagaagtttgaccggctgaagaagctgcaccaggatgagaagaagaagctggaggacaagaagaagagcctggatgatgaggtgaatgccttcaagcagaggaagacagctgctgagctgctgcagagccagggcagccaggccggcggcagccagaccctgaagagggacaaggagaagaagaagtag

SEQ ID NO: 169185 - DNA, 1374 bp, Artificial Sequence
  Description of Artificial Sequence: Synthetic coding sequence
atggccgccacagacatcgcccggcaggtgtttggaagaagaaggctgctgctgctgggctttgaaacagtgggcttctctgctgcctgcacagaggagggcggccacatgctgcggcggggggagggctgcaggacagtgcccctggccggccacgtgggctttgacagcctgcctgaccagctggtgaacaagtctgtgtcccagggcttctgcttcaacatcctgtgtgtgggggagaccggcctgggcaagagcaccctgatggacaccctcttcaacaccaagtttgaaggagagcccgccacccacacccagcccggggtgcagctgcagagcaacacctatgacctgcaggagagcaatgtgcggctgaagctgaccatcgtgtccacagtgggctttggagaccagatcaacaaggaggacagctacaagcccatcgtggagttcattgatgcccagtttgaggcctacctgcaggaggagctgaagatcagaagagtgctgcacacctaccatgacagccgcatccacgtgtgcctgtacttcatcgcccccaccggccacagcctgaagagcctggacctggtgaccatgaagaagctggacagcaaggtgaacatcatccccatcatcgccaaggcagatgccatcagcaagtctgagctgaccaagttcaagatcaagatcaccagcgagctggtgtccaatggagtgcagatctaccagttccccacagatgatgaatctgtggccgagatcaatggcaccatgaatgcccacctgccctttgctgtgattggcagcacagaggagctgaagattggcaacaagatgatgagggcccggcagtacccctggggcaccgtgcaggtggagaatgaggcccactgtgactttgtgaagctgcgggagatgctgatccgggtgaacatggaggacctgcgggagcagacccacaccaggcactatgagctgtaccgccgctgcaagctggaggagatgggcttcaaggacacagatcctgacagcaagcccttcagcctgcaggagacctatgaggccaagagaaatgagttcctgggggagctgcagaagaaggaggaggagatgaggcagatgtttgtgcagagggtgaaggagaaggaggccgagctgaaggaggccgagaaggagctgcacgagaagtttgaccggctgaagaagctgcaccaggatgagaagaagaagctggaggacaagaagaagagcctggatgatgaggtgaatgccttcaagcagaggaagacagctgctgagctgctgcagagccagggcagccaggccggcggcagccagaccctgaagagggacaaggagaagaagaagtag

SEQ ID NO: 169186 - DNA, 1284 bp, Artificial Sequence; identical to SEQ ID NO: 169182
  Description of Artificial Sequence: Synthetic coding sequence

SEQ ID NO: 169187 - DNA, 804 bp, Artificial Sequence
  Description of Artificial Sequence: Synthetic coding sequence
atggccgccacagacatcgcccggcaggtgggggagggctgcaggacagtgcccctggccggccacgtgggctttgacagcctgcctgaccagctggtgaacaagtctgtgtcccagggcttctgcttcaacatcctgtgtgtgggggagaccggcctgggcaagagcaccctgatggacaccctcttcaacaccaagtttgaaggagagcccgccacccacacccagcccggggtgcagctgcagagcaacacctatgacctgcaggagagcaatgtgcggctgaagctgaccatcgtgtccacagtgggctttggagaccagatcaacaaggaggacagctacaagcccatcgtggagttcattgatgcccagtttgaggcctacctgcaggaggagctgaagatcagaagagtgctgcacacctaccatgacagccgcatccacgtgtgcctgtacttcatcgcccccaccggccacagcctgaagagcctggacctggtgaccatgaagaagctggacagcaaggtgaacatcatccccatcatcgccaaggcagatgccatcagcaagtctgagctgaccaagttcaagatcaagatcaccagcgagctggtgtccaatggagtgcagatctaccagttccccacagatgatgaatctgtggccgagatcaatggcaccatgaatgcccacctgccctttgctgtgattggcagcacagaggagctgaagattggcaacaagatgatgagggcccggcagtacccctggggcaccgtgcagggcagcagccaggtgtag

SEQ ID NO: 169188 - DNA, 1452 bp, Artificial Sequence
  Description of Artificial Sequence: Synthetic coding sequence
atggccgccacagacctggagcgcttcagcaatgctgagcctgagcccaggagcctgagcctgggcggccacgtgggctttgacagcctgcctgaccagctggtgtccaagtctgtgacccagggcttctccttcaacatcctgtgtgtgggggagactggaattggcaagagcaccctgatgaacaccctcttcaacaccacctttgaaacagaggaggccagccaccacgaggcctgtgtgcggctgcggccccagacctatgacctgcaggagagcaatgtgcagctgaagctgaccatcgtggatgctgtgggctttggagaccagatcaacaaggatgagagctaccggcccatcgtggactacattgatgcccagtttgagaactacctgcaggaggagctgaagatcagaagaagcctgtttgactaccatgacacccgcatccacgtgtgcctgtacttcatcacccccaccggccacagcctgaagagcctggacctggtgaccatgaagaagctggacagcaaggtgaacatcatccccatcatcgccaaggctgacaccatcagcaagtctgagctgcacaagttcaagatcaagatcatgggagagctggtgtccaatggagtgcagatctaccagttccccacagatgatgaagctgtggccgagatcaatgctgtgatgaatgcccacctgccctttgctgtggtgggcagcacagaggaggtgaaggtgggcaacaagctggtgcgggcccggcagtacccctggggcgtggtgcaggtggagaatgaaaaccactgtgactttgtgaagctgcgggagatgctgatccgggtgaacatggaggacctgcgggagcagacccacagccgccactatgagctgtaccgccgctgcaagctggaggagatgggcttccaggacagtgatggagacagccagcccttcagcctgcaggagacctatgaggccaagaggaaggagttcctgtctgagctgcagaggaaggaggaggagatgaggcagatgtttgtgaacaaggtgaaggagacagagctggagctgaaggagaaggagcgggagctgcacgagaagtttgagcacctgaagagggtgcaccaggaggagaagaggaaggtggaggagaagaggcgggagctggaggaggagaccaatgccttcaacagaaggaaggctgctgtggaggccctgcagagccaggccctgcacgccaccagccagcagcccctgaggaaggacaaggacaagaagaacagaagtgacattggagcccaccagcccggcatgagcctgagcagcagcaaggtgatgatgaccaaggcctctgtggagcccctgaactgcagctcctggtggccagccatccagtgctgcagctgcctggtgagagatgccacctggagggagggcttcctgtag

SEQ ID NO: 169189 - DNA, 1110 bp, Artificial Sequence
  Description of Artificial Sequence: Synthetic coding sequence
atgaacaccctcttcaacaccacctttgaaacagaggaggccagccaccacgaggcctgtgtgcggctgcggccccagacctatgacctgcaggagagcaatgtgcagctgaagctgaccatcgtggatgctgtgggctttggagaccagatcaacaaggatgagagctaccggcccatcgtggactacattgatgcccagtttgagaactacctgcaggaggagctgaagatcagaagaagcctgtttgactaccatgacacccgcatccacgtgtgcctgtacttcatcacccccaccggccacagcctgaagagcctggacctggtgaccatgaagaagctggacagcaaggtgaacatcatccccatcatcgccaaggctgacaccatcagcaagtctgagctgcacaagttcaagatcaagatcatgggagagctggtgtccaatggagtgcagatctaccagttccccacagatgatgaagctgtggccgagatcaatgctgtgatgaatgcccacctgccctttgctgtggtgggcagcacagaggaggtgaaggtgggcaacaagctggtgcgggcccggcagtacccctggggcgtggtgcaggtggagaatgaaaaccactgtgactttgtgaagctgcgggagatgctgatccgggtgaacatggaggacctgcgggagcagacccacagccgccactatgagctgtaccgccgctgcaagctggaggagatgggcttccaggacagtgatggagacagccagcccttcagcctgcaggagacctatgaggccaagaggaaggagttcctgtctgagctgcagaggaaggaggaggagatgaggcagatgtttgtgaacaaggtgaaggagacagagctggagctgaaggagaaggagcgggagctgcacgagaagtttgagcacctgaagagggtgcaccaggaggagaagaggaaggtggaggagaagaggcgggagctggaggaggagaccaatgccttcaacagaaggaaggctgctgtggaggccctgcagagccaggccctgcacgccaccagccagcagcccctgaggaaggacaaggacaagaagaactag

SEQ ID NO: 169190 - DNA, 1290 bp, Artificial Sequence
  Description of Artificial Sequence: Synthetic coding sequence
atggccgccacagacctggagcgcttcagcaatgctgagcctgagcccaggagcctgagcctgggcggccacgtgggctttgacagcctgcctgaccagctggtgtccaagtctgtgacccagggcttctccttcaacatcctgtgtgtgggggagactggaattggcaagagcaccctgatgaacaccctcttcaacaccacctttgaaacagaggaggccagccaccacgaggcctgtgtgcggctgcggccccagacctatgacctgcaggagagcaatgtgcagctgaagctgaccatcgtggatgctgtgggctttggagaccagatcaacaaggatgagagctaccggcccatcgtggactacattgatgcccagtttgagaactacctgcaggaggagctgaagatcagaagaagcctgtttgactaccatgacacccgcatccacgtgtgcctgtacttcatcacccccaccggccacagcctgaagagcctggacctggtgaccatgaagaagctggacagcaaggtgaacatcatccccatcatcgccaaggctgacaccatcagcaagtctgagctgcacaagttcaagatcaagatcatgggagagctggtgtccaatggagtgcagatctaccagttccccacagatgatgaagctgtggccgagatcaatgctgtgatgaatgcccacctgccctttgctgtggtgggcagcacagaggaggtgaaggtgggcaacaagctggtgcgggcccggcagtacccctggggcgtggtgcaggtggagaatgaaaaccactgtgactttgtgaagctgcgggagatgctgatccgggtgaacatggaggacctgcgggagcagacccacagccgccactatgagctgtaccgccgctgcaagctggaggagatgggcttccaggacagtgatggagacagccagcccttcagcctgcaggagacctatgaggccaagaggaaggagttcctgtctgagctgcagaggaaggaggaggagatgaggcagatgtttgtgaacaaggtgaaggagacagagctggagctgaaggagaaggagcgggagctgcacgagaagtttgagcacctgaagagggtgcaccaggaggagaagaggaaggtggaggagaagaggcgggagctggaggaggagaccaatgccttcaacagaaggaaggctgctgtggaggccctgcagagccaggccctgcacgccaccagccagcagcccctgaggaaggacaaggacaagaagaactag

SEQ ID NO: 169191 - DNA, 1329 bp, Artificial Sequence
  Description of Artificial Sequence: Synthetic coding sequence
atggccgccacagacctggagcgcttcagcaatgctgagcctgagcccaggagcctgagcctgggcggccacgtgggctttgacagcctgcctgaccagctggtgtccaagtctgtgacccagggcttctccttcaacatcctgtgtgtgggggagactggaattggcaagagcaccctgatgaacaccctcttcaacaccacctttgaaacagaggaggccagccaccacgaggcctgtgtgcggctgcggccccagacctatgacctgcaggagagcaatgtgcagctgaagctgaccatcgtggatgctgtgggctttggagaccagatcaacaaggatgagagctaccggcccatcgtggactacattgatgcccagtttgagaactacctgcaggaggagctgaagatcagaagaagcctgtttgactaccatgacacccgcatccacgtgtgcctgtacttcatcacccccaccggccacagcctgaagagcctggacctggtgaccatgaagaagctggacagcaaggtgaacatcatccccatcatcgccaaggctgacaccatcagcaagtctgagctgcacaagttcaagatcaagatcatgggagagctggtgtccaatggagtgcagatctaccagttccccacagatgatgaagctgtggccgagatcaatgctgtgatgaatgcccacctgccctttgctgtggtgggcagcacagaggaggtgaaggtgggcaacaagctggtgcgggcccggcagtacccctggggcgtggtgcaggtggagaatgaaaaccactgtgactttgtgaagctgcgggagatgctgatccgggtgaacatggaggacctgcgggagcagacccacagccgccactatgagctgtaccgccgctgcaagctggaggagatgggcttccaggacagtgatggagacagccagcccttcagcctgcaggagacctatgaggccaagaggaaggagttcctgtctgagctgcagaggaaggaggaggagatgaggcagatgtttgtgaacaaggtgaaggagacagagctggagctgaaggagaaggagcgggagctgcacgagaagtttgagcacctgaagagggtgcaccaggaggagaagaggaaggtggaggagaagaggcgggagctggaggaggagaccaatgccttcaacagaaggaaggctgctgtggaggccctgcagagccaggccctgcacgccaccagccagcagcccctgaggaaggacaaggacaagaagaaggccagcggctggagcagcatctacagcgtgaccatcccctag

SEQ ID NO: 169192 - DNA, 1707 bp, Artificial Sequence
  Description of Artificial Sequence: Synthetic coding sequence
atggagcgggaccgcatcagcgccctgaagaggagctttgaggtggaggaggtggagacccccaacagcaccccaccaagaagagtgcagacccccctgctgcgggccaccgtggccagcagcacccagaagttccaggacctgggcgtgaagaacagcgagcccagcgcccggcacgtggacagcctgagccagaggagccccaaggccagcctgcggcgggtggagctgagcggccccaaggctgctgagcctgtgtccagaagaacagagctgagcattgacatcagcagcaagcaggtggagaatgctggggccatcggccccagccgcttcggcctgaagagagctgaggtgctgggccacaagaccccagagcccgcccccaggagaacagagatcaccatcgtgaagccccaggagagcgcccacaggaggatggagcccccagccagcaaggtgcctgaggtgcccacagccccagccacagatgctgcccccaagagggtggagatccagatgcccaagccagctgaggcccccacagcccccagccctgcccagaccctggagaacagcgagcccgcccctgtgtcccagctgcagagccggctggagcccaagccccagccccctgtggccgaggccacccccaggagccaggaggccacagaggccgcccccagctgtgtgggggacatggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgactgtgattgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaggacagtgaagatcggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 169193 - DNA, 591 bp, Artificial Sequence
  Description of Artificial Sequence: Synthetic coding sequence
atggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgaccgtcatcgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcccctgctggagcagaaggtgcccctgagccagcccagcgctgactgcctggcccgctgtggggaccggctggagtag

SEQ ID NO: 169194 - DNA, 1740 bp, Artificial Sequence
  Description of Artificial Sequence: Synthetic coding sequence
atgtctgaccctgctgtgaatgcccagctggatggcatcatcagtgactttgaggccctgaagaggagctttgaggtggaggaggtggagacccccaacagcaccccaccccggcgggtgcagacccccctgctgcgggccaccgtggccagcagcacccagaagttccaggacctgggcgtgaagaacagcgagcccagcgcccggcacgtggacagcctgagccagaggagccccaaggccagcctgcggcgggtggagctgagcggccccaaggctgctgagcctgtgtccagaagaacagagctgagcattgacatcagcagcaagcaggtggagaatgctggggccatcggccccagcagatttggcctgaagagagctgaggtgctgggccacaagaccccagagcccgcccccaggagaacagagatcaccatcgtgaagccccaggagagcgcccacaggaggatggagcccccagccagcaaggtgcctgaggtgcccacagccccagccacagatgctgcccccaagagggtggagatccagatgcccaagccagctgaggcccccacagcccccagccctgcccagaccctggagaacagcgagcccgcccctgtgtcccagctgcagagccggctggagcccaagccccagccccctgtggccgaggccacccccaggagccaggaggccacagaagctgcccccagctgtgtgggggacatggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgaccgtcatcgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaagattctgaggaccggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 169195 - DNA, 1761 bp, Artificial Sequence
  Description of Artificial Sequence: Synthetic coding sequence
atgaagaagagctacagcggcggcaccaggaccagcagcggccgcctgcggcggctgggggacagcagcggccctgccctgaagaggagctttgaggtggaggaggtggagacccccaacagcaccccaccaagaagagtgcagacccccctgctgcgggccaccgtggccagcagcacccagaagttccaggacctgggcgtgaagaacagcgagcccagcgcccggcacgtggacagcctgagccagaggagccccaaggccagcctgcggcgggtggagctgagcggccccaaggctgctgagcctgtgtccagaagaacagagctgagcattgacatcagcagcaagcaggtggagaatgctggggccatcggccccagccgcttcggcctgaagagagctgaggtgctgggccacaagaccccagagcccgcccccaggagaacagagatcaccatcgtgaagccccaggagagcgcccacaggaggatggagcccccagccagcaaggtgcctgaggtgcccacagccccagccacagatgctgcccccaagagggtggagatccagatgcccaagccagctgaggcccccacagcccccagccctgcccagaccctggagaacagcgagcccgcccctgtgtcccagctgcagagccggctggagcccaagccccagccccctgtggccgaggccacccccaggagccaggaggccacagaggccgcccccagctgtgtgggggacatggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgactgtgattgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaggacagtgaagatcggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 169196 - DNA, 1425 bp, Artificial Sequence
  Description of Artificial Sequence: Synthetic coding sequence
atgggcagcagcttctgggagggcctgcaggtggccgtgggcctgccccagggctgctggccccagggcctggacagcggggagcctgctgagggcggccagctggaggccgcccctgtgtgcatcgtgacccggcagagcaaggagacagctggccccaccctgggccggggcggctggaggcagggcagcctgcggcggggcaagggcaccagctgccgctgccggcagctgagccctggccacggccctggccgcctgaccggctgtggggagtgccaccggctgccctgccggggcctggtgtctggcttcaccggcctgcggggccaggaggaggatgacctggccttctgcctggccaccatcggcagtgaccggcaggccacagaggccgcccccagctgtgtgggggacatggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgactgtgattgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaggacagtgaagatcggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 169197 - DNA, 1269 bp, Artificial Sequence
  Description of Artificial Sequence: Synthetic coding sequence
atggagcccccagccagcaaggtgcctgaggtgcccacagccccagccacagatgctgcccccaagagggtggagatccagatgcccaagccagctgaggcccccacagcccccagccctgcccagaccctggagaacagcgagcccgcccctgtgtcccagctgcagagccggctggagcccaagccccagccccctgtggccgaggccacccccaggagccaggaggccacagaggccgcccccagctgtgtgggggacatggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgactgtgattgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaggacagtgaagatcggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 169198 - DNA, 1008 bp, Artificial Sequence
  Description of Artificial Sequence: Synthetic coding sequence
atggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgaccgtcatcgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaagattctgaggaccggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 169199 - DNA, 1269 bp, Artificial Sequence; identical to SEQ ID NO: 169197
  Description of Artificial Sequence: Synthetic coding sequence

SEQ ID NO: 169200 - DNA, 1089 bp, Artificial Sequence
  Description of Artificial Sequence: Synthetic coding sequence
atggccggggccggctgcaccggcacctggagctggctgtggggcacagccacagaggccgcccccagctgtgtgggggacatggctgacaccccaagagatgctggcctgaagcaggccccagccagcagaaatgagaaggcccctgtggactttggctacgtgggcatcgacagcatcctggagcagatgaggaggaaggccatgaagcagggctttgagttcaacatcatggtggtgggccagagcggcctgggcaagagcaccctcatcaacaccctcttcaagagcaagatcagcaggaagtctgtgcagcccaccagcgaggagcgcatccccaagaccatcgagatcaagagcatcacccatgacatcgaggagaagggcgtgaggatgaagctgactgtgattgacaccccaggctttggagaccacatcaacaatgaaaactgctggcagcccatcatgaagttcatcaatgaccagtatgagaagtacctgcaggaggaggtgaacatcaacaggaagaagaggatcccagacaccagggtgcactgctgcctgtacttcatcccagccaccggccacagcctgcggcccctggacatcgagttcatgaagaggctgagcaaggtggtgaacatcgtgcctgtgattgccaaggctgacaccctgaccctggaggagcgggtgcacttcaagcagaggatcacagctgacctgctgagcaatggaattgatgtgtacccccagaaggagtttgatgaggacagtgaagatcggctggtgaatgagaagttccgggagatgatcccctttgctgtggtgggcagtgaccacgagtaccaggtgaatggcaagaggatcctgggcaggaagaccaagtggggcaccatcgaggtggagaacaccacccactgtgaatttgcctacctgcgggacctgctgatccgcacccacatgcagaacatcaaggacatcaccagcagcatccactttgaggcctacagagtgaagaggctgaatgaaggcagcagcgccatggccaacggcatggaggagaaggagcctgaggcccctgagatgtag

SEQ ID NO: 169201 - DNA, 582 bp, Artificial Sequence
  Description of Artificial Sequence: Synthetic coding sequence
atgaccctgtgcccccaggcctggctgcctgagggcagcgaggagcagctgcgctgtgccgaccaccccagctgtggggtgctgtctgctggcccctggggcggcggccaggccagccacctgcagaggagccctgtgggctgcaccctgcccagcatccccatcggccctgtgccctggagcgtgtctgagcccagaggagagtgcagccccccaggggcccctggccccccagcccggcacatggtgtggcccagcctgagcccctacccctgcccagcccccaagggcaggaagctgcagggccccctgcccccaacagcccagcccctgcaggccccctggcagctgcccctgctggagcagaaggtgcccctgagccagcccagcgctgactgctggccagatgctggcaccggctggaatgaaggaggagtcttcatcagcctgcccagccccagccacgccaccccagcccccaccggcctgcaggtgctgctgatgcgctgggacctgattgaggacaagaaggagggggagatgacccccacccccagcagccccagctttgagaaggtgtag

SEQ ID NO: 169202 - DNA, 1071 bp, Artificial Sequence
  Description of Artificial Sequence: Synthetic coding sequence
atggccatgtcctatgtgaaggatgacatcttccgcatctacatcaaggagaagaaggagtgccggcgggaccacaggcctccctgtgcccaggaggcccccaggaacatggtgcaccccaacgtcatctgtgatggctgcaatggacctgtggtgggcacccgctacaagtgcagcgtgtgcccagactatgacctgtgcagcgtgtgtgagggcaagggcctgcaccggggccacaccaagctggccttccccagccccttcggccacctgtctgagggcttcagccacagccgctggctgaggaaggtgaagcacggccacttcggctggccaggctgggagatgggccccccaggcaactggagcccccggccccccagggctggggaggcccggcccggccccacagctgagagcgccagcggccccagcgaggaccccagcgtgaacttcctgaagaatgtgggggagagcgtggccgccgccctgagccccctgggcatcgaggtggacattgatgtggagcacggcggcaagaggagccggctgacccctgtgtccccagagagcagcagcacagaggagaagagcagcagccagcccagcagctgctgcagcgaccccagcaagccaggcggcaatgtggagggcgccacccagagcctggccgagcagatgaggaagatcgccctggagagcgagggccggcctgaggagcagatggagagtgacaactgcagcggaggagatgatgactggacccacctgagcagcaaggaggtggaccccagcactggagagctgcagagcctgcagatgcctgagagcgagggccccagcagcctggaccccagccaggagggccccaccggcctgaaggaggccgccctgtacccccacctgcccccagaggccgacccccggctgattgagagcctgagccagatgctgtccatgggcttcagtgatgagggcggctggctgacccggctgctgcagaccaagaactatgacatcggggccgccctggacaccatccagtacagcaagcaccccccacccctgtag

SEQ ID NO: 169203 - DNA, 1071 bp, Artificial Sequence; identical to SEQ ID NO: 169202
  Description of Artificial Sequence: Synthetic coding sequence

SEQ ID NO: 169204 - DNA, 1323 bp, Artificial Sequence
  Description of Artificial Sequence: Synthetic coding sequence
atggccagcctgactgtgaaggcctacctgctgggcaaggaggatgctgcccgggagatccgccgcttctccttctgctgcagccctgagcctgaggccgaggccgaggccgctgctggccctggcccctgtgagcggctgctgagccgggtggccgccctcttccctgccctgcggcctgggggcttccaggcccactacagagatgaagatggagacctggtggccttcagcagtgatgaggagctgaccatggccatgtcctatgtgaaggatgacatcttccgcatctacatcaaggagaagaaggagtgccggcgggaccacaggcctccctgtgcccaggaggcccccaggaacatggtgcaccccaacgtcatctgtgatggctgcaatggacctgtggtgggcacccgctacaagtgcagcgtgtgcccagactatgacctgtgcagcgtgtgtgagggcaagggcctgcaccggggccacaccaagctggccttccccagccccttcggccacctgtctgagggcttcagccacagccgctggctgaggaaggtgaagcacggccacttcggctggccaggctgggagatgggccccccaggcaactggagcccccggccccccagggctggggaggcccggcccggccccacagctgagagcgccagcggccccagcgaggaccccagcgtgaacttcctgaagaatgtgggggagagcgtggccgccgccctgagccccctgggcatcgaggtggacattgatgtggagcacggcggcaagaggagccggctgacccctgtgtccccagagagcagcagcacagaggagaagagcagcagccagcccagcagctgctgcagcgaccccagcaagccaggcggcaatgtggagggcgccacccagagcctggccgagcagatgaggaagatcgccctggagagcgagggccggcctgaggagcagatggagagtgacaactgcagcggaggagatgatgactggacccacctgagcagcaaggaggtggaccccagcactggagagctgcagagcctgcagatgcctgagagcgagggccccagcagcctggaccccagccaggagggccccaccggcctgaaggaggccgccctgtacccccacctgcccccagaggccgacccccggctgattgagagcctgagccagatgctgtccatgggcttcagtgatgagggcggctggctgacccggctgctgcagaccaagaactatgacatcggggccgccctggacaccatccagtacagcaagcaccccccacccctgtag

SEQ ID NO: 169205 - DNA, 1071 bp, Artificial Sequence; identical to SEQ ID NO: 169202
  Description of Artificial Sequence: Synthetic coding sequence

SEQ ID NO: 169206 - DNA, 423 bp, Artificial Sequence
  Description of Artificial Sequence: Synthetic coding sequence
atggccatgtcctatgtgaaggatgacatcttccgcatctacatcaaggagaagaaggagtgccggcgggaccacaggcctccctgtgcccaggaggcccccaggaacatggtgcaccccaacgtcatctgtgatggctgcaatggacctgtggtgggcacccgctacaagtgcagcgtgtgcccagactatgacctgtgcagcgtgtgtgagggcaagggcctgcaccggggccacaccaagctggccttccccagccccttcggccacctgtctgagggcttcagccacagccgctggctgaggaaggtgaagcacggccacttcggctggccaggctgggagatgggccccccaggcaactggagcccccggccccccagggctggggaggcccggcccggccccacagctgagagctag

SEQ ID NO: 169207 - DNA, 891 bp, Artificial Sequence
  Description of Artificial Sequence: Synthetic coding sequence
atgaccagcagcgagagcaccctgaagaggaagaagtctgctgggggcaccacagcccaccgggtgctgcggcggcggcccttcggccacctgtctgagggcttcagccacagccgctggctgaggaaggtgaagcacggccacttcggctggccaggctgggagatgggccccccaggcaactggagcccccggccccccagggctggggaggcccggcccggccccacagctgagagcgccagcggccccagcgaggaccccagcgtgaacttcctgaagaatgtgggggagagcgtggccgccgccctgagccccctgggcatcgaggtggacattgatgtggagcacggcggcaagaggagccggctgacccctgtgtccccagagagcagcagcacagaggagaagagcagcagccagcccagcagctgctgcagcgaccccagcaagccaggcggcaatgtggagggcgccacccagagcctggccgagcagatgaggaagatcgccctggagagcgagggccggcctgaggagcagatggagagtgacaactgcagcggaggagatgatgactggacccacctgagcagcaaggaggtggaccccagcactggagagctgcagagcctgcagatgcctgagagcgagggccccagcagcctggaccccagccaggagggccccaccggcctgaaggaggccgccctgtacccccacctgcccccagaggccgacccccggctgattgagagcctgagccagatgctgtccatgggcttcagtgatgagggcggctggctgacccggctgctgcagaccaagaactatgacatcggggccgccctggacaccatccagtacagcaagcaccccccacccctgtag

SEQ ID NO: 169208 - DNA, 504 bp, Artificial Sequence
  Description of Artificial Sequence: Synthetic coding sequence
atggccatgtcctatgtgaaggatgacatcttccgcatctacatcaaggagaagaaggagtgccggcgggaccacaggcctccctgtgcccaggaggcccccaggaacatggtgcaccccaacgtcatctgtgatggctgcaatggacctgtggtgggcacccgctacaagtgcagcgtgtgcccagactatgacctgtgcagcgtgtgtgagggcaagggcctgcaccggggccacaccaagctggccttccccagccccttcggccacctgtctgagggcttcagccacagccgctggctgaggaaggtgaagcacggccacttcggctggccaggctgggagatgggccccccaggcaactggagcccccggccccccagggctggggaggcccggcccggccccacagctgagagcgccagcggccccagcgaggaccccagcgtgaacttcctgaagaatgtgggggagagcgtggccgccgccctgagccccctgtag

SEQ ID NO: 169209 - DNA, 477 bp, Artificial Sequence
  Description of Artificial Sequence: Synthetic coding sequence
atgatgcagaagctgctgaagtgcagccggctggtgctggccctggccctgatcctggtgctggagagctctgtgcagggctaccccacccggcgggcccgctaccagtgggtgcgctgcaacccagacagcaacagcgccaactgcctggaggagaagggccccatgtttgagctgctgcctggagagagcaacaagatcccccggctgaggacagacctcttccccaagacccgcatccaggacctgaaccgcatcttccccctgtctgaggactacagcggcagcggcttcggcagcggcagcggcagcggcagcggcagcggcagcggcttcctgacagagatggagcaggactaccagctggtggatgaaagtgatgccttccatgacaacctgcggagcctggacaggaacctgcccagcgacagccaggacctgggccagcacggcctggaggaggacttcatgctgtag

SEQ ID NO: 169210 - DNA, 987 bp, Artificial Sequence
  Description of Artificial Sequence: Synthetic coding sequence
atgatgtctggagagcccctgcacgtgaagacccccatccgggacagcatggccctgagcaagatggccggcacctctgtgtacctgaagatggattctgcccagcccagcggcagcttcaagatccggggcatcggccacttctgcaagcgctgggccaagcagggctgtgcccactttgtgtgcagcagcgctggaaatgccggcatggccgccgcctatgctgcccggcagctgggcgtgcctgccaccatcgtggtgcccagcaccaccccagccctgaccatcgagcggctgaagaatgaaggagccaccgtgaaggtggtgggggagctgctggatgaggcctttgagctggccaaggccctggccaagaacaaccctggctgggtgtacatccccccatttgatgaccccctcatctgggagggccacgccagcatcgtgaaggagctgaaggagaccctgtgggagaagccaggggccatcgccctgtctgtgggcggcggcggcctgctgtgtggggtggtgcagggcctgcaggaggtgggctggggagatgtgcctgtgattgccatggagaccttcggggcccacagcttccacgccgccaccacagctgggaagctggtgtccctgcccaagatcacctctgtggccaaggccctgggcgtgaagacagtgggcgcccaggccctgaagctgttccaggagcaccccatcttcagcgaggtgatcagtgaccaggaggccgtggccgccatcgagaagtttgtggatgatgagaagatcctggtggagcccgcctgtggggccgccctggccgctgtgtacagccacgtgatccagaagctgcagctggagggcaacctgcggacccccctgcccagcctggtggtgattgtgtgtggcggcagcaacatcagcctggcccagctgcgggccctgaaggagcagctgggcatgaccaaccggctgcccaagtag

SEQ ID NO: 169211 - DNA, 657 bp, Artificial Sequence
  Description of Artificial Sequence: Synthetic coding sequence
atgatgtctggagagcccctgcacgtgaagacccccatccgggacagcatggccctgagcaagatggccggcacctctgtgtacctgaagatggattctgcccagcccagcggcagcttcaagatccggggcatcggccacttctgcaagcgctgggccaagcagggctgtgcccactttgtgtgcagcagcgctggaaatgccggcatggccgccgcctatgctgcccggcagctgggcgtgcctgccaccatcgtggtgcccagcaccaccccagccctgaccatcgagcggctgaagaatgaaggagccaccgtgaaggtggtgggggagctgctggatgaggcctttgagctggccaaggccctggccaagaacaaccctggctgggtgtacatccccccatttgatgaccccctcatctgggagggccacgccagcatcgtgaaggagctgaaggagaccctgtgggagaagccaggggccatcgccctgtctgtgggcggcggcggcctgctgtgtggggtggtgcagggcctgcaggaggtgggctggggagatgtgcctgtgattgccatggagaccttcggggcccacagcttccacgccgccaccacagctgggaagctggtgtccctgcccaagatcaccaggtag

SEQ ID NO: 169212 - DNA, 1452 bp, Artificial Sequence
  Description of Artificial Sequence: Synthetic coding sequence
atgaccatgcctgtgaatggagcccacaaggatgctgacctgtggagcagccatgacaagatgctggcccagcccctgaaggacagtgatgtggaggtgtacaacatcatcaagaaggagagcaaccggcagagggtgggcctggagctgattgccagcgagaactttgccagcagagctgtgctggaggccctgggcagctgcctgaacaacaagtacagcgagggctacccaggccagcgctactatggaggaacagagttcattgatgagctggagaccctgtgccagaagagggccctgcaggcctacaagctggacccccagtgctggggcgtgaatgtgcagccctacagcggcagccctgccaactttgctgtgtacacagccctggtggagccccacggccgcatcatgggcctggacctgcctgatggcggccacctgacccacggcttcatgacagacaagaagaagatcagcgccaccagcatcttctttgagagcatgccctacaaggtgaacccagacaccggctacatcaactatgaccagctggaggagaatgcccggctcttccaccccaagctgatcatcgccggcaccagctgctacagcaggaacctggagtatgcccggctgaggaagattgctgatgaaaatggagcctacctgatggctgacatggcccacatcagcggcctggtggccgccggcgtggtgcccagcccctttgagcactgccacgtggtgaccaccaccacccacaagaccctgcggggctgccgggccggcatgatcttctacagaaaaggagtgaagtctgtggaccccaagacaggcaaggagatcctgtacaacctggagagcctcatcaacagcgctgtgtttcctggcctgcagggcggcccccacaaccacgccatcgccggcgtggccgtggccctgaagcaggccatgaccctggagttcaaggtgtaccagcaccaggtggtggccaactgccgggccctgtctgaggccctgacagagctgggctacaagatcgtgactggaggcagtgacaaccacctgatcctggtggacctgcggagcaagggcacagatggcggccgggcagagaaggtgctggaggcctgcagcatcgcctgcaacaagaacacctgccctggggacagaagtgccctgcggcccagcggcctgcggctgggcaccccagccctgaccagccggggcctgctggagaaggacttccagaaggtggcccacttcatccaccggggcatcgagctgaccctgcagatccagagcgacacaggagtgcgggccaccctgaaggagttcaaggagcggctggccggggacaagtaccaggccgctgtgcaggccctgcgggaggaggtggagagctttgccagcctcttccccctgcccggcctgcctgacttctag

SEQ ID NO: 169213 - DNA, 378 bp, Artificial Sequence
  Description of Artificial Sequence: Synthetic coding sequence
atgagatacctgctgcaggtggcccagctggtgtggctgactgtggacagccggggcatcggcggcaccctggaccatgctggcttcagcatctgcatcttcaccgtgccccccctgtccttcttcggcctgtgtgaggcccagaccttcggcctgagcggcagcaagagccctgccctgcaccgctactacggcggcacagagttcattgatgagctggagaccctgtgccagaagagggccctgcaggcctacaagctggacccccagtgctggggcgtgaatgtgcccacccaggtgctggtgagcagcatctggccaggagctgccagcagctgtgccagccccagggctgacatgcaccaggaggagagctag

SEQ ID NO: 169214 - DNA, 1212 bp, Artificial Sequence
  Description of Artificial Sequence: Synthetic coding sequence
atgaccatgcctgtgaatggagcccacaaggatgctgacctgtggagcagccatgacaagatgctggcccagcccctgaaggacagtgatgtggaggtgtacaacatcatcaagaaggagagcaaccggcagagggtgggcctggagctgattgccagcgagaactttgccagcagagctgtgctggaggccctgggcagctgcctgaacaacaagtacagcgagggctacccaggccagcgctactatggaggaacagagttcattgatgagctggagaccctgtgccagaagagggccctgcaggcctacaagctggacccccagtgctggggcgtgaatgtgcagccctacagcggcagccctgccaactttgctgtgtacacagccctggtggagccccacggccgcatcatgggcctggacctgcctgatggcggccacctgacccacggcttcatgacagacaagaagaagatcagcgccaccagcatcttctttgagagcatgccctacaaggtgaacccagacaccggctacatcaactatgaccagctggaggagaatgcccggctcttccaccccaagctgatcatcgccggcaccagctgctacagcaggaacctggagtatgcccggctgaggaagattgctgatgaaaatggagcctacctgatggctgacatggcccacatcagcggcctggtggccgccggcgtggtgcccagcccctttgagcactgccacgtggtgaccaccaccacccacaagaccctgcggggctgccgggccggcatgatcttctacagaaaaggaggcagtgacaaccacctgatcctggtggacctgcggagcaagggcacagatggcggccgggcagagaaggtgctggaggcctgcagcatcgcctgcaacaagaacacctgccctggggacagaagtgccctgcggcccagcggcctgcggctgggcaccccagccctgaccagccggggcctgctggagaaggacttccagaaggtggcccacttcatccaccggggcatcgagctgaccctgcagatccagagcgacacaggagtgcgggccaccctgaaggagttcaaggagcggctggccggggacaagtaccaggccgctgtgcaggccctgcgggaggaggtggagagctttgccagcctcttccccctgcccggcctgcctgacttctag

SEQ ID NO: 169215 - DNA, 1335 bp, Artificial Sequence
  Description of Artificial Sequence: Synthetic coding sequence
atgaccatgcctgtgaatggagcccacaaggatgctgacctgtggagcagccatgacaagatgctggcccagcccctgaaggacagtgatgtggaggtgtacaacatcatcaagaaggagagcaaccggcagagggtgggcctggagctgattgccagcgagaactttgccagcagagctgtgctggaggccctgggcagctgcctgaacaacaagtacagcgagggctacccaggccagcgctactatggaggaacagagttcattgatgagctggagaccctgtgccagaagagggccctgcaggcctacaagctggacccccagtgctggggcgtgaatgtgcagccctacagcggcagccctgccaactttgctgtgtacacagccctggtggagccccacggccgcatcatgggcctggacctgcctgatggcggccacctgacccacggcttcatgacagacaagaagaagatcagcgccaccagcatcttctttgagagcatgccctacaaggtgaacccagacaccggctacatcaactatgaccagctggaggagaatgcccggctcttccaccccaagctgatcatcgccggcaccagctgctacagcaggaacctggagtatgcccggctgaggaagattgctgatgaaaatggagcctacctgatggctgacatggcccacatcagcggcctggtggccgccggcgtggtgcccagcccctttgagcactgccacgtggtgaccaccaccacccacaagaccctgcggggctgccgggccggcatgatcttctacagaaaaggagtggccgtggccctgaagcaggccatgaccctggagttcaaggtgtaccagcaccaggtggtggccaactgccgggccctgtctgaggccctgacagagctgggctacaagatcgtgactggaggcagtgacaaccacctgatcctggtggacctgcggagcaaaggaacagatggcggccgggcagagaaggtgctggaggcctgcagcatcgcctgcaacaagaacacctgccctggggacagaagtgccctgcggcccagcggcctgcggctgggcaccccagccctgaccagccggggcctgctggagaaggacttccagaaggtggcccacttcatccaccggggcatcgagctgaccctgcagatccagagcgacaccggggtgcgggccaccctgaaggagttcaaggagcggctggccggggacaagtaccaggccgctgtgcaggccctgcgggaggaggtggagagctttgccagcctcttccccctgcccggcctgcctgacttctag

SEQ ID NO: 169216 - DNA, 285 bp, Artificial Sequence
  Description of Artificial Sequence: Synthetic coding sequence
atgaccatgcctgtgaatggagcccacaaggatgctgacctgtggagcagccatgacaagatgctggcccagcccctgaaggacagtgatgtggaggtgtacaacatcatcaagaaggagagcaaccggcagagggtgggcctggagctgattgccagcgagaactttgccagcagagctgtgctggaggccctgggcagctgcctgaacaacaagtacagcgagggctacccaggccagcgctacgtgaacatcttcaagggcctggtgctgacccagagctag

SEQ ID NO: 169217 - DNA, 777 bp, Artificial Sequence
  Description of Artificial Sequence: Synthetic coding sequence
atggctgacatggcccacatcagcggcctggtggccgccggcgtggtgcccagcccctttgagcactgccacgtggtgaccaccaccacccacaagaccctgcggggctgcagagctggcatgatcttctacaggaagggcgtgaagtctgtggaccccaagacaggcaaggagatcctgtacaacctggagagcctcatcaacagcgctgtgtttcctggcctgcagggcggcccccacaaccacgccatcgccggcgtggccgtggccctgaagcaggccatgaccctggagttcaaggtgtaccagcaccaggtggtggccaactgccgggccctgtctgaggccctgacagagctgggctacaagatcgtgactggaggcagtgacaaccacctgatcctggtggacctgcggagcaaaggaacagatggcggccgggcagagaaggtgctggaggcctgcagcatcgcctgcaacaagaacacctgccctggggacagaagtgccctgcggcccagcggcctgcggctgggcaccccagccctgaccagccggggcctgctggagaaggacttccagaaggtggcccacttcatccaccggggcatcgagctgaccctgcagatccagagcgacaccggggtgcgggccaccctgaaggagttcaaggagcggctggccggggacaagtaccaggccgctgtgcaggccctgcgggaggaggtggagagctttgccagcctcttccccctgcccggcctgcctgacttctag

SEQ ID NO: 169218 - DNA, 1341 bp, Artificial Sequence
  Description of Artificial Sequence: Synthetic coding sequence
atgaccatgcctgtgaatggagcccacaaggatgctgacctgtggagcagccatgacaagatgctggcccagcccctgaaggacagtgatgtggaggtgtacaacatcatcaagaaggagagcaaccggcagagggtgggcctggagctgattgccagcgagaactttgccagcagagctgtgctggaggccctgggcagctgcctgaacaacaagtacagcgagggctacccaggccagcgctactatggaggaacagagttcattgatgagctggagaccctgtgccagaagagggccctgcaggcctacaagctggacccccagtgctggggcgtgaatgtgcagccctacagcggcagccctgccaactttgctgtgtacacagccctggtggagccccacggccgcatcatgggcctggacctgcctgatggcggccacctgacccacggcttcatgacagacaagaagaagatcagcgccaccagcatcttctttgagagcatgccctacaaggtgaacccagacaccggctacatcaactatgaccagctggaggagaatgcccggctcttccaccccaagctgatcatcgccggcaccagctgctacagcaggaacctggagtatgcccggctgaggaagattgctgatgaaaatggagcctacctgatggctgacatggcccacatcagcggcctggtggccgccggcgtggtgcccagcccctttgagcactgccacgtggtgaccaccaccacccacaagaccctgcggggctgccgggccggcatgatcttctacagaaaaggagtgaagtctgtggaccccaagacaggcaaggagatcctgtacaacctggagagcctcatcaacagcgctgtgtttcctggcctgcagggcggcccccacaaccacgccatcgccggcgtggccgtggccctgaagcaggccatgaccctggagttcaaggtgtaccagcaccaggtggtggccaactgccgggccctgtctgaggccctgacagagctgggctacaagatcgtgactggaggcagtgacaaccacctgatcctggtggacctgcggagcaagggcacagatggcggccgggcagagaaggtgctggaggcctgcagcatcgcctgcaacaagaacacctgccccggcatcgagctgaccctgcagatccagagcgacaccggggtgcgggccaccctgaaggagttcaaggagcggctggccggggacaagtaccaggccgctgtgcaggccctgcgggaggaggtggagagctttgccagcctcttccccctgcccggcctgcctgacttctag

SEQ ID NO: 169219 - DNA, 1038 bp, Artificial Sequence
  Description of Artificial Sequence: Synthetic coding sequence
atgggcctggacctgcctgatggcggccacctgacccacggcttcatgacagacaagaagaagatcagcgccaccagcatcttctttgagagcatgccctacaaggtgaacccagacaccggctacatcaactatgaccagctggaggagaatgcccggctcttccaccccaagctgatcatcgccggcaccagctgctacagcaggaacctggagtatgcccggctgaggaagattgctgatgaaaatggagcctacctgatggctgacatggcccacatcagcggcctggtggccgccggcgtggtgcccagcccctttgagcactgccacgtggtgaccaccaccacccacaagaccctgcggggctgccgggccggcatgatcttctacagaaaaggagtgaagtctgtggaccccaagacaggcaaggagatcctgtacaacctggagagcctcatcaacagcgctgtgtttcctggcctgcagggcggcccccacaaccacgccatcgccggcgtggccgtggccctgaagcaggccatgaccctggagttcaaggtgtaccagcaccaggtggtggccaactgccgggccctgtctgaggccctgacagagctgggctacaagatcgtgactggaggcagtgacaaccacctgatcctggtggacctgcggagcaagggcacagatggcggccgggcagagaaggtgctggaggcctgcagcatcgcctgcaacaagaacacctgccctggggacagaagtgccctgcggcccagcggcctgcggctgggcaccccagccctgaccagccggggcctgctggagaaggacttccagaaggtggcccacttcatccaccggggcatcgagctgaccctgcagatccagagcgacacaggagtgcgggccaccctgaaggagttcaaggagcggctggccggggacaagtaccaggccgctgtgcaggccctgcgggaggaggtggagagctttgccagcctcttccccctgcccggcctgcctgacttctag

SEQ ID NO: 169220 - DNA, 1515 bp, Artificial Sequence
  Description of Artificial Sequence: Synthetic coding sequence
atgctgtacttcagcctcttctgggccgcccggcccctgcagagatgtggccagctggtgaggatggccatccgggcccagcacagcaatgctgcccagacccagacaggagaggccaacagaggctggacaggccaggagagcctgagtgacagcgaccctgagatgtgggagctgctgcagcgggagaaggaccggcagtgccggggcctggagctgattgccagcgagaacttctgcagcagagctgccctggaggccctgggcagctgcctgaacaacaagtacagcgagggctacccaggcaagcgctactacggcggcgctgaggtggtggatgaaattgagctgctgtgccagaggcgggccctggaggcctttgacctggaccctgcccagtggggcgtgaatgtgcagccctacagcggcagccctgccaacctggccgtgtacacagccctgctgcagccccatgaccgcatcatgggcctggacctgcctgatggcggccacctgacccacggctacatgtctgatgtgaagaggatcagcgccaccagcatcttctttgagagcatgccctacaagctgaaccccaagacaggcctgattgactacaaccagctggccctgacagcccggctcttccggcccaggctcatcatcgccggcaccagcgcctatgcccggctgattgattatgccaggatgagggaggtgtgtgatgaggtgaaggcccacctgctggccgacatggcccacatcagcggcctggtggccgccaaggtgatccccagccccttcaagcatgctgacatcgtgaccaccaccacccacaagaccctgcggggggcccggagcggcctcatcttctacaggaagggcgtgaaggctgtggaccccaagacaggccgggagatcccctacacctttgaggaccgcatcaactttgctgtgttccccagcctgcagggcggcccccacaaccacgccatcgctgctgtggccgtggccctgaagcaggcctgcacccccatgttccgggagtacagcctgcaggtgctgaagaatgcccgggccatggctgatgccctgctggagcggggctacagcctggtgtctgggggcacagacaaccacctggtgctggtggacctgcggcccaagggcctggatggagcccgggcagagcgggtgctggagctggtgtccatcacagccaacaagaacacctgccctggggacagaagtgccatcaccccaggcggcctgcggctgggcgccccagccctgaccagccggcagttccgggaggatgacttccggcgggtggtggacttcattgatgaaggagtgaacatcggcctggaggtgaagagcaagacagccaagctgcaggacttcaagagcttcctgctgaaggacagcgagaccagccagaggctggccaacctgcggcagagggtggagcagtttgcccgggccttccccatgcctggctttgatgagcactag

SEQ ID NO: 169221 - DNA, 1227 bp, Artificial Sequence
  Description of Artificial Sequence: Synthetic coding sequence
atgggagagcagcgctggtggatgaagctgagctgctgtgccagcgctggcccctggaagcccctgacctggatcctgcacagcggggagagcatgagcagccccaccccaggcccccagcccacctggcccagcacccagcccttctgcaacctgaccaccggctcctggggctggacctgccccatgggcgccatcagccccacagccacctgcctgaccagcagcggctaccagccccggcccagcagcagcagcctgtgccccatcagcagcacagccctggccgtgtgtgtgtctgtgcagcccaagacaggcctgattgactacaaccagctggccctgacagcccggctcttccggcccaggctcatcatcgccggcaccagcgcctatgcccggctgattgattatgccaggatgagggaggtgtgtgatgaggtgaaggcccacctgctggccgacatggcccacatcagcggcctggtggccgccaaggtgatccccagccccttcaagcatgctgacatcgtgaccaccaccacccacaagaccctgcggggggcccggagcggcctcatcttctacaggaagggcgtgaaggctgtggaccccaagacaggccgggagatcccctacacctttgaggaccgcatcaactttgctgtgttccccagcctgcagggcggcccccacaaccacgccatcgctgctgtggccgtggccctgaagcaggcctgcacccccatgttccgggagtacagcctgcaggtgctgaagaatgcccgggccatggctgatgccctgctggagcggggctacagcctggtgtctgggggcacagacaaccacctggtgctggtggacctgcggcccaagggcctggatggagcccgggcagagcgggtgctggagctggtgtccatcacagccaacaagaacacctgccctggggacagaagtgccatcaccccaggcggcctgcggctgggcgccccagccctgaccagccggcagttccgggaggatgacttccggcgggtggtggacttcattgatgaaggagtgaacatcggcctggaggtgaagagcaagacagccaagctgcaggacttcaagagcttcctgctgaaggacagcgagaccagccagaggctggccaacctgcggcagagggtggagcagtttgcccgggccttccccatgcctggctttgatgagcactag

SEQ ID NO: 169222 - DNA, 1452 bp, Artificial Sequence
  Description of Artificial Sequence: Synthetic coding sequence
atggccatccgggcccagcacagcaatgctgcccagacccagacaggagaggccaacagaggctggacaggccaggagagcctgagtgacagcgaccctgagatgtgggagctgctgcagcgggagaaggaccggcagtgccggggcctggagctgattgccagcgagaacttctgcagccgggccgccctggaggccctgggcagctgcctgaacaacaagtacagcgagggctacccaggcaagcgctactatggaggagctgaggtggtggatgaaattgagctgctgtgccagaggcgggccctggaggcctttgacctggaccctgcccagtggggcgtgaatgtgcagccctacagcggcagccctgccaacctggccgtgtacacagccctgctgcagccccatgaccgcatcatgggcctggacctgcctgatggcggccacctgacccacggctacatgtctgatgtgaagaggatcagcgccaccagcatcttctttgagagcatgccctacaagctgaaccccaagacaggcctgattgactacaaccagctggccctgacagcccggctcttccggcccaggctcatcatcgccggcaccagcgcctatgcccggctgattgattatgccaggatgagggaggtgtgtgatgaggtgaaggcccacctgctggccgacatggcccacatcagcggcctggtggccgccaaggtgatccccagccccttcaagcacgccgacatcgtgaccaccaccacccacaagaccctgcggggggcccggagcggcctcatcttctacagaaaaggagtgaaggctgtggaccccaagacaggccgggagatcccctacacctttgaagatcgcatcaactttgctgtgttccccagcctgcagggcggcccccacaaccacgccatcgctgctgtggccgtggccctgaagcaggcctgcacccccatgttccgggagtacagcctgcaggtgctgaagaatgcccgggccatggctgatgccctgctggagcggggctacagcctggtgtctgggggcacagacaaccacctggtgctggtggacctgcggcccaagggcctggatggagcccgggcagagcgggtgctggagctggtgtccatcacagccaacaagaacacctgccctggggacagaagtgccatcacccctgggggcctgcggctgggcgccccagccctgaccagccggcagttcagagaagatgacttcagaagagtggtggacttcattgatgagggcgtgaacatcggcctggaggtgaagagcaagacagccaagctgcaggacttcaagagcttcctgctgaaggacagcgagaccagccagaggctggccaacctgcggcagagggtggagcagtttgcccgggccttccccatgcctggctttgatgagcactag

SEQ ID NO: 169223 - DNA, 1452 bp, Artificial Sequence; identical to SEQ ID NO: 169222
  Description of Artificial Sequence: Synthetic coding sequence

SEQ ID NO: 169224 - DNA, 1452 bp, Artificial Sequence; identical to SEQ ID NO: 169222
  Description of Artificial Sequence: Synthetic coding sequence

SEQ ID NO: 169225 - DNA, 1485 bp, Artificial Sequence
  Description of Artificial Sequence: Synthetic coding sequence
atgctgtacttcagcctcttctgggccgcccggcccctgcagagatgtggccagctggtgaggatggccatccgggcccagcacagcaatgctgcccagacccagacaggagaggccaacagaggctggacaggccaggagagcctgagtgacagcgaccctgagatgtgggagctgctgcagcgggagaaggaccggcagtgccggggcctggagctgattgccagcgagaacttctgcagcagagctgccctggaggccctgggcagctgcctgaacaacaagtacagcgagggctacccaggcaagcgctactacggcggcgctgaggtggtggatgaaattgagctgctgtgccagaggcgggccctggaggcctttgacctggaccctgcccagtggggcgtgaatgtgcagccctacagcggcagccctgccaacctggccgtgtacacagccctgctgcagccccatgaccgcatcatgggcctggacctgcctgatggcggccacctgacccacggctacatgtctgatgtgaagaggatcagcgccaccagcatcttctttgagagcatgccctacaagctgaacctggccctgacagcccggctcttccggcccaggctcatcatcgccggcaccagcgcctatgcccggctgattgattatgccaggatgagggaggtgtgtgatgaggtgaaggcccacctgctggccgacatggcccacatcagcggcctggtggccgccaaggtgatccccagccccttcaagcatgctgacatcgtgaccaccaccacccacaagaccctgcggggggcccggagcggcctcatcttctacaggaagggcgtgaaggctgtggaccccaagacaggccgggagatcccctacacctttgaggaccgcatcaactttgctgtgttccccagcctgcagggcggcccccacaaccacgccatcgctgctgtggccgtggccctgaagcaggcctgcacccccatgttccgggagtacagcctgcaggtgctgaagaatgcccgggccatggctgatgccctgctggagcggggctacagcctggtgtctgggggcacagacaaccacctggtgctggtggacctgcggcccaagggcctggatggagcccgggcagagcgggtgctggagctggtgtccatcacagccaacaagaacacctgccctggggacagaagtgccatcaccccaggcggcctgcggctgggcgccccagccctgaccagccggcagttccgggaggatgacttccggcgggtggtggacttcattgatgaaggagtgaacatcggcctggaggtgaagagcaagacagccaagctgcaggacttcaagagcttcctgctgaaggacagcgagaccagccagaggctggccaacctgcggcagagggtggagcagtttgcccgggccttccccatgcctggctttgatgagcactag

SEQ ID NO: 169226 - DNA, 1422 bp, Artificial Sequence
  Description of Artificial Sequence: Synthetic coding sequence
atgggcgctgtgctgggcgtcttcagcctggcctcctgggtgccctgcctgtgcagcggggccagctgcctgctgtgcagctgctgccccaacagcaagaacagcacagtgaccaggctcatctatgccttcatcctgctgctgagcacagtggtgtcctacatcatgcagaggaaggagatggagacctacctgaagaagatccctggcttctgtgagggcggcttcaagatccatgaagctgacatcaatgctgacaaggactgtgatgtgctggtgggctacaaggctgtgtaccgcatcagctttgccatggccatcttcttctttgtgttcagcctgctgatgttcaaggtgaagaccagcaaggacctgcgggctgctgtgcacaacggcttctggttcttcaagattgctgccctgattggcatcatggtgggcagcttctacatccctgggggctacttcagctctgtgtggtttgtggtgggcatgattggagctgccctcttcatcctgatccagctggtgctgctggtggactttgcccacagctggaatgaatcctgggtgaacaggatggaggagggcaacccccggctgtggtacgccgccctgctgtccttcaccagcgccttctacatcctgagcatcatctgtgtgggcctgctgtacacctactacaccaagccagatggctgcacagagaacaagttcttcatcagcatcaacctgatcctgtgtgtggtggccagcatcatcagcatccaccccaagatccaggagcaccagcccaggagcggcctgctgcagagcagcctcatcaccctgtacaccatgtacctgacctggagcgccatgagcaatgaaccagacaggagctgcaaccccaacctgatgtccttcatcacccgcatcacagcccccaccctggcccctggcaacagcacagctgtggtgcccacccccaccccacccagcaagagcggcagcctgctggacagcgacaacttcatcggcctgtttgtgtttgtgctgtgcctgctgtacagcagcatccgcaccagcaccaacagccaggtggacaagctgaccctgagcggcagtgacagcgtcatcctgggggacaccaccaccagcggggccagtgatgaggaggatggccagcccaggagagctgtggacaatgagaaggagggcgtgcagtacagctacagcctcttccacctgatgctgtgcctggccagcctgtacatcatgatgaccctgacctcctggtacagcccagatgccaagttccagagcatgaccagcaagtggccagctgtgtgggtgaagatcagcagctcctgggtgtgcctgctgctgtatgtgtggaccctggtggcccccctggtgctgaccagccgggacttctcctag

SEQ ID NO: 169227 - DNA, 1422 bp, Artificial Sequence; identical to SEQ ID NO: 169226
  Description of Artificial Sequence: Synthetic coding sequence

SEQ ID NO: 169228 - DNA, 639 bp, Artificial Sequence
  Description of Artificial Sequence: Synthetic coding sequence
gagcaccagcccaggagcggcctgctgcagagcagcctcatcaccctgtacaccatgtacctgacctggagcgccatgagcaatgaaccagacaggagctgcaaccccaacctgatgtccttcatcacccgcatcacagcccccaccctggcccctggcaacagcacagctgtggtgcccacccccaccccacccagcaagagcggcagcctgctggacagcgacaacttcatcggcctgtttgtgtttgtgctgtgcctgctgtacagcagcatccgcaccagcaccaacagccaggtggacaagctgaccctgagcggcagtgacagcgtcatcctgggggacaccaccaccagcggggccagtgatgaagaagatggccagccccggcgggctgtggacaatgagaaggagggcgtgcagtacagctacagcctcttccacctgatgctgtgcctggccagcctgtacatcatgatgaccctgacctcctggtacagcccagatgccaagttccagagcatgaccagcaagtggccagctgtgtgggtgaagatcagcagctcctgggtgtgcctgctgctgtatgtgtggaccctggtggcccccctggtgctgaccagccgggacttctcctag

SEQ ID NO: 169229 - DNA, 1323 bp, Artificial Sequence
  Description of Artificial Sequence: Synthetic coding sequence
atgcccctgcagcgctgcctgatctatgccttcatcctgctgctgagcacagtggtgtcctacatcatgcagaggaaggagatggagacctacctgaagaagatccctggcttctgtgagggcggcttcaagatccacgaggccgacatcaatgctgacaaggactgtgatgtgctggtgggctacaaggctgtgtaccgcatcagctttgccatggccatcttcttctttgtgttcagcctgctgatgttcaaggtgaagaccagcaaggacctgcgggctgctgtgcacaacggcttctggttcttcaagattgctgccctgattggcatcatggtgggcagcttctacatccctgggggctacttcagctctgtgtggtttgtggtgggcatgattggagctgccctcttcatcctgatccagctggtgctgctggtggactttgcccacagctggaatgaatcctgggtgaacaggatggaggagggcaacccccggctgtggtatgctgccctgctgtccttcaccagcgccttctacatcctgagcatcatctgtgtgggcctgctgtacacctactacaccaagccagatggctgcacagagaacaagttcttcatcagcatcaacctgatcctgtgtgtggtggccagcatcatcagcatccaccccaagatccaggagcaccagcccaggagcggcctgctgcagagcagcctcatcaccctgtacaccatgtacctgacctggagcgccatgagcaatgaaccagacaggagctgcaaccccaacctgatgtccttcatcacccgcatcacagcccccaccctggcccctggcaacagcacagctgtggtgcccacccccaccccacccagcaagagcggcagcctgctggacagcgacaacttcatcggcctgtttgtgtttgtgctgtgcctgctgtacagcagcatccgcaccagcaccaacagccaggtggacaagctgaccctgagcggcagtgacagcgtcatcctgggggacaccaccaccagcggggccagtgatgaagaagatggccagccccggcgggctgtggacaatgagaaggagggcgtgcagtacagctacagcctcttccacctgatgctgtgcctggccagcctgtacatcatgatgaccctgacctcctggtacagcccagatgccaagttccagagcatgaccagcaagtggccagctgtgtgggtgaagatcagcagctcctgggtgtgcctgctgctgtatgtgtggaccctggtggcccccctggtgctgaccagccgggacttctcctag

SEQ ID NO: 169230 - DNA, 1257 bp, Artificial Sequence
  Description of Artificial Sequence: Synthetic coding sequence
atgcagaggaaggagatggagacctacctgaagaagatccctggcttctgtgagggcggcttcaagatccacgaggccgacatcaatgctgacaaggactgtgatgtgctggtgggctacaaggctgtgtaccgcatcagctttgccatggccatcttcttctttgtgttcagcctgctgatgttcaaggtgaagaccagcaaggacctgcgggctgctgtgcacaacggcttctggttcttcaagattgctgccctgattggcatcatggtgggcagcttctacatccctgggggctacttcagctctgtgtggtttgtggtgggcatgattggagctgccctcttcatcctgatccagctggtgctgctggtggactttgcccacagctggaatgaatcctgggtgaacaggatggaggagggcaacccccggctgtggtatgctgccctgctgtccttcaccagcgccttctacatcctgagcatcatctgtgtgggcctgctgtacacctactacaccaagccagatggctgcacagagaacaagttcttcatcagcatcaacctgatcctgtgtgtggtggccagcatcatcagcatccaccccaagatccaggagcaccagcccaggagcggcctgctgcagagcagcctcatcaccctgtacaccatgtacctgacctggagcgccatgagcaatgaaccagacaggagctgcaaccccaacctgatgtccttcatcacccgcatcacagcccccaccctggcccctggcaacagcacagctgtggtgcccacccccaccccacccagcaagagcggcagcctgctggacagcgacaacttcatcggcctgtttgtgtttgtgctgtgcctgctgtacagcagcatccgcaccagcaccaacagccaggtggacaagctgaccctgagcggcagtgacagcgtcatcctgggggacaccaccaccagcggggccagtgatgaagaagatggccagccccggcgggctgtggacaatgagaaggagggcgtgcagtacagctacagcctcttccacctgatgctgtgcctggccagcctgtacatcatgatgaccctgacctcctggtacagcccagatgccaagttccagagcatgaccagcaagtggccagctgtgtgggtgaagatcagcagctcctgggtgtgcctgctgctgtatgtgtggaccctggtggcccccctggtgctgaccagccgggacttctcctag

SEQ ID NO: 169231 - DNA, 1422 bp, Artificial Sequence
  Description of Artificial Sequence: Synthetic coding sequence
atggccacagccacagagcagtgggtgctggtggagatggtgcaggccctgtatgaggccccagcctaccacctgatcctggagggcatcctgatcctgtggatcatccggctgctcttcagcaagacctacaagctgcaggagaggagtgacctgactgtgaaggagaaggaggagctgattgaggagtggcagcctgagcccctggtgccccctgtgcccaaggaccacccagccctgaactacaacatcgtgtctggcccccccagccacaagacagtggtgaatggcaaggagtgcatcaactttgccagcttcaacttcctgggcctgctggacaacccccgggtgaaggccgccgccctggccagcctgaagaagtatggagtgggcacctgtggcccccggggcttctacggcacctttgatgtgcacctggacctggaggaccggctggccaagttcatgaagacagaggaggccatcatctacagctatggctttgccaccatcgccagcgccatcccagcctacagcaagagaggagacatcgtgtttgtggaccgggccgcctgctttgccatccagaagggcctgcaggccagcagaagtgacatcaagctgttcaagcacaatgacatggctgacctggagcggctgctgaaggagcaggagattgaggaccagaagaaccccaggaaggcccgggtgacccggcgcttcatcgtggtggagggcctgtacatgaacacaggcaccatctgccccctgcctgagctggtgaagctgaagtacaagtacaaggcccgcatcttcctggaggagagcctgagctttggagtgctgggggagcacggccggggcgtgacagagcactacggcatcaacattgatgacatcgacctgatcagcgccaacatggagaatgccctggccagcatcggcggcttctgctgcggccgcagctttgtgattgaccaccagaggctgagcggccagggctactgcttcagcgccagcctgccccccctgctggccgccgccgccatcgaggccctgaacatcatggaggagaaccctggcatctttgctgtgctgaaggagaagtgtggccagatccacaaggccctgcagggcatcagcggcctgaaggtggtgggggagagcctgagccctgccttccacctgcagctggaggagagcacaggcagccgggagcaggatgtgcggctgctgcaggagatcgtggaccagtgcatgaacagaagcatcgccctgacccaggcccgctacctggagaaggaggagaagtgcctgcccccacccagcatccgggtggtggtgacagtggagcagacagaggaggagctggagcgggccgccagcaccatcaaggaggtggcccaggccgtgctgctgtag

SEQ ID NO: 169232 - DNA, 432 bp, Artificial Sequence
  Description of Artificial Sequence: Synthetic coding sequence
atggccacagccacagagcagtgggtgctggtggagatggtgcaggccctgtatgaggccccagcctaccacctgatcctggagggcatcctgatcctgtggatcatccggctgctcttcagcaagacctacaagctgcaggagaggagtgacctgactgtgaaggagaaggaggagctgattgaggagtggcagcctgagcccctggtgccccctgtgcccaaggaccacccagccctgaactacaacatcgtgtctggcccccccagccacaagacagtggtgaatggcaaggagtgcatcaactttgccagcttcaacttcctgggcctgctggacaacccccgggtgaaggccgccgccctggccagcctgaagaagtatggagtgggcacctgtggcccccggggcttctacggcacctttgaatag

SEQ ID NO: 169233 - DNA, 1017 bp, Artificial Sequence
  Description of Artificial Sequence: Synthetic coding sequence
atggccaagtggggcgagggggacccccgctggatcgtggaggagcgggcagatgccaccaacgtgaacaactggcactggacagaaagagatgccagcaactggagcacagacaagctgaagaccctcttcctggccgtgcaggtgcagaatgaggagggcaaatgtgaggtgacagaggtgtccaagctggatggagaggccagcatcaacaacaggaagggcaagctgatcttcttctatgagtggagcgtgaagctgaactggacaggcaccagcaagtctggagtgcagtacaagggccacgtggagatccccaacctgagtgatgaaaattctgtggatgaggtggagatctctgtgtccctggccaaggatgagccagacaccaacctggtggccctgatgaaggaggagggcgtgaagctgctgcgggaggccatgggcatctacatcagcaccctgaagacagagttcacccagggcatgatcctgcccaccatgaatggagagagcgtggaccctgtgggccagcctgccctgaagacagaggagaggaaggccaagccagcccccagcaagacccaggcccggcctgtgggcgtgaagatccccacctgcaagatcaccctgaaggagaccttcctgaccagccctgaggagctgtacagagtcttcaccacccaggagctggtgcaggccttcacccacgccccagccaccctggaggccgacagaggaggcaagttccacatggtggatggaaatgtgtctggagagttcacagacctggtgcctgagaagcacatcgtgatgaagtggaggttcaagtcctggccagagggccactttgccaccatcaccctgaccttcatcgacaagaatggagaaacagagctgtgcatggagggccggggcatcccagcccctgaggaggagaggacccggcagggctggcagcgctactactttgagggcatcaagcagaccttcggctatggagcccggctcttctag

SEQ ID NO: 169234 - DNA, 990 bp, Artificial Sequence
  Description of Artificial Sequence: Synthetic coding sequence
atggccaaccctgggggcggcgctgtgtgcaatggcaagctgcacaaccacaagaagcagagcaatggcagccagagcaggaactgcaccaagaatggcatcgtgaaggaggcccagcagaatggcaagccccacttctatgacaagctgattgtggagagctttgaggaggcccccctgcacgtgatggtgttcacctacatgggctacggcatcggcaccctgtttggctacctgcgggacttcctgaggaactggggcatcgagaagtgcaatgctgctgtggagaggaaggagcagaaggactttgtgcccctgtaccaggactttgagaacttctacaccaggaacctgtacatgaggatccgggacaactggaaccggcccatctgcagcgcccctggccccctgtttgacctgatggagcgggtgtctgatgactacaactggaccttccgcttcaccggccgggtcatcaaggatgtgatcaacatgggcagctacaacttcctgggcctggccgccaagtatgatgagagcatgaggaccatcaaggatgtgctggaggtgtatggaactggagtggccagcaccaggcatgagatgggcaccctggacaagcacaaggagctggaggacctggtggccaagttcctgaatgtggaggccgccatggtgtttggcatgggctttgccaccaacagcatgaacatcccagccctggtgggcaagggctgcctgatcctgagtgatgagctgaaccacaccagcctggtgctgggcgcccggctgagcggggccaccatccgcatcttcaagcacaacaacacccagagcctggagaagctgctgagagatgctgtgatctacggccagcccaggacccggcgggcctggaagaagatcctgatcctggtggagggcgtgtaccgcacctcctggatcatctacggcttcacccgcatcgtgctcttcatgctgcacccctag

SEQ ID NO: 169235 - DNA, 1659 bp, Artificial Sequence
  Description of Artificial Sequence: Synthetic coding sequence
atggccaaccctgggggcggcgctgtgtgcaatggcaagctgcacaaccacaagaagcagagcaatggcagccagagcaggaactgcaccaagaatggcatcgtgaaggaggcccagcagaatggcaagccccacttctatgacaagctgattgtggagagctttgaggaggcccccctgcacgtgatggtgttcacctacatgggctacggcatcggcaccctgtttggctacctgcgggacttcctgaggaactggggcatcgagaagtgcaatgctgctgtggagaggaaggagcagaaggactttgtgcccctgtaccaggactttgagaacttctacaccaggaacctgtacatgaggatccgggacaactggaaccggcccatctgcagcgcccctggccccctgtttgacctgatggagcgggtgtctgatgactacaactggaccttccgcttcaccggccgggtcatcaaggatgtgatcaacatgggcagctacaacttcctgggcctggccgccaagtatgatgagagcatgaggaccatcaaggatgtgctggaggtgtatggaactggagtggccagcaccaggcatgagatgggcaccctggacaagcacaaggagctggaggacctggtggccaagttcctgaatgtggaggccgccatggtgtttggcatgggctttgccaccaacagcatgaacatcccagccctggtgggcaagggctgcctgatcctgagtgatgagctgaaccacaccagcctggtgctgggcgcccggctgagcggggccaccatccgcatcttcaagcacaacaacacccagagcctggagaagctgctgagagatgctgtgatctacggccagcccaggacccggcgggcctggaagaagatcctgatcctggtggagggcgtgtacagcatggagggcagcatcgtgcacctgccccagatcatcgccctgaagaagaagtacaaggcctacctgtacattgatgaggcccacagcattggagctgtgggccccaccggccggggcgtgacagagttcttcggcctggacccccatgaggtggatgtgctgatgggcaccttcaccaagagctttggagccagcggcggctacatcgccggcaggaaggacctggtggactacctgcgggtgcacagccacagcgctgtgtatgccagctccatgagcccccccatcgccgagcagatcatccgcagcctgaagctgatcatgggcctggatggcaccacccagggcctgcagagggtgcagcagctggccaagaacacccgctacttccggcagaggctgcaggagatgggcttcatcatctatggaaatgaaaatgcctctgtggtgcccctgctgctgtacatgcctgggaaggtggccgcctttgcccggcacatgctggagaagaagattggagtggtggtggtgggcttccctgccacccccctggccgaggcccgggcccgcttctgtgtgtctgctgcccacacccgggagatgctggacacagtgctggaggccctggatgagatgggagacctgctgcagctgaagtacagccgccacaagaagagcgcccggcctgagctgtatgatgagaccagctttgagctggaggactag

SEQ ID NO: 169236 - DNA, 366 bp, Artificial Sequence
  Description of Artificial Sequence: Synthetic coding sequence
tgaagcccccccatcgccgagcagatcatccgcagcctgaagctgatcatgggcctggatggcaccacccagggcctgcagagggtgcagcagctggccaagaacacccgctacttccggcagaggctgcaggagatgggcttcatcatctatggaaatgaaaatgcctctgtggtgcccctgctgctgtacatgcctgggaaggtggccgcctttgcccggcacatgctggagaagaagattggagtggtggtggtgggcttccctgccacccccctggccgaggcccgggcccgcttctgtgtgtctgctgcccacacccgggagatgctggacaccgtcatctgctgcgtgatgaagatctag

SEQ ID NO: 169237 - DNA, 420 bp, Artificial Sequence
  Description of Artificial Sequence: Synthetic coding sequence
atggccaaccctgggggcggcgctgtgtgcaatggcaagctgcacaaccacaagaagcagagcaatggcagccagagcaggaactgcaccaagaatggcatcgtgaaggaggcccagcagaatggcaagccccacttctatgacaagctgattgtggagagctttgaggaggcccccctgcacgtgatggtgttcacctacatgggctacggcatcggcaccctgtttggctacctgcgggacttcctgaggaactggggcatcgagaagtgcaatgctgctgtggagaggaaggagcagaaggactttgtgcccctgtaccaggactttgagaacttctacaccaggaacctgtacatgaggatccgggacaactggaaccggcccatctgcagcgcccctggccccctgtttgattag

SEQ ID NO: 169238 - DNA, 648 bp, Artificial Sequence
  Description of Artificial Sequence: Synthetic coding sequence
aactgcaccaagaatggaattgtgaaggaggcccagcagaatggcaagccccacttctatgacaagctgattgtggagagctttgaggaggcccccctgcacgtgatggtgttcacctacatgggctatggaattggcaccctgtttggctacctgcgggacttcctgaggaactggggcattgaaaaatgtaatgctgctgtggagaggaaggagcagaaggactttgtgcccctgtaccaggactttgagaacttctacaccaggaacctgtacatgaggatccgggacaactggaaccggcccatctgcagcgcccctggccccctgtttgacctgatggagcgggtgtctgatgactacaactggaccttccgcttcaccggccgggtcatcaaggatgtgatcaacatgggcagctacaacttcctgggcctggccgccaagtatgatgagagcatgaggaccatcaaggatgtgctggaggtgtatggcaccggggtggccagcaccaggcatgagatgggagagttcaccagctcctggcagaatgccctgtgtgtgggcggcgtgctgcaggccgacagcgtgccccagggccccccctggagctggaagatgggccgccacagcagcctgctggagtag

SEQ ID NO: 169239 - DNA, 360 bp, Artificial Sequence
  Description of Artificial Sequence: Synthetic coding sequence
atggccctgtctgtgctgcggctggccctgctgctgctggccgtgacctttgctggcagcgcccggagcggccctggagagcggggccccccagagaagagcggcttcggcagccagacaggaggcggcccctgcccagcccctgggggcctgggagatgccagcctcatcccccagtttggcctcttcagcaagtaccgcacccccaactgcagccagtaccgcctgcccggctgccccaggcacttcaaccctgtgtgtggcagtgacatgagcacctacgccaatgaatgtaccctgtgcatgaagatccgggagggcggccacaacatcaagatcatcagaaatggcccctgctag

SEQ ID NO: 169240 - DNA, 405 bp, Artificial Sequence
  Description of Artificial Sequence: Synthetic coding sequence
atggccctgtctgtgctgcggctggccctgctgctgctggccgtgacctttgctggcagcgcccggagcggccctggagagcggggccccccagagaagagcggcttcggcagccagacaggaggcggcccctgcccagcccctgggggcctgggagatggcacccgggcccctgtgactggaggcagccctgaggacctgcctgccagcctcatcccccagtttggcctcttcagcaagtaccgcacccccaactgcagccagtaccgcctgcccggctgccccaggcacttcaaccctgtgtgtggcagtgacatgagcacctacgccaatgaatgtaccctgtgcatgaagatccgggagggcggccacaacatcaagatcatcagaaatggcccctgctag

SEQ ID NO: 169241 - DNA, 240 bp, Artificial Sequence
  Description of Artificial Sequence: Synthetic coding sequence
atgaaggtgacaggcatcttcctgctgagcgccctggccctgctgagcctgagcggcaacacaggagctgacagcctgggccgggaggccaagtgctacaatgagctgaatggctgcaccaagatctatgaccctgtgtgtggcacagatggcaacacctacccaaatgaatgtgtgctgtgctttgaaaataggaagaggcagaccagcatcctgatccagaagagcggcccctgctag

SEQ ID NO: 169242 - DNA, 255 bp, Artificial Sequence
  Description of Artificial Sequence: Synthetic coding sequence
atggccctgtctgtgctgcggctggccctgctgctgctggccgtgacctttgctgccagcctcatcccccagtttggcctcttcagcaagtaccgcacccccaactgcagccagtaccgcctgcccggctgccccaggcacttcaaccctgtgtgtggcagtgacatgagcacctacgccaatgaatgtaccctgtgcatgaagatccgggagggcggccacaacatcaagatcatcagaaatggcccctgctag

SEQ ID NO: 169243 - DNA, 261 bp, Artificial Sequence
  Description of Artificial Sequence: Synthetic coding sequence
atggctgtgcggcagtgggtgattgccctggccctggccgccctgctggtggtggaccgggaggtgcctgtggccgccggcaagctgcccttcagcaggatgcccatctgtgagcacatggtggagagccccacctgcagccagatgagcaacctggtgtgtggcacagatggcctgacctacaccaatgaatgccagctgtgcctggcccgcatcaagaccaagcaggacatccagatcatgaaggatggaaaatgttag

SEQ ID NO: 169244 - DNA, 330 bp, Artificial Sequence
  Description of Artificial Sequence: Synthetic coding sequence
atgatcctgggcatcggcagcagcccccacctgctgtggaccctggagggcacccacatctggagcctgctgggagatgccagccacacagaccggctgcctgaggccggggccggcaagctgctgtctgaggtgcctgtggccgccggcaagctgcccttcagcaggatgcccatctgtgagcacatggtggagagccccacctgcagccagatgagcaacctggtgtgtggcacagatggcctgacctacaccaatgaatgccagctgtgcctggcccgcatcaagaccaagcaggacatccagatcatgaaggatggcaagtgctag

SEQ ID NO: 169245 - DNA, 330 bp, Artificial Sequence; identical to SEQ ID NO: 169244
  Description of Artificial Sequence: Synthetic coding sequence

SEQ ID NO: 169246 - DNA, 3195 bp, Artificial Sequence
  Description of Artificial Sequence: Synthetic coding sequence
atgaagatcgccaccgtgtctgtgctgctgcccctggccctgtgcctgatccaggatgctgccagcaagaatgaagaccaggagatgtgccacgagttccaggccttcatgaagaatggcaagctgttctgcccccaggacaagaagttcttccagagcctggatggcatcatgttcatcaacaagtgtgccacctgcaagatgatcctggagaaggaggccaagagccagaagagggcccggcacctggcccgggcccccaaggccacagcccccacagagctgaactgtgatgacttcaagaagggggagagagatggagacttcatctgcccagactactatgaagctgtgtgtggcacagatggcaagacctatgacaacagatgtgccctgtgtgctgaaaatgccaagacaggcagccagattggagtgaagtctgagggggagtgcaagagcagcaaccctgagcaggatgtgtgcagcgccttccggccctttgtgagagatggccgcctgggctgcacccgggagaatgaccctgtgctgggcccagatggcaagacccacggcaacaagtgtgccatgtgtgccgagctgttcctgaaggaggccgagaatgccaagcgggagggggagacccgcatcagaagaaatgctgagaaggacttctgcaaggagtatgagaagcaggtgagaaatggccgcctcttctgcacccgggagagtgaccctgtgcggggcccagatggccgcatgcacggcaacaagtgtgccctgtgtgccgagatcttcaagcagcgcttcagcgaggagaacagcaagacagaccagaacctgggcaaggccgaggagaagaccaaggtgaagcgggagatcgtgaagctgtgcagccagtaccagaaccaggccaagaatggcatcctcttctgcacccgggagaatgaccccatccggggcccagatggcaagatgcacggcaacctgtgcagcatgtgccaggcctacttccaggccgagaatgaggagaagaagaaggccgaggcccgggccaggaacaagcgggagagcggcaaggccaccagctatgcagagctgtgcagcgagtacaggaagctggtgagaaatggcaagctggcctgcacccgggagaatgaccccatccagggcccagatggcaaggtgcacggcaacacctgcagcatgtgtgaggtgttcttccaggccgaggaggaggagaagaagaagaaggagggcaagagcaggaacaagaggcagagcaagagcacagccagctttgaggagctgtgcagcgagtacaggaagagcaggaagaatggccgcctcttctgcacccgggagaatgaccccatccagggcccagatggcaagatgcacggcaacacctgcagcatgtgtgaggccttcttccagcaggaggagcgggcccgggccaaggccaagcgggaggccgccaaggagatctgcagcgagttccgggaccaggtgagaaatggcaccctcatctgcacccgggagcacaaccctgtgcggggcccagatggcaagatgcacggcaacaagtgtgccatgtgtgccagcgtcttcaagctggaggaggaggagaagaagaatgacaaggaggagaagggcaaggtggaggccgagaaggtgaagcgggaggccgtgcaggagctgtgcagcgagtaccgccactacgtgagaaatggccgcctgccctgcacccgggagaatgaccccatcgagggcctggatggcaagatccacggcaacacctgcagcatgtgtgaggccttcttccagcaggaggccaaggagaaggagagagctgagccccgggccaaggtgaagcgggaggccgagaaggagacctgtgatgagttccggcggctgctgcagaatggcaagctgttctgcaccagagaaaatgaccctgtgcggggcccagatggcaagacccacggcaacaagtgtgccatgtgcaaggctgtgttccagaaggaaaatgaggagaggaagaggaaggaggaggaggaccagagaaatgctgctggccacggcagcagcggcggcggcggcggcaacacccaggatgaatgtgccgagtaccgggagcagatgaagaatggccgcctgagctgcacccgggagagtgaccctgtgagagatgctgatggcaagagctacaacaaccagtgcaccatgtgcaaggccaagctggagcgggaggccgagaggaagaatgagtacagccgcagccgcagcaatggaactggaagtgaaagtggcaaggacacctgtgatgagttccgcagccagatgaagaatggcaagctgatctgcacccgggagagtgaccctgtgcggggcccagatggcaagacccacggcaacaagtgcaccatgtgcaaggagaagctggagcgggaggccgctgagaagaagaagaaggaggatgaagatagaagcaacacaggagagaggagcaacacaggagagaggagcaatgacaaggaggacctgtgccgggagttccgctccatgcagagaaatggcaagctgatctgcacccgggagaacaaccctgtgcggggcccctacggcaagatgcacatcaacaagtgtgccatgtgccagagcatctttgaccgggaggccaatgaaaggaagaagaaggatgaggagaagagcagcagcaagcccagcaacaatgccaaggatgaatgttctgagttcaggaactacatccggaacaatgagctgatctgccccagagaaaatgaccctgtgcacggggctgatggcaagttctacaccaacaagtgctacatgtgcagagctgtgttcctgacagaggccctggagcgggccaagctgcaggagaagcccagccacgtgcgggccagccaggaggaggacagcccagacagcttcagcagcctggacagcgagatgtgcaaggactacagagtgctgccccgcatcggctacctgtgccccaaggacctgaagcctgtgtgtggagatgatggccagacctacaacaacccctgcatgctgtgccacgagaacctgatccggcagaccaacacccacatccgcagcactggaaaatgtgaggagagcagcaccccaggcaccacagctgcctccatgccacccagtgatgaatag

SEQ ID NO: 169247 - DNA, 3285 bp, Artificial Sequence
  Description of Artificial Sequence: Synthetic coding sequence
atgaagatcgccaccgtgtctgtgctgctgcccctggccctgtgcctgatccaggatgctgccagcaagaatgaagaccaggagatgtgccacgagttccaggccttcatgaagaatggcaagctgttctgcccccaggacaagaagttcttccagagcctggatggcatcatgttcatcaacaagtgtgccacctgcaagatgatcctggagaaggaggccaagagccagaagagggcccggcacctggcccgggcccccaaggccacagcccccacagagctgaactgtgatgacttcaagaagggggagagagatggagacttcatctgcccagactactatgaagctgtgtgtggcacagatggcaagacctatgacaacagatgtgccctgtgtgctgaaaatgccaagacaggcagccagattggagtgaagtctgagggggagtgcaagagcagcaaccctgagcaggatgtgtgcagcgccttccggccctttgtgagagatggccgcctgggctgcacccgggagaatgaccctgtgctgggcccagatggcaagacccacggcaacaagtgtgccatgtgtgccgagctgttcctgaaggaggccgagaatgccaagcgggagggggagacccgcatcagaagaaatgctgagaaggacttctgcaaggagtatgagaagcaggtgagaaatggccgcctcttctgcacccgggagagtgaccctgtgcggggcccagatggccgcatgcacggcaacaagtgtgccctgtgtgccgagatcttcaagcagcgcttcagcgaggagaacagcaagacagaccagaacctgggcaaggccgaggagaagaccaaggtgaagcgggagatcgtgaagctgtgcagccagtaccagaaccaggccaagaatggcatcctcttctgcacccgggagaatgaccccatccggggcccagatggcaagatgcacggcaacctgtgcagcatgtgccaggcctacttccaggccgagaatgaggagaagaagaaggccgaggcccgggccaggaacaagcgggagagcggcaaggccaccagctatgcagagctgtgcagcgagtacaggaagctggtgagaaatggcaagctggcctgcacccgggagaatgaccccatccagggcccagatggcaaggtgcacggcaacacctgcagcatgtgtgaggtgttcttccaggccgaggaggaggagaagaagaagaaggagggcaagagcaggaacaagaggcagagcaagagcacagccagctttgaggagctgtgcagcgagtacaggaagagcaggaagaatggccgcctcttctgcacccgggagaatgaccccatccagggcccagatggcaagatgcacggcaacacctgcagcatgtgtgaggccttcttccagcaggaggagcgggcccgggccaaggccaagcgggaggccgccaaggagatctgcagcgagttccgggaccaggtgagaaatggcaccctcatctgcacccgggagcacaaccctgtgcggggcccagatggcaagatgcacggcaacaagtgtgccatgtgtgccagcgtcttcaagctggaggaggaggagaagaagaatgacaaggaggagaagggcaaggtggaggccgagaaggtgaagcgggaggccgtgcaggagctgtgcagcgagtaccgccactacgtgagaaatggccgcctgccctgcacccgggagaatgaccccatcgagggcctggatggcaagatccacggcaacacctgcagcatgtgtgaggccttcttccagcaggaggccaaggagaaggagagagctgagccccgggccaaggtgaagcgggaggccgagaaggagacctgtgatgagttccggcggctgctgcagaatggcaagctgttctgcaccagagaaaatgaccctgtgcggggcccagatggcaagacccacggcaacaagtgtgccatgtgcaaggctgtgttccagaaggaaaatgaggagaggaagaggaaggaggaggaggaccagagaaatgctgctggccacggcagcagcggcggcggcggcggcaacacccaggatgaatgtgccgagtaccgggagcagatgaagaatggccgcctgagctgcacccgggagagtgaccctgtgagagatgctgatggcaagagctacaacaaccagtgcaccatgtgcaaggccaagctggagcgggaggccgagaggaagaatgagtacagccgcagccgcagcaatggaactggaagtgaaagtggcaaggacacctgtgatgagttccgcagccagatgaagaatggcaagctgatctgcacccgggagagtgaccctgtgcggggcccagatggcaagacccacggcaacaagtgcaccatgtgcaaggagaagctggagcgggaggccgctgagaagaagaagaaggaggatgaagatagaagcaacacaggagagaggagcaacacaggagagaggagcaatgacaaggaggacctgtgccgggagttccgctccatgcagagaaatggcaagctgatctgcacccgggagaacaaccctgtgcggggcccctacggcaagatgcacatcaacaagtgtgccatgtgccagagcatctttgaccgggaggccaatgaaaggaagaagaaggatgaggagaagagcagcagcaagcccagcaacaatgccaaggaccagtgccggcaggtgcagaatgaagcagaagatgccaagttccggcagcccggccgcagcctggcctctgtggccaggatgagcacagatgaatgttctgagttcaggaactacatccggaacaatgagctgatctgccccagagaaaatgaccctgtgcacggggctgatggcaagttctacaccaacaagtgctacatgtgcagagctgtgttcctgacagaggccctggagcgggccaagctgcaggagaagcccagccacgtgcgggccagccaggaggaggacagcccagacagcttcagcagcctggacagcgagatgtgcaaggactacagagtgctgccccgcatcggctacctgtgccccaaggacctgaagcctgtgtgtggagatgatggccagacctacaacaacccctgcatgctgtgccacgagaacctgatccggcagaccaacacccacatccgcagcactggaaaatgtgaggagagcagcaccccaggcaccacagctgcctccatgccacccagtgatgaatag

SEQ ID NO: 169248 - DNA, 2751 bp, Artificial Sequence
  Description of Artificial Sequence: Synthetic coding sequence
atgaagatcgccaccgtgtctgtgctgctgcccctggccctgtgcctgatccaggatgctgccagcaagaatgaagaccaggagatgtgccacgagttccaggccttcatgaagaatggcaagctgttctgcccccaggacaagaagttcttccagagcctggatggcatcatgttcatcaacaagtgtgccacctgcaagatgatcctggagaaggaggccaagagccagaagagggcccggcacctggcccgggcccccaaggccacagcccccacagagctgaactgtgatgacttcaagaagggggagagagatggagacttcatctgcccagactactatgaagctgtgtgtggcacagatggcaagacctatgacaacagatgtgccctgtgtgctgaaaatgccaagacaggcagccagattggagtgaagtctgagggggagtgcaagagcagcaaccctgagcaggatgtgtgcagcgccttccggccctttgtgagagatggccgcctgggctgcacccgggagaatgaccctgtgctgggcccagatggcaagacccacggcaacaagtgtgccatgtgtgccgagctgttcctgaaggaggccgagaatgccaagcgggagggggagacccgcatcagaagaaatgctgagaaggacttctgcaaggagtatgagaagcaggtgagaaatggccgcctcttctgcacccgggagagtgaccctgtgcggggcccagatggccgcatgcacggcaacaagtgtgccctgtgtgccgagatcttcaagcagcgcttcagcgaggagaacagcaagacagaccagaacctgggcaaggccgaggagaagaccaaggtgaagcgggagatcgtgaagctgtgcagccagtaccagaaccaggccaagaatggcatcctcttctgcacccgggagaatgaccccatccggggcccagatggcaagatgcacggcaacctgtgcagcatgtgccaggcctacttccaggccgagaatgaggagaagaagaaggccgaggcccgggccaggaacaagcgggagagcggcaaggccaccagctatgcagagctgtgcagcgagtacaggaagctggtgagaaatggcaagctggcctgcacccgggagaatgaccccatccagggcccagatggcaaggtgcacggcaacacctgcagcatgtgtgaggtgttcttccaggccgaggaggaggagaagaagaagaaggagggcaagagcaggaacaagaggcagagcaagagcacagccagctttgaggagctgtgcagcgagtacaggaagagcaggaagaatggccgcctcttctgcacccgggagaatgaccccatccagggcccagatggcaagatgcacggcaacacctgcagcatgtgtgaggccttcttccagcaggaggagcgggcccgggccaaggccaagcgggaggccgccaaggagatctgcagcgagttccgggaccaggtgagaaatggcaccctcatctgcacccgggagcacaaccctgtgcggggcccagatggcaagatgcacggcaacaagtgtgccatgtgtgccagcgtcttcaagctggaggaggaggagaagaagaatgacaaggaggagaagggcaaggtggaggccgagaaggtgaagcgggaggccgtgcaggagctgtgcagcgagtaccgccactacgtgagaaatggccgcctgccctgcacccgggagaatgaccccatcgagggcctggatggcaagatccacggcaacacctgcagcatgtgtgaggccttcttccagcaggaggccaaggagaaggagagagctgagccccgggccaaggtgaagcgggaggccgagaaggagacctgtgatgagttccggcggctgctgcagaatggcaagctgttctgcaccagagaaaatgaccctgtgcggggcccagatggcaagacccacggcaacaagtgtgccatgtgcaaggctgtgttccagaaggaaaatgaggagaggaagaggaaggaggaggaggaccagagaaatgctgctggccacggcagcagcggcggcggcggcggcaacacccaggatgaatgtgccgagtaccgggagcagatgaagaatggccgcctgagctgcacccgggagagtgaccctgtgagagatgctgatggcaagagctacaacaaccagtgcaccatgtgcaaggccaagctggagcgggaggccgagaggaagaatgagtacagccgcagccgcagcaatggaactggaagtgaaagtggcaaggacacctgtgatgagttccgcagccagatgaagaatggcaagctgatctgcacccgggagagtgaccctgtgcggggcccagatggcaagacccacggcaacaagtgcaccatgtgcaaggagaagctggagcgggaggccgctgagaagaagaagaaggaggatgaagatagaagcaacacaggagagaggagcaacacaggagagaggagcaatgacaaggaggacctgtgccgggagttccgctccatgcagagaaatggcaagctgatctgcacccgggagaacaaccctgtgcggggcccctacggcaagatgcacatcaacaagtgtgccatgtgccagagcatctttgaccgggaggccaatgaaaggaagaagaaggatgaggagaagagcagcagcaagcccagcaacaatgccaaggtgatctactag

SEQ ID NO: 169249 - DNA, 261 bp, Artificial Sequence
  Description of Artificial Sequence: Synthetic coding sequence
atgagggccacagccatcgtgctgctgctggccctgaccctggccaccatgttcagcattgaatgtgccaagcagaccaagcagatggtggactgcagccactacaagaagctgcccccaggccagcagcgcttctgccaccacatgtatgaccccatctgtggcagtgatggcaagacctacaagaatgactgcttcttctgcagcaaggtgaagaagacagatggcaccctgaagtttgtgcactttggaaaatgttag

SEQ ID NO: 169250 - DNA, 759 bp, Artificial Sequence
  Description of Artificial Sequence: Synthetic coding sequence
atggcccagctgtgtggcctgcggcgcagccgggccttcctggccctgctgggcagcctgctgctgtctggagtgctggccgctgaccgggagaggagcatccatgacttctgcctggtgtccaaggtggtgggccgctgccgggcctccatgccccgctggtggtacaacgtgacagatggcagctgccagctgtttgtgtatggaggctgtgatggcaacagcaacaactacctgaccaaggaggagtgcctgaagaagtgtgccaccgtgacagaaaatgccaccggggacctggccaccagcagaaatgctgctgacagctctgtgcccagcgccccccggcggcaggacagcgaggaccacagcagtgacatgttcaactatgaggagtactgcacagccaatgctgtgacaggcccctgccgggccagcttcccccgctggtactttgatgtggagaggaacagctgcaacaacttcatctatggaggctgccggggcaacaagaacagctacagaagtgaggaggcctgcatgctgcgctgcttccggcagcaggagaacccccccctgcccctgggcagcaaggtggtggtgctggccggcctgtttgtgatggtgctgatcctcttcctgggcgcctccatggtgtacctgatccgggtggcccggaggaaccaggagcgggccctgaggacagtgtggagcagtggagatgacaaggagcagctggtgaagaacacctacgtgctgtag

SEQ ID NO: 169251 - DNA, 588 bp, Artificial Sequence
  Description of Artificial Sequence: Synthetic coding sequence
atggcccagctgtgtggcctgcggcgcagccgggccttcctggccctgctgggcagcctgctgctgtctggagtgctggccgctgaccgggagaggagcatccatgaaaatgccactggagacctggccaccagcagaaatgctgctgacagctctgtgcccagcgccccccggcggcaggacagcgaggaccacagcagtgacatgttcaactatgaggagtactgcacagccaatgctgtgacaggcccctgccgggccagcttcccccgctggtactttgatgtggagaggaacagctgcaacaacttcatctacggcggctgccggggcaacaagaacagctacagaagtgaggaggcctgcatgctgcgctgcttccggcagcaggagaacccccccctgcccctgggcagcaaggtggtggtgctggccggcctgtttgtgatggtgctgatcctcttcctgggcgcctccatggtgtacctgatccgggtggcccggaggaaccaggagcgggccctgaggacagtgtggagcagtggagatgacaaggagcagctggtgaagaacacctacgtgctgtag

SEQ ID NO: 169252 - DNA, 1299 bp, Artificial Sequence
  Description of Artificial Sequence: Synthetic coding sequence
atgtctgacaagctgccctacaaggtggccgacatcggcctggccgcctggggcaggaaggccctggacattgctgaaaatgagatgcctggcctgatgaggatgagggagcgctacagcgccagcaagcccctgaagggggccagaattgctggctgcctgcacatgacagtggagacagctgtgctgattgagaccctggtgaccctgggcgctgaggtgcagtggagcagctgcaacatcttcagcacccaggaccacgccgccgccgccatcgccaaggccggcatccctgtgtatgcctggaagggggagacagatgaggagtacctgtggtgcatcgagcagaccctgtacttcaaggatggccccctgaacatgatcctggatgatggaggagacctgaccaacctgatccacaccaagtacccccagctgctgcccggcatccggggcatcagcgaggagaccaccactggagtgcacaacctgtacaagatgatggccaacggcatcctgaaggtgcctgccatcaacgtgaatgattctgtgaccaagagcaagtttgacaacctgtatggctgccgggagagcctgattgatggcatcaagagggccacagatgtgatgattgctgggaaggtggccgtggtggccggctatggagatgtgggcaagggctgtgcccaggccctgcggggctttggagcccgggtcatcatcacagaaattgaccccatcaatgccctgcaggccgccatggagggctatgaggtgaccaccatggatgaggcctgccaggagggcaacatctttgtgaccaccaccggctgcatcgacatcatcctgggccgccactttgagcagatgaaggatgatgccatcgtgtgcaacatcggccactttgatgtggagattgatgtgaagtggctgaatgaaaatgctgtggagaaggtgaacatcaagccccaggtggaccgctaccgcctgaagaatggccgccgcatcatcctgctggccgagggccgcctggtgaacctgggctgtgccatgggccaccccagctttgtgatgagcaacagcttcaccaaccaggtgatggcccagatcgagctgtggacccacccagacaagtaccctgtgggcgtgcacttcctgcccaagaagctggatgaagctgtggccgaggcccacctgggcaagctgaatgtgaagctgaccaagctgacagagaagcaggcccagtacctgggcatgagctgtgatggccccttcaagccagaccactaccgctactag

SEQ ID NO: 169253 - DNA, 1023 bp, Artificial Sequence
  Description of Artificial Sequence: Synthetic coding sequence
atgtgtgcccagtactgcatcagctttgctgatgtggagaaggcccacatcaacatccgggacagcatccacctgacccctgtgctgaccagcagcatcctgaaccagctgaccggcaggaacctcttcttcaagtgtgagctgttccagaagacaggcagcttcaagatccggggggccctgaatgctgtgcgcagcctggtgcctgatgccctggagaggaagcccaaggctgtggtgacccacagcagcggcaaccacggccaggccctgacctacgccgccaagctggagggcatcccagcctacatcgtggtgccccagacagccccagactgcaagaagctggccatccaggcctatggagccagcatcgtgtactgtgagcccagtgatgagagccgggagaatgtggccaagagggtgacagaggagacagagggcatcatggtgcaccccaaccaggagcctgctgtgattgctggccagggcaccatcgccctggaggtgctgaaccaggtgcccctggtggatgccctggtggtgcctgtgggcggcggcggcatgctggccggcatcgccatcaccgtgaaggccctgaagcccagcgtgaaggtgtatgctgctgagcccagcaatgctgatgactgctaccagagcaagctgaagggcaagctgatgcccaacctgtacccacctgagaccatcgcagatggagtgaagagcagcatcggcctgaacacctggcccatcatccgggacctggtggatgacatcttcaccgtgacagaagatgagatcaagtgtgccacccagctggtgtgggagaggatgaagctgctgattgagcccacagctggggtgggcgtggccgctgtgctgagccagcacttccagacagtgtccccagaggtgaagaacatctgcatcgtgctgagcggcggcaatgtggacctgaccagcagcatcacctgggtgaagcaggccgagaggcctgccagctaccagagcgtgtctgtgtag

SEQ ID NO: 169254 - DNA, 1638 bp, Artificial Sequence
  Description of Artificial Sequence: Synthetic coding sequence
atggccgagcccagcggcagccctgtgcacgtgcagctgccccagcaggccgcccctgtgacagctgctgctgctgctgccccagctgctgccacagctgccccagccccagctgccccagctgccccagccccagccccagccccagctgcccaggccgtgggctggcccatctgcagagatgcctatgagctgcaggaggtgattggcagcggggccacagctgtggtgcaggccgccctgtgcaagccccggcaggagcgggtggccatcaagaggatcaacctggagaagtgccagacctccatggatgagctgctgaaggagatccaggccatgagccagtgcagccaccccaacgtggtgacctactacaccagctttgtggtgaaggatgagctgtggctggtgatgaagctgctgagcggcggctccatgctggacatcatcaagtacatcgtgaacagaggagagcacaagaatggagtgctggaggaggccatcatcgccaccatcctgaaggaggtgctggagggcctggactacctgcacagaaatggccagatccaccgggacctgaaggccggcaacatcctgctgggggaggatggctctgtgcagattgctgactttggagtgtctgccttcctggccactggaggagatgtgaccaggaacaaggtgaggaagacctttgtgggcaccccctgctggatggcccctgaggtgatggagcaggtgcggggctatgacttcaaggctgacatgtggagctttggcatcacagccatcgagctggccaccggggccgccccctaccacaagtacccacccatgaaggtgctgatgctgaccctgcagaatgacccccccaccctggagactggagtggaggacaaggagatgatgaagaagtatggcaagagcttcaggaagctgctgagcctgtgcctgcagaaggaccccagcaagaggcccacagctgctgagctgctgaagtgcaagttcttccagaaggccaagaaccgggagtacctgattgagaagctgctgaccaggaccccagacatcgcccagagggccaagaaggtgagaagagtgcccggcagcagcggccacctgcacaagacagaagatggagactgggagtggagcgatgatgagatggatgagaagtctgaggagggcaaggccgccttcagccaggagaagagccggcgggtgaaggaggagaaccctgagattgctgtgtctgccagcaccatccctgagcagatccagagcctgtctgtgcatgacagccagggccccccaaatgccaatgaagactaccgggaggccagcagctgtgctgtgaacctggtgctgcggctgaggaacagcaggaaggagctgaatgacatccgctttgagttcaccccaggccgggacacagcagatggagtgtcccaggagctgttctctgctggcctggtggatggccatgatgtggtgattgtggccgccaacctgcagaagatcgtggatgaccccaaggccctgaagaccctgaccttcaagctggccagcggctgtgatggcagcgagatcccagatgaggtgaagctgattggatttgcccagctgtctgtgtcctag

SEQ ID NO: 169255 - DNA, 2715 bp, Artificial Sequence
  Description of Artificial Sequence: Synthetic coding sequence
atggatgctggcttcttccggggcaccagcgctgagcaggacaaccgcttcagcaacaagcagaagaagctgctgaagcagctgaagtttgctgagtgcctggagaagaaggtggacatgagcaaggtgaacctggaggtgatcaagccctggatcaccaagagggtgacagagatcctgggctttgaagatgatgtggtgattgagttcatcttcaaccagctggaggtgaagaacccagacagcaagatgatgcagatcaacctgaccggcttcctgaatggcaagaatgcccgggagttcatgggagagctgtggcccctgctgctgagcgcccaggagaacattgctggcatccccagcgccttcctggagctgaagaaggaggagatcaagcagaggcagatcgagcaggagaagctggcctccatgaagaagcaggatgaggacaaggacaagagggacaaggaggagaaggagagcagccgggagaagcgggagaggagccgcagccccaggaggaggaagagccgcagccccagcccccggcggcgcagcagccctgtgcggcgggagaggaagaggagccacagccgcagccccaggcacaggaccaagagccgcagccccagccctgcccctgagaagaaggagaagaccccagagctgcctgagcccagcgtgaaggtgaaggagcccagcgtgcaggaggccaccagcaccagtgacatcctgaaggtgcccaagccagagcccatccctgagcccaaggagcccagccctgagaagaacagcaagaaggagaaggagaaggagaagacccggcccaggagccgcagccgcagcaagagccgcagcaggaccaggagccgcagccccagccacacccggccccggcggcggcacaggagccgcagccgcagctacagccccaggagaagacccagccccaggagaagacccagccccaggaggaggaccccacccaggaggatgcctcctccacccaggcacagaagaagccgcagccctgtgagaagaagaagaagaagcagcgccagcctgagcggcagcagcagcagcagcagcagcagccgcagccgcagcccccccaagaagccacccaagaggaccagcagcccccccaggaagacccggcggctgagccccagcgccagcccccccaggagaagacaccggcccagccccccagccaccccaccacccaagaccaggcacagccccaccccccagcagagcaacagaaccaggaagagccgggtgtctgtgtccccaggccgcaccagcggcaaggtgaccaagcacaagggcacagagaagcgggagagccccagccctgcccccaagcccaggaaggtggagctgtctgagagtgaagaagataaaggaggcaagatggctgctgctgacagcgtgcagcagaggcggcagtaccgccggcagaaccagcagagcagcagtgacagcggcagcagcagcagcagtgaagatgagcggcccaagaggagccacgtgaagaatggagaggtgggcagaagaagaagacacagccccagccgcagcgccagccccagccccaggaagaggcagaaggagaccagcccccggggcagaagaagaagaagccccagccccccacccaccaggagaagaagaagccccagccctgcccccccacccaggagaagaaggacccccaccccaccacccaggaggaggacccccagccccccaccaagaagaagaagccccagcccccggcgctacagcccccccatccagaggcgctacagccccagccccccacccaagagaagaacagccagccccccacctccacccaagagaagagccagccccagccccccacccaagagaagagtgagccacagccccccacccaagcagaggagcagccctgtgaccaagagaagaagccccagcctgagcagcaagcacaggaagggcagcagccccagccgcagcacccgggaggcccggagcccccagcccaacaagaggcacagccccagcccccggccccgggccccccagaccagcagcagccccccacctgtgagaagaggagccagcagcagcccccagaggcggcagagccccagccccagcacccggcccatccggcgggtgtccaggaccccagagcccaagaagatcaagaaggccgccagccccagcccccagagcgtgagaagagtgagcagcagccgctctgtgtctggcagccctgagcctgctgccaagaagcccccagccccacccagccctgtgcagagccagagccccagcaccaactggagccctgctgtgcctgtgaagaaggccaagagccccacccccagccccagcccccccaggaacagcgaccaggagggcggcggcaagaagaagaagaagaagaaggacaagaagcacaagaaggacaagaagcacaagaagcacaagaagcacaagaaggagaaggctgtggccgctgctgctgctgctgctgtgaccccagctgccatcgccgccgccaccaccaccctggcccaggaggagcctgtggccgcccctgagcccaagaaggagacagagagcgaggccgaggacaacctggatgacctggagaagcacctgcgggagaaggccctgcgctccatgaggaaggcccaggtgagcccccagagctag

SEQ ID NO: 169256 - DNA, 2742 bp, Artificial Sequence
  Description of Artificial Sequence: Synthetic coding sequence
atggatgctggcttcttccggggcaccagcgctgagcaggacaaccgcttcagcaacaagcagaagaagctgctgaagcagctgaagtttgctgagtgcctggagaagaaggtggacatgagcaaggtgaacctggaggtgatcaagccctggatcaccaagagggtgacagagatcctgggctttgaagatgatgtggtgattgagttcatcttcaaccagctggaggtgaagaacccagacagcaagatgatgcagatcaacctgaccggcttcctgaatggcaagaatgcccgggagttcatgggagagctgtggcccctgctgctgagcgcccaggagaacattgctggcatccccagcgccttcctggagctgaagaaggaggagatcaagcagaggcagatcgagcaggagaagctggcctccatgaagaagcaggatgaggacaaggacaagagggacaaggaggagaaggagagcagccgggagaagcgggagaggagccgcagccccaggaggaggaagagccgcagccccagcccccggcggcgcagcagccctgtgcggcgggagaggaagaggagccacagccgcagccccaggcacaggaccaagagccgcagccccagccctgcccctgagaagaaggagaagaccccagagctgcctgagcccagcgtgaaggtgaaggagcccagcgtgcaggaggccaccagcaccagtgacatcctgaaggtgcccaagccagagcccatccctgagcccaaggagcccagccctgagaagaacagcaagaaggagaaggagaaggagaagacccggcccaggagccgcagccgcagcaagagccgcagcaggaccaggagccgcagccccagccacacccggccccggcggcggcacaggagccgcagcagaagaagacccagcccccggcggcggcccagccccaggaggaggaccccacccaggaggatgcctcctccacccaggcaccggcgcagccgcagccctgtgagaagaagaagaagaagcagcgccagcctgagcggcagcagcagcagcagcagcagcagccgcagccgcagcccccccaagaagccacccaagaggaccagcagcccccccaggaagacccggcggctgagccccagcgccagccccccaagaagaagacaccggcccagccccccagccaccccaccacccaagaccaggcacagccccaccccccagcagagcaacagaaccaggaagagccgggtgtctgtgtccccaggccgcaccagcggcaaggtgaccaagcacaagggcacagagaagcgggagagccccagccctgcccccaagcccaggaaggtggagctgtctgagagcgaggaggacaagggcggcaagatggctgctgctgacagcgtgcagcagaggcggcagtaccgccggcagaaccagcagagcagcagtgacagcggcagcagcagcagcagtgaagatgagcggcccaagaggagccacgtgaagaatggagaggtgggcagaagaagaagacacagccccagccgcagcgccagccccagccccaggaagaggcagaaggagaccagccccaggatgcagatgggcaagcgctggcagagccctgtgaccaagagcggcagaagaagaagaagccccagccccccacccaccaggagaagaagaagccccagccctgcccctcctccaagaagaagaaggacccccaccccacctccaagaagaaggacccccagccccccacccaggagaagaagccccagcccccggcgctacagcccccccatccagaggcgctacagccccagccccccacccaagagaagaacagccagccccccacctccacccaagaggcgggccagccccagccccccacccaagagaagagtgagccacagccccccacccaagcagaggagcagccctgtgaccaagaggaggagccccagcctgagcagcaagcacaggaagggcagcagccccagccgcagcacccgggaggcccggagcccccagcccaacaagaggcacagccccagcccccggccccgggccccccagaccagcagcagccccccacctgtgcggcggggggccagcagcagcccccagaggcggcagagccccagccccagcacccggcccatcagaagagtgtccaggaccccagagcccaagaagatcaagaaggccgccagccccagcccccagagcgtgcggcgggtgagcagcagccgctctgtgtctggcagccctgagcctgctgccaagaagcccccagccccacccagccctgtgcagagccagagccccagcaccaactggagccctgctgtgcctgtgaagaaggccaagagccccacccccagccccagccccccaagaaacagcgaccaggagggcggcggcaagaagaagaagaagaagaaggacaagaagcacaagaaggacaagaagcacaagaagcacaagaagcacaagaaggagaaggctgtggccgctgctgctgctgctgctgtgaccccagctgccatcgctgctgccaccaccaccctggcccaggaggagcctgtggccgcccctgagcccaagaaggagacagaaagtgaagctgaggacaacctggatgacctggagaagcacctgcgggagaaggccctgcgctccatgaggaaggcccaggtgagcccccagagctag

SEQ ID NO: 169257 - DNA, 2751 bp, Artificial Sequence
  Description of Artificial Sequence: Synthetic coding sequence
atggatgctggcttcttccggggcaccagcgctgagcaggacaaccgcttcagcaacaagcagaagaagctgctgaagcagctgaagtttgctgagtgcctggagaagaaggtggacatgagcaaggtgaacctggaggtgatcaagccctggatcaccaagagggtgacagagatcctgggctttgaagatgatgtggtgattgagttcatcttcaaccagctggaggtgaagaacccagacagcaagatgatgcagatcaacctgaccggcttcctgaatggcaagaatgcccgggagttcatgggagagctgtggcccctgctgctgagcgcccaggagaacattgctggcatccccagcgccttcctggagctgaagaaggaggagatcaagcagaggcagatcgagcaggagaagctggcctccatgaagaagcaggatgaggacaaggacaagagggacaaggaggagaaggagagcagccgggagaagcgggagaggagccgcagccccaggaggaggaagagccgcagccccagcccccggcggcgcagcagccctgtgcggcgggagaggaagaggagccacagccgcagccccaggcacaggaccaagagccgcagccccagccctgcccctgagaagaaggagaagaccccagagctgcctgagcccagcgtgaaggtgaaggagcccagcgtgcaggaggccaccagcaccagtgacatcctgaaggtgcccaagccagagcccatccctgagcccaaggagcccagccctgagaagaacagcaagaaggagaaggagaaggagaagacccggcccaggagccgcagccgcagcaagagccgcagcaggaccaggagccgcagccccagccacacccggccccggcggcggcacaggagccgcagccgcagctacagccccaggagaagacccagccccaggagaagacccagccccaggaggaggaccccacccaggaggatgcctcctccacccaggcacagaagaagccgcagccctgtgagaagaagaagaagaagcagcgccagcctgagcggcagcagcagcagcagcagcagcagccgcagccgcagcccccccaagaagccacccaagaggaccagcagcccccccaggaagacccggcggctgagccccagcgccagcccccccaggagaagacaccggcccagccccccagccaccccaccacccaagaccaggcacagccccaccccccagcagagcaacagaaccaggaagagccgggtgtctgtgtccccaggccgcacctctgtgaccaagcacaagggcacagagaagcgggagagccccagccctgcccccaagcccaggaaggtggagctgtctgagagtgaagaagataaaggaggcaagatggctgctgctgacagcgtgcagcagaggcggcagtaccgccggcagaaccagcagagcagcagtgacagcggcagcagcagcagcagtgaagatgagcggcccaagaggagccacgtgaagaatggagaggtgggcagaagaagaagacacagccccagccgcagcgccagccccagccccaggaagaggcagaaggagaccagccccaggatgcagatgggcaagcgctggcagagccctgtgaccaagtctggaagaagaagaagaagccccagccccccacccaccaggagaagaagaagccccagccctgcccccccacccaggagaagaaggacccccaccccaccacccaggaggaggacccccagccccccaccaagaagaagaagccccagcccccggcgctacagcccccccatccagaggcgctacagccccagccccccacccaagagaagaacagccagccccccacctccacccaagagaagagccagccccagccccccacccaagagaagagtgagccacagccccccacccaagcagaggagcagccctgtgaccaagagaagaagccccagcctgagcagcaagcacaggaagggcagcagccccagccgcagcacccgggaggcccggagcccccagcccaacaagaggcacagccccagcccccggccccgggccccccagaccagcagcagccccccacctgtgagaagaggagccagcagcagcccccagaggcggcagagccccagccccagcacccggcccatccggcgggtgtccaggaccccagagcccaagaagatcaagaaggccgccagccccagcccccagagcgtgagaagagtgagcagcagccgctctgtgtctggcagccctgagcctgctgccaagaagcccccagccccacccagccctgtgcagagccagagccccagcaccaactggagccctgctgtgcctgtgaagaaggccaagagccccacccccagccccagcccccccaggaacagcgaccaggagggcggcggcaagaagaagaagaagaagaaggacaagaagcacaagaaggacaagaagcacaagaagcacaagaagcacaagaaggagaaggctgtggccgctgctgctgctgctgctgtgaccccagctgccatcgccgccgccaccaccaccctggcccaggaggagcctgtggccgcccctgagcccaagaaggagacagagagcgaggccgaggacaacctggatgacctggagaagcacctgcgggagaaggccctgcgctccatgaggaaggcccaggtgagcccccagagctag

SEQ ID NO: 169258 - DNA, 957 bp, Artificial Sequence
  Description of Artificial Sequence: Synthetic coding sequence
atgggagagctgtggcccctgctgctgagcgcccaggagaacattgctggcatccccagcgccttcctggagctgaagaaggaggagatcaagcagaggcagatcgagcaggagaagctggcctccatgaagaagcaggatgaggacaaggacaagagggacaaggaggagaaggagagcagccgggagaagcgggagaggagccgcagccccaggaggaccaagagccgcagccccagccctgcccctgagaagaaggagaagaccccagagctgcctgagcccagcgtgaaggtgaaggagcccagcgtgcaggaggccaccagcaccagtgacatcctgaaggtgcccaagccagagcccatccctgagcccaaggagcccagccctgagaagaacagcaagaaggagaaggagaaggagaagacccggcccaggagccgcagccgcagcaagagccgcagcaggaccaggagccgcagccccagccacacccggcccaggagaagacacaggagccgcagccgcagctacagcccccggcggcggcccagcccccggcggcggcccagccccaggaggaggaccccacccaggaggatgcctcctccacccaggcaccggcgcagccgcagccctgtgcggcgcttcagcggcatcctgccccccaaggtgaacagcgctgaggaggatgtgcggcagcacccctgcctgggcgtggcccaccaccccctgcacctggtgcacggccaccaccagaggagcctgccccggggccacccagcccccctgggcaagctggtgggctacctgctgcagcaggtgctgcagggcgagggcaccggccaccacctgctgcagctgcaccaccccaagctgggcatccccctgcaccccagcagccagacagtgcaggagaaggtggtgttcctgtgcctgcagggcgagctgcagtag

SEQ ID NO: 169259 - DNA, 8259 bp, Artificial Sequence
  Description of Artificial Sequence: Synthetic coding sequence
atgtacaatggaattggcctgcccaccccccggggcagcggcaccaacggctacgtgcagaggaacctgagcctggtgcggggcagaagaggagagaggccagactacaagggggaggaggagctgcggcggctggaggccgccctggtgaagaggcccaacccagacatcctggaccacgagaggaagagaagagtggagctgcgctgcctggagctggaggagatgatggaggagcagggctatgaggagcagcagatccaggagaaggtggccaccttccggctgatgctgctggagaaggatgtgaaccctgggggcaaggaggagaccccaggccagaggcctgctgtgacagagacccaccagctggccgagctgaatgagaagaagaatgaaaggctgcgggccgccttcggcatcagtgacagctatgtggatggcagcagctttgacccccagaggcgggcccgggaggccaagcagcctgcccctgagccccccaagccctacagcctggtgcgggagagcagcagcagccgcagccccacccccaagcagaagaagaagaagaagaagaaggaccggggccgccgctctgagagcagcagcccccggcgggagaggaagaagagcagcaagaagaagaagcacaggtctgagagcgagagcaagaagaggaagcacaggagccccacccccaagagcaagaggaagagcaaggacaagaagaggaagaggagccgcagcaccaccccagcccccaagagccggcgggcccacaggagcaccagcgctgacagcgccagcagcagtgacaccagccgcagccgcagccgctctgctgctgccaagacccacaccacagccctggccggccgcagccccagccctgccagcggccggcggggggagggagatgcccccttcagcgagcccggcaccaccagcacccagaggcccagcagccctgagacagccaccaagcagcccagcagcccctatgaggacaaggacaaggacaagaaggagaagagcgccacccggcccagccccagccctgagaggagcagcactggacctgagcccccagcccccacccccctgctggccgagcggcacggcggcagcccccagcccctggccaccacccccctgagccaggagcctgtgaaccccccatctgaggccagccccacccgggacaggagcccccccaagagccctgagaagctgccccagagcagcagcagcgagagcagcccccccagcccccagcccaccaaggtgtccagacatgccagcagcagccctgagagccccaagccagccccagcccctggcagccaccgggagatcagcagcagccccaccagcaagaacagaagccacggccgggccaagagggacaagagccacagccacacccccagcaggaggatgggccgcagccgcagccctgccacagccaagaggggccgcagccgcagcaggacccccaccaagaggggccacagccgcagccgcagcccccagtggaggaggagccgcagcgcccagcgctggggccgcagccgcagcccccagaggcggggccgcagccgcagcccccagaggcctggctggagccgcagcaggaacacccagaggcggggccgcagccgcagcgcccggcggggccgcagccacagccgcagccctgccacccggggccgcagccgcagcaggaccccagcccggcggggccgcagccgcagcaggaccccagcccggcggcgcagccgcagcaggacccccacccggcggcgcagccgcagcaggaccccagcccggcggggccgcagccgcagcaggaccccagccaggagaagaagcaggaccaggagccctgtgagaagaagaagccgcagccgcagccctgcccggcgcagcggccgcagccgcagcaggaccccagcccggcggggccgcagccgcagcaggaccccagcccggcggggccgcagccgcagcaggaccccagcccggcgcagcggccgcagccgcagcaggaccccagcccggcggggccgcagccgcagcaggaccccccggcggggccgcagccgcagccgcagcctggtgagaagaggccgcagccacagcaggaccccccagaggcggggccgcagcggcagcagcagcgagaggaagaacaagagcaggaccagccagaggaggagccgcagcaacagcagccctgagatgaagaagagccgcatcagcagcagaagaagccgcagcctgagcagccccaggagcaaggccaagagccggctgagcctgcggcgcagcctgagcggcagcagcccctgccccaagcagaagagccagaccccaccaagaagaagccgcagcggcagcagccagcccaaggccaagagcaggaccccaccaagaagaagccgcagcagcagcagccccccacccaagcagaagagcaagacccccagccggcagagccacagcagcagcagcccccaccccaaggtgaagagcggcaccccaccccggcagggcagcatcaccagcccccaggccaatgagcagagcgtgaccccccagaggaggagctgctttgagagcagcccagaccctgagctgaagagcaggacccccagccgccacagctgcagcggcagcagccccccccgggtgaagagcagcaccccaccccggcagagccccagccgcagcagcagcccccagcccaaggtgaaggccatcatcagcccccggcagaggagccacagcggcagcagcagccccagccccagccgggtgaccagcaggaccaccccccggcgcagccgctctgtgagcccctgcagcaatgtggagagccggctgctgccccgctacagccacagcggcagcagcagcccagacaccaaggtgaagccagagaccccaccccggcagagccacagcggcagcatcagcccctaccccaaggtgaaggcccagaccccacctggccccagcctgagcggcagcaagagcccctgcccccaggagaagagcaaggacagcctggtgcagagctgccccggcagcctgagcctgtgtgccggcgtgaagagcagcaccccacctggagagagctactttggagtgagcagcctgcagctgaagggccagagccagaccagcccagaccacagaagtgacaccagcagccctgaggtgcggcagagccacagcgagagccccagcctgcagagcaagagccagaccagccccaagggcggccgcagccgcagcagcagccctgtgacagagctggccagccgcagccccatccggcaggacagaggagagttcagcgccagccccatgctgaagagcggcatgagccctgagcagagccgcttccagagcgacagcagcagctaccccaccgtggacagcaacagcctgctgggccagagccggctggagacagctgagagcaaggagaagatggccctgcccccccaggaggatgccacagccagccccccccggcagaaggacaagttcagccccttccctgtgcaggacaggcctgagagcagcctggtgttcaaggacaccctgcggaccccaccccgggagaggtctggggccggcagcagccctgagaccaaggagcagaacagcgccctgcccaccagcagccaggatgaggagctgatggaggtggtggagaagtctgaggagcctgctggccagatcctgagccacctgagcagcgagctgaaggagatgagcaccagcaactttgagagcagccctgaggtggaggagaggcctgctgtgtccctgaccctggaccagagccagagccaggccagcctggaggccgtggaggtgcccagcatggccagctcctggggcggcccccacttcagccctgagcacaaggagctgagcaacagccccctgcgggagaacagctttggcagccccctggagttcaggaacagcggccccctgggcacagagatgaacacaggcttcagcagcgaggtgaaggaggacctgaatggccccttcctgaaccagctggagacagaccccagcctggacatgaaggagcagagcaccaggagcagcggccacagcagcagcgagctgagcccagatgctgtggagaaggccggcatgagcagcaaccagagcatcagcagccctgtgctggatgctgtgcccaggacccccagccgggagaggagcagcagcgccagcagccctgagatgaaggatggcctgcccaggacccccagcagaagaagccgcagcggcagcagccctggcctgagagatggcagcggcacccccagccgccacagcctgagcggcagcagccctggcatgaaggacatccccaggacccccagccggggccgctcagaatgtgacagcagccctgagcccaaggccctgccccagaccccccggcccaggagccgcagccccagcagccctgagctgaacaacaagtgcctgaccccccagcgggagaggagcggcagcgagagctctgtggaccagaagacagtggcccggacccccctgggccagaggagccgcagcggcagcagccaggagctggatgtgaagcccagcgccagcccccaggagaggtctgagagtgacagcagcccagacagcaaggccaagaccaggacccccctgcggcagaggagccgcagcggcagcagccctgaggtggacagcaagagccggctgagcccccggcgcagccgcagcggcagcagccctgaggtgaaggacaagccccgggccgccccccgggcccagagcggcagtgacagcagccctgagcccaaggccccagccccccgggccctgccccggcgcagccgcagcggcagcagcagcaagggccggggccccagccctgagggcagcagcagcacagagagcagccctgagcacccccccaagagcaggacagcccggcggggcagccgcagcagccctgagcccaagaccaagagcaggaccccaccaagaagaagaagcagccgcagcagccctgagctgaccaggaaggcccggctgagcagaagaagccgcagcgccagcagcagccctgagaccaggagcaggaccccacccaggcacagaagaagccccagcgtgagcagccctgagcctgctgagaagagccgcagcagcagaagaagaagaagtgccagcagccccaggaccaagaccaccagccggcggggccgcagccccagccccaagccccggggcctgcagaggagccgcagccgcagccggcgggagaagaccaggaccaccaggagaagagacagaagtggcagcagccagagcaccagcagaagacggcagaggagccgcagccgcagccgggtgaccaggagaagaagaggaggcagcggctaccacagccgcagccctgcccggcaggagagcagcaggaccagcagcagaagaagaagaggccgcagcaggaccccacccaccagcaggaagaggagccgcagcaggaccagccctgccccctggaagaggagccgcagccgggccagccctgccacccaccggcgcagccgcagcaggacccccctcatcagcagaagaagaagccgcagcaggaccagccctgtgtccagaagaagaagccgcagcaggacctctgtgaccaggagaagaagccgcagccgggccagccctgtgtccagaagaagaagccgcagcaggaccccacctgtgaccaggagaagaagccgcagcaggacccccaccacccggcggcgcagccgcagcaggaccccacctgtgacccggcggcgcagccgcagcaggaccccacctgtgacccggcggcgcagccgcagcaggaccagccccatcacccggcggcgcagccgcagcaggaccagccctgtgacccggcggcgcagccgcagcaggaccagccctgtgacccggcggcgcagccgcagcaggaccagccctgtgacccggcggcgcagccgcagcaggaccccaccagccatcagaagaagaagccgcagcaggacccccctgctgcccaggaagaggagccgcagccgcagccccctggccatcagaagaagaagccgcagcaggacccccaggacagcccggggcaagaggagcctgaccaggagccccccagccatcagaagaagaagtgccagcggcagcagcagtgacaggagccgcagcgccaccccaccagccaccaggaaccacagcggcagcaggaccccacctgtggccctgaacagcagcaggatgagctgcttcagccggcccagcatgagccccacccccctggaccgctgccgcagccctggcatgctggagcccctgggcagcagcaggacccccatgtctgtgctgcagcaggccggcggctccatgatggatggccctggcccccgcatcccagaccaccagaggacctctgtgcctgagaaccacgcccagagcagaattgccctggccctgacagccatcagcctgggcacagcccggcccccacccagcatgtctgctgctggcctggccgccaggatgagccaggtgcctgcccctgtgcccctgatgagcctgaggacagccccagctgccaacctggccagccgcatcccagctgccagcgctgctgccatgaacctggccagcgcccggaccccagccatccccacagctgtgaacctggccgacagcaggaccccagctgctgctgctgccatgaacctggccagccccaggacagctgtggcccccagcgctgtgaacctggccgaccccaggacccccacagccccagctgtgaacctggccggggcccggaccccagctgccctggccgccctgagcctgaccggcagcggcaccccacccacagctgccaactaccccagcagcagcaggaccccccaggccccagccagcgccaacctggtgggccccaggtctgcccacgccacagcccctgtgaacattgctggcagcaggacagctgctgccctggccccagccagcctgaccagcgccaggatggccccagccctgagcggggccaacctgaccagcccccgggtgcccctgagcgcctatgaaagagtgtctggccgcaccagcccccccctgctggaccgggcccggagcaggaccccacccagcgcccccagccagagcaggatgaccagcgagcgggcccccagccccagcagcaggatgggccaggcccccagccagagcctgctgcccccagcccaggaccagcccaggagccctgtgcccagcgccttcagtgaccagagccgctgcctgattgcccagaccacccctgtggccggcagccagagcctgagcagtggagctgtggccaccaccaccagcagcgctggggaccacaacggcatgctgtctgtgcctgcccctggggtgccccacagtgatgtgggggagcccccagccagcactggagcccagcagcccagcgccctggccgccctgcagcctgccaaggagcggcgcagcagcagcagcagcagcagcagcagcagcagcagcagcagcagcagcagcagcagcagcagcagcagcagcagcggcagcagcagcagtgacagcgagggcagcagcctgcctgtgcagcctgaggtggccctgaagagggtgcccagccccaccccagcccccaaggaggccgtgcgggagggccggcccccagagcccaccccagccaagaggaagagaagaagcagcagcagcagcagcagcagcagcagcagcagcagcagcagcagcagcagcagcagcagcagcagcagcagcagcagcagcagcagcagcagcagcagcagcagcagcagcagcagcagcagccccagccctgccaagccaggcccccaggccctgcccaagccagccagccccaagaagcccccacctggagagaggaggagccgcagccccaggaagcccatcgacagcctgcgggacagccgcagcctgagctacagccctgtggagaggagaagacccagcccccagcccagcccccgggaccagcagagcagcagcagcgagcggggcagccggcggggccagagaggagacagccgcagccccagccacaagagaagaagagagacccccagcccccggcccatgaggcacaggagcagccgcagcccctag

SEQ ID NO: 169260 - DNA, 702 bp, Artificial Sequence
  Description of Artificial Sequence: Synthetic coding sequence
atgatctccttccccagcctgcagaggacagagctggaggagatggacctgatcctgcagcaggagggctggcagctggacctgaagaggaacagcctgggctggaaggacctgcagaggagcagccaccccagcccctgcctgcaggccggccggcccctgccccagcccacctgcacccaccggggcctgcccaagctgcggctgtctgaggagggggactacccagccagcgccagcaccccagagccccggggcctcatccccccatctggcaccttcctgcgcttcaacctggaccccctgtgctgcggcccccagcctgtggcctctgtgtcccggggctgggtgagcagccaccactgcagccctgagaactgctggctgacctggctgggggagctgcctgcccccttcagcggcaccccaccacccacagctgtgcccccaggccagggcagccgcagccgcagccccaggaagcccatcgacagcctgcgggacagccgcagcctgagctacagccctgtggagcggcggcggcccagcccccagcccagcccccgggaccagcagagcagcagcagcgagcggggcagcagaagaggccagagaggagacagccgcagccccagccacaagagaagaagagagacccccagcccccggcccatgaggcacaggagcagccgcagcccctag

SEQ ID NO: 169261 - DNA, 7005 bp, Artificial Sequence
  Description of Artificial Sequence: Synthetic coding sequence
atgtacaatggaattggcctgcccaccccccggggcagcggcaccaacggctacgtgcagaggaacctgagcctggtgcggggcagaagaggagagaggccagactacaagggggaggaggagctgcggcggctggaggccgccctggtgaagaggcccaacccagacatcctggaccacgagaggaagagaagagtggagctgcgctgcctggagctggaggagatgatggaggagcagggctatgaggagcagcagatccaggagaaggtggccaccttccggctgatgctgctggagaaggatgtgaaccctgggggcaaggaggagaccccaggccagaggcctgctgtgacagagacccaccagctggccgagctgaatgagaagaagaatgaaaggctgcgggccgccttcggcatcagtgacagctatgtggatggcagcagctttgacccccagaggcgggcccgggaggccaagcagcctgcccctgagccccccaagccctacagcctggtgcgggagagcagcagcagccgcagccccacccccaagcagaagaagaagaagaagaagaaggaccggggccgccgctctgagagcagcagcccccggcgggagaggaagaagagcagcaagaagaagaagcacaggtctgagagcgagagcaagaagaggaagcacaggagccccacccccaagagcaagaggaagagcaaggacaagaagaggaagaggagccgcagcaccaccccagcccccaagagccggcgggcccacaggagcaccagcgctgacagcgccagcagcagtgacaccagccgcagccgcagccgctctgctgctgccaagacccacaccacagccctggccggccgcagccccagccctgccagcggccggcggggggagggagatgcccccttcagcgagcccggcaccaccagcacccagaggcccagcagccctgagacagccaccaagcagcccagcagcccctatgaggacaaggacaaggacaagaaggagaagagcgccacccggcccagccccagccctgagaggagcagcactggacctgagcccccagcccccacccccctgctggccgagcggcacggcggcagcccccagcccctggccaccacccccctgagccaggagcctgtgaaccccccatctgaggccagccccacccgggacaggagcccccccaagagccctgagaagctgccccagagcagcagcagcgagagcagcccccccagcccccagcccaccaaggtgtccagacatgccagcagcagccctgagagccccaagccagccccagcccctggcagccaccgggagatcagcagcagccccaccagcaagaacagaagccacggccgggccaagagggacaagagccacagccacacccccagcaggaggatgggccgcagccgcagccctgccacagccaagaggggccgcagccgcagcaggacccccaccaagaggggccacagccgcagccgcagcccccagtggaggaggagccgcagcgcccagcgctggggccgcagccgcagcccccagaggcggggccgcagccgcagcccccagaggcctggctggagccgcagcaggaacacccagaggcggggccgcagccgcagcgcccggcggggccgcagccacagccgcagccctgccacccggggccgcagccgcagcaggaccccagcccggcggggccgcagccgcagcaggaccccagcccggcggcgcagccgcagcaggacccccacccggcggcgcagccgcagcaggaccccagcccggcggggccgcagccgcagcaggaccccagccaggagaagaagcaggaccaggagccctgtgagaagaagaagccgcagccgcagccctgcccggcgcagcggccgcagccgcagcaggaccccagcccggcggggccgcagccgcagcaggaccccagcccggcggggccgcagccgcagcaggaccccagcccggcgcagcggccgcagccgcagcaggaccccagcccggcggggccgcagccgcagcaggaccccccggcggggccgcagccgcagccgcagcctggtgagaagaggccgcagccacagcaggaccccccagaggcggggccgcagcggcagcagcagcgagaggaagaacaagagcaggaccagccagaggaggagccgcagcaacagcagccctgagatgaagaagagccgcatcagcagcagaagaagccgcagcctgagcagccccaggagcaaggccaagagccggctgagcctgcggcgcagcctgagcggcagcagcccctgccccaagcagaagagccagaccccaccaagaagaagccgcagcggcagcagccagcccaaggccaagagcaggaccccaccaagaagaagccgcagcagcagcagccccccacccaagcagaagagcaagacccccagccggcagagccacagcagcagcagcccccaccccaaggtgaagagcggcaccccaccccggcagggcagcatcaccagcccccaggccaatgagcagagcgtgaccccccagaggaggagctgctttgagagcagcccagaccctgagctgaagagcaggacccccagccgccacagctgcagcggcagcagccccccccgggtgaagagcagcaccccaccccggcagagccccagccgcagcagcagcccccagcccaaggtgaaggccatcatcagcccccggcagaggagccacagcggcagcagcagccccagccccagccgggtgaccagcaggaccaccccccggcgcagccgctctgtgagcccctgcagcaatgtggagagccggctgctgccccgctacagccacagcggcagcagcagcccagacaccaaggtgaagccagagaccccaccccggcagagccacagcggcagcatcagcccctaccccaaggtgaaggcccagaccccacctggccccagcctgagcggcagcaagagcccctgcccccaggagaagagcaaggacagcctggtgcagagctgccccggcagcctgagcctgtgtgccggcgtgaagagcagcaccccacctggagagagctactttggagtgagcagcctgcagctgaagggccagagccagaccagcccagaccacagaagtgacaccagcagccctgaggtgcggcagagccacagcgagagccccagcctgcagagcaagagccagaccagccccaagggcggccgcagccgcagcagcagccctgtgacagagctggccagccgcagccccatccggcaggacagaggagagttcagcgccagccccatgctgaagagcggcatgagccctgagcagagccgcttccagagcgacagcagcagctaccccaccgtggacagcaacagcctgctgggccagagccggctggagacagctgagagcaaggagaagatggccctgcccccccaggaggatgccacagccagccccccccggcagaaggacaagttcagccccttccctgtgcaggacaggcctgagagcagcctggtgttcaaggacaccctgcggaccccaccccgggagaggtctggggccggcagcagccctgagaccaaggagcagaacagcgccctgcccaccagcagccaggatgaggagctgatggaggtggtggagaagtctgaggagcctgctggccagatcctgagccacctgagcagcgagctgaaggagatgagcaccagcaactttgagagcagccctgaggtggaggagaggcctgctgtgtccctgaccctggaccagagccagagccaggccagcctggaggccgtggaggtgcccagcatggccagctcctggggcggcccccacttcagccctgagcacaaggagctgagcaacagccccctgcgggagaacagctttggcagccccctggagttcaggaacagcggccccctgggcacagagatgaacacaggcttcagcagcgaggtgaaggaggacctgaatggccccttcctgaaccagctggagacagaccccagcctggacatgaaggagcagagcaccaggagcagcggccacagcagcagcgagctgagcccagatgctgtggagaaggccggcatgagcagcaaccagagcatcagcagccctgtgctggatgctgtgcccaggacccccagccgggagaggagcagcagcgccagcagccctgagatgaaggatggcctgcccaggacccccagcagaagaagccgcagcggcagcagccctggcctgagagatggcagcggcacccccagccgccacagcctgagcggcagcagccctggcatgaaggacatccccaggacccccagccggggccgctcagaatgtgacagcagccctgagcccaaggccctgccccagaccccccggcccaggagccgcagccccagcagccctgagctgaacaacaagtgcctgaccccccagcgggagaggagcggcagcgagagctctgtggaccagaagacagtggcccggacccccctgggccagaggagccgcagcggcagcagccaggagctggatgtgaagcccagcgccagcccccaggagaggtctgagagtgacagcagcccagacagcaaggccaagaccaggacccccctgcggcagaggagccgcagcggcagcagccctgaggtggacagcaagagccggctgagcccccggcgcagccgcagcggcagcagccctgaggtgaaggacaagccccgggccgccccccgggcccagagcggcagtgacagcagccctgagcccaaggccccagccccccgggccctgccccggcgcagccgcagcggcagcagcagcaagggccggggccccagccctgagggcagcagcagcacagagagcagccctgagcacccccccaagagcaggacagcccggcggggcagccgcagcagccctgagcccaagaccaagagcaggaccccaccaagaagaagaagcagccgcagcagccctgagctgaccaggaaggcccggctgagcagaagaagccgcagcgccagcagcagccctgagaccaggagcaggaccccacccaggcacagaagaagccccagcgtgagcagccctgagcctgctgagaagagccgcagcagcagaagaagaagaagtgccagcagccccaggaccaagaccaccagccggcggggccgcagccccagccccaagccccggggcctgcagaggagccgcagccgcagccggcgggagaagaccaggaccaccaggagaagagacagaagtggcagcagccagagcaccagcagaagacggcagaggagccgcagccgcagccgggtgaccaggagaagaagaggaggcagcggctaccacagccgcagccctgcccggcaggagagcagcaggaccagcagcagaagaagaagaggccgcagcaggaccccacccaccagcaggaagaggagccgcagcaggaccagccctgccccctggaagaggagccgcagccgggccagccctgccacccaccggcgcagccgcagcaggacccccctcatcagcagaagaagaagccgcagcaggaccagccctgtgtccagaagaagaagccgcagcaggacctctgtgaccaggagaagaagccgcagccgggccagccctgtgtccagaagaagaagccgcagcaggaccccacctgtgaccaggagaagaagccgcagcaggacccccaccacccggcggcgcagccgcagcaggaccccacctgtgacccggcggcgcagccgcagcaggaccccacctgtgacccggcggcgcagccgcagcaggaccagccccatcacccggcggcgcagccgcagcaggaccagccctgtgacccggcggcgcagccgcagcaggaccagccctgtgacccggcggcgcagccgcagcaggaccagccctgtgacccggcggcgcagccgcagcaggaccccaccagcccaggaccagcccaggagccctgtgcccagcgccttcagtgaccagagccgctgcctgattgcccagaccacccctgtggccggcagccagagcctgagcagtggagctgtggccaccaccaccagcagcgctggggaccacaacggcatgctgtctgtgcctgcccctggggtgccccacagtgatgtgggggagcccccagccagcactggagcccagcagcccagcgccctggccgccctgcagcctgccaaggagcggcgcagcagcagcagcagcagcagcagcagcagcagcagcagcagcagcagcagcagcagcagcagcagcagcagcagcggcagcagcagcagtgacagcgagggcagcagcctgcctgtgcagcctgaggtggccctgaagagggtgcccagccccaccccagcccccaaggaggccgtgcgggagggccggcccccagagcccaccccagccaagaggaagagaagaagcagcagcagcagcagcagcagcagcagcagcagcagcagcagcagcagcagcagcagcagcagcagcagcagcagcagcagcagcagcagcagcagcagcagcagcagcagcagcagcagcagccccagccctgccaagccaggcccccaggccctgcccaagccagccagccccaagaagcccccacctggagagaggaggagccgcagccccaggaagcccatcgacagcctgcgggacagccgcagcctgagctacagccctgtggagaggagaagacccagcccccagcccagcccccgggaccagcagagcagcagcagcgagcggggcagccggcggggccagagaggagacagccgcagccccagccacaagagaagaagagagacccccagcccccggcccatgaggcacaggagcagccgcagcccctag

SEQ ID NO: 169262 - DNA, 936 bp, Artificial Sequence
  Description of Artificial Sequence: Synthetic coding sequence
atgctgctggagaaggatgtgaaccctgggggcaaggaggagaccccaggccagaggcctgctgtgacagagacccaccagctggccgagctgaatgagaagaagaatgaaaggctgcgggccgccttcggcatcagtgacagctatgtggatggcagcagctttgacccccagaggcgggcccgggaggccaagcagcctgcccctgagccccccaagccctacagcctggtgcgggagagcagcagcagccgcagccccacccccaagcagaagaagaagaagaagaagaaggaccggggccgccgctctgagagcagcagcccccggcgggagaggaagaagagcagcaagaagaagaagcacaggtctgagagcgagagcaagaagaggaagcacaggagccccacccccaagagcaagaggaagagcaaggacaagaagaggaagaggagccgcagcaccaccccagcccccaagagccggcgggcccacaggagcaccagcgctgacagcgccagcagcagtgacaccagccgcagccgcagccgctctgctgctgccaagacccacaccacagccctggccggccgcagccccagccctgccagcggccggcggggggagggagatgcccccttcagcgagcccggcaccaccagcacccagaggcccagcagccctgagacagccaccaagcagcccagcagcccctatgaggacaaggacaaggacaagaaggagaagagcgccacccggcccagccccagccctgagaggagcagcactggacctgagcccccagcccccacccccctgctggccgagcggcacggcggcagcccccagcccctggccaccacccccctgagccaggagcctgtgaaccccagcccccagctgttcatgttcctgaagggcatcctggtgttctag

SEQ ID NO: 169263 - DNA, 2871 bp, Artificial Sequence
  Description of Artificial Sequence: Synthetic coding sequence
agaagaagaaggctgcggcgggctgaccggcggggggaggccgccgcccctggcccccgggacagcggggcccgggctgctgctgctgcccggcccctgcccctgggcggcggcggcagaagaagaagagtgcggggctatgaggagcagcagatccaggagaaggtggccaccttccggctgatgctgctggagaaggatgtgaaccctgggggcaaggaggagaccccaggccagaggcctgctgtgacagagacccaccagctggccgagctgaatgagaagaagaatgaaaggctgcgggccgccttcggcatcagtgacagctatgtggatggcagcagctttgacccccagaggcgggcccgggaggccaagcagcctgcccctgagccccccaagccctacagcctggtgcgggagagcagcagcagccgcagccccacccccaagcagaagaagaagaagaagaagaaggaccggggcagaagaagtgagagcagcagcccccggcgggagaggaagaagagcagcaagaagaagaagcacaggtctgagagcgagagcaagaagaggaagcacaggagccccacccccaagagcaagaggaagagcaaggacaagaagaggaagaggagccgcagcaccaccccagcccccaagagcagaagagcccacaggagcaccagcgctgacagcgccagcagcagtgacaccagccgcagccgcagccgctctgctgctgccaagacccacaccacagccctggccggccgcagccccagccctgccagcggcagaagaggagaaggagatgcccccttcagcgagcccggcaccaccagcacccagaggcccagcagccctgagacagccaccaagcagcccagcagcccctatgaggacaaggacaaggacaagaaggagaagagcgccacccggcccagccccagccctgagaggagcagcacaggccctgagcccccagcccccacccccctgctggccgagagacatggaggcagcccccagcccctggccaccacccccctgagccaggagcctgtgaacccccccagcgaggccagccccacccgggacaggagcccccccaagagccctgagaagctgccccagagcagcagcagcgagagcagcccccccagcccccagcccaccaaggtgtccagacatgccagcagcagccctgagagccccaagccagccccagcccctggcagccaccgggagatcagcagcagccccaccagcaagaacagaagccacggccgggccaagagggacaagagccacagccacacccccagcaggaggatgggccgcagccgcagccctgccacagccaagaggggccgcagccgcagcaggacccccaccaagaggggccacagccgcagccgcagcccccagtggaggaggagccgcagcgcccagcgctggggccgcagccgcagcccccagaggcggggccgcagccgcagcccccagaggcctggctggagccgcagcaggaacacccagaggcggggccgcagccgcagcgcccggcggggccgcagccacagccgcagccctgccacccggggccgcagccgcagcaggaccccagcccggcggggccgcagccgcagcaggaccccagccaggagaagaagccgcagcaggacccccaccaggagaagaagccgcagcaggaccccagcccggcggggccgcagccgcagcaggaccccagcccggcggcgcagcaggaccaggagccctgtgagaagaagaagccgcagccgcagccctgccaggagaagtggccgcagccgcagcaggaccccagcccggcggggccgcagccgcagcaggaccccagcccggcggggccgcagccgcagcaggaccccagccaggagaagtggccgcagccgcagcaggaccccagcccggcggggccgcagccgcagcaggaccccaagaagaggccgcagccgcagccgcagcctggtgcggcggggccgcagccacagcaggaccccccagaggcggggccgcagcggcagcagcagcgagaggaagaacaagagcaggaccagccagaggaggagccgcagcaacagcagccctgagatgaagaagagccgcatcagcagccgccgcagccgcagcctgagcagccccaggagcaaggccaagagccggctgagcctgcggcgcagcctgagcggcagcagcccctgccccaagcagaagagccagaccccaccccggcgcagccgcagcggcagcagccagcccaaggccaagagcaggaccccaccccggcgcagccgcagcagcagcagccccccacccaagcagaagagcaagacccccagccggcagagccacagcagcagcagcccccaccccaaggtgaagagcggcaccccaccccggcagggcagcatcaccagcccccaggccaatgagcagagcgtgaccccccagaggaggagctgctttgagagcagcccagaccctgagctgaagagcaggacccccagccgccacagctgcagcggcagcagccccccccgggtgaagagcagcaccccaccccggcagagccccagccgcagcagcagcccccagcccaaggtgaaggccatcatcagcccccggcagaggagccacagcggcagcagcagccccagccccagccgggtgaccagcaggaccaccccaagaagaagccgctctgtgagcccctgcagcaatgtggagagccggctgctgccccgctacagccacagcggcagcagcagcccagacaccaaggtgaagccagagaccccaccccggcagagccacagcggctag

SEQ ID NO: 169264 - DNA, 6036 bp, Artificial Sequence
  Description of Artificial Sequence: Synthetic coding sequence
atgaagaagagccgcatcagcagcagaagaagccgcagcctgagcagccccaggagcaaggccaagagccggctgagcctgcggcgcagcctgagcggcagcagcccctgccccaagcagaagagccagaccccaccaagaagaagccgcagcggcagcagccagcccaaggccaagagcaggaccccaccaagaagaagccgcagcagcagcagccccccacccaagcagaagagcaagacccccagccggcagagccacagcagcagcagcccccaccccaaggtgaagagcggcaccccaccccggcagggcagcatcaccagcccccaggccaatgagcagagcgtgaccccccagaggaggagctgctttgagagcagcccagaccctgagctgaagagcaggacccccagccgccacagctgcagcggcagcagccccccccgggtgaagagcagcaccccaccccggcagagccccagccgcagcagcagcccccagcccaaggtgaaggccatcatcagcccccggcagaggagccacagcggcagcagcagccccagccccagccgggtgaccagcaggaccaccccccggcgcagccgctctgtgagcccctgcagcaatgtggagagccggctgctgccccgctacagccacagcggcagcagcagcccagacaccaaggtgaagccagagaccccaccccggcagagccacagcggcagcatcagcccctaccccaaggtgaaggcccagaccccacctggccccagcctgagcggcagcaagagcccctgcccccaggagaagagcaaggacagcctggtgcagagctgccccggcagcctgagcctgtgtgccggcgtgaagagcagcaccccacctggagagagctactttggagtgagcagcctgcagctgaagggccagagccagaccagcccagaccacagaagtgacaccagcagccctgaggtgcggcagagccacagcgagagccccagcctgcagagcaagagccagaccagccccaagggcggccgcagccgcagcagcagccctgtgacagagctggccagccgcagccccatccggcaggacagaggagagttcagcgccagccccatgctgaagagcggcatgagccctgagcagagccgcttccagagcgacagcagcagctaccccaccgtggacagcaacagcctgctgggccagagccggctggagacagctgagagcaaggagaagatggccctgcccccccaggaggatgccacagccagccccccccggcagaaggacaagttcagccccttccctgtgcaggacaggcctgagagcagcctggtgttcaaggacaccctgcggaccccaccccgggagaggtctggggccggcagcagccctgagaccaaggagcagaacagcgccctgcccaccagcagccaggatgaggagctgatggaggtggtggagaagtctgaggagcctgctggccagatcctgagccacctgagcagcgagctgaaggagatgagcaccagcaactttgagagcagccctgaggtggaggagaggcctgctgtgtccctgaccctggaccagagccagagccaggccagcctggaggccgtggaggtgcccagcatggccagctcctggggcggcccccacttcagccctgagcacaaggagctgagcaacagccccctgcgggagaacagctttggcagccccctggagttcaggaacagcggccccctgggcacagagatgaacacaggcttcagcagcgaggtgaaggaggacctgaatggccccttcctgaaccagctggagacagaccccagcctggacatgaaggagcagagcaccaggagcagcggccacagcagcagcgagctgagcccagatgctgtggagaaggccggcatgagcagcaaccagagcatcagcagccctgtgctggatgctgtgcccaggacccccagccgggagaggagcagcagcgccagcagccctgagatgaaggatggcctgcccaggacccccagcagaagaagccgcagcggcagcagccctggcctgagagatggcagcggcacccccagccgccacagcctgagcggcagcagccctggcatgaaggacatccccaggacccccagccggggccgctcagaatgtgacagcagccctgagcccaaggccctgccccagaccccccggcccaggagccgcagccccagcagccctgagctgaacaacaagtgcctgaccccccagcgggagaggagcggcagcgagagctctgtggaccagaagacagtggcccggacccccctgggccagaggagccgcagcggcagcagccaggagctggatgtgaagcccagcgccagcccccaggagaggtctgagagtgacagcagcccagacagcaaggccaagaccaggacccccctgcggcagaggagccgcagcggcagcagccctgaggtggacagcaagagccggctgagcccccggcgcagccgcagcggcagcagccctgaggtgaaggacaagccccgggccgccccccgggcccagagcggcagtgacagcagccctgagcccaaggccccagccccccgggccctgccccggcgcagccgcagcggcagcagcagcaagggccggggccccagccctgagggcagcagcagcacagagagcagccctgagcacccccccaagagcaggacagcccggcggggcagccgcagcagccctgagcccaagaccaagagcaggaccccaccaagaagaagaagcagccgcagcagccctgagctgaccaggaaggcccggctgagcagaagaagccgcagcgccagcagcagccctgagaccaggagcaggaccccacccaggcacagaagaagccccagcgtgagcagccctgagcctgctgagaagagccgcagcagcagaagaagaagaagtgccagcagccccaggaccaagaccaccagccggcggggccgcagccccagccccaagccccggggcctgcagaggagccgcagccgcagccggcgggagaagaccaggaccaccaggagaagagacagaagtggcagcagccagagcaccagcagaagacggcagaggagccgcagccgcagccgggtgaccaggagaagaagaggaggcagcggctaccacagccgcagccctgcccggcaggagagcagcaggaccagcagcagaagaagaagaggccgcagcaggaccccacccaccagcaggaagaggagccgcagcaggaccagccctgccccctggaagaggagccgcagccgggccagccctgccacccaccggcgcagccgcagcaggacccccctcatcagcagaagaagaagccgcagcaggaccagccctgtgtccagaagaagaagccgcagcaggacctctgtgaccaggagaagaagccgcagccgggccagccctgtgtccagaagaagaagccgcagcaggaccccacctgtgaccaggagaagaagccgcagcaggacccccaccacccggcggcgcagccgcagcaggaccccacctgtgacccggcggcgcagccgcagcaggaccccacctgtgacccggcggcgcagccgcagcaggaccagccccatcacccggcggcgcagccgcagcaggaccagccctgtgacccggcggcgcagccgcagcaggaccagccctgtgacccggcggcgcagccgcagcaggaccagccctgtgacccggcggcgcagccgcagcaggaccccaccagccatcagaagaagaagccgcagcaggacccccctgctgcccaggaagaggagccgcagccgcagccccctggccatcagaagaagaagccgcagcaggacccccaggacagcccggggcaagaggagcctgaccaggagccccccagccatcagaagaagaagtgccagcggcagcagcagtgacaggagccgcagcgccaccccaccagccaccaggaaccacagcggcagcaggaccccacctgtggccctgaacagcagcaggatgagctgcttcagccggcccagcatgagccccacccccctggaccgctgccgcagccctggcatgctggagcccctgggcagcagcaggacccccatgtctgtgctgcagcaggccggcggctccatgatggatggccctggcccccgcatcccagaccaccagaggacctctgtgcctgagaaccacgcccagagcagaattgccctggccctgacagccatcagcctgggcacagcccggcccccacccagcatgtctgctgctggcctggccgccaggatgagccaggtgcctgcccctgtgcccctgatgagcctgaggacagccccagctgccaacctggccagccgcatcccagctgccagcgctgctgccatgaacctggccagcgcccggaccccagccatccccacagctgtgaacctggccgacagcaggaccccagctgctgctgctgccatgaacctggccagccccaggacagctgtggcccccagcgctgtgaacctggccgaccccaggacccccacagccccagctgtgaacctggccggggcccggaccccagctgccctggccgccctgagcctgaccggcagcggcaccccacccacagctgccaactaccccagcagcagcaggaccccccaggccccagccagcgccaacctggtgggccccaggtctgcccacgccacagcccctgtgaacattgctggcagcaggacagctgctgccctggccccagccagcctgaccagcgccaggatggccccagccctgagcggggccaacctgaccagcccccgggtgcccctgagcgcctatgaaagagtgtctggccgcaccagcccccccctgctggaccgggcccggagcaggaccccacccagcgcccccagccagagcaggatgaccagcgagcgggcccccagccccagcagcaggatgggccaggcccccagccagagcctgctgcccccagcccaggaccagcccaggagccctgtgcccagcgccttcagtgaccagagccgctgcctgattgcccagaccacccctgtggccggcagccagagcctgagcagtggagctgtggccaccaccaccagcagcgctggggaccacaacggcatgctgtctgtgcctgcccctggggtgccccacagtgatgtgggggagcccccagccagcactggagcccagcagcccagcgccctggccgccctgcagcctgccaaggagcggcgcagcagcagcagcagcagcagcagcagcagcagcagcagcagcagcagcagcagcagcagcagcagcagcagcagcggcagcagcagcagtgacagcgagggcagcagcctgcctgtgcagcctgaggtggccctgaagagggtgcccagccccaccccagcccccaaggaggccgtgcgggagggccggcccccagagcccaccccagccaagaggaagagaagaagcagcagcagcagcagcagcagcagcagcagcagcagcagcagcagcagcagcagcagcagcagcagcagcagcagcagcagcagcagcagcagcagcagcagcagcagcagcagcagcagcagccccagccctgccaagccaggcccccaggccctgcccaagccagccagccccaagaagcccccacctggagagaggagcctgctgcctgtgagccccagccccaggcacagcctgccccacgtggcccggggcaccttcctgaagaggaccagcggctacttcccccccctgcacaagagctttggcaccccctgtggcctgcaggacaaggccccacccctgcgggagtggagggtgcggctcttcaccaacggcccctgccccccctgtgtgctgctgctgcctgcccccacccacgccctgtgcagcagccacacccagaggctggccgtgtag

SEQ ID NO: 169265 - DNA, 1836 bp, Artificial Sequence
  Description of Artificial Sequence: Synthetic coding sequence
atggcctctgtgcagcagggcgagaagcagctgtttgagaagttctggaggggcaccttcaaggctgtggccacccccaggcctgagagcatcatcgtggccagcatcacagccaggaagcccctgcccaggacagagccccagaacaaccctgtggtgcctgcccaggacggccccagcgagaagctgggccagcacctggccacagagcccctgggcaccaacagctgggagcgggacaagacctgccgggagctgggcgccacccggggccacagcgccagccatgacaaggacctgaccccaccacccagcagccggggcaagaagaagaagaagaagagcaccaggaagaagagaagaagaagcagcagctacagccccagccctgtgaagaagaagaagaagaagagcagcaagaagcacaagagaagaagaagcttcagcaagaagaggaggcacagcagcagcagccccaagagcaagagaagagatgagaagaggcacaagaagcagagccgcagccggcccaggaagagccaccgccaccgccaccaccgctgccccagccgcagccagagcagcgagagccggcccagcagctgtgagagccgccaccggggccgcagccctgaggagggccagaagagcagaagaagacacagccgccgctgcagcaagaccctgtgcaaggacagccctgaggcccagagcagcaggcctcccagccagcccctgcagatgctgggctacctgagcgcccggggcgtcatcactggaagtggcagcgctgctgacctcttcaccaagacagccagccccctgaccaccagccggggccgcagccaggagtatgattctggaaatgacaccagcagcccccccagcacccagaccagcagcgcccggagccggggccaggagaagggcagccccagcggcggcctgagcaagagccgggagctgaacagcggcaacaccagtgacagcggcaacagcttcaccaccagcagcccccagaacaagggggccatgctggagaacctgagccccaccagccggggccgggagagccggggcttccagagcccctgcctggagtgtgccgaggtgaagaagagcagcctggtgcccagcacagcccggagcagccccatgaagggctgcagccgcagcagcagctatgccagcaccaggagcagcagccacagcagccgcagccccaacccccgggccagcccccgctacacccagagccgcagcaccagcagcgagaagaggagctacagccgcagccccagctacagcagcaagagcggcaagaggagcccccccagccgcagcagccgcagccgccgcagccccagctacagccgctacagccccagccgggagcgggaccccaagtacagcgagaaggacagccagcagcgggagcgggagcgggccaggagaagaagaagaagctacagccccatgaggaagagaagaagagacagccccagccacctggaggcccggcgcatcaccagcgccaggaagaggcccatcccctactaccggcccagccccagcagcagcggcagcctgagcagcaccagctcctggtacagcagcagcagcagccgcagcgccagccgcagctacagccgcagccgcagccgcagccgcagcagaagaagaagcaggaccaggaccagcagcagcagcagcagccgcagccccagccctggcagccgcagccgcagccgcagccgcagccgcagccgcagccgcagccgcagccagagccgcagctacagcagcgctgacagctacagcagcaccaggaggtag

SEQ ID NO: 169266 - DNA, 747 bp, Artificial Sequence
  Description of Artificial Sequence: Synthetic coding sequence
atgtctgggggcggcgtcatccggggccctgctggcaacaatgactgccgcatctacgtgggcaacctgcccccagacatccgcaccaaggacattgaagatgtgttctacaagtatggagccatccgggacatcgacctgaagaacagaagaggaggccccccatttgcctttgtggagtttgaggaccccagagatgctgaagatgctgtgtatggaagagatggctatgactatgatggctaccgcctgcgggtggagttccccaggagcggccggggcaccggccggggcggcggcggcggcggcggcggcggggccccccggggccgctatggcccccccagcagaagaagtgagaacagagtggtggtgtctggcctgcccccatctggctcctggcaggacctgaaggaccacatgagggaggccggagatgtgtgctacgcagatgtgtacagagatggcactggagtggtggagtttgtgaggaaggaggacatgacctatgctgtgaggaagctggacaacaccaagttccgcagccatgaaggagaaacagcctacatccgggtgaaggtggatggccccaggagccccagctatggccgcagccgcagccgcagccgcagccgcagccgcagccgcagccgcagcaacagccgcagccgcagctacagccccaggaggagccggggcagcccccgctacagccccaggcacagccgcagccgcagcaggacatag

SEQ ID NO: 169267 - DNA, 606 bp, Artificial Sequence
  Description of Artificial Sequence: Synthetic coding sequence
atgtctgggggcggcgtcatccggggccctgctggcaacaatgactgccgcatctacgtgggcaacctgcccccagacatccgcaccaaggacattgaagatgtgttctacaagtatggagccatccgggacatcgacctgaagaacagaagaggaggccccccatttgcctttgtggagtttgaggaccccagagatgctgaagatgctgtgtatggaagagatggctatgactatgatggctaccgcctgcgggtggagttccccaggagcggccggggcaccggccggggcggcggcggcggcggcggcggcggggccccccggggccgctatggcccccccagcagaagaagtgagaacagagtggtggtgtctggcctgcccccatctggctcctggcaggacctgaaggaccacatgagggaggccggagatgtgtgctacgcagatgtgtacagagatggcactggagtggtggagtttgtgaggaaggaggacatgacctatgctgtgaggaagctggacaacaccaagttccgcagccatgaggtgggctacacccgcatcctcttctttgaccagaactggatccagtggagctag

SEQ ID NO: 169268 - DNA, 786 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaaccggcccaccggccggcccaggaggagccgcagccacagcgacaatgaccgcttcaagcacaggaacagaagcttcagccgcagcaagagcaacagccgcagccgcagcaagagccagcccaagaaggagatgaaggccaagagccgcagccgcagcgccagccacaccaagacccggggcaccagcaagacagacagcaagacccactacaagagcggcagccgctatgagaaggagagcaggaagaaggagcccccaagaagcaagagccagagccgcagccagagccgcagccgcagcaagagccgcagccgctcctggaccagccccaagagcagcggccactag

SEQ ID NO: 169269 - DNA, 552 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaacagccggcccaccggccggccccggcgcagccgcagccacagcgacaatgaccggcccaactgctcctggaacacccagtacagcagcgcctactacaccagcaggaagatctag

SEQ ID NO: 169270 - DNA, 522 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaacagccggcccaccggccggccccggcgcagccgcagccacagcgacaatgacagccaggtgtccaagaagaagaatgaaagatag

SEQ ID NO: 169271 - DNA, 519 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaaccggcccaccggccggcccaggaggagccgcagccacagcgacaatgacagccaggtgtccaagaagaagaatgaaagatag

SEQ ID NO: 169272 - DNA, 498 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaagcccaactgctcctggaacacccagtacagcagcgcctactacaccagcaggaagatctag

SEQ ID NO: 169273 - DNA, 549 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaaccggcccaccggccggcccaggaggagccgcagccacagcgacaatgaccggcccaactgctcctggaacacccagtacagcagcgcctactacaccagcaggaagatctag

SEQ ID NO: 169274 - DNA, 789 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaacagccggcccaccggccggccccggcgcagccgcagccacagcgacaatgaccgcttcaagcacaggaacagaagcttcagccgcagcaagagcaacagccgcagccgcagcaagagccagcccaagaaggagatgaaggccaagagccgcagccgcagcgccagccacaccaagacccggggcaccagcaagacagacagcaagacccactacaagagcggcagccgctatgagaaggagagcaggaagaaggagccccccaggagcaagagccagagccgcagccagagccgcagccgcagcaagagccgcagccgctcctggaccagccccaagagcagcggccactag

SEQ ID NO: 169275 - DNA, 1275 bp, Artificial Sequence
  Description of Artificial Sequence: Synthetic coding sequence
atgatcaacaaccacaggaaccaggccctgtacttcagcgagcacaagtacttccagcagacccaggtggtgtaccagggcgacatcttctgggtgttcctgtgtgtgttctgcctgaggaaagaatgtgtgctgatgcagggctgcttctctgctggggtcatcccagatgaggccaaggccctgagcctgctggccccagccaatgctgtggccggcctgctgcccggcggcggcctgctgcccacccccaaccccctgacccagatcggggctgtgcccctggccgccctgggcgcccccaccctggaccctgccctggccgccctgggcctgcccggggccaacctgaacagccagagcctggccgctgaccagctgctgaagctgatgagcacagtggaccccaagctgaaccacgtggccgccggcctggtgagccccagcctgaagagtgacaccagcagcaaggagattgaggaggccatgaagagggtgcgggaggcccagagcctcatctctgctgccattgaaccagacaagaaggaggagaagaggaggcacagccgcagccgcagccgcagcagaagaagaaggacccccagcagcagccgccacagaagaagccgcagccgcagcagaagaagaagccacagcaagagccgcagcagaagaagaagcaagagccccaggagaagaagaagccacagccgggagcggggccgccgcagccgcagcaccagcaagacccgggacaagaagaaggaggacaaggagaagaagaggagcaagaccccacccaagagctacagcacagcccggcgcagccgcagcgccagccgggagaggagaagaagaagaagccgcagcggcaccaggagccccaagaagcccaggagccccaagaggaagctgagccgcagccccagcccccggcggcacaagaaggagaagaagaaggacaaggacaaggagaggagcagagatgagcgggagaggagcaccagcaagaagaagaagagcaaggacaaggagaaggaccgggagaggaagtctgagagtgacaaggatgtgaagcaggtgacccgggactatgatgaggaggagcagggctatgacagcgagaaggagaagaaggaggagaagaagcccattgaaacaggcagccccaagaccaaggagtgcagcgtggagaagggcactggagacagcctgcgggagagcaaggtgaatggagatgaccaccacgaggaggacatggacatgtctgactag

SEQ ID NO: 169276 - DNA, 1455 bp, Artificial Sequence
  Description of Artificial Sequence: Synthetic coding sequence
atgagcaacaccaccgtggtgcccagcacagctggccctggccccagcggcggccctgggggcggcggcggcggcggcggcggcggcggcggcacagaggtgatccaggtgaccaacgtgagccccagcgccagcagcgagcagatgaggaccctgtttggcttcctgggcaagattgatgagctgcggctcttccccccagatgacagccccctgcctgtgagcagccgggtgtgctttgtgaagttccatgaccctgacagcgctgtggtggcccagcacctgaccaacacagtgtttgtggaccgggccctgattgtggtgccctatgcagagggcgtcatcccagatgaggccaaggccctgagcctgctggccccagccaatgctgtggccggcctgctgcccggcggcggcctgctgcccacccccaaccccctgacccagatcggggctgtgcccctggccgccctgggcgcccccaccctggaccctgccctggccgccctgggcctgcccggggccaacctgaacagccagagcctggccgctgaccagctgctgaagctgatgagcacagtggaccccaagctgaaccacgtggccgccggcctggtgagccccagcctgaagagtgacaccagcagcaaggagattgaggaggccatgaagagggtgcgggaggcccagagcctcatctctgctgccattgaaccagacaagaaggaggagaagaggaggcacagccgcagccgcagccgcagcagaagaagaaggacccccagcagcagccgccacagaagaagccgcagccgcagcagaagaagaagccacagcaagagccgcagcagaagaagaagcaagagccccaggagaagaagaagccacagccgggagcggggccgccgcagccgcagcaccagcaagacccgggacaagaagaaggaggacaaggagaagaagaggagcaagaccccacccaagagctacagcacagcccggcgcagccgcagcgccagccgggagaggagaagaagaagaagccgcagcggcaccaggagccccaagaagcccaggagccccaagaggaagctgagccgcagccccagcccccggcggcacaagaaggagaagaagaaggacaaggacaaggagaggagcagagatgagcgggagaggagcaccagcaagaagaagaagagcaaggacaaggagaaggaccgggagaggaagtctgagagtgacaaggatgtgaagcaggtgacccgggactatgatgaggaggagcagggctatgacagcgagaaggagaagaaggaggagaagaagcccattgaaacaggcagccccaagaccaaggagtgcagcgtggagaagggcactggagacagcctgcgggagagcaaggtgaatggagatgaccaccacgaggaggacatggacatgtctgactag

SEQ ID NO: 169277 - DNA, 1452 bp, Artificial Sequence
  Description of Artificial Sequence: Synthetic coding sequence
atgagcaacaccaccgtggtgcccagcacagctggccctggccccagcggcggccctgggggcggcggcggcggcggcggcggcggcggcggcacagaggtgatccaggtgaccaacgtgagccccagcgccagcagcgagcagatgaggaccctgtttggcttcctgggcaagattgatgagctgcggctcttccccccagatgacagccccctgcctgtgagcagccgggtgtgctttgtgaagttccatgaccctgacagcgctgtggtggcccagcacctgaccaacacagtgtttgtggaccgggccctgattgtggtgccctatgcagagggcgtcatcccagatgaggccaaggccctgagcctgctggccccagccaatgctgtggccggcctgctgcccggcggcggcctgctgcccacccccaaccccctgacccagatcggggctgtgcccctggccgccctgggcgcccccaccctggaccctgccctggccgccctgggcctgcccggggccaacctgaacagccagagcctggccgctgaccagctgctgaagctgatgagcacagtggaccccaagctgaaccacgtggccgccggcctggtgagccccagcctgaagagtgacaccagcagcaaggagattgaggaggccatgaagagggtgcgggaggcccagagcctcatctctgctgccattgaaccagacaagaaggaggagaagaggaggcacagccgcagccgcagccgcagcagaagaagaaggacccccagcagcagccgccacagaagaagccgcagccgcagcagaagaagaagccacagcaagagccgcagcagaagaagaagcaagagccccaggagaagaagaagccacagccgggagcggggccgccgcagccgcagcaccagcaagacccgggacaagaagaaggaggacaaggagaagaagaggagcaagaccccacccaagagctacagcacagcccggcgcagccgcagcgccagccgggagaggagaagaagaagaagccgcagcggcaccaggagccccaagaagcccaggagccccaagaggaagctgagccgcagccccagcccccggcggcacaagaaggagaagaagaaggacaaggacaaggagaggagcagagatgagcgggagaggagcaccagcaagaagaagaagagcaaggacaaggagaaggaccgggagaggaagtctgagagtgacaaggatgtgaaggtgacccgggactatgatgaggaggagcagggctatgattctgagaaggagaagaaggaggagaagaagcccatcgagaccggcagccccaagaccaaggaatgttctgtggagaagggcaccggggacagcctgcgggagagcaaggtgaatggagatgaccaccacgaggaggacatggacatgtctgactag

SEQ ID NO: 169278 - DNA, 1170 bp, Artificial Sequence
  Description of Artificial Sequence: Synthetic coding sequence
atgagcaacaccaccgtggtgcccagcacagctggccctggccccagcggcggccctgggggcggcggcggcggcggcggcggcggcggcggcacagaggtgatccaggtgaccaacgtgagccccagcgccagcagcgagcagatgaggaccctgtttggcttcctgggcaagattgatgagctgcggctcttccccccagatgacagccccctgcctgtgagcagccgggtgtgctttgtgaagttccatgaccctgacagcgctgtggtggcccagcacctgaccaacacagtgtttgtggaccgggccctgattgtggtgccctatgcagagggcgtcatcccagatgaggccaaggccctgagcctgctggccccagccaatgctgtggccggcctgctgcccggcggcggcctgctgcccacccccaaccccctgacccagatcggggctgtgcccctggccgccctgggcgcccccaccctggaccctgccctggccgccctgggcctgcccggggccaacctgaacagccagagcctggccgctgaccagctgctgaagctgatgagcacagtggaccccaagctgaaccacgtggccgccggcctggtgagccccagcctgaagagtgacaccagcagcaaggagattgaggaggccatgaagagggtgcgggaggcccagagcctcatctctgctgccattgaaccagacaagaaggaggagaagaggaggcacagccgcagccgcagccgcagcagaagaagaaggacccccagcagcagccgccacagaagaagccgcagccgcagcagaagaagaagccacagcaagagccgcagcagaagaagaagcaagagccccaggagaagaagaagccacagccgggagcggggccgccgcagccgcagcaccagcaagacccgggacaagaagaaggaggacaaggagaagaagaggagcaagaccccacccaagagctacagcacagcccggcgcagccgcagcgccagcagcctgcacatctgtgacagccgggagaggagaagaagaagaagccgcagcggcaccaggagccccaagaagcccaggagccccaagaggaagctgagccgcagccccagccccaggaggcacaagaaggagaagaagaaggacaagtag

SEQ ID NO: 169279 - DNA, 1455 bp, Artificial Sequence; identical to SEQ ID NO: 169276
  Description of Artificial Sequence: Synthetic coding sequence

SEQ ID NO: 169280 - DNA, 387 bp, Artificial Sequence
  Description of Artificial Sequence: Synthetic coding sequence
atgagcaacaccaccgtggtgcccagcacagctggccctggccccagcggcggccctgggggcggcggcggcggcggcggcggcggcggcggcacagaggtgatccaggtgaccaacgtgagccccagcgccagcagcgagcagatgaggaccctgtttggcttcctgggcaagattgatgagctgcggctcttccccccagatgacagccccctgcctgtgagcagccgggtgtgctttgtgaagttccatgaccctgacagcgctgtggtggcccagcacctgaccaacacagtgtttgtggaccgggccctgattgtggtgccctatgcagaggtgaagcagcccaccagggtggtggtgcacaagacagcctttgagagctag

SEQ ID NO: 169281 - DNA, 396 bp, Artificial Sequence
  Description of Artificial Sequence: Synthetic coding sequence
atgagcaacaccaccgtggtgcccagcacagctggccctggccccagcggcggccctgggggcggcggcggcggcggcggcggcggcggcggcacagaggtgatccaggtgaccaacgtgagccccagcgccagcagcgagcagatgaggaccctgtttggcttcctgggcaagattgatgagctgcggctcttccccccagatgacagccccctgcctgtgagcagccgggtgtgctttgtgaagttccatgaccctgacagcgctgtggtggcccagcacctgaccaacacagtgtttgtggaccgggccctgattgtggtgccctatgcagaggtgttccacggcagcatcaaggctgctgtgaagaagatcctgctgacccatgagaactag

SEQ ID NO: 169282 - DNA, 630 bp, Artificial Sequence
  Description of Artificial Sequence: Synthetic coding sequence
atgaccagcctgaaggtggacaacctgacctaccgcaccagcccagacaccctgcggcgggtgtttgagaagtatggccgggtgggagatgtgtacatcccccgggaccgctacaccaaggagagccggggctttgcctttgtgcgcttccatgacaagagagatgctgaagatgccatggatgccatggatggagctgtgctggatggccgggagctgcgggtgcagatggcccgctatggccggcccccagacagccaccacagccggcggggccccccaccccggcgctatggaggcggcggctatggaagaagaagccgcagccccaggagaagaagaagaagccgcagccgcagccgcagccgcagccgcagccgcagccgcagccgctacagccgcagcaagagccgcagcaggaccaggagccgcagccgcagcaccagcaagagccgcagcgcccggcgcagcaagagcaagagcagctctgtgagccgcagccgcagccgcagccgcagccgcagccgcagccgcagccccccacctgtgtccaagcgggagagcaagagccgcagccgcagcaagagcccccccaagagccctgaggaggagggcgctgtgagcagctag

SEQ ID NO: 169283 - DNA, 606 bp, Artificial Sequence
  Description of Artificial Sequence: Synthetic coding sequence
atgtcctatggccggcccccaccagatgtggagggcatgaccagcctgaaggtggacaacctgacctaccgcaccagcccagacaccctgcggcgggtgtttgagaagtatggccgggtgggagatgtgtacatcccccgggaccgctacaccaaggagagccggggctttgcctttgtgcgcttccatgacaagagagatgctgaagatgccatggatgccatggatggagctgtgctggatggccgggagctgcgggtgcagatggcccgctgtggcggctatggaagaagaagccgcagccccaggagaagaagaagaagccgcagccgcagccgcagccgcagccgcagccgcagccgcagccgctacagccgcagcaagagccgcagcaggaccaggagccgcagccgcagcaccagcaagagccgcagcgcccggcgcagcaagagcaagagcagctctgtgagccgcagccgcagccgcagccgcagccgcagccgcagccgcagccccccacctgtgtccaagcgggagagcaagagccgcagccgcagcaagagcccccccaagagccctgaggaggagggcgctgtgagcagctag

SEQ ID NO: 169284 - DNA, 666 bp, Artificial Sequence
  Description of Artificial Sequence: Synthetic coding sequence
atgtcctatggccggcccccaccagatgtggagggcatgaccagcctgaaggtggacaacctgacctaccgcaccagcccagacaccctgcggcgggtgtttgagaagtatggccgggtgggagatgtgtacatcccccgggaccgctacaccaaggagagccggggctttgcctttgtgcgcttccatgacaagagagatgctgaagatgccatggatgccatggatggagctgtgctggatggccgggagctgcgggtgcagatggcccgctatggccggcccccagacagccaccacagccggcggggccccccaccccggcgctatggaggcggcggctatggaagaagaagccgcagccccaggagaagaagaagaagccgcagccgcagccgcagccgcagccgcagccgcagccgcagccgctacagccgcagcaagagccgcagcaggaccaggagccgcagccgcagcaccagcaagagccgcagcgcccggcgcagcaagagcaagagcagctctgtgagccgcagccgcagccgcagccgcagccgcagccgcagccgcagccccccacctgtgtccaagcgggagagcaagagccgcagccgcagcaagagcccccccaagagccctgaggaggagggcgctgtgagcagctag

SEQ ID NO: 169285 - DNA, 540 bp, Artificial Sequence
  Description of Artificial Sequence: Synthetic coding sequence
atgtcctatggccggcccccaccagatgtggagggcatgaccagcctgaaggtggacaacctgacctaccgcaccagcccagacaccctgcggcgggtgtttgagaagtatggccgggtgggagatgtgtacatcccccgggaccgctacaccaaggagagccggggctttgcctttgtgcgcttccatgacaagagagatgctgaagatgccatggatgccatggatggagctgaccccggggtgggcgtggtgcccggcctggccgctgacctggccacagctgcccggagcctgggccctgccctggtgctggacctgggccggccccccagcccagacccccatgagggccccagccccagcccccggcgcagcccagacctggtgcggggccctggccctggcctgggccctggggtgctgccccagtgcccccggggcaaccccaaccctggccgggaccggcgggtgccccccagcctgctgaagaggaaggagcgctgccccctgaagaagatgctgcggagccctgtgtag

SEQ ID NO: 169286 - DNA, 669 bp, Artificial Sequence
  Description of Artificial Sequence: Synthetic coding sequence
cctgagaggagaggagtggccccacccagggctgaggaggccggggccagcagccggggcagcggcccccccctgcgggccatgtcctatggccggcccccaccagatgtggagggcatgaccagcctgaaggtggacaacctgacctaccgcaccagcccagacaccctgcggcgggtgtttgagaagtatggccgggtgggagatgtgtacatcccccgggaccgctacaccaaggagagccggggctttgcctttgtgcgcttccatgacaagagagatgctgaagatgccatggatgccatggatggagctgtgctggatggccgggagctgcgggtgcagatggcccgctatggccggcccccagacagccaccacagcagaagaggccccccaccaagaagatatggaggcggcggctacggccgccgcagccgcagccccaggagaagaagaagaagccgcagccgcagccgcagccgcagccgcagccgcagccgcagccgctacagccgcagcaagagccgcagcaggaccaggagccgcagccgcagcaccagcaagagccgcagcgcccggcgcagcaagagcaagagcagctctgtgagccgcagccgcagccgcagccgcagccgcagccgcagccgcagccccccacctgtgtag

SEQ ID NO: 169287 - DNA, 375 bp, Artificial Sequence
  Description of Artificial Sequence: Synthetic coding sequence
atgcaccgggacagctgccccctggactgcaaggtgtatgtgggcaacctgggcaacaacggcaacaagacagagctggagcgggccttcggctactacggccccctgcggtctgtgtgggtggccagaaatcctcctggctttgcctttgtggagtttgaggaccccagagatgctgctgatgctgtgcgggagctggatggccgcaccctgtgtggctgccgggtgcgggtggagctgagcaatggagagaagaggagcaggaacagaggccccccacccagctggggccggcggcccagagatgactacagaagaagaagccccccacccaggagaagagtgaccatcatgagcctgctgaccaccctgtag

SEQ ID NO: 169288 - DNA, 495 bp, Artificial Sequence
  Description of Artificial Sequence: Synthetic coding sequence
atgcaccgggacagctgccccctggactgcaaggtgtatgtgggcaacctgggcaacaacggcaacaagacagagctggagcgggccttcggctactacggccccctgcggtctgtgtgggtggccagaaatcctcctggctttgcctttgtggagtttgaggaccccagagatgctgctgatgctgtgcgggagctggatggccgcaccctgtgtggctgccgggtgcgggtggagctgagcaatggagagaagaggagcaggaacagaggccccccacccagctggggccggcggcccagagatgactacagaagaagaagccccccacccaggagaagaagcccccggcggcgctccttcagccgcagccgcagccgcagcctgagccgggacagaagaagagagaggagcctgagccgggagaggaaccacaagcccagccgctccttcagccgcagccgcagccgcagccgcagcaatgaaaggaagtag

SEQ ID NO: 169289 - DNA, 1485 bp, Artificial Sequence
  Description of Artificial Sequence: Synthetic coding sequence
atgccccgggtgtacatcggccgcctgagctaccaggcccgggagagagatgtggagcgcttcttcaagggctacggcaagatcctggaggtggacctgaagaatggctacggctttgtggagtttgatgacctgagagatgctgatgatgctgtgtatgagctgaatggcaaggacctgtgtggggagagggtcatcgtggagcacgcccggggccccaggagagatggcagctatggcagcggccgcagcggctacggctacagaagaagtggccgggacaagtatggcccccccaccaggacagagtaccgcctgattgtggagaacctgagcagccgctgctcctggcaggacctgaaggactacatgaggcaggccggggaggtgacctatgcagatgcccacaagggcaggaagaatgaaggagtgattgaatttgtgtcctacagcgacatgaagagggccctggagaagctggatggaacagaggtgaatggaaggaagatccggctggtggaggacaagccaggcagcagaagaagaagaagctacagccgcagccgcagccacagccgcagccgcagccgcagccgccacagcaggaagagccgcagccgcagcggcagcagcaagagcagccacagcaagagccgcagccgcagccgcagcggcagccgcagccgcagcaagagccgcagccgcagccagagccgcagccgcagcaagaaggagaagagccgcagccccagcaaggagaagagccgcagccgcagccacagcgctgggaagagccgcagcaagagcaaggaccaggccgaggagaagatccagaacaatgacaacgtgggcaagcccaagagccgcagccccagccgccacaagagcaagagcaagagccgcagccgcagccaggagaggagagtggaggaggagaagaggggctctgtgtcccggggccgcagccaggagaagagcctgcggcagagccgcagccgcagccgcagcaaaggaggcagccgcagccgcagccgcagccgcagcaagagcaaggacaagaggaaaggaaggaagaggagccgggaggagagccgcagccgcagccgcagccgcagcaagtctgagaggagcaggaagaggggcagcaagagggacagcaaggccggcagcagcaagaagaagaagaaggaggacacagacaggagccagagccgcagccccagccgctctgtgtccaaggagcgggagcacgccaagtctgagagcagccagcgggagggccgcggggagagtgaaaatgccggcaccaaccaggagaccaggagccgcagccgcagcaacagcaagagcaagcccaacctgcccagcgagagccgcagccgcagcaagagcgccagcaagaccaggagccgcagcaagagccgcagccgcagcgccagccgcagccccagccgcagccgcagccgcagccacagccgctcctag

SEQ ID NO: 169290 - DNA, 1221 bp, Artificial Sequence
  Description of Artificial Sequence: Synthetic coding sequence
atgccccgggtgtacatcggccgcctgagctaccaggcccgggagagagatgtggagcgcttcttcaagggctacggcaagatcctggaggtggacctgaagaatggctacggctttgtggagtttgatgacctgagagatgctgatgatgctgtgtatgagctgaatggcaaggacctgtgtggggagagggtcatcgtggagcacgcccggggccccaggagagatggcagctatggcagcggccgcagcggctacggctacagaagaagtggccgggacaagtatggcccccccaccaggacagagtaccgcctgattgtggagaacctgagcagccgctgctcctggcaggacctgaaggactacatgaggcaggccggggaggtgacctatgcagatgcccacaagggcaggaagaatgaaggagtgattgaatttgtgtcctacagcgacatgaagagggccctggagaagctggatggaacagaggtgaatggaaggaagatccggctggtggaggacaagccaggcagcagaagaagaagaagctacagccgcagccgcagccacagccgcagccgcagccgcagccgccacagcaggaagagccgcagccgcagcggcagcagcaagagcagccacagcaagagccgcagccgcagccgcagcggcagccgcagccgcagcaagagccgcagccgcagccagagccgcagccgcagcaagaaggagaagagccgcagccccagcaaggagaagagccgcagccgcagccacagcgctgggaagagccgcagcaagagcaaggaccaggccgaggagaagatccagaacaatgacaacgtgggcaagcccaagagccgcagccccagccgccacaagagcaagagcaagagccgcagccgcagccaggagaggagagtggaggaggagaagaggggctctgtgtcccggggccgcagccaggagaagagcctgcggcagagccgcagccgcagccgcagcaaaggaggcagccgcagccgcagccgcagccgcagcaagagcaaggacaagaggaaaggaaggaagaggagccgggaggagagccgcagccgcagccgcagccgcagcaagtctgagaggagcaggaagaggggcagcctggccttccggcccggcctgagctaccgggagctgagcaacctggatggcagcaaggccggcatgaccacctag

SEQ ID NO: 169291 - DNA, 477 bp, Artificial Sequence
  Description of Artificial Sequence: Synthetic coding sequence
atgccccgggtgtacatcggccgcctgagctaccaggcccgggagagagatgtggagcgcttcttcaagggctacggcaagatcctggaggtggacctgaagaatggctacggctttgtggagtttgatgacctgagagatgctgatgatgctgtgtatgagctgaatggcaaggacctgtgtggggagagggtcatcgtggagcacgcccggggccccaggagagatggcagctatggcagcggccgcagcggctacggctacagaagaagtggccgggacaagtatggcccccccaccaggacagagtaccgcctgattgtggagaacctgagcagccgctgctcctggcaggacctgaaggtgggcctgcccctgcctgagcaggagcctgagcctgagcctgagagcgagcctgagcaggagcgggagaagcaggagccccagcagggcaaggagccccagccccagccctag

SEQ ID NO: 169292 - DNA, 819 bp, Artificial Sequence
  Description of Artificial Sequence: Synthetic coding sequence
atgagcggctgcagggtcttcatcggccgcctgaacccagctgcccgggagaaggatgtggagcgcttcttcaagggctacggccgcatccgggacatcgacctgaagaggggctttggatttgtggagtttgaggaccccagagatgctgatgatgctgtgtatgagctggatggcaaggagctgtgcagcgagcgggtgaccattgaacatgcccgggcccggagccggggcggccggggccggggccgctacagcgaccgcttcagcagccggcggcccagaaatgacagaagaaatgcccctcctgtgaggacagaaaatcggctgattgtggagaacctgagcagccgggtgtcctggcaggacctgaaggacttcatgaggcaggccggggaggtgacctttgctgatgcccaccggcccaagctgaatgaaggagtggtggagtttgccagctatggagacctgaagaatgccatcgagaagctgagcggcaaggagatcaatggaaggaagatcaagctgattgagggcagcaagaggcacagccgcagccgcagccgcagccgcagcaggaccaggagcagcagccgcagccgcagccgcagccgcagccgcagcaggaagagctacagccgcagccgcagccgcagccgcagccgcagccgcagcaagagccgctctgtgagccgcagccctgtgcctgagaagagccagaagaggggcagcagcagccgcagcaagagccctgcctctgtggaccggcagaggagccgcagccgcagccgcagccgctctgtggacagcggcaactag

SEQ ID NO: 169293 - DNA, 417 bp, Artificial Sequence
  Description of Artificial Sequence: Synthetic coding sequence
atgagcggctgcagggtcttcatcggccgcctgaacccagctgcccgggagaaggatgtggagcgcttcttcaagggctacggccgcatccgggacatcgacctgaagaggggctttggatttgtggagtttgaggaccccagagatgctgatgatgctgtgtatgagctggatggcaaggagctgtgcagcgagcgggtgaccattgaacatgcccgggcccggagccggggcggccggggccggggccgctacagcgaccgcttcagcagccggcggcccagaaatgacagaagaaatgcccctcctgtgaggacagaaaatcggctgattgtggagaacctgagcagccgggtgtcctggcagcctgtgtgtgtggtgggcctgatgaccaggtctgcctgtggcctgtcctag

SEQ ID NO: 169294 - DNA, 819 bp, Artificial Sequence; identical to SEQ ID NO: 169292
  Description of Artificial Sequence: Synthetic coding sequence

SEQ ID NO: 169295 - DNA, 819 bp, Artificial Sequence; identical to SEQ ID NO: 169292
  Description of Artificial Sequence: Synthetic coding sequence

SEQ ID NO: 169296 - DNA, 1035 bp, Artificial Sequence
  Description of Artificial Sequence: Synthetic coding sequence
atgccccgggtgtacatcggccgcctgagctacaacgtgcgggagaaggacatccagcgcttcttcagcggctacggccgcctgctggaggtggacctgaagaatggctacggctttgtggagtttgaggacagcagagatgctgatgatgctgtgtatgagctgaatggcaaggagctgtgtggggagagggtcatcgtggagcacgcccggggcccccggcgggacagagatggctacagctatggcagccgcagcggcggcggcggctacagcagcaggaggaccagcggccgggacaagtatggcccccctgtgaggacagagtaccgcctgattgtggagaacctgagcagccgctgctcctggcaggacctgaaggacttcatgaggcaggccggggaggtgacctatgcagatgcccacaaggagaggaccaatgaaggagtgattgagttccgcagctacagcgacatgaagagggccctggacaagctggatggaacagagatcaatggaagaaacatccggctgattgaggacaagcccaggaccagccaccggcgcagctacagcggcagccgcagccgcagccgcagcagaagaagaagccgcagccgcagcagaagaagcagccgcagccgcagccgcagcatcagcaagagccgcagccgcagccgcagccgcagcaagggccgcagccgcagccgcagcaaaggaaggaagagccgcagcaagagcaagagcaagcccaagagtgaccggggcagccacagccacagccgcagccgcagcaaggatgaatatgagaagagccgcagccgcagccgcagccgcagccccaaggaaaatggcaagggggacatcaagagcaagagccgcagccgcagccagagccgcagcaacagccccctgcctgtgccccccagcaaggcccggtctgtgtccccaccacccaagagggccaccagccgcagccgcagccgcagccgcagcaagagccgcagccgcagccgcagcagcagccgggactag

SEQ ID NO: 169297 - DNA, 717 bp, Artificial Sequence
  Description of Artificial Sequence: Synthetic coding sequence
atgagccgctatggccgctatggaggagagaccaaggtgtatgtgggcaacctgggcaccggggccggcaagggggagctggagcgggccttctcctactacggccccctgaggacagtgtggatcgccaggaaccccccaggctttgcctttgtggagtttgaggaccccagagatgctgaagatgctgtgcggggcctggatggcaaggtgatctgtggcagccgggtgcgggtggagctgagcacaggcatgcccaggaggagcagatttgaccggcccccagcccggcggccctttgaccccaatgaccgctgctatgaatgtggggagaagggccactacgcctatgactgccaccgctacagcagaagaagaagaagccgcagccgcagccgcagccacagccgcagccggggccgccgctacagccgcagccgcagccgcagccggggcagaagaagccgcagcgccagccccaggaggagccgcagcatcagcctgcggcgcagccgcagcgccagcctgcggcgcagccgcagcggcagcatcaagggcagccgctacttccagagccccagccgcagccgcagccgcagccgcagcatcagccggcccaggagcagccgcagcaagagccgcagccccagccccaagaggagccgcagccccagcggcagccccaggagaagtgccagccctgagaggatggactag

SEQ ID NO: 169298 - DNA, 681 bp, Artificial Sequence
  Description of Artificial Sequence: Synthetic coding sequence
atgagccgctatggccgctatggaggagagaccaaggtgtatgtgggcaacctgggcaccggggccggcaagggggagctggagcgggccttctcctactacggccccctgaggacagtgtggatcgccaggaaccccccaggctttgcctttgtggagtttgaggaccccagagatgctgaagatgctgtgcggggcctggatggcaaggtgatctgtggcagccgggtgcgggtggagctgagcacaggcatgcccaggaggagcagatttgaccggcccccagcccggcggccctttgaccccaatgaccgctgctatgaatgtggggagaagggccactacgcctatgactgccaccgctacagcagaagaagaagaagccgcagccgcagccgcagccacagccgcagccggggccgccgctacagccgcagccgcagccgcagccggggcagaagaagccgcagcgccagccccaggaggagccgcagcatcagcctgcggcgcagccgcagcgccagcctgcggcgcagccgcagcggcagcatcaagggcagccgctacttccagagccccagccgcagccgcagccgcagccgcagcatcagccggcccaggagcagccgcagccccagcggcagccccaggagaagtgccagccctgagaggatggactag

SEQ ID NO: 169299 - DNA, 1926 bp, Artificial Sequence
  Description of Artificial Sequence: Synthetic coding sequence
atgaactgggccgccttcggcggcagcgagttcttcatccctgagggcatccagattgacagccgctgccccctgagcaggaacatcacagagtggtaccactactacggcattgctgtgaaggagagcagccagtactatgatgtgatgtacagcaagaagggggccgcctgggtgtctgagaccgggaagaaggaggtgtccaagcagacagtggcctacagccccaggagcaagctgggcaccctgctgcctgagttccccaacgtgaaggacctgaacctgcctgccagcctgcctgaggagaaggtgtccaccttcatcatgatgtaccgcacccactgccagaggatcctggacaccgtcatccgggccaactttgatgaggtgcagagcttcctgctgcacttctggcagggcatgccaccccacatgctgcctgtgctgggcagcagcacagtggtgaacatcgtgggcgtgtgtgacagcatcctgtacaaggccatcagcggcgtgctgatgcccaccgtgctgcaggccctgcctgacagcctgacccaggtgatcaggaagtttgccaagcagctggatgagtggctgaaggtggccctgcatgacctgcctgagaacctgaggaacatcaagtttgagctgagccgccgcttcagccagatcctgcggcggcagaccagcctgaaccacctgtgccaggccagcaggacagtcatccacagcgctgacatcaccttccagatgctggaggactggagaaatgtggacctgaacagcatcaccaagcagaccctgtacaccatggaggacagcagagatgagcacaggaagctgatcacccagctgtaccaggagtttgaccacctgctggaggagcagagccccatcgagagctacatcgagtggctggacaccatggtggacagatgtgtggtgaaggtggccgccaagaggcagggcagcctgaagaaggtggcccagcagttcctgctgatgtggagctgcttcggcaccagggtcatccgggacatgaccctgcacagcgcccccagctttggcagcttccacctgatccacctgatgtttgatgattatgtgctgtacctgctggagagcctgcactgccaggagcgggccaatgagctgatgagggccatgaagggggagggcagcacagctgaggtgcgggaggagatcatcctgacagaggccgccgcccccacccccagccctgtgcccagcttctccccagccaagagcgccacctctgtggaggtgcccccacccagcagccctgtgagcaaccccagccctgagtacacaggcctgagcaccaccggggccatgcagagctacacctggagcctgacctacacagtgaccacagctgctggcagccctgctgagaacagccagcagctgccctgcatgaggaacacccacgtgcccagcagctctgtgacccaccgcatccctgtgtacccccaccgggaggagcacggctacacaggcagctacaactacggcagctatggcaaccagcacccccaccccatgcagagccagtacccagccctgccccatgacacagccatcagcggccccctgcactacgccccctaccacaggagcagcgcccagtaccccttcaacagccccaccagcaggatggagccctgcctgatgagcagcaccccccggctgcaccccacccctgtgaccccccgctggccagaggtgcccagcgccaacacctgctacaccagccccagcgtgcacagcgcccgctatggcaacagcagtgacatgtacacccccctgaccaccaggagaaattctgaatatgagcacatgcagcacttccctggctttgcctacatcaacggggaggccagcacaggctgggccaagtag

SEQ ID NO: 169300 - DNA, 2907 bp, Artificial Sequence
  Description of Artificial Sequence: Synthetic coding sequence
atggcctttgccaacttccgccgcatcctgcggctgagcacctttgagaagaggaagagccgggagtatgaacatgtgagaagagacctggaccccaatgaggtgtgggagatcgtgggggagctgggagatggagccttcggcaaggtgtacaaggccaagaacaaggagaccggggccctggccgccgccaaggtgattgagaccaagtctgaggaggagctggaggactacatcgtggagattgagatcctggccacctgtgaccacccctacatcgtgaagctgctgggcgcctactaccatgatggcaagctgtggatcatgattgagttctgccctgggggcgctgtggatgccatcatgctggagctggaccggggcctgacagagccccagatccaggtggtgtgccggcagatgctggaggccctgaacttcctgcacagcaagaggatcatccaccgggacctgaaggctggaaatgtgctgatgaccctggagggggacatccggctggccgactttggagtgtctgccaagaacctgaagaccctgcagaagagggacagcttcatcggcaccccctactggatggcccctgaggtggtgatgtgtgagaccatgaaggacaccccctatgactacaaggctgacatctggagcctgggcatcaccctcatcgagatggcccagatcgagcccccccaccacgagctgaaccccatgagggtgctgctgaagatcgccaagagtgacccccccaccctgctgacccccagcaagtggagcgtggagttccgggacttcctgaagatcgccctggacaagaaccctgagacccggcccagcgctgcccagctgctggagcacccctttgtgagcagcatcaccagcaacaaggccctgcgggagctggtggccgaggccaaggccgaggtgatggaggagattgaagatggaagagatgaaggagaggaggaggatgctgtggatgctgccagcaccctggagaaccacacccagaacagcagcgaggtgtccccacccagcctgaatgctgacaagcccctggaggagagccccagcacccccctggcccccagccagagccaggacagcgtgaatgagccctgcagccagcccagcggggacaggagcctgcagaccaccagcccccctgtggtggcccctggaaatgaaaatggcctggccgtgcctgtgcccctgaggaagagcaggcctgtgtccatggatgcccgcatccaggtggcccaggagaagcaggtggccgagcagggcggggacctgagccctgctgccaacagaagccagaaggccagccagagccggcccaacagcagcgccctggagaccctgggcggggagaagctggccaacggcagcctggagcccccagcccaggccgcccctggccccagcaagagggacagcgactgcagcagcctgtgcaccagcgagagcatggactatggcaccaacctgagcacagacctgagcctgaacaaggagatgggcagcctgagcatcaaggaccccaagctgtacaagaagaccctgaagaggaccaggaagtttgtggtggatggagtggaggtgtccatcaccaccagcaagatcatcagtgaagatgagaagaaggatgaggagatgaggttcctgcggcggcaggagctgcgggagctgcggctgctgcagaaggaggagcacaggaaccagacccagctgagcaacaagcatgagctgcagctggagcagatgcacaagagatttgagcaggagatcaatgccaagaagaagttctttgacacagagctggagaacctggagcggcagcagaagcagcaggtggagaagatggagcaggaccatgctgtgagaagaagagaggaggcccggcgcatccggctggagcaggaccgggactacacccgcttccaggagcagctgaagctgatgaagaaggaggtgaagaatgaggtggagaagctgccccggcagcagaggaaggagagcatgaagcagaagatggaggagcacacccagaagaagcagctgctggaccgggactttgtggccaagcagaaggaggacctggagctggccatgaagaggctgaccacagacaacagaagagagatctgtgacaaggagagagaatgtctgatgaagaagcaggagctgctgcgggaccgggaggccgccctgtgggagatggaggagcaccagctgcaggagcggcaccagctggtgaagcagcagctgaaggaccagtacttcctgcagagacatgagctgctgaggaagcatgagaaggagcgggagcagatgcagcgctacaaccagaggatgattgagcagctgaaggtgcggcagcagcaggagaaggcccggctgcccaagatccagaggtctgagggcaagaccaggatggccatgtacaagaagagcctgcacatcaatggaggcggcagcgctgctgagcagcgggagaagatcaagcagttcagccagcaggaggagaagaggcagaagtctgagcggctgcagcagcagcagaagcatgagaaccagatgagggacatgctggcccagtgtgagagcaacatgtctgagctgcagcagctgcagaatgagaagtgccacctgctggtggagcacgagacccagaagctgaaggccctggatgagagccacaaccagaacctgaaggagtggagggacaagctgcggcccaggaagaaggccctggaggaggacctgaaccagaagaagcgggagcaggagatgttcttcaagctgtctgaggaggccgagtgccccaaccccagcacccccagcaaggccgccaagttcttcccctacagcagcgcagatgccagctag

SEQ ID NO: 169301 - DNA, 2907 bp, Artificial Sequence; identical to SEQ ID NO: 169300
  Description of Artificial Sequence: Synthetic coding sequence

SEQ ID NO: 169302 - DNA, 3300 bp, Artificial Sequence
  Description of Artificial Sequence: Synthetic coding sequence
cgcttcggcagcgccccccagaggcctgtggccatgaccacagcccagagggacagcctgctgtggaagctggccggcctgctgcgggagagcggagatgtggtgctgagcggctgcagcaccctgagcctgctgacccccaccctgcagcagctgaaccacgtgtttgagctgcacctgggcccctggggccctggccagacaggctttgtggccctgcccagccaccctgctgacagccctgtgatcctgcagctgcagttcctgtttgatgtgctgcagaagaccctgagcctgaagctggtgcacgtggccggccctggccccaccggccccatcaagatcttccccttcaagagcctgcggcacctggagctgcggggcgtgcccctgcactgcctgcacggcctgcggggcatctacagccagctggagaccctcatctgcagccgcagcctgcaggccctggaggagctgctgagcgcctgtggcggggacttctgcagcgccctgccctggctggccctgctgagcgccaacttctcctacaatgccctgacagccctggacagcagcctgcggctgctgagcgccctgcgcttcctgaacctgagccacaaccaggtgcaggactgccagggcttcctgatggacctgtgtgagctgcaccacctggacatctcctacaaccggctgcacctggtgcccaggatgggccccagcggggccgccctgggcgtgctgatcctgcggggaaatgagctgcggagcctgcacggcctggagcagctgaggaacctgcggcacctggacctggcctacaacctgctggagggccaccgggagctgagccccctgtggctgctggccgagctgaggaagctgtacctggagggcaaccccctgtggttccaccctgagcaccgggccgccacagcccagtacctgagcccccgggccagagatgctgccaccggcttcctgctggatggcaaggtgctgagcctgacagacttccagacccacaccagcctgggcctgagccccatgggcccccccctgccctggcctgtgggcagcaccccagagaccagcggcggccctgacctgagtgacagcctgagcagcggcggcgtggtgacccagcccctgctgcacaaggtgaagagccgggtgcgggtgagaagagccagcatcagcgagcccagcgacacagatcctgagcccaggaccctgaaccccagccctgctggctggtttgtgcagcagcaccctgagctggagctgatgagcagcttccgggagagatttggaagaaactggctgcagtaccgcagccacctggagcccagcggcaaccccctgcctgccacccccaccaccagcgcccccagcgcccccccagccagcagccagggccctgacacagccccccggcccagccccccccaggaggaggcccggggcccccaggagagcccccagaagatgtctgaggaggtgcgggcagagccccaggaggaggaggaggagaaggagggcaaggaggagaaggaggagggggagatggtggagcagggcgaggaggaggccggggaggaggaggaggaggagcaggaccagaaggaggtggaggccgagctgtgccggcccctgctggtgtgccccctggagggccctgagggcgtgcggggccgggagtgcttcctgcgggtgaccagcgcccacctgtttgaggtggagctgcaggccgcccggaccctggagcggctggagctgcagagcctggaggccgctgagattgagcctgaggcccaggcccagaggagcccccggcccaccggcagtgacctgctgcccggggcccccatcctgagcctgcgcttctcctacatctgcccagaccggcagctgcggcgctacctggtgctggagccagatgcccacgccgctgtgcaggagctgctggccgtgctgacccctgtgaccaacgtggcccgggagcagctgggggaggcccgggacctgctgctgggccgcttccagtgcctgcgctgtggccacgagttcaagccagaggagcccaggatgggcctggacagcgaggagggctggaggcccctcttccagaagacagagagccctgctgtgtgccccaactgtggcagtgaccacgtggtgctgctggccgtgtcccggggcacccccaaccgggagaggaagcagggcgagcagagcctggcccccagccccagcgccagccctgtgtgccaccccccaggccacggggaccacctggaccgggccaagaacagccccccccaggcccccagcacccgggaccacggctcctggagcctgagccccccacctgagcgctgtggcctgcggtctgtggaccaccggctgcggctcttcctggatgtggaggtgttcagtgatgcccaggaggagttccagtgctgcctgaaggtgcctgtggccctggccggccacactggagagttcatgtgcctggtggtggtgtctgacagaagactctacctgctgaaggtgactggagagatgagggagcccccagcctcctggctgcagctgaccctggccgtgcccctgcaggacctgagcggcatcgagctgggcctggccggccagagcctgcggctggagtgggccgccggggccggccgctgtgtgctgctgcccagagatgcccggcactgccgggccttcctggaggagctgctggatgtgctgcagagcctgcccccagcctggaggaactgtgtgtctgccacagaggaggaggtgaccccccagcaccggctgtggcccctgctggagaaggacagcagcctggaggcccggcagttcttctacctgcgggccttcctggtggagggccccagcacctgcctggtgtccctgctgctgacccccagcaccctcttcctgctggatgaagatgctgctggcagccctgctgagcccagccccccagctgccagcggggaggccagcgagaaggtgcccccatctggccctggccctgctgtgcgggtgcgggagcagcagcccctgagcagcctgagctctgtgctgctgtaccgcagcgcccctgaggacctgcggctgctcttctatgatgaggtgtcccggctggagagcttctgggccctgcgggtggtgtgccaggagcagctgacagccctgctggcctggatccgggagccctgggaggagctgttcagcatcggcctgaggacagtcatccaggaggccctggccctggacagatag

SEQ ID NO: 169303 - DNA, 1938 bp, Artificial Sequence
  Description of Artificial Sequence: Synthetic coding sequence
cgcttcggcagcgccccccagaggcctgtggccatgaccacagcccagagggacagcctgctgtggaagctggccggcctgctgcgggagagcggagatgtggtgctgagcggctgcagcaccctgagcctgctgacccccaccctgcagcagctgaaccacgtgtttgagctgcacctgggcccctggggccctggccagacaggctttgtggccctgcccagccaccctgctgacagccctgtgatcctgcagctgcagttcctgtttgatgtgctgcagaagaccctgagcctgaagctggtgcacgtggccggccctggccccaccggccccatcaagatcttccccttcaagagcctgcggcacctggagctgcggggcgtgcccctgcactgcctgcacggcctgcggggcatctacagccagctggagaccctcatctgcagccgcagcctgcaggccctggaggagctgctgagcgcctgtggcggggacttctgcagcgccctgccctggctggccctgctgagcgccaacttctcctacaatgccctgacagccctggacagcagcctgcggctgctgagcgccctgcgcttcctgaacctgagccacaaccaggtgcaggactgccagggcttcctgatggacctgtgtgagctgcaccacctggacatctcctacaaccggctgcacctggtgcccaggatgggccccagcggggccgccctgggcgtgctgatcctgcggggaaatgagctgcggagcctgcacggcctggagcagctgaggaacctgcggcacctggacctggcctacaacctgctggagggccaccgggagctgagccccctgtggctgctggccgagctgaggaagttcctgctggatggcaaggtgctgagcctgacagacttccagacccacaccagcctgggcctgagccccatgggcccccccctgccctggcctgtgggcagcaccccagagaccagcggcggccctgacctgagtgacagcctgagcagcggcggcgtggtgacccagcccctgctgcacaaggtgaagagccgggtgcgggtgagaagagccagcatcagcgagcccagcgacacagatcctgagcccaggaccctgaaccccagccctgctggctggtttgtgcagcagcaccctgagctggagctgatgagcagcttccgggagagatttggaagaaactggctgcagtaccgcagccacctggagcccagcggcaaccccctgcctgccacccccaccaccagcgcccccagcgcccccccagccagcagccagggccctgacacagccccccggcccagccccccccaggaggaggcccggggcccccaggagagcccccagaagatgtctgaggaggtgcgggcagagccccaggaggaggaggaggagaaggagggcaaggaggagaaggaggagggggagatggtggagcagggcgaggaggaggccggggaggaggaggaggaggagcaggaccagaaggaggtggaggccgagctgtgccggcccctgctggtgtgccccctggagggccctgagggcgtgcggggccgggagtgcttcctgcgggtgaccagcgcccacctgtttgaggtggagctgcaggccgcccggaccctggagcggctggagctgcagagcctggaggccgctgagattgagcctgaggcccaggcccagaggagcccccggcccaccggcagtgacctgctgcccggggcccccatcctgagcctgcgcttctcctacatctgcccagaccggcagctgcggcgctacctggtgctggagccagatgcccacgccgctgtgcaggtgatggccccccgggtgggcgcccaggaggccgtgggcatcaagagggcccggggcaagtggcagcaggcctag

SEQ ID NO: 169304 - DNA, 1095 bp, Artificial Sequence
  Description of Artificial Sequence: Synthetic coding sequence
atgcagaagtggttcagcgcctttgatgatgccatcatccagaggcagtggagggccaaccccagccggggcggcggcggcgtgtccttcaccaaggaggtggacaccaacgtggccaccggggccccaccccggcggcagagggtgcccggccgggcctgcccctggagggagcccatccggggcagaagaggagcccggcctggaggaggagatgctgggggcaccccaggagagaccgtgcgccactgcagcgcccctgaggaccccatcttccgcttcagcagcctgcacagctaccccttccctggcaccatcaagagccgggacatgtcctggaagaggcaccacctgatccctgagacctttggagtgaagagaagaaggaagaggggccctgtggagagtgaccccctgcggggggagcccggcagcgcccgggctgctgtgtctgagctgatgcagctgttcccccggggcctgtttgaagatgccctgccccccatcgtgctgcggagccaggtgtacagcctggtgcctgacagaacagtggccgaccggcagctgaaggagctgcaggagcagggcgagatccgcatcgtgcagctgggctttgacctggatgcccacggcatcatcttcacagaggactaccgcaccagggtgctgaaggcctgtgatggccggccctatgctggagctgtgcagaagttcctggcctctgtgctgcctgcctgtggggacctgtccttccagcaggaccagatgacccagaccttcggcttccgggacagcgagatcacccacctggtgaatgccggcgtgctgactgtgagagatgctggctcctggtggctggccgtgcctggagctggccgcttcatcaagtactttgtgaagggccggcaggccgtgctgtccatggtgaggaaggccaagtaccgggagctgctgctgtctgagctgctgggcagaagagcccctgtggtggtgcggctgggcctgacctaccacgtgcatgacctgattggagcccagctggtggactgcatcagcaccaccagcggcaccctgctgcggctgcctgagacctag

SEQ ID NO: 169305 - DNA, 1107 bp, Artificial Sequence
  Description of Artificial Sequence: Synthetic coding sequence
atgcagaagtggttcagcgcctttgatgatgccatcatccagaggcagtggagggccaaccccagccggggcggcggcggcgtgtccttcaccaaggaggtggacaccaacgtggccaccggggccccaccccggcggcagagggtgcccggccgggcctgcccctggagggagcccatccggggcagaagaggagcccggcctggaggaggagatgctgggggcaccccaggagagaccgtgcgccactgcagcgcccctgaggaccccatcttccgcttcagcagcctgcacagctaccccttccctggcaccatcaagagccgggacatgtcctggaagaggcaccacctgatccctgagacctttggagtgaagagaagaaggaagaggggccctgtggagagtgaccccctgcggggggagcccggcagcgcccgggctgctgtgtctgagctgatgcagctgttcccccggggcctgtttgaagatgccctgccccccatcgtgctgcggagccaggtgtacagcctggtgcctgacagaacagtggccgaccggcagctgaaggagctgcaggagcagggcgagatccgcatcgtgcagctgggctttgacctggatgcccacggcatcatcttcacagaggactaccgcaccagggtgtgtgactgtgtgctgaaggcctgtgatggccggccctatgctggagctgtgcagaagttcctggcctctgtgctgcctgcctgtggggacctgtccttccagcaggaccagatgacccagaccttcggcttccgggacagcgagatcacccacctggtgaatgccggcgtgctgactgtgagagatgctggctcctggtggctggccgtgcctggagctggccgcttcatcaagtactttgtgaagggccggcaggccgtgctgtccatggtgaggaaggccaagtaccgggagctgctgctgtctgagctgctgggcagaagagcccctgtggtggtgcggctgggcctgacctaccacgtgcatgacctgattggagcccagctggtggactgcatcagcaccaccagcggcaccctgctgcggctgcctgagacctag

SEQ ID NO: 169306 - DNA, 1107 bp, Artificial Sequence
  Description of Artificial Sequence: Synthetic coding sequence
atgcagaagtggttcagcgcctttgatgatgccatcatccagaggcagtggagggccaaccccagccggggcggcggcggcgtgtccttcaccaaggaggtggacaccaacgtggccaccggggccccaccccggcggcagagggtgcccggccgggcctgcccctggagggagcccatccggggcagaagaggagcccggcctggaggaggagatgctgggggcaccccaggagagaccgtgcgccactgcagcgcccctgaggaccccatcttccgcttcagcagcctgcacagctaccccttccctggcaccatcaagagccgggacatgtcctggaagaggcaccacctgatccctgagacctttggagtgaagagaagaaggaagaggggccctgtggagagtgaccccctgcggggggagcccggcagcgcccgggctgctgtgtctgagctgatgcagctgttcccccggggcctgtttgaagatgccctgccccccatcgtgctgcggagccaggtgtacagcctggtgcctgacagaacagtggccgaccggcagctgaaggagctgcaggagcagggcgagatccgcatcgtgcagctgggctttgacctggatgcccacggcatcatcttcacagaggactaccgcaccagggtgtgtgactgtgtgctgaaggcctgtgatggccggccctatgctggagctgtgcagaagttcctggcctctgtgctgcctgcctgtggggacctgtccttccagcaggaccagatgacccagaccttcggcttccgggacagcgagatcacccacctggtgaatgccggcgtgctgactgtgagagatgctggctcctggtggctggccgtgcctggagctggccgcttcatcaagtactttgtgaagggccggcaggccgtgctgggcatggtgaggaaggccaagtaccgggagctgctgctgtctgagctgctgggcagaagagcccctgtggtggtgcggctgggcctgacctaccacgtgcatgacctgattggagcccagctggtggactgcatcagcaccaccagcggcaccctgctgcggctgcctgagacctag

SEQ ID NO: 169307 - DNA, 1095 bp, Artificial Sequence
  Description of Artificial Sequence: Synthetic coding sequence
atgcagaagtggttcagcgcctttgatgatgccatcatccagaggcagtggagggccaaccccagccggggcggcggcggcgtgtccttcaccaaggaggtggacaccaacgtggccaccggggccccaccccggcggcagagggtgcccggccgggcctgcccctggagggagcccatccggggcagaagaggagcccggcctggaggaggagatgctgggggcaccccaggagagaccgtgcgccactgcagcgcccctgaggaccccatcttccgcttcagcagcctgcacagctaccccttccctggcaccatcaagagccgggacatgtcctggaagaggcaccacctgatccctgagacctttggagtgaagagaagaaggaagaggggccctgtggagagtgaccccctgcggggggagcccggcagcgcccgggctgctgtgtctgagctgatgcagctgttcccccggggcctgtttgaagatgccctgccccccatcgtgctgcggagccaggtgtacagcctggtgcctgacagaacagtggccgaccggcagctgaaggagctgcaggagcagggcgagatccgcatcgtgcagctgggctttgacctggatgcccacggcatcatcttcacagaggactaccgcaccagggtgctgaaggcctgtgatggccggccctatgctggagctgtgcagaagttcctggcctctgtgctgcctgcctgtggggacctgtccttccagcaggaccagatgacccagaccttcggcttccgggacagcgagatcacccacctggtgaatgccggcgtgctgactgtgagagatgctggctcctggtggctggccgtgcctggagctggccgcttcatcaagtactttgtgaagggccggcaggccgtgctgggcatggtgaggaaggccaagtaccgggagctgctgctgtctgagctgctgggcagaagagcccctgtggtggtgcggctgggcctgacctaccacgtgcatgacctgattggagcccagctggtggactgcatcagcaccaccagcggcaccctgctgcggctgcctgagacctag

SEQ ID NO: 169308 - DNA, 1095 bp, Artificial Sequence; identical to SEQ ID NO: 169304
  Description of Artificial Sequence: Synthetic coding sequence

SEQ ID NO: 169309 - DNA, 1095 bp, Artificial Sequence; identical to SEQ ID NO: 169304
  Description of Artificial Sequence: Synthetic coding sequence

SEQ ID NO: 169310 - DNA, 1095 bp, Artificial Sequence; identical to SEQ ID NO: 169304
  Description of Artificial Sequence: Synthetic coding sequence

SEQ ID NO: 169311 - DNA, 1107 bp, Artificial Sequence; identical to SEQ ID NO: 169305
  Description of Artificial Sequence: Synthetic coding sequence

SEQ ID NO: 169312 - DNA, 1107 bp, Artificial Sequence; identical to SEQ ID NO: 169305
  Description of Artificial Sequence: Synthetic coding sequence

SEQ ID NO: 169313 - DNA, 1107 bp, Artificial Sequence; identical to SEQ ID NO: 169305
  Description of Artificial Sequence: Synthetic coding sequence

SEQ ID NO: 169314 - DNA, 1095 bp, Artificial Sequence; identical to SEQ ID NO: 169304
  Description of Artificial Sequence: Synthetic coding sequence

SEQ ID NO: 169315 - DNA, 1107 bp, Artificial Sequence; identical to SEQ ID NO: 169305
  Description of Artificial Sequence: Synthetic coding sequence

SEQ ID NO: 169316 - DNA, 339 bp, Artificial Sequence
  Description of Artificial Sequence: Synthetic coding sequence
atgcagaagtggttcagcgcctttgatgatgccatcatccagaggcagtggagggccaaccccagccggggcggcggcggcgtgtccttcaccaaggaggtggacaccaacgtggccaccggggccccaccccggcggcagagggtgcccggccgggcctgcccctggagggagcccatccggggcagaagaggagcccggcctggaggaggagatgctgggggcaccccaggagagaccgtgcgccactgcagcgcccctgaggaccccatcttccgcttcagcagcctgcacagctaccccttccctggcaccatcaagagccgggacatgtcctag

SEQ ID NO: 169317 - DNA, 966 bp, Artificial Sequence
  Description of Artificial Sequence: Synthetic coding sequence
atgctggtgtgtgccagccccccacccctgcctgccctgaccggcctgagagatgacaagctgaccctgctgagcagcagccctggcctgggcggcaccccaggagaaacagtgcgccactgcagcgcccctgaggaccccatcttccgcttcagcagcctgcacagctaccccttccctggcaccatcaagagccgggacatgtcctggaagaggcaccacctgatccctgagaccttcggcgtgaagagaagaaggaagaggggccctgtggagagtgaccccctgcggggggagcccggcagcgcccgggctgctgtgtctgagctgatgcagctgttcccccggggcctgtttgaagatgccctgccccccatcgtgctgcggagccaggtgtacagcctggtgcctgacagaacagtggccgaccggcagctgaaggagctgcaggagcagggcgagatcagaattgtgcagctgggctttgacctggatgcccacggcatcatcttcacagaggactaccgcaccagggtgctgaaggcctgtgatggccggccctatgctggagctgtgcagaagttcctggcctctgtgctgcctgcctgtggggacctgtccttccagcaggaccagatgacccagaccttcggcttccgggacagcgagatcacccacctggtgaatgctggggtgctgactgtgagagatgctggctcctggtggctggccgtgcctggggccggccgcttcatcaagtactttgtgaagggccggcaggccgtgctgggcatggtgaggaaggccaagtaccgggagctgctgctgtctgagctgctgggccggcgggcccctgtggtggtgcggctgggcctgacctaccacgtgcatgacctgattggagcccagctggtggactgcatcagcaccaccagcggcaccctgctgcggctgcctgagacctag

SEQ ID NO: 169318 - DNA, 966 bp, Artificial Sequence
  Description of Artificial Sequence: Synthetic coding sequence
atgctggtgtgtgccagccccccacccctgcctgccctgaccggcctgagagatgacaagctgaccctgctgagcagcagccctggcctgggcggcaccccaggagaaacagtgcgccactgcagcgcccctgaggaccccatcttccgcttcagcagcctgcacagctaccccttccctggcaccatcaagagccgggacatgtcctggaagaggcaccacctgatccctgagaccttcggcgtgaagagaagaaggaagaggggccctgtggagagtgaccccctgcggggggagcccggcagcgcccgggctgctgtgtctgagctgatgcagctgttcccccggggcctgtttgaagatgccctgccccccatcgtgctgcggagccaggtgtacagcctggtgcctgacagaacagtggccgaccggcagctgaaggagctgcaggagcagggcgagatcagaattgtgcagctgggctttgacctggatgcccacggcatcatcttcacagaggactaccgcaccagggtgctgaaggcctgtgatggccggccctatgctggagctgtgcagaagttcctggcctctgtgctgcctgcctgtggggacctgtccttccagcaggaccagatgacccagaccttcggcttccgggacagcgagatcacccacctggtgaatgctggggtgctgactgtgagagatgctggctcctggtggctggccgtgcctggggccggccgcttcatcaagtactttgtgaagggccggcaggccgtgctgtccatggtgaggaaggccaagtaccgggagctgctgctgtctgagctgctgggccggcgggcccctgtggtggtgcggctgggcctgacctaccacgtgcatgacctgattggagcccagctggtggactgcatcagcaccaccagcggcaccctgctgcggctgcctgagacctag

SEQ ID NO: 169319 - DNA, 966 bp, Artificial Sequence; identical to SEQ ID NO: 169318
  Description of Artificial Sequence: Synthetic coding sequence

SEQ ID NO: 169320 - DNA, 966 bp, Artificial Sequence; identical to SEQ ID NO: 169318
  Description of Artificial Sequence: Synthetic coding sequence

SEQ ID NO: 169321 - DNA, 966 bp, Artificial Sequence; identical to SEQ ID NO: 169318
  Description of Artificial Sequence: Synthetic coding sequence

SEQ ID NO: 169322 - DNA, 1320 bp, Artificial Sequence
  Description of Artificial Sequence: Synthetic coding sequence
atgcagaacctgaaggctgaccctgaggagctgttcaccaagctggagaagattggcaagggcagctttggagaggtgttcaagggcatcgacaacagaacccagaaggtggtggccatcaagatcatcgacctggaggaggctgaagatgaaattgaggacatccagcaggagatcaccgtgctgagccagtgtgacagcccctacgtgaccaagtactacggcagctacctgaaggacaccaagctgtggatcatcatggagtacctgggcggcggcagcgccctggacctgctggagcccggccccctggatgagacccagatcgccaccatcctgcgggagatcctgaagggcctggactacctgcacagcgagaagaagatccaccgggacatcaaggccgccaacgtgctgctgtctgaacatggagaggtgaagctggccgactttggagtggccggccagctgacagacacccagatcaagaggaacacctttgtgggcacccccttctggatggcccctgaggtgatcaagcagagcgcctatgacagcaaggctgacatctggagcctgggcatcacagccatcgagctggcccggggggagcccccccacagcgagctgcaccccatgaaggtgctcttcctgatccccaagaacaacccccccaccctggagggcaactacagcaagcccctgaaggagtttgtggaggcctgcctgaacaaggagcccagcttccggcccacagccaaggagctgctgaagcacaagttcatcctgagaaatgccaagaagaccagctacctgacagagctgattgaccgctacaagcgctggaaggccgagcagagccatgatgacagcagcagcgaggacagtgatgctgagacagatggccaggccagcggcggcagtgacagcggggactggatcttcaccatccgggagaaggaccccaagaacctggagaatggagccctgcagcccagcgacctggacaggaacaagatgaaggacatccccaagaggcccttcagccagtgcctgagcaccatcatcagccccctgtttgctgagctgaaggagaagagccaggcctgtggcggcaacctgggcagcattgaggagctgcggggggccatctacctggccgaggaggcctgccccggcatcagtgacaccatggtggcccagctggtgcagaggctgcagaggagcatccacggcaaccaggcccccccagactgccacctggcccaggtgcaggcctttggaggcagcggctgtgtgctgggcagccgctctgtgtag

SEQ ID NO: 169323 - DNA, 672 bp, Artificial Sequence
  Description of Artificial Sequence: Synthetic coding sequence
atggcccctgaggtgatcaagcagagcgcctatgacagcaaggctgacatctggagcctgggcatcacagccatcgagctggcccggggggagcccccccacagcgagctgcaccccatgaaggtgctcttcctgatccccaagaacaacccccccaccctggagggcaactacagcaagcccctgaaggagtttgtggaggcctgcctgaacaaggagcccagcttccggcccacagccaaggagctgctgaagcacaagttcatcctgagaaatgccaagaagaccagctacctgacagagctgattgaccgctacaagcgctggaaggccgagcagagccatgatgacagcagcagtgaagattctgatgctgagacagatggccaggccagcggcggcagtgacagcggggactggatcttcaccatccgggagaaggaccccaagaacctggagaatggagccctgcagcccagcgacctggacaggaacaagctgaaggagaagagccaggcctgtggcggcaacctgggcagcattgaggagctgcggggggccatctacctggccgaggaggcctgccccggcatcagtgacaccatggtggcccagctggtgcagaggctgcagcgctacagcctgagcggcggcggcaccagcagccactag

SEQ ID NO: 169324 - DNA, 1332 bp, Artificial Sequence
  Description of Artificial Sequence: Synthetic coding sequence
atggacagccgggcccagctgtggggcctggccctgaacaagagaagagccaccctgccccaccctgggggcagcaccaacctgaaggctgaccctgaggagctgttcaccaagctggagaagattggcaagggcagctttggagaggtgttcaagggcatcgacaacagaacccagaaggtggtggccatcaagatcatcgacctggaggaggctgaagatgaaattgaggacatccagcaggagatcaccgtgctgagccagtgtgacagcccctacgtgaccaagtactacggcagctacctgaaggacaccaagctgtggatcatcatggagtacctgggcggcggcagcgccctggacctgctggagcccggccccctggatgagacccagatcgccaccatcctgcgggagatcctgaagggcctggactacctgcacagcgagaagaagatccaccgggacatcaaggccgccaacgtgctgctgtctgaacatggagaggtgaagctggccgactttggagtggccggccagctgacagacacccagatcaagaggaacacctttgtgggcacccccttctggatggcccctgaggtgatcaagcagagcgcctatgacagcaaggctgacatctggagcctgggcatcacagccatcgagctggcccggggggagcccccccacagcgagctgcaccccatgaaggtgctcttcctgatccccaagaacaacccccccaccctggagggcaactacagcaagcccctgaaggagtttgtggaggcctgcctgaacaaggagcccagcttccggcccacagccaaggagctgctgaagcacaagttcatcctgagaaatgccaagaagaccagctacctgacagagctgattgaccgctacaagcgctggaaggccgagcagagccatgatgacagcagcagcgaggacagtgatgctgagacagatggccaggccagcggcggcagtgacagcggggactggatcttcaccatccgggagaaggaccccaagaacctggagaatggagccctgcagcccagcgacctggacaggaacaagatgaaggacatccccaagaggcccttcagccagtgcctgagcaccatcatcagccccctgtttgctgagctgaaggagaagagccaggcctgtggcggcaacctgggcagcattgaggagctgcggggggccatctacctggccgaggaggcctgccccggcatcagtgacaccatggtggcccagctggtgcagaggctgcagcgctacagcctgagcggcggcggcaccagcagccactag

SEQ ID NO: 169325 - DNA, 1296 bp, Artificial Sequence
  Description of Artificial Sequence: Synthetic coding sequence
atggcccacagccctgtgcagagcggcctgcccggcatgcagaacctgaaggctgaccctgaggagctgttcaccaagctggagaagattggcaagggcagctttggagaggtgttcaagggcatcgacaacagaacccagaaggtggtggccatcaagatcatcgacctggaggaggctgaagatgaaattgaggacatccagcaggagatcaccgtgctgagccagtgtgacagcccctacgtgaccaagtactacggcagctacctgaaggacaccaagctgtggatcatcatggagtacctgggcggcggcagcgccctggacctgctggagcccggccccctggatgagacccagatcgccaccatcctgcgggagatcctgaagggcctggactacctgcacagcgagaagaagatccaccgggacatcaaggccgccaacgtgctgctgtctgaacatggagaggtgaagctggccgactttggagtggccggccagctgacagacacccagatcaagaggaacacctttgtgggcacccccttctggatggcccctgaggtgatcaagcagagcgcctatgacagcaaggctgacatctggagcctgggcatcacagccatcgagctggcccggggggagcccccccacagcgagctgcaccccatgaaggtgctcttcctgatccccaagaacaacccccccaccctggagggcaactacagcaagcccctgaaggagtttgtggaggcctgcctgaacaaggagcccagcttccggcccacagccaaggagctgctgaagcacaagttcatcctgagaaatgccaagaagaccagctacctgacagagctgattgaccgctacaagcgctggaaggccgagcagagccatgatgacagcagcagcgaggacagtgatgctgagacagatggccaggccagcggcggcagtgacagcggggactggatcttcaccatccgggagaaggaccccaagaacctggagaatggagccctgcagcccagcgacctggacaggaacaagatgaaggacatccccaagaggcccttcagccagtgcctgagcaccatcatcagccccctgtttgctgagctgaaggagaagagccaggcctgtggcggcaacctgggcagcattgaggagctgcggggggccatctacctggccgaggaggcctgccccggcatcagtgacaccatggtggcccagctggtgcagaggctgcagcgctacagcctgagcggcggcggcaccagcagccactag

SEQ ID NO: 169326 - DNA, 1239 bp, Artificial Sequence
  Description of Artificial Sequence: Synthetic coding sequence
atggcccacagccctgtgcagagcggcctgcccggcatgcagaacctgaaggctgaccctgaggagctgttcaccaagctggagaagattggcaagggcagctttggagaggtgttcaagggcatcgacaacagaacccagaaggtggtggccatcaagatcatcgacctggaggaggctgaagatgaaattgaggacatccagcaggagatcaccgtgctgagccagtgtgacagcccctacgtgaccaagtactacggcagctacctgaagctggagcccggccccctggatgagacccagatcgccaccatcctgcgggagatcctgaagggcctggactacctgcacagcgagaagaagatccaccgggacatcaaggccgccaacgtgctgctgtctgagcacggggaggtgaagctggccgactttggagtggccggccagctgacagacacccagatcaagaggaacacctttgtgggcacccccttctggatggcccctgaggtgatcaagcagagcgcctatgacagcaaggctgacatctggagcctgggcatcacagccatcgagctggcccggggggagcccccccacagcgagctgcaccccatgaaggtgctcttcctgatccccaagaacaacccccccaccctggagggcaactacagcaagcccctgaaggagtttgtggaggcctgcctgaacaaggagcccagcttccggcccacagccaaggagctgctgaagcacaagttcatcctgagaaatgccaagaagaccagctacctgacagagctgattgaccgctacaagcgctggaaggccgagcagagccatgatgacagcagcagtgaagattctgatgctgagacagatggccaggccagcggcggcagtgacagcggggactggatcttcaccatccgggagaaggaccccaagaacctggagaatggagccctgcagcccagcgacctggacaggaacaagatgaaggacatccccaagaggcccttcagccagtgcctgagcaccatcatcagccccctgtttgctgagctgaaggagaagagccaggcctgtggcggcaacctgggcagcattgaggagctgcggggggccatctacctggccgaggaggcctgccccggcatcagtgacaccatggtggcccagctggtgcagaggctgcagcgctacagcctgagcggcggcggcaccagcagccactag

SEQ ID NO: 169327 - DNA, 1029 bp, Artificial Sequence
  Description of Artificial Sequence: Synthetic coding sequence
atggcccacagccctgtgcagagcggcctgcccggcatgcagaacctgaaggctgaccctgaggagctgttcaccaagctggagaagattggcaagggcagctttggagaggtgttcaagggcatcgacaacagaacccagaaggtggtggccatcaagatcatcgacctggaggaggctgaagatgaaattgaggacatccagcaggagatcaccgtgctgagccagtgtgacagcccctacgtgaccaagtactacggcagctacctgaaggacaccaagctgtggatcatcatggagtacctgggcggcggcagcgccctggacctgctggagcccggccccctggatgagacccagatcgccaccatcctgcgggagatcctgaagggcctggactacctgcacagcgagaagaagatccaccgggacatcaaggccgccaacgtgctgctgtctgaacatggagaggtgaagctggccgactttggagtggccggccagctgacagacacccagatcaagaggaacacctttgtgggcacccccttctggatggcccctgaggtgatcaagcagagcgcctatgacagcaaggctgacatctggagcctgggcatcacagccatcgagctggcccggggggagcccccccacagcgagctgcaccccatgaaggtgctcttcctgatccccaagaacaacccccccaccctggagggcaactacagcaagcccctgaaggagtttgtggaggcctgcctgaacaaggagcccagcttccggcccacagccaaggagctgctgaagcacaagttcatcctgagaaatgccaagaagaccagctacctgacagagctgattgaccgctacaagcgctggaaggccgagcagagccatgatgacagcagcagcgaggacagtgatgctgagacagatggccaggccagcggcggcagtgacagcggggactggatcttcaccatccgggagtggagcagcagcgccatcggcctgggccagaagtag

SEQ ID NO: 169328 - DNA, 2991 bp, Artificial Sequence
  Description of Artificial Sequence: Synthetic coding sequence
atggatgaggacacccactatgacaaggtggaggatgtggtgggcagccacattgaagatgctgtgaccttctgggcccagagcatcaacagaaacaaggacatcatgaagattggctgcagcctgtctgaggtgtgcccccaggccagctctgtgctgggcaacctggaccccaacaagatctacggcggcctcttcagcgaggaccagtgctggtaccgctgcaaggtgctgaagatcatctctgtggagaagtgcctggtgcgctacattgattatggcaacacagagatcctgaacagaagtgacatcgtggagatccccctggagctgcagttcagctctgtggccaagaagtacaagctgtggggcctgcacatccccagcgaccaggaggtgacccagtttgaccagggcaccaccttcctgggcagcctcatctttgagaaggagatcaagatgaggatcaaggccaccagtgaagatggcaccgtcatcgcccaggccgagtatggctctgtggacatcggggaggaggtgctgaagaagggctttgctgagaagtgccgcctggccagcaggacagacatctgtgaggagaagaagctggaccccggccagctggtgctgaggaacctgaagagccccatccccctgtggggccacaggagcaaccagagcaccttcagccggcccaagggccacctgtctgagaagatgaccctggacctgaaggatgaaaatgatgctggcaacctgatcaccttccccaaggagagcctggccgtgggggacttcaacctgggcagcaatgtgtccctggagaagatcaagcaggaccagaagctgattgaggagaatgagaagctgaagacagagaaggatgccctgctggagagctacaaggccctggagctgaaggtggagcagatcgcccaggagctgcagcaggagaaggctgctgctgtggacctgaccaaccacctggagtacaccctgaagacctacatcgacaccaggatgaagaacctggccgccaagatggagatcctgaaggagatgagacatgtggacatctctgtgcgctttgggaaggacctgagtgatgccatccaggtgctggatgagggctgcttcaccaccccagccagcctgaatggcctggagatcatctgggccgagtacagcctggcccaggagaacatcaagacctgtgaatatgtgtctgagggcaacatcctgattgcccagagaaatgagatgcagcagaagctgtacatgtctgtggaggacttcatcctggaggtggatgagagcagcctgaacaagaggctgaagaccctgcaggacctgtctgtgtccctggaggccgtgtatggccaggccaaggagggcgccaacagtgatgagatcctgaagaagttctatgactggaagtgtgacaagcgggaggagttcacctctgtgcgctcagaaacagatgccagcctgcaccggctggtggcctggttccagaggaccctgaaggtgtttgacctgtctgtggagggcagcctcatcagtgaagatgccatggacaacattgatgagatcctggagaagacagagagctctgtgtgcaaggagctggagatcgccctggtggaccagggagatgctgacaaggagatcatcagcaacacctacagccaggtgctgcagaagatccacagcgaggagcggctcatcgccaccgtgcaggccaagtacaaggacagcattgagttcaagaagcagctgattgagtacctgaacaagagccccagcgtggaccacctgctgagcatcaagaagaccctgaagagcctgaaggccctgctgcgctggaagctggtggagaagagcaacctggaggagagtgatgatcctgatggcagccagatcgagaagatcaaggaggagatcacccagctgaggaacaacgtgttccaggagatctaccacgagcgggaggagtatgagatgctgaccagcctggcccagaagtggttccctgagctgcccctgctgcaccctgagatcggcctgctgaagtacatgaacagcggcggcctgctgaccatgagcctggagcgggacctgctggatgctgagcccatgaaggagctgagcagcaagaggcccctggtgcgctctgaggtgaatggccagatcatcctgctgaagggctacagcgtggatgtggacacagaggccaaggtgattgaaagagctgccacctaccaccgggcctggagggaggccgagggggacagcggcctgctgcccctcatcttcctgttcctgtgcaagagtgaccccatggcctacctgatggtgccctactacccccgggccaacctgaatgctgtgcaggccaacatgcccctgaacagcgaggagaccctgaaggtgatgaagggcgtggcccagggcctgcacaccctgcacaaggctgacatcatccacggcagcctgcaccagaacaacgtgtttgccctgaaccgggagcagggcatcgtgggggactttgacttcaccaagtctgtgtcccagagggcctctgtgaacatgatggtgggggacctgagcctgatgagccctgagctgaagatgggcaagccagccagccctggcagtgacctgtatgcctacggctgcctgctgctgtggctgtctgtgcagaaccaggagtttgagatcaacaaggatggcatccccaaggtggaccagttccacctggatgacaaggtgaagagcctgctgtgcagcctcatctgctaccgcagctccatgacagctgagcaggtgctgaatgctgagtgcttcctgatgcccaaggagcagagcgtgcccaaccctgagaaggacacagagtacaccctgtacaagaaggaggaggagatcaagacagagaacctggacaagtgcatggagaagaccagaaatggagaggccaactttgactgctag

SEQ ID NO: 169329 - DNA, 3060 bp, Artificial Sequence
  Description of Artificial Sequence: Synthetic coding sequence
atgtgggtgcagggccacagcagccgggccagcgccacagaatctgtgtccttctctggaattgtgcagatggatgaggacacccactatgacaaggtggaggatgtggtgggcagccacattgaagatgctgtgaccttctgggcccagagcatcaacagaaacaaggacatcatgaagattggctgcagcctgtctgaggtgtgcccccaggccagctctgtgctgggcaacctggaccccaacaagatctatggaggcctcttcagcgaggaccagtgctggtaccgctgcaaggtgctgaagatcatctctgtggagaagtgcctggtgcgctacatcgactatggcaacacagagatcctgaacagaagtgacatcgtggagatccccctggagctgcagttcagctctgtggccaagaagtacaagctgtggggcctgcacatccccagcgaccaggaggtgacccagtttgaccagggcaccaccttcctgggcagcctcatctttgagaaggagatcaagatgaggatcaaggccaccagtgaagatggcaccgtgattgcccaggccgagtatggctctgtggacattggagaggaggtgctgaagaagggctttgctgagaagtgccgcctggccagcaggacagacatctgtgaggagaagaagctggaccccggccagctggtgctgaggaacctgaagagccccatccccctgtggggccacaggagcaaccagagcaccttcagccggcccaagggccacctgtctgagaagatgaccctggacctgaaggatgaaaatgatgctggcaacctgatcaccttccccaaggagagcctggccgtgggggacttcaacctgggcagcaatgtgtccctggagaagatcaagcaggaccagaagctgattgaagaaaatgagaagctgaagacagagaaggatgccctgctggagagctacaaggccctggagctgaaggtggagcagatcgcccaggagctgcagcaggagaaggctgctgctgtggacctgaccaaccacctggagtacaccctgaagacctacatcgacaccaggatgaagaacctggccgccaagatggagatcctgaaggagatgagacatgtggacatctctgtgcgctttgggaaggacctgagtgatgccatccaggtgctggatgagggctgcttcaccaccccagccagcctgaatggcctggagatcatctgggccgagtacagcctggcccaggagaacatcaagacctgtgaatatgtgtctgagggcaacatcctgattgcccagagaaatgagatgcagcagaagctgtacatgtctgtggaggacttcatcctggaggtggatgagagcagcctgaacaagaggctgaagaccctgcaggacctgtctgtgtccctggaggccgtgtatggccaggccaaggagggcgccaacagtgatgagatcctgaagaagttctatgactggaagtgtgacaagcgggaggagttcacctctgtgcgctcagaaacagatgccagcctgcaccggctggtggcctggttccagaggaccctgaaggtgtttgacctgtctgtggagggcagcctcatcagtgaagatgccatggacaacattgatgagatcctggagaagacagagagctctgtgtgcaaggagctggagatcgccctggtggaccagggagatgctgacaaggagatcatcagcaacacctacagccaggtgctgcagaagatccacagcgaggagcggctgattgccaccgtgcaggccaagtacaaggacagcattgagttcaagaagcagctgattgagtacctgaacaagagccccagcgtggaccacctgctgagcatcaagaagaccctgaagagcctgaaggccctgctgcgctggaagctggtggagaagagcaacctggaggagagtgatgatcctgatggcagccagatcgagaagatcaaggaggagatcacccagctgagaaataatgtgttccaggagatctaccacgagcgggaggagtatgagatgctgaccagcctggcccagaagtggttccctgagctgcccctgctgcaccctgagatcggcctgctgaagtacatgaacagcggcggcctgctgaccatgagcctggagcgggacctgctggatgctgagcccatgaaggagctgagcagcaagaggcccctggtgcgctctgaggtgaatggccagatcatcctgctgaagggctacagcgtggatgtggacacagaggccaaggtgattgagcgggccgccacctaccaccgggcctggagggaggccgagggggacagcggcctgctgcccctcatcttcctgttcctgtgcaagagtgaccccatggcctacctgatggtgccctactacccccgggccaacctgaatgctgtgcaggccaacatgcccctgaacagcgaggagaccctgaaggtgatgaagggcgtggcccagggcctgcacaccctgcacaaggctgacatcatccacggcagcctgcaccagaacaacgtgtttgccctgaaccgggagcagggcatcgtgggggactttgacttcaccaagtctgtgtcccagagggcctctgtgaacatgatggtgggggacctgagcctgatgagccctgagctgaagatgggcaagccagccagccctggcagtgacctgtatgcctacggctgcctgctgctgtggctgtctgtgcagaaccaggagtttgagatcaacaaggatggcatccccaaggtggaccagttccacctggatgacaaggtgaagagcctgctgtgcagcctcatctgctaccgcagctccatgacagctgagcaggtgctgaatgctgagtgcttcctgatgcccaaggagcagagcgtgcccaaccctgagaaggacacagagtacaccctgtacaagaaggaggaggagatcaagacagagaacctggacaagtgcatggagaagaccagaaatggagaggccaactttgactgctag

SEQ ID NO: 169330 - DNA, 2991 bp, Artificial Sequence; identical to SEQ ID NO: 169328
  Description of Artificial Sequence: Synthetic coding sequence

SEQ ID NO: 169331 - DNA, 285 bp, Artificial Sequence
  Description of Artificial Sequence: Synthetic coding sequence
atggatgaggacacccactatgacaaggtggaggatgtggtgggcagccacattgaagatgctgtgaccttctgggcccagagcatcaacagaaacaaggacatcatgaagattggctgcagcctgtctgaggtgtgcccccaggccagctctgtgctgggcaacctggaccccaacaagatctacggcggcctcttcagcgaggaccagtgctggtaccgctgcaaggtgctgaagatcatctctgtggagaagtgcctggtgcgctacattgattatggatag

SEQ ID NO: 169332 - DNA, 132 bp, Artificial Sequence
  Description of Artificial Sequence: Synthetic coding sequence
atggatgaggacacccactatgacaaggtggaggatgtggtgggcagccacattgaagatgctgtgaccttctgggcccagagcatcaacagaaacaaggacatcatgaagattggctgcagcctgtcctag

SEQ ID NO: 169333 - DNA, 2991 bp, Artificial Sequence
  Description of Artificial Sequence: Synthetic coding sequence
atgtgggtgcagggccacagcagccgggccagcgccacagaatctgtgtccttctctggaattgtgcagatggatgaggacacccactatgacaaggtggaggatgtggtgggcagccacattgaagatgctgtgaccttctgggcccagagcatcaacagaaacaaggacatcatgaagattggctgcagcctgtctgaggtgtgcccccaggccagctctgtgctgggcaacctggaccccaacaagatctatggaggcctcttcagcgaggaccagtgctggtaccgctgcaaggtgctgaagatcatctctgtggagaagtgcctggtgcgctacatcgactatggcaacacagagatcctgaacagaagtgacatcgtggagatccccctggagctgcagttcagctctgtggccaagaagtacaagctgtggggcctgcacatccccagcgaccaggaggtgacccagtttgaccagggcaccaccttcctgggcagcctcatctttgagaaggagatcaagatgaggatcaaggccaccagtgaagatggcaccgtgattgcccaggccgagtatggctctgtggacattggagaggaggtgctgaagaagggctttgctgagaagtgccgcctggccagcaggacagacatctgtgaggagaagaagctggaccccggccagctggtgctgaggaacctgaagagccccatccccctgtggggccacaggagcaaccagagcaccttcagccggcccaagggccacctgtctgagaagatgaccctggacctgaaggatgaaaatgatgctggcaacctgatcaccttccccaaggagagcctggccgtgggggacttcaacctgggcagcaatgtgtccctggagaagatcaagcaggaccagaagctgattgaagaaaatgagaagctgaagacagagaaggatgccctgctggagagctacaaggccctggagctgaaggtggagcagatcgcccaggagctgcagcaggagaaggctgctgctgtggacctgaccaaccacctggagtacaccctgaagacctacatcgacaccaggatgaagaacctggccgccaagatggagatcctgaaggagatgagacatgtggacatctctgtgcgctttgggaaggacctgagtgatgccatccaggtgctggatgagggctgcttcaccaccccagccagcctgaatggcctggagatcatctgggccgagtacagcctggcccaggagaacatcaagacctgtgaatatgtgtctgagggcaacatcctgattgcccagagaaatgagatgcagcagaagctgtacatgtctgtggaggacttcatcctggaggtggatgagagcagcctgaacaagaggctgaagaccctgcaggacctgtctgtgtccctggaggccgtgtatggccaggccaaggagggcgccaacagtgatgagatcctgaagaagttctatgactggaagtgtgacaagcgggaggagttcacctctgtgcgctcagaaacagatgccagcctgcaccggctggtggcctggttccagaggaccctgaaggtgtttgacctgtctgtggagggcagcctcatcagtgaagatgccatggacaacattgatgagatcctggagaagacagagagctctgtgtgcaaggagctggagatcgccctggtggaccagggagatgctgacaaggagatcatcagcaacacctacagccaggtgctgcagaagatccacagcgaggagcggctgattgccaccgtgcaggccaagtacaaggacagcattgagttcaagaagcagctgattgagtacctgaacaagagccccagcgtggaccacctgctgagcatcaagaagaccctgaagagcctgaaggccctgctgcgctggaagctggtggagaagagcaacctggaggagagtgatgatcctgatggcagccagatcgagaagatcaaggaggagatcacccagctgagaaataatgtgttccaggagatctaccacgagcgggaggagtatgagatgctgaccagcctggcccagaagtggttccctgagctgcccctgctgcaccctgagatcggcctgctgaagtacatgaacagcggcggcctgctgaccatgagcctggagcgggacctgctggatgctgagcccatgaaggagctgagcagcaagaggcccctggtgcgctctgaggtgaatggccagatcatcctgctgaagggctacagcgtggatgtggacacagaggccaaggtgattgagcgggccgccacctaccaccgggcctggagggaggccgagggggacagcggcctgctgcccctcatcttcctgttcctgtgcaagagtgaccccatggcctacctgatggtgccctactacccccgggccaacctgaatgctgtgcaggccaacatgcccctgaacagcgaggagaccctgaaggtgatgaagggcgtggcccagggcctgcacaccctgcacaaggctgacatcatccacggcagcctgcaccagaacaacgtgtttgccctgaaccgggagcagggcatcgtgggggactttgacttcaccaagtctgtgtcccagagggcctctgtgaacatgatggtgggggacctgagcctgatgagccctgagctgaagatgggcaagccagccagccctggcagtgacctgtatgcctacggctgcctgctgctgtgggatgacaaggtgaagagcctgctgtgcagcctcatctgctaccgcagctccatgacagctgagcaggtgctgaatgctgagtgcttcctgatgcccaaggagcagagcgtgcccaaccctgagaaggacacagagtacaccctgtacaagaaggaggaggagatcaagacagagaacctggacaagtgcatggagaagaccagaaatggagaggccaactttgactgctag

SEQ ID NO: 169334 - DNA, 1545 bp, Artificial Sequence
  Description of Artificial Sequence: Synthetic coding sequence
atggctgacagcggcctggacaagaagagcaccaagtgcccagactgcagcagcgccagccagaaggatgtgctgtgtgtgtgcagcagcaagaccagggtgccccctgtgctggtggtggagatgagccagaccagcagcatcggcagcgctgagagcctcatcagcctggagaggaagaaggagaagaacatcaacagagacatcaccagcaggaaggacctgcccagcaggaccagcaatgtggagaggaaggccagccagcagcagtggggccggggcaacttcacagagggcaaggtgccccacatcagaattgaaaatggagctgccatcgaggagatctacaccttcggccgcatcctgggcaagggcagctttggaattgtgattgaggccacagacaaggagacagagaccaagtgggccatcaagaaggtgaacaaggagaaggccggcagcagcgctgtgaagctgctggagcgggaggtgaacatcctgaagtctgtgaagcatgagcacatcatccacctggagcaggtgtttgagacccccaagaagatgtacctggtgatggagctgtgtgaagatggagagctgaaggagatcctggacaggaagggccacttctctgaaaatgagacccgctggatcatccagagcctggccagcgccatcgcctacctgcacaacaatgacatcgtgcaccgggacctgaagctggagaacatcatggtgaagagcagcctgattgatgacaacaatgagatcaacctgaacatcaaggtgacagactttggcctggccgtgaagaagcagagccgctctgaggccatgctgcaggccacctgtggcacccccatctacatggcccctgaggtgatcagcgcccatgactacagccagcagtgtgacatctggagcattggagtggtgatgtacatgctgctgcggggggagccccccttcctggccagcagcgaggagaagctgtttgagctgatcagaaaaggagagctgcactttgaaaatgctgtgtggaacagcatcagtgactgtgccaagtctgtgctgaagcagctgatgaaggtggaccctgcccaccgcatcacagccaaggagctgctggacaaccagtggctgaccggcaacaagctgagctctgtgcggcccaccaacgtgctggagatgatgaaggagtggaagaacaaccctgagagcgtggaggagaacaccacagaggagaagaacaagcccagcacagaggagaagctgaagagctaccagccctggggcaatgtgcctgatgccaactacaccagtgatgaggaggaggagaagcagagcacagcctatgagaagcagtttcctgccaccagcaaggacaactttgacatgtgcagcagcagcttcaccagcagcaagctgctgcctgctgagatcaagggggagatggagaagacccctgtgacccccagccagggcacagccaccaagtacccagccaagagcggggccctgagcaggaccaagaagaagctgtag

SEQ ID NO: 169335 - DNA, 1545 bp, Artificial Sequence; identical to SEQ ID NO: 169334
  Description of Artificial Sequence: Synthetic coding sequence

SEQ ID NO: 169336 - DNA, 1347 bp, Artificial Sequence
  Description of Artificial Sequence: Synthetic coding sequence
atggctgacagcggcctggacaagaagagcaccaagtgcccagactgcagcagcgccagccagaaggatgtgctgtgtgtgtgcagcagcaagaccagggtgccccctgtgctggtggtggagatgagccagaccagcagcatcggcagcgctgagagcctcatcagcctggagaggaagaaggagaagaacatcaacagagacatcaccagcaggaaggacctgcccagcaggaccagcaatgtggagaggaaggccagccagcagcagtggggccggggcaacttcacagagggcaaggtgccccacatcagaattgaaaatggagctgccatcgaggagatctacaccttcggccgcatcctgggcaagggcagctttggaattgtgattgaggccacagacaaggagacagagaccaagtgggccatcaagaaggtgaacaaggagaaggccggcagcagcgctgtgaagctgctggagcgggaggtgaacatcctgaagtctgtgaagcatgagcacatcatccacctggagcaggtgtttgagacccccaagaagatgtacctggtgatggagctgtgtgaagatggagagctgaaggagatcctggacaggaagggccacttctctgaaaatgagacccgctggatcatccagagcctggccagcgccatcgcctacctgcacaacaatgacatcgtgcaccgggacctgaagctggagaacatcatggtgaagagcagcctgattgatgacaacaatgagatcaacctgaacatcaaggtgacagactttggcctggccgtgaagaagcagagccgctctgaggccatgctgcaggccacctgtggcacccccatctacatggcccctgaggtgatcagcgcccatgactacagccagcagtgtgacatctggagcattggagtggtgatgtacatgctgctgcggggggagccccccttcctggccagcagcgaggagaagctgtttgagctgatcagaaaaggagagctgcactttgaaaatgctgtgtggaacagcatcagtgactgtgccaagtctgtgctgaagcagctgatgaaggtggaccctgcccaccgcatcacagccaaggagctgctggacaaccagtggctgaccagcacagcctatgagaagcagtttcctgccaccagcaaggacaactttgacatgtgcagcagcagcttcaccagcagcaagctgctgcctgctgagatcaagggggagatggagaagacccctgtgacccccagccagggcacagccaccaagtacccagccaagagcggggccctgagcaggaccaagaagaagctgtag

SEQ ID NO: 169337 - DNA, 192 bp, Artificial Sequence
  Description of Artificial Sequence: Synthetic coding sequence
atggctgacagcggcctggacaagaagagcaccaagtgcccagactgcagcagcgccagccagaaggatgtgctgtgtgtgtgcagcagcaagaccagggtgccccctgtgctggtggtggagatgagccagaccagcagcatcggcagcgctgagagcctcatcagcctggagaggaagaaggagaagtag

SEQ ID NO: 169338 - DNA, 1545 bp, Artificial Sequence; identical to SEQ ID NO: 169334
  Description of Artificial Sequence: Synthetic coding sequence

SEQ ID NO: 169339 - DNA, 114 bp, Artificial Sequence
  Description of Artificial Sequence: Synthetic coding sequence
atggctgacagcggcctggacaagaagagcaccaagtgcccagactgcagcagcgccagccagaaggatgtgctgtgtgtgtgcagcagcaagaccagggtgccccctgtgtag

SEQ ID NO: 169340 - DNA, 516 bp, Artificial Sequence
  Description of Artificial Sequence: Synthetic coding sequence
atggctgacagcggcctggacaagaagagcaccaagtgcccagactgcagcagcgccagccagaaggatgtgctgtgtgtgtgcagcagcaagaccagggtgccccctgtgctggtggtggagatgagccagaccagcagcatcggcagcgctgagagcctcatcagcctggagaggaagaaggagaagaacatcaacagagacatcaccagcaggaaggacctgcccagcaggaccagcaatgtggagaggaaggccagccagcagcagtggggccggggcaacttcacagagggcaaggtgccccacatcagaattgaaaatggagctgccatcgaggagatctacaccttcggccgcatcctgggcaagggcagctttggaattgtgattgaggccacagacaaggagacagagaccaagtgggccatcaagaaggtgaacaaggagaaggccggcagcagcgctgtgaagctgctggagcgggaggtgaacatcctgaagtctgtgaagtag

SEQ ID NO: 169341 - DNA, 90 bp, Artificial Sequence
  Description of Artificial Sequence: Synthetic coding sequence
atggctgacagcggcctggacaagaagagcaccaagtgcccagactgcagcagcgccagccagaaggatgtgctgtgtgtgtgcagctag

SEQ ID NO: 169342 - DNA, 1206 bp, Artificial Sequence
  Description of Artificial Sequence: Synthetic coding sequence
atggagaccgggaaggatggagcccggcggggcacccagagccctgagaggaagagaagaagccctgtgccccgggcccccagcaccaagctgcggcctgctgctgctgcccgggccatggaccctgtggccgctgaggcccctggagaggccttcctggcccggcggcggcctgagggcggcggcggcagcgcccggccccgctacagcctgctggccgagatcggccggggcagctatggagtggtgtatgaggccgtggccggccgcagcggggcccgggtggccgtgaagaagatccgctgtgatgccccagaaaatgtggagctggccctggccgagttctgggccctgaccagcctgaagagaagacaccagaatgtggtgcagtttgaagaatgtgtgctgcagagaaatggcctggcccagaggatgagccacggcaacaagagcagccagctgtacctgcggctggtggagaccagcctgaagggggagcgcatcctgggctacgccgaggagccctgctacctgtggtttgtgatggagttctgtgagggcggggacctgaaccagtatgtgctgagcagaagaccagaccctgccaccaacaagagcttcatgctgcagctgaccagcgccatcgccttcctgcacaagaaccacatcgtgcaccgggacctgaagccagacaacatcctgatcacagagaggagcggcacccccatcctgaaggtggccgactttggcctgagcaaggtgtgtgccggcctggccccccggggcaaggagggcaaccaggacaacaagaatgtgaatgtgaacaagtactggctgagcagcgcctgtggcagtgacttctacatggcccctgaggtgtgggagggccactacacagccaaggctgacatctttgccctgggcatcatcatctgggccatgattgagcgcatcaccttcattgattctgagaccaagaaggagctgctgggcacctacatcaagcagggcacagagatcgtgcctgtgggggaggccctgctggagaaccccaagatggagctgcacatcccccagaagaggaggacctccatgtctgagggcatcaagcagctgctgaaggacatgctggccgccaacccccaggacagaccagatgcctttgagctggagaccaggatggaccaggtgacctgtgccgcctag

SEQ ID NO: 169343 - DNA, 1605 bp, Artificial Sequence
  Description of Artificial Sequence: Synthetic coding sequence
atgggccaccaggagagccccctggcccgggccccagctggaggagctgcctacgtgaagaggctgtgcaagggcctgtcctggagggagcacgtggagagccacggcagcctgggcgcccaggccagccctgccagcgctgctgctgctgagggcagcgccacccggcgggcccgggccgccaccagcagagctgcccggagccggcggcagcccggccctggagctgaccacccccaggccggggcccctgggggcaagagagctgccaggaagtggaggtgtgccggccaggtgaccatccagggccctgccccaccccggcccagggctggaagaagagatgaagctggaggagcccgggccgcccccctgctgctgcccccacctcctgctgccatggagaccgggaaggatggagcccggcggggcacccagagccctgagaggaagaggaggagccctgtgccccgggcccccagcaccaagctgcggcctgctgctgctgcccgggccatggaccctgtggccgctgaggcccctggagaggccttcctggccaggagaagacctgagggcggcggcggcagcgcccggccccgctacagcctgctggccgagatcggccggggcagctatggagtggtgtatgaagctgtggccggccgcagcggggcccgggtggccgtgaagaagatccgctgtgatgccccagaaaatgtggagctggccctggccgagttctgggccctgaccagcctgaagaggaggcaccagaatgtggtgcagtttgaggagtgtgtgctgcagagaaatggcctggcccagaggatgagccacggcaacaagagcagccagctgtacctgcggctggtggagaccagcctgaagggggagcgcatcctgggctatgcagaggagccctgctacctgtggtttgtgatggagttctgtgagggcggggacctgaaccagtatgtgctgagccggcggccagaccctgccaccaacaagagcttcatgctgcagctgaccagcgccatcgccttcctgcacaagaaccacatcgtgcaccgggacctgaagccagacaacatcctgatcacagagaggagcggcacccccatcctgaaggtggccgactttggcctgagcaaggtgtgtgccggcctggccccccggggcaaggagggcaaccaggacaacaagaatgtgaatgtgaacaagtactggctgagcagcgcctgtggcagtgacttctacatggcccctgaggtgtgggagggccactacacagccaaggctgacatctttgccctgggcatcatcatctgggccatgattgaaagaatcaccttcatcgacagcgagaccaagaaggagctgctgggcacctacatcaagcagggcacagaaattgtgcctgtgggggaggccctgctggagaaccccaagatggagctgcacatcccccagaagaggaggacctccatgtctgagggcatcaagcagctgctgaaggacatgctggccgccaacccccaggacagaccagatgcctttgagctggagaccaggatggaccaggtgacctgtgccgcctag

SEQ ID NO: 169344 - DNA, 489 bp, Artificial Sequence
  Description of Artificial Sequence: Synthetic coding sequence
atggaccctgtggccgctgaggcccctggagaggccttcctggccaggagaagacctgagggcggcggcggcagcgcccggccccgctacagcctgctggccgagatcggccggggcagctatggagtggtgtatgaagctgtggccggccgcagcggggcccgggtggccgtgaagaagatccgctgtgatgccccagaaaatgtggagctggccctggccgagttctgggccctgaccagcctgaagaggaggcaccagaatgtggtgcagtttgaggagtgtgtgctgcagagaaatggcctggcccagaggatgagccacggcaacaagagcagccagctgtacctgcggctggtggagaccagcctgaagggccgcttcctgggcacccacagcctgaccaccagccccccagaagatggccggggctaccgctggtggccaggccgcctggccatcagccggcagctggaccctgccatgtag

SEQ ID NO: 169345 - DNA, 3948 bp, Artificial Sequence
  Description of Artificial Sequence: Synthetic coding sequence
atggagaagtaccacgtgctggagatgattggagagggcagctttggccgggtgtacaagggccgcaggaagtacagcgcccaggtggtggccctgaagttcatccccaagctgggccgctctgagaaggagctgaggaacctgcagcgggagattgagatcatgaggggcctgcggcaccccaacatcgtgcacatgctggacagctttgaaacagacaaggaggtggtggtggtgacagattatgcagagggggagctgttccagatcctggaggatgatggcaagctgcctgaggaccaggtgcaggccatcgccgcccagctggtgtctgccctgtactacctgcacagccaccgcatcctgcaccgggacatgaagccccagaacatcctgctggccaagggcggcggcatcaagctgtgtgactttggatttgcccgggccatgagcaccaacaccatggtgctgaccagcatcaagggcacccccctgtacatgagccctgagctggtggaggagcggccctatgaccacacagctgacctgtggagcgtgggctgcatcctgtatgagctggccgtgggcaccccacccttctacgccaccagcatcttccagctggtgtccctcatcctgaaggaccctgtgcgctggcccagcaccatcagcccctgcttcaagaacttcctgcagggcctgctgaccaaggacccccggcagaggctgtcctggccagacctgctgtaccaccccttcatcgccggccacgtgaccatcatcacagagcctgctggccctgacctgggcacccccttcaccagccggctgcccccagagctgcaggtgctgaaggatgagcaggcccaccggctggcccccaagggcaaccagagccgcatcctgacccaggcctacaagaggatggccgaggaggccatgcagaagaagcaccagaacacaggccctgccctggagcaggaggacaagaccagcaaggtggcccctggaacagcccccctgccccggctgggcgccaccccccaggagagcagcctgctggccggcatcctggccagcgagctgaagagctcctgggccaagtctggaactggagaggtgcccagcgccccccgggagaacagaaccaccccagactgtgagcgggccttccctgaggagaggcctgaggtgctgggccagaggagcacagatgtggtggacctggagaatgaggagccagacagcgacaatgagtggcagcacctgctggagaccacagagcctgtgcccatccagctgaaggcccccctgaccctgctgtgcaacccagacttctgccagaggatccagagccagctgcatgaagctgggggccagatcctgaagggcatcctggagggcgccagccacatcctgcctgccttccgggtgctgagcagcctgctgagcagctgcagcgacagcgtggccctgtacagcttctgccgggaggccggcctgcccggcctgctgctgagcctgctgcggcacagccaggagagcaacagcctgcagcagcagagctggtacggcaccttcctgcaggacctgatggctgtgatccaggcctactttgcctgcaccttcaacctggagaggagccagaccagtgacagcctgcaggtgttccaggaggccgccaacctcttcctggacctgctgggcaagctgctggcccagccagatgacagcgagcagaccctgcggcgggacagcctgatgtgcttcaccgtgctgtgtgaggccatggatggcaacagccgggccatcagcaaggccttctacagcagcctgctgaccacccagcaggtggtgctggatggcctgctgcacggcctgactgtgccccagctgcctgtgcacaccccccagggcgccccccaggtgtcccagcccctgcgggagcagagcgaggacatccctggggccatcagcagcgccctggccgccatctgcacagcccctgtgggcctgcctgactgctgggatgccaaggagcaggtgtgctggcacctggccaaccagctgacagaggacagcagccagctgcggcccagcctcatcagcggcctgcagcaccccatcctgtgcctgcacctgctgaaggtgctgtacagctgctgcctggtgtctgagggcctgtgccgcctgctgggccaggagcccctggccctggagagcctcttcatgctgatccagggcaaggtgaaggtggtggactgggaggagagcacagaggtgaccctgtacttcctgagcctgctggtgttccggctgcagaacctgccctgtggcatggagaagctgggcagtgatgtggccaccctcttcacccacagccacgtggtgtccctggtgtctgctgctgcctgcctgctgggccagctgggccagcagggcgtgacctttgacctgcagcccatggagtggatggctgctgccacccacgccctgagcgccccagctgaggtgcggctgaccccacctggcagctgtggcttctatgatggcctgctgatcctgctgctgcagctgctgacagagcagggcaaggccagcctcatccgggacatgagcagcagcgagatgtggacagtgctgtggcaccgcttctccatggtgctgcggctgcctgaggaggccagcgcccaggagggggagctgagcctgagcagcccccccagccctgagccagactggaccctcatcagcccccagggcatggccgccctgctgagcctggccatggccaccttcacccaggagccccagctgtgcctgagctgcctgagccagcacggcagcatcctgatgagcatcctgaagcacctgctgtgccccagcttcctgaaccagctgcggcaggccccccacggcagcgagttcctgcctgtggtggtgctgtctgtgtgccagctgctgtgcttcccctttgccctggacatggatgctgacctgctgattggagtgctggccgacctgcgggacagcgaggtggccgcccacctgctgcaggtgtgctgctaccacctgcccctgatgcaggtggagctgcccatcagcctgctgacccggctggccctgatggaccccaccagcctgaaccagtttgtgaacacagtgtctgccagccccaggaccatcgtgtccttcctgtctgtggccctgctgagtgaccagcccctgctgaccagtgacctgctgagcctgctggcccacacagcccgggtgctgagccccagccacctgtccttcatccaggagctgctggccggcagtgatgagagctaccggcccctgcggagcctgctgggccaccctgagaacagcgtgcgggcccacacctaccgcctgctgggccacctgctgcagcacagcatggccctgcggggggccctgcagagccagagcggcctgctgagcctgctgctgctgggcctgggggacaaggaccctgtggtgcgctgcagcgccagctttgctgtgggcaatgctgcctaccaggccggccccctgggccctgccctggccgctgctgtgcccagcatgacccagctgctgggggacccccaggccggcatcagaagaaatgtggccagcgccctgggcaacctgggccctgagggcctgggggaggagctgctgcagtgtgaggtgccccagaggctgctggagatggcctgtggggacccccagcccaacgtgaaggaggccgccctgattgccctgcggagcctgcagcaggagcccggcatccaccaggtgctggtgtccctgggcgccagcgagaagctgagcctgctgagcctgggcaaccagagcctgccccacagcagccccaggcctgccagcgccaagcactgcaggaagctgatccacctgctgcggcctgcccacagcatgtag

SEQ ID NO: 169346 - DNA, 3885 bp, Artificial Sequence
  Description of Artificial Sequence: Synthetic coding sequence
atggagaagtaccacgtgctggagatgattggagagggcagctttggccgggtgtacaagggccgcaggaagtacagcgcccaggtggtggccctgaagttcatccccaagctgggccgctctgagaaggagctgaggaacctgcagcgggagattgagatcatgaggggcctgcggcaccccaacatcgtgcacatgctggacagctttgaaacagacaaggaggtggtggtggtgacagattatgcagagggggagctgttccagatcctggaggatgatggcaagctgcctgaggaccaggtgcaggccatcgccgcccagctggtgtctgccctgtactacctgcacagccaccgcatcctgcaccgggacatgaagccccagaacatcctgctggccaagggcggcggcatcaagctgtgtgactttggatttgcccgggccatgagcaccaacaccatggtgctgaccagcatcaagggcacccccctgtacatgagccctgagctggtggaggagcggccctatgaccacacagctgacctgtggagcgtgggctgcatcctgtatgagctggccgtgggcaccccacccttctacgccaccagcatcttccagctggtgtccctcatcctgaaggaccctgtgcgctggcccagcaccatcagcccctgcttcaagaacttcctgcagggcctgctgaccaaggacccccggcagaggctgtcctggccagacctgctgtaccaccccttcatcgccggccacgtgaccatcatcacagagcctgctggccctgacctgggcacccccttcaccagccggctgcccccagagctgcaggtgctgaaggatgagcaggcccaccggctggcccccaagggcaaccagagccgcatcctgacccaggcctacaagaggatggccgaggaggccatgcagaagaagcaccagaacacaggccctgccctggagcaggaggacaagaccagcaaggtggcccctggaacagcccccctgccccggctgggcgccaccccccaggagagcagcctgctggccggcatcctggccagcgagctgaagagctcctgggccaagtctggaactggagaggtgcccagcgccccccgggagaacagaaccaccccagactgtgagcgggccttccctgaggagaggcctgaggtgctgggccagaggagcacagatgtggtggacctggagaatgaggagccagacagcgacaatgagtggcagcacctgctggagaccacagagcctgtgcccatccagctgaaggcccccctgaccctgctgtgcaacccagacttctgccagaggatccagagccagctgcatgaagctgggggccagatcctgaagggcatcctggagggcgccagccacatcctgcctgccttccgggtgctgagcagcctgctgagcagctgcagcgacagcgtggccctgtacagcttctgccgggaggccggcctgcccggcctgctgctgagcctgctgcggcacagccaggagagcaacagcctgcagcagcagagctggtacggcaccttcctgcaggacctgatggctgtgatccaggcctactttgcctgcaccttcaacctggagaggagccagaccagtgacagcctgcaggtgttccaggaggccgccaacctcttcctggacctgctgggcaagctgctggcccagccagatgacagcgagcagaccctgcggcgggacagcctgatgtgcttcaccgtgctgtgtgaggccatggatggcaacagccgggccatcagcaaggccttctacagcagcctgctgaccacccagcaggtggtgctggatggcctgctgcacggcctgactgtgccccagctgcctgtgcacaccccccagggcgccccccaggtgtcccagcccctgcgggagcagagcgaggacatccctggggccatcagcagcgccctggccgccatctgcacagcccctgtgggcctgcctgactgctgggatgccaaggagcaggtgtgctggcacctggccaaccagctgacagaggacagcagccagctgcggcccagcctcatcagcggcctgcagcaccccatcctgtgcctgcacctgctgaaggtgctgtacagctgctgcctggtgtctgagggcctgtgccgcctgctgggccaggagcccctggccctggagagcctcttcatgctgatccagggcaaggtgaaggtggtggactgggaggagagcacagaggtgaccctgtacttcctgagcctgctggtgttccggctgcagaacctgccctgtggcatggagaagctgggcagtgatgtggccaccctcttcacccacagccacgtggtgtccctggtgtctgctgctgcctgcctgctgggccagctgggccagcagggcgtgacctttgacctgcagcccatggagtggatggctgctgccacccacgccctgagcgccccagctgagctgctgacagagcagggcaaggccagcctcatccgggacatgagcagcagcgagatgtggacagtgctgtggcaccgcttctccatggtgctgcggctgcctgaggaggccagcgcccaggagggggagctgagcctgagcagcccccccagccctgagccagactggaccctcatcagcccccagggcatggccgccctgctgagcctggccatggccaccttcacccaggagccccagctgtgcctgagctgcctgagccagcacggcagcatcctgatgagcatcctgaagcacctgctgtgccccagcttcctgaaccagctgcggcaggcccctcatggcagcgagttcctgcctgtggtggtgctgtctgtgtgccagctgctgtgcttcccctttgccctggacatggatgctgacctgctgattggagtgctggccgacctgcgggacagcgaggtggccgcccacctgctgcaggtgtgctgctaccacctgcccctgatgcaggtggagctgcccatcagcctgctgacccggctggccctgatggaccccaccagcctgaaccagtttgtgaacacagtgtctgccagccccaggaccatcgtgtccttcctgtctgtggccctgctgagtgaccagcccctgctgaccagtgacctgctgagcctgctggcccacacagcccgggtgctgagccccagccacctgtccttcatccaggagctgctggccggcagtgatgagagctaccggcccctgcggagcctgctgggccacccagaaaattctgtgcgggcccacacctaccgcctgctgggccacctgctgcagcacagcatggccctgcggggggccctgcagagccagagcggcctgctgagcctgctgctgctgggcctgggggacaaggaccctgtggtgcgctgcagcgccagctttgctgtgggcaatgctgcctaccaggccggccccctgggccctgccctggccgctgctgtgcccagcatgacccagctgctgggggacccccaggccggcatcagaagaaatgtggccagcgccctgggcaacctgggccctgagggcctgggggaggagctgctgcagtgtgaggtgccccagaggctgctggagatggcctgtggggacccccagcccaacgtgaaggaggccgccctgattgccctgcggagcctgcagcaggagcccggcatccaccaggtgctggtgtccctgggcgccagcgagaagctgagcctgctgagcctgggcaaccagagcctgccccacagcagccccaggcctgccagcgccaagcactgcaggaagctgatccacctgctgcggcctgcccacagcatgtag

SEQ ID NO: 169347 - DNA, 3885 bp, Artificial Sequence
  Description of Artificial Sequence: Synthetic coding sequence
atggagaagtaccacgtgctggagatgattggagagggcagctttggccgggtgtacaagggccgcaggaagtacagcgcccaggtggtggccctgaagttcatccccaagctgggccgctctgagaaggagctgaggaacctgcagcgggagattgagatcatgaggggcctgcggcaccccaacatcgtgcacatgctggacagctttgaaacagacaaggaggtggtggtggtgacagattatgcagagggggagctgttccagatcctggaggatgatggcaagctgcctgaggaccaggtgcaggccatcgccgcccagctggtgtctgccctgtactacctgcacagccaccgcatcctgcaccgggacatgaagccccagaacatcctgctggccaagggcggcggcatcaagctgtgtgactttggatttgcccgggccatgagcaccaacaccatggtgctgaccagcatcaagggcacccccctgtacatgagccctgagctggtggaggagcggccctatgaccacacagctgacctgtggagcgtgggctgcatcctgtatgagctggccgtgggcaccccacccttctacgccaccagcatcttccagctggtgtccctcatcctgaaggaccctgtgcgctggcccagcaccatcagcccctgcttcaagaacttcctgcagggcctgctgaccaaggacccccggcagaggctgtcctggccagacctgctgtaccaccccttcatcgccggccacgtgaccatcatcacagagcctgctggccctgacctgggcacccccttcaccagccggctgcccccagagctgcaggtgctgaaggatgagcaggcccaccggctggcccccaagggcaaccagagccgcatcctgacccaggcctacaagaggatggccgaggaggccatgcagaagaagcaccagaacacaggccctgccctggagcaggaggacaagaccagcaaggtggcccctggaacagcccccctgccccggctgggcgccaccccccaggagagcagcctgctggccggcatcctggccagcgagctgaagagctcctgggccaagtctggaactggagaggtgcccagcgccccccgggagaacagaaccaccccagactgtgagcgggccttccctgaggagaggcctgaggtgctgggccagaggagcacagatgtggtggacctggagaatgaggagccagacagcgacaatgagtggcagcacctgctggagaccacagagcctgtgcccatccagctgaaggcccccctgaccctgctgtgcaacccagacttctgccagaggatccagagccagctgcatgaagctgggggccagatcctgaagggcatcctggagggcgccagccacatcctgcctgccttccgggtgctgagcagcctgctgagcagctgcagcgacagcgtggccctgtacagcttctgccgggaggccggcctgcccggcctgctgctgagcctgctgcggcacagccaggagagcaacagcctgcagcagcagagctggtacggcaccttcctgcaggacctgatggctgtgatccaggcctactttgcctgcaccttcaacctggagaggagccagaccagtgacagcctgcaggtgttccaggaggccgccaacctcttcctggacctgctgggcaagctgctggcccagccagatgacagcgagcagaccctgcggcgggacagcctgatgtgcttcaccgtgctgtgtgaggccatggatggcaacagccgggccatcagcaaggccttctacagcagcctgctgaccacccagcaggtggtgctggatggcctgctgcacggcctgactgtgccccagctgcctgtgcacaccccccagggcgccccccaggtgtcccagcccctgcgggagcagagcgaggacatccctggggccatcagcagcgccctggccgccatctgcacagcccctgtgggcctgcctgactgctgggatgccaaggagcaggtgtgctggcacctggccaaccagctgacagaggacagcagccagctgcggcccagcctcatcagcggcctgcagcaccccatcctgtgcctgcacctgctgaaggtgctgtacagctgctgcctggtgtctgagggcctgtgccgcctgctgggccaggagcccctggccctggagagcctcttcatgctgatccagggcaaggtgaaggtggtggactgggaggagagcacagaggtgaccctgtacttcctgagcctgctggtgttccggctgcagaacctgccctgtggcatggagaagctgggcagtgatgtggccaccctcttcacccacagccacgtggtgtccctggtgtctgctgctgcctgcctgctgggccagctgggccagcagggcgtgacctttgacctgcagcccatggagtggatggctgctgccacccacgccctgagcgccccagctgagatgagctgtgagcagggcaaggccagcctcatccgggacatgagcagcagcgagatgtggacagtgctgtggcaccgcttctccatggtgctgcggctgcctgaggaggccagcgcccaggagggggagctgagcctgagcagcccccccagccctgagccagactggaccctcatcagcccccagggcatggccgccctgctgagcctggccatggccaccttcacccaggagccccagctgtgcctgagctgcctgagccagcacggcagcatcctgatgagcatcctgaagcacctgctgtgccccagcttcctgaaccagctgcggcaggcccctcatggcagcgagttcctgcctgtggtggtgctgtctgtgtgccagctgctgtgcttcccctttgccctggacatggatgctgacctgctgattggagtgctggccgacctgcgggacagcgaggtggccgcccacctgctgcaggtgtgctgctaccacctgcccctgatgcaggtggagctgcccatcagcctgctgacccggctggccctgatggaccccaccagcctgaaccagtttgtgaacacagtgtctgccagccccaggaccatcgtgtccttcctgtctgtggccctgctgagtgaccagcccctgctgaccagtgacctgctgagcctgctggcccacacagcccgggtgctgagccccagccacctgtccttcatccaggagctgctggccggcagtgatgagagctaccggcccctgcggagcctgctgggccacccagaaaattctgtgcgggcccacacctaccgcctgctgggccacctgctgcagcacagcatggccctgcggggggccctgcagagccagagcggcctgctgagcctgctgctgctgggcctgggggacaaggaccctgtggtgcgctgcagcgccagctttgctgtgggcaatgctgcctaccaggccggccccctgggccctgccctggccgctgctgtgcccagcatgacccagctgctgggggacccccaggccggcatcagaagaaatgtggccagcgccctgggcaacctgggccctgagggcctgggggaggagctgctgcagtgtgaggtgccccagaggctgctggagatggcctgtggggacccccagcccaacgtgaaggaggccgccctgattgccctgcggagcctgcagcaggagcccggcatccaccaggtgctggtgtccctgggcgccagcgagaagctgagcctgctgagcctgggcaaccagagcctgccccacagcagccccaggcctgccagcgccaagcactgcaggaagctgatccacctgctgcggcctgcccacagcatgtag

SEQ ID NO: 169348 - DNA, 840 bp, Artificial Sequence
  Description of Artificial Sequence: Synthetic coding sequence
atggagaagtaccacgtgctggagatgattggagagggcagctttggccgggtgtacaagggccgcaggaagtacagcgcccaggtggtggccctgaagttcatccccaagctgggccgctctgagaaggagctgaggaacctgcagcgggagattgagatcatgaggggcctgcggcaccccaacatcgtgcacatgctggacagctttgaaacagacaaggaggtggtggtggtgacagattatgcagagggggagctgttccagatcctggaggatgatggcaagctgcctgaggaccaggtgcaggccatcgccgcccagctggtgtctgccctgtactacctgcacagccaccgcatcctgcaccgggacatgaagccccagaacatcctgctggccaagggcggcggcatcaagctgtgtgactttggatttgcccgggccatgagcaccaacaccatggtgctgaccagcatcaagggcacccccctgtacatgagccctgagctggtggaggagcggccctatgaccacacagctgacctgtggagcgtgggctgcatcctgtatgagctggccgtgggcaccccacccttctacgccaccagcatcttccagctggtgtccctcatcctgaaggaccctgtgcgctggcccagcaccatcagcccctgcttcaagaacttcctgcagggcctgctgaccaaggacccccggcagaggctgtcctggccagacctgctgtaccaccccttcatcgccggccacgtgaccatcatcacagagcctgctggccctgacctgggcacccccttcaccagccggctgcccccatag

SEQ ID NO: 169349 - DNA, 3948 bp, Artificial Sequence; identical to SEQ ID NO: 169345
  Description of Artificial Sequence: Synthetic coding sequence

SEQ ID NO: 169350 - DNA, 1056 bp, Artificial Sequence
  Description of Artificial Sequence: Synthetic coding sequence
atgaggttcaccttccccctgatggccatcgtgctggagatcgccatgattgtgctgtttggcctgtttgtggagtatgaaacagaccagacagtgctggagcagctgaacatcaccaagcccacagacatgggcatcttctttgagctgtaccccctcttccaggatgtgcacgtgatgatctttgtgggcttcggcttcctgatgaccttcctgaagaagtatggcttcagctctgtgggcatcaacctgctggtggccgccctgggcctgcagtggggcaccatcgtgcagggcatcctgcagagccagggccagaagttcaacatcggcatcaagaacatgatcaatgctgacttctctgctgccaccgtgctgatcagctttggagctgtgctgggcaagaccagccccacccagatgctgatcatgaccatcctggagatcgtgttctttgcccacaatgagtacctggtgtctgagatcttcaaggccagtgacatcggggcctccatgaccatccacgcctttggagcctacttcggcctggccgtggccggcatcctgtaccgcagcggcctgaggaagggccatgaaaatgaggagagcgcctactacagcgacctgtttgccatgattggcaccctcttcctgtggatgttctggcccagcttcaacagcgccatcgccgagcccggggacaagcagtgccgggccatcgtgaacacctacttcagcctggccgcctgtgtgctgacagcctttgccttcagcagcctggtggagcaccggggcaagctgaacatggtgcacatccagaatgccaccctggccggcggcgtggccgtgggcacctgtgccgacatggccatccaccccttcggctccatgatcatcggcagcattgctggcatggtgtctgtgctgggctacaagttcctgactgtgtatggccacgccggcagctgcaccggcttcctgtacagaaacagcagctgctggaggagtgatgaccgcttcaacagcaaggtggccagcctgggcacagccatctag

SEQ ID NO: 169351 - DNA, 1389 bp, Artificial Sequence
  Description of Artificial Sequence: Synthetic coding sequence
atggagaccgtgcagctgagaaatccaccccggcggcagctgaagaagctggatgaggacagcctgaccaagcagcctgaggaggtgtttgatgtgctggagaagctgggggagggcagctatggctctgtgtacaaggccatccacaaggagaccggccagatcgtggccatcaagcaggtgcctgtggagagtgacctgcaggagatcatcaaggagatcagcatcatgcagcagtgtgacagcccccacgtggtgaagtactacggcagctacttcaagaacacagacctgtggatcgtgatggagtactgtggggccggctctgtgtctgacatcatccggctgaggaacaagaccctgacagaagatgagatcgccaccatcctgcagagcaccctgaagggcctggagtacctgcacttcatgaggaagatccaccgggacatcaaggccggcaacatcctgctgaacacagagggccacgccaagctggccgactttggagtggccggccagctgacagacaccatggccaagaggaacacagtgattggcacccccttctggatggcccctgaggtgatccaggagatcggctacaactgtgtggccgacatctggagcctgggcatcacagccatcgagatggccgagggcaagccaccctatgctgacatccaccccatgagggccatcttcatgatccccaccaaccccccacccaccttcaggaagccagagctgtggagcgacaacttcacagactttgtgaagcagtgcctggtgaagagccctgagcagagggccacagccacccagctgctgcagcacccctttgtgcgcagcgccaagggcgtgtccatcctgcgggacctgatcaatgaggccatggatgtgaagctgaagaggcaggagagccagcagcgggaggtggaccaggatgatgaggagaacagcgaggaggatgagatggattctggcaccatggtgcgggctgtgggagatgagatgggcaccgtgcgggtggccagcaccatgacagatggagccaacaccatgattgaacatgatgacaccctgcccagccagctgggcaccatggtgatcaatgcagaagatgaggaggaggagggcaccatgaagagaagagatgagaccatgcagcctgccaagcccagcttcctggagtactttgagcagaaggagaaggagaaccagatcaacagctttgggaagtctgtgcccggccccctgaagaacagcagtgactggaagatcccccaggatggagactatgagttcaagaccagccaggagcagcagagcggcaaggacatctgcatccagaactgccagggcaacctgctgtgccgctatgccttctag

SEQ ID NO: 169352 - DNA, 1464 bp, Artificial Sequence
  Description of Artificial Sequence: Synthetic coding sequence
atggagaccgtgcagctgagaaatccaccccggcggcagctgaagaagctggatgaggacagcctgaccaagcagcctgaggaggtgtttgatgtgctggagaagctgggggagggcagctatggctctgtgtacaaggccatccacaaggagaccggccagatcgtggccatcaagcaggtgcctgtggagagtgacctgcaggagatcatcaaggagatcagcatcatgcagcagtgtgacagcccccacgtggtgaagtactacggcagctacttcaagaacacagacctgtggatcgtgatggagtactgtggggccggctctgtgtctgacatcatccggctgaggaacaagaccctgacagaagatgagatcgccaccatcctgcagagcaccctgaagggcctggagtacctgcacttcatgaggaagatccaccgggacatcaaggccggcaacatcctgctgaacacagagggccacgccaagctggccgactttggagtggccggccagctgacagacaccatggccaagaggaacacagtgattggcacccccttctggatggcccctgaggtgatccaggagatcggctacaactgtgtggccgacatctggagcctgggcatcacagccatcgagatggccgagggcaagccaccctatgctgacatccaccccatgagggccatcttcatgatccccaccaaccccccacccaccttcaggaagccagagctgtggagcgacaacttcacagactttgtgaagcagtgcctggtgaagagccctgagcagagggccacagccacccagctgctgcagcacccctttgtgcgcagcgccaagggcgtgtccatcctgcgggacctgatcaatgaggccatggatgtgaagctgaagaggcaggagagccagcagcgggaggtggaccaggatgatgaggagaacagcgaggaggatgagatggattctggcaccatggtgcgggctgtgggagatgagatgggcaccgtgcgggtggccagcaccatgacagatggagccaacaccatgattgaacatgatgacaccctgcccagccagctgggcaccatggtgatcaatgcagaagatgaggaggaggagggcaccatgaagagaagagatgagaccatgcagcctgccaagcccagcttcctggagtactttgagcagaaggagaaggagaaccagatcaacagctttgggaagtctgtgcccggccccctgaagaacagcagtgactggaagatcccccaggatggagactatgagttcctgaagtcctggacagtggaggacctgcagaagaggctgctggccctggaccccatgatggagcaggagattgaggagatccggcagaagtaccagagcaagaggcagcccatcctggatgccatcgaggccaagaagaggcggcagcagaacttctag

SEQ ID NO: 169353 - DNA, 1389 bp, Artificial Sequence; identical to SEQ ID NO: 169351
  Description of Artificial Sequence: Synthetic coding sequence

SEQ ID NO: 169354 - DNA, 1299 bp, Artificial Sequence
  Description of Artificial Sequence: Synthetic coding sequence
atggagaccgtgcagctgagaaatccaccccggcggcagctgaagaagctggatgaggacagcctgaccaagcagcctgaggaggtgtttgatgtgctggagaagctgggggagggcagctatggctctgtgtacaaggccatccacaaggagaccggccagatcgtggccatcaagcaggtgcctgtggagagtgacctgcaggagatcatcaaggagatcagcatcatgcagcagtgtgacagcccccacgtggtgaagtactacggcagctacttcaagaacacagacctgtggatcgtgatggagtactgtggggccggctctgtgtctgacatcatccggctgaggaacaagacagacaccatggccaagaggaacacagtcatcggcacccccttctggatggcccctgaggtgatccaggagatcggctacaactgtgtggccgacatctggagcctgggcatcacagccatcgagatggccgagggcaagccaccctatgctgacatccaccccatgagggccatcttcatgatccccaccaaccccccacccaccttcaggaagccagagctgtggagcgacaacttcacagactttgtgaagcagtgcctggtgaagagccctgagcagagggccacagccacccagctgctgcagcacccctttgtgcgcagcgccaagggcgtgtccatcctgcgggacctgatcaatgaggccatggatgtgaagctgaagaggcaggagagccagcagcgggaggtggaccaggatgatgaagaaaattctgaagaagatgagatggacagcggcaccatggtgcgggctgtgggagatgagatgggcaccgtgcgggtggccagcaccatgacagatggagccaacaccatgattgaacatgatgacaccctgcccagccagctgggcaccatggtgatcaatgcagaagatgaggaggaggagggcaccatgaagagaagagatgagaccatgcagcctgccaagcccagcttcctggagtactttgagcagaaggagaaggagaaccagatcaacagctttgggaagtctgtgcccggccccctgaagaacagcagtgactggaagatcccccaggatggagactatgagttcctgaagtcctggacagtggaggacctgcagaagaggctgctggccctggaccccatgatggagcaggagattgaggagatccggcagaagtaccagagcaagaggcagcccatcctggatgccatcgaggccaagaagaggcggcagcagaacttctag

SEQ ID NO: 169355 - DNA, 1254 bp, Artificial Sequence
  Description of Artificial Sequence: Synthetic coding sequence
atgaagagaagagccagtgacagaggagctggggagaccagcgcccgggccaaggccctgggcagcggcatcagcggcaacaatgccaagagagctggccccttcatcctgggcccccggctgggcaacagccctgtgcccagcatcgtgcagtgcctggccaggaaggatggaacagatgacttctaccagctgaagatcctgaccctggaggagcggggggaccagggcatcgagagccaggaggagcggcagggcaagatgctgctgcacacagagtacagcctgctgagcctgctgcacacccaggatggagtggtgcaccaccacggcctcttccaggacaggacctgtgagatcgtggaggacacagagagcagcaggatggtgaagaagatgaagaagaggatctgcctggtgctggactgcctgtgtgcccatgacttcagtgacaagacagctgacctgatcaacctgcagcactacgtgatcaaggagaagaggctgtctgagcgggagaccgtggtgatcttctatgatgtggtgcgggtggtggaggccctgcaccagaagaacatcgtgcaccgggacctgaagctgggcaacatggtgctgaacaagaggacccaccgcatcaccatcaccaacttctgcctgggcaagcacctggtgtctgagggggacctgctgaaggaccagaggggcagccctgcctacatcagcccagatgtgctgagcggccggccctaccggggcaagcccagcgacatgtgggccctgggcgtggtgctcttcaccatgctgtatggccagttccccttctatgacagcatcccccaggagctgttcaggaagatcaaggctgctgagtacaccatcccagaagatggccgggtgtctgaaaatacagtgtgcctgatcaggaagctgctggtgctggacccccagcagaggctggccgctgctgatgtgctggaggccctgagcgccatcatcgcctcctggcagagcctgagcagcctgagcggccccctgcaggtggtgcctgacattgatgaccagatgagcaatgctgacagcagccaggaggtgtcctggggcggccagatgggccactacccagccccccgggaccggctgctgggcgccggccgggcccgggcagaggtggccgccacccggcggccccagagcttcctgggcctgctgccccagccctggggcggcaagggccgcctgcagagcagcgcctag

SEQ ID NO: 169356 - DNA, 1308 bp, Artificial Sequence
  Description of Artificial Sequence: Synthetic coding sequence
atgaagagaagagccagtgacagaggagctggggagaccagcgcccgggccaaggccctgggcagcggcatcagcggcaacaatgccaagagagctggccccttcatcctgggcccccggctgggcaacagccctgtgcccagcatcgtgcagtgcctggccaggaaggatggaacagatgacttctaccagctgaagatcctgaccctggaggagcggggggaccagggcatcgagagccaggaggagcggcagggcaagatgctgctgcacacagagtacagcctgctgagcctgctgcacacccaggatggagtggtgcaccaccacggcctcttccaggacaggacctgtgagatcgtggaggacacagagagcagcaggatggtgaagaagatgaagaagaggatctgcctggtgctggactgcctgtgtgcccatgacttcagtgacaagacagctgacctgatcaacctgcagcactacgtgatcaaggagaagaggctgtctgagcgggagaccgtggtgatcttctatgatgtggtgcgggtggtggaggccctgcaccagaagaacatcgtgcaccgggacctgaagctgggcaacatggtgctgaacaagaggacccaccgcatcaccatcaccaacttctgcctgggcaagcacctggtgtctgagggggacctgctgaaggaccagaggggcagccctgcctacatcagcccagatgtgctgagcggccggccctaccggggcaagcccagcgacatgtgggccctgggcgtggtgctcttcaccatgctgtatggccagttccccttctatgacagcatcccccaggagctgttcaggaagatcaaggctgctgagtacaccatcccagaagatggccgggtgtctgaaaatacagtgtgcctgatcaggaagctgctggtgctggacccccagcagaggctggccgctgctgatgtgctggaggccctgagcgccatcatcgcctcctggcagagcctgagcagcctgagcggccccctgcaggtggtgcctgacattgatgaccagatgagcaatgctgacagcagccaggaggccaaggtgacagaagaatgttcccagtatgaatttgagaactacatgaggcagcagctgctgctggccgaggagaagagcagcatccatgatgcccgctcctgggtgcccaagaggcagtttggcagcgcccctcctgtgcggcggctgggccatgatgcccagcccatgaccagcctggacacagccatcctggcccagcgctacctgaggaagtag

SEQ ID NO: 169357 - DNA, 1323 bp, Artificial Sequence
  Description of Artificial Sequence: Synthetic coding sequence
atgaagagaagagccagtgacagaggagctggggagaccagcgcccgggccaaggccctgggcagcggcatcagcggcaacaatgccaagagagctggccccttcatcctggccctgtgtgctgtgggcccccggctgggcaacagccctgtgcccagcatcgtgcagtgcctggccaggaaggatggaacagatgacttctaccagctgaagatcctgaccctggaggagcggggggaccagggcatcgagagccaggaggagcggcagggcaagatgctgctgcacacagagtacagcctgctgagcctgctgcacacccaggatggagtggtgcaccaccacggcctcttccaggacaggacctgtgaaattgtggaggacacagagagcagcaggatggtgaagaagatgaagaagaggatctgcctggtgctggactgcctgtgtgcccatgacttcagtgacaagacagctgacctgatcaacctgcagcactacgtgatcaaggagaagaggctgtctgagcgggagaccgtggtgatcttctatgatgtggtgcgggtggtggaggccctgcaccagaagaacatcgtgcaccgggacctgaagctgggcaacatggtgctgaacaagaggacccaccgcatcaccatcaccaacttctgcctgggcaagcacctggtgtctgagggggacctgctgaaggaccagaggggcagccctgcctacatcagcccagatgtgctgagcggccggccctaccggggcaagcccagcgacatgtgggccctgggcgtggtgctcttcaccatgctgtatggccagttccccttctatgacagcatcccccaggagctgttcaggaagatcaaggctgctgagtacaccatcccagaagatggccgggtgtctgagaacacagtgtgcctgatcaggaagctgctggtgctggacccccagcagaggctggccgctgctgatgtgctggaggccctgagcgccatcatcgcctcctggcagagcctgagcagcctgagcggccccctgcaggtggtgcctgacattgatgaccagatgagcaatgctgacagcagccaggaggccaaggtgacagaggagtgcagccagtatgaatttgagaactacatgaggcagcagctgctgctggccgaggagaagagcagcatccatgatgcccgctcctgggtgcccaagaggcagtttggaagtgcccctcctgtgcggcggctgggccatgatgcccagcccatgaccagcctggacacagccatcctggcccagcgctacctgaggaagtag

SEQ ID NO: 169358 - DNA, 1308 bp, Artificial Sequence; identical to SEQ ID NO: 169356
  Description of Artificial Sequence: Synthetic coding sequence

SEQ ID NO: 169359 - DNA, 1092 bp, Artificial Sequence
  Description of Artificial Sequence: Synthetic coding sequence
atggccatgaggcagacccccctgacctgcagcggccacaccaggcctgtggtggacctggccttcagcggcatcaccccctacggctacttcctgatcagcgcctgcaagggagctggccagcacctgccccggctgagcggccagcatgatggcaagcccatgctgcggcagggcgacacaggagactggattggcaccttcctgggccacaagggagctgtgtggggcgccaccctgaacaaggatgccaccaaggccgccacagctgctgctgacttcaccgccaaggtgtgggatgctgtgtctggagatgagctgatgaccctggcccacaagcacatcgtgaagacagtggacttcacccaggacagcaactacctgctgaccggcggccaggacaagctgctgcgcatctatgacctgaacaagccagaggccgagcccaaggagatcagcggccacaccagcggcatcaagaaggccctgtggtgcagcgaggacaagcagatcctgtctgcagatgacaagacagtgcggctgtgggaccacgccaccatgacagaggtgaagagcctgaacttcaacatgtctgtgtcctccatggagtacatccctgagggggagatcctggtgatcacctacggccgcagcatcgccttccacagcgctgtgtccctggaccccatcaagagctttgaggccccagccaccatcaacagcgccagcctgcaccctgagaaggagttcctggtggccggcggggaggacttcaagctgtacaagtatgactacaacagcggggaggagctggagagctacaagggccacttcggccccatccactgtgtgcgcttctccccagatggagagctgtatgccagcggctctgaagatggcaccctgcggctgtggcagacagtggtgggcaagacctacggcctgtggaagtgtgtgctgcctgaagaagattctggagagctggccaagcccaagattggcttccctgagaccacagaggaggagctggaggagatcgcctctgaaaattctgactgcatcttccccagcgccccagatgtgaaggcctag

SEQ ID NO: 169360 - DNA, 1053 bp, Artificial Sequence
  Description of Artificial Sequence: Synthetic coding sequence
atggccatgaggcagacccccctgacctgcagcggccacaccaggcctgtggtggacctggccttcagcggcatcaccccctacggctacttcctgatcagcgcctgcaaggatggcaagcccatgctgcggcagggcgacaccggggactggattggcaccttcctgggccacaagggagctgtgtggggcgccaccctgaacaaggatgccaccaaggccgccacagctgctgctgacttcaccgccaaggtgtgggatgctgtgtctggagatgagctgatgaccctggcccacaagcacatcgtgaagacagtggacttcacccaggacagcaactacctgctgactggaggccaggacaagctgctgcgcatctatgacctgaacaagccagaggccgagcccaaggagatcagcggccacaccagcggcatcaagaaggccctgtggtgcagcgaggacaagcagatcctgtctgcagatgacaagacagtgcggctgtgggaccacgccaccatgacagaggtgaagagcctgaacttcaacatgtctgtgtcctccatggagtacatccctgagggggagatcctggtgatcacctacggccgcagcatcgccttccacagcgctgtgtccctggaccccatcaagagctttgaggccccagccaccatcaacagcgccagcctgcaccctgagaaggagttcctggtggccggaggagaggacttcaagctgtacaagtatgactacaacagcggggaggagctggagagctacaagggccacttcggccccatccactgtgtgcgcttctccccagatggagagctgtatgccagcggctctgaagatggcaccctgcggctgtggcagacagtggtgggcaagacctacggcctgtggaagtgtgtgctgcctgaggaggacagcggggagctggccaagcccaagattggcttccctgagaccacagaggaggagctggaggagatcgccagcgagaacagcgactgcatcttccccagcgccccagatgtgaaggcctag

SEQ ID NO: 169361 - DNA, 771 bp, Artificial Sequence
  Description of Artificial Sequence: Synthetic coding sequence
atgaccctggcccacaagcacatcgtgaagacagtggacttcacccaggacagcaactacctgctgactggaggccaggacaagctgctgcgcatctatgacctgaacaagccagaggccgagcccaaggagatcagcggccacaccagcggcatcaagaaggccctgtggtgcagcgaggacaagcagatcctgtctgcagatgacaagacagtgcggctgtgggaccacgccaccatgacagaggtgaagagcctgaacttcaacatgtctgtgtcctccatggagtacatccctgagggggagatcctggtgatcacctacggccgcagcatcgccttccacagcgctgtgtccctggaccccatcaagagctttgaggccccagccaccatcaacagcgccagcctgcaccctgagaaggagttcctggtggccggaggagaggacttcaagctgtacaagtatgactacaacagcggggaggagctggagagctacaagggccacttcggccccatccactgtgtgcgcttctccccagatggagagctgtatgccagcggctctgaagatggcaccctgcggctgtggcagacagtggtgggcaagacctacggcctgtggaagtgtgtgctgcctgaggaggacagcggggagctggccaagcccaagattggcttccctgagaccacagaggaggagctggaggagatcgccagcgagaacagcgactgcatcttccccagcgccccagatgtgaaggcctag

SEQ ID NO: 169362 - DNA, 1707 bp, Artificial Sequence
  Description of Artificial Sequence: Synthetic coding sequence
atgaagaacaagatccaggtggtggtgctggagaatgaaggcctgcagcagcagctgaagagccagaggcaggaggagaccctgcgggagcagaccctgctggatgccagcggcaacatgcacaacagctggatcaccactggagaagattctggagtgggggagaccagcaagaggcccttcagccatgacaatgctgactttgggaaggccgccagcgctggggagcagctggagctggagaagctgaagctgacctatgaggagaagtgtgaaattgaggagagccagctgaagttcctgagaaatgacctggccgagtaccagaggacctgtgaggacctgaaggagcagctgaagcacaaggagttcctgctggccgccaacacctgcaacagagtgggcggcctgtgcctgaagtgtgcccagcacgaggccgtgctgagccagacccacaccaacgtgcacatgcagaccatcgagcggctggtgaaggagagagatgacctgatgtctgccctggtgtctgtgcgcagcagcctggccgacacccagcagcgggaggccagcgcctatgagcaggtgaagcaggtgctgcagatcagcgaggaggccaactttgagaagaccaaggccctgatccagtgtgaccagctgaggaaggagctggagcggcaggccgagcggctggagaaggagctggccagccagcaggagaagagggccatcgagaaggacatgatgaagaaggagatcaccaaggagcgggagtacatgggcagcaagatgctgatcctgagccagaacatcgcccagctggaggcccaggtggagaaggtgaccaaggagaagatcagcgccatcaaccagctggaggagatccagagccagctggccagccgggagatggatgtgaccaaggtgtgtggggagatgagataccagctgaacaagaccaacatggagaaggatgaggccgagaaggagcaccgggagttccgggccaagaccaacagagacctggagatcaaggaccaggagattgagaagctgagaattgagctggatgagagcaagcagcacctggagcaggagcagcagaaggccgccctggcccgggaggagtgcctgcggctgacagagctgctgggggagagcgagcaccagctgcacctgacccggcaggagaaggacagcatccagcagagcttcagcaaggaggccaaggcccaggccctgcaggcccagcagcgggagcaggagctgacccagaagatccagcagatggaggcccagcacgacaagacagaaaatgagcagtacctgctgctgaccagccagaacaccttcctgaccaagctgaaggaggagtgctgcaccctggccaagaagctggagcagatcagccagaagaccaggtctgagatcgcccagctgagccaggagaagcgctacacctatgacaagctgggcaagctgcagaggagaaatgaggagctggaggagcagtgtgtgcagcacggccgggtgcatgagaccatgaagcagaggctgcggcagctggacaagcacagccaggccacagcccagcagctggtgcagctgctgagcaagcagaaccagctgctgctggagcggcagagcctgtctgaggaggtggaccggctgcggacccagctgcccagcatgccccagagcgactgctag

SEQ ID NO: 169363 - DNA, 2013 bp, Artificial Sequence
  Description of Artificial Sequence: Synthetic coding sequence
atggccaagagccctgagaacagcaccctggaggagatcctgggccagtaccagaggagcctgcgggagcacgccagccgcagcatccaccagctgacctgtgccctgaaggagggagatgtgaccatcggagaagatgcccccaacctgtccttcagcacctctgtgggcaatgaagatgccaggacagcctggccagagctgcagcagagccatgctgtgaaccagctgaaggacctgctgcggcagcaggccgacaaggagagcgaggtgagccccagcagaagaaggaagatgagccccctgcggagcctggagcacgaggagaccaacatgcccaccatgcatgacctggtgcacaccatcaatgaccagagccagtacatccaccacctggaggccgaggtgaagttctgcaaggaggagctgagcggcatgaagaacaagatccaggtggtggtgctggagaatgaaggcctgcagcagcagctgaagagccagaggcaggaggagaccctgcgggagcagaccctgctggatgccagcgagaagctgaagctgacctatgaggagaagtgtgaaattgaggagagccagctgaagttcctgagaaatgacctggccgagtaccagaggacctgtgaggacctgaaggagcagctgaagcacaaggagttcctgctggccgccaacacctgcaacagagtgggcggcctgtgcctgaagtgtgcccagcacgaggccgtgctgagccagacccacaccaacgtgcacatgcagaccatcgagcggctggtgaaggagagagatgacctgatgtctgccctggtgtctgtgcgcagcagcctggccgacacccagcagcgggaggccagcgcctatgagcaggtgaagcaggtgctgcagatcagcgaggaggccaactttgagaagaccaaggccctgatccagtgtgaccagctgaggaaggagctggagcggcaggccgagcggctggagaaggagctggccagccagcaggagaagagggccatcgagaaggacatgatgaagaaggagatcaccaaggagcgggagtacatgggcagcaagatgctgatcctgagccagaacatcgcccagctggaggcccaggtggagaaggtgaccaaggagaagatcagcgccatcaaccagctggaggagatccagagccagctggccagccgggagatggatgtgaccaaggtgtgtggggagatgagataccagctgaacaagaccaacatggagaaggatgaggccgagaaggagcaccgggagttccgggccaagaccaacagagacctggagatcaaggaccaggagattgagaagctgagaattgagctggatgagagcaagcagcacctggagcaggagcagcagaaggccgccctggcccgggaggagtgcctgcggctgacagagctgctgggggagagcgagcaccagctgcacctgacccggcaggagaaggacagcatccagcagagcttcagcaaggaggccaaggcccaggccctgcaggcccagcagcgggagcaggagctgacccagaagatccagcagatggaggcccagcacgacaagacagaaaatgagcagtacctgctgctgaccagccagaacaccttcctgaccaagctgaaggaggagtgctgcaccctggccaagaagctggagcagatcagccagaagaccaggtctgagatcgcccagctgagccaggagaagcgctacacctatgacaagctgggcaagctgcagaggagaaatgaggagctggaggagcagtgtgtgcagcacggccgggtgcatgagaccatgaagcagaggctgcggcagctggacaagcacagccaggccacagcccagcagctggtgcagctgctgagcaagcagaaccagctgctgctggagcggcagagcctgtctgaggaggtggaccggctgcggacccagctgcccagcatgccccagagcgactgctag

SEQ ID NO: 169364 - DNA, 2142 bp, Artificial Sequence
  Description of Artificial Sequence: Synthetic coding sequence
atggccaagagccctgagaacagcaccctggaggagatcctgggccagtaccagaggagcctgcgggagcacgccagccgcagcatccaccagctgacctgtgccctgaaggagggagatgtgaccatcggagaagatgcccccaacctgtccttcagcacctctgtgggcaatgaagatgccaggacagcctggccagagctgcagcagagccatgctgtgaaccagctgaaggacctgctgcggcagcaggccgacaaggagagcgaggtgagccccagcagaagaaggaagatgagccccctgcggagcctggagcacgaggagaccaacatgcccaccatgcatgacctggtgcacaccatcaatgaccagagccagtacatccaccacctggaggccgaggtgaagttctgcaaggaggagctgagcggcatgaagaacaagatccaggtggtggtgctggagaatgaaggcctgcagcagcagctgaagagccagaggcaggaggagaccctgcgggagcagaccctgctggatgccagcggcaacatgcacaacagctggatcaccaccggggaggacagcggcgtgggggagaccagcaagaggcccttcagccatgacaatgctgactttgggaaggccgccagcgctggggagcagctggagctggagaagctgaagctgacctatgaggagaagtgtgaaattgaggagagccagctgaagttcctgagaaatgacctggccgagtaccagaggacctgtgaggacctgaaggagcagctgaagcacaaggagttcctgctggccgccaacacctgcaacagagtgggcggcctgtgcctgaagtgtgcccagcatgaagctgtgctgagccagacccacaccaacgtgcacatgcagaccatcgagcggctggtgaaggagagagatgacctgatgtctgccctggtgtctgtgcgcagcagcctggccgacacccagcagcgggaggccagcgcctatgagcaggtgaagcaggtgctgcagatcagcgaggaggccaactttgagaagaccaaggccctgatccagtgtgaccagctgaggaaggagctggagcggcaggccgagcggctggagaaggagctggccagccagcaggagaagagggccatcgagaaggacatgatgaagaaggagatcaccaaggagcgggagtacatgggcagcaagatgctgatcctgagccagaacatcgcccagctggaggcccaggtggagaaggtgaccaaggagaagatcagcgccatcaaccagctggaggagatccagagccagctggccagccgggagatggatgtgaccaaggtgtgtggggagatgagataccagctgaacaagaccaacatggagaaggatgaagctgagaaggagcaccgggagttccgggccaagaccaacagagacctggagatcaaggaccaggagattgagaagctgcgcatcgagctggatgagagcaagcagcacctggagcaggagcagcagaaggccgccctggcccgggaggagtgcctgcggctgacagagctgctgggggagagcgagcaccagctgcacctgacccggcaggagaaggacagcatccagcagagcttcagcaaggaggccaaggcccaggccctgcaggcccagcagcgggagcaggagctgacccagaagatccagcagatggaggcccagcacgacaagacagaaaatgagcagtacctgctgctgaccagccagaacaccttcctgaccaagctgaaggaggagtgctgcaccctggccaagaagctggagcagatcagccagaagaccaggagtgaaattgcccagctgagccaggagaagcgctacacctatgacaagctgggcaagctgcagaggagaaatgaggagctggaggagcagtgtgtgcagcacggccgggtgcatgagaccatgaagcagaggctgcggcagctggacaagcacagccaggccacagcccagcagctggtgcagctgctgagcaagcagaaccagctgctgctggagcggcagagcctgtctgaggaggtggaccggctgcggacccagctgcccagcatgccccagagcgactgctag

SEQ ID NO: 169365 - DNA, 1083 bp, Artificial Sequence
  Description of Artificial Sequence: Synthetic coding sequence
atggccaagagccctgagaacagcaccctggaggagatcctgggccagtaccagaggagcctgcgggagcacgccagccgcagcatccaccagctgacctgtgccctgaaggagggagatgtgaccatcggagaagatgcccccaacctgtccttcagcacctctgtgggcaatgaagatgccaggacagcctggccagagctgcagcagagccatgctgtgaaccagctgaaggacctgctgcggcagcaggccgacaaggagagcgaggtgagccccagcagaagaaggaagatgagccccctgcggagcctggagcacgaggagaccaacatgcccaccatgcatgacctggtgcacaccatcaatgaccagagccagtacatccaccacctggaggccgaggtgaagttctgcaaggaggagctgagcggcatgaagaacaagatccaggtggtggtgctggagaatgaaggcctgcagcagcagctgaagagccagaggcaggaggagaccctgcgggagcagaccctgctggatgccagcggcaacatgcacaacagctggatcaccaccggggaggacagcggcgtgggggagaccagcaagaggcccttcagccatgacaatgctgactttgggaaggccgccagcgctggggagcagctggagctggagaagctgaagctgacctatgaggagaagtgtgaaattgaggagagccagctgaagttcctgagaaatgacctggccgagtaccagaggacctgtgaggacctgaaggagcagctgaagcacaaggagttcctgctggccgccaacacctgcaacagagtgggcggcctgtgcctgaagtgtgcccagcatgaagctgtgctgagccagacccacaccaacgtgcacatgcagaccatcgagcggctggtgaaggagagagatgacctgatgtctgccctggtgtctgtgcgcagcagcctggccgacacccagcagcgggaggccagcgcctatgagcaggtgaagcaggtgctgcagatcagcgaggaggccaactttgagaagaccaagcaccccagccagtag

SEQ ID NO: 169366 - DNA, 1245 bp, Artificial Sequence
  Description of Artificial Sequence: Synthetic coding sequence
ctgctggatgccagcgagaagctgaagctgacctatgaggagaagtgtgaaattgaggagagccagctgaagttcctgagaaatgacctggccgagtaccagaggacctgtgaggacctgaaggagcagctgaagcacaaggagttcctgctggccgccaacacctgcaacagagtgggcggcctgtgcctgaagtgtgcccagcatgaagctgtgctgagccagacccacaccaacgtgcacatgcagaccatcgagcggctggtgaaggagagagatgacctgatgtctgccctggtgtctgtgcgcagcagcctggccgacacccagcagcgggaggccagcgcctatgagcaggtgaagcaggtgctgcagatcagcgaggaggccaactttgagaagaccaaggccctgatccagtgtgaccagctgaggaaggagctggagcggcaggccgagcggctggagaaggagctggccagccagcaggagaagagggccatcgagaaggacatgatgaagaaggagatcaccaaggagcgggagtacatgggcagcaagatgctgatcctgagccagaacatcgcccagctggaggcccaggtggagaaggtgaccaaggagaagatcagcgccatcaaccagctggaggagatccagagccagctggccagccgggagatggatgtgaccaaggtgtgtggggagatgagataccagctgaacaagaccaacatggagaaggatgaagctgagaaggagcaccgggagttccgggccaagaccaacagagacctggagatcaaggaccaggagattgagaagctgcgcatcgagctggatgagagcaagcagcacctggagcaggagcagcagaaggccgccctggcccgggaggagtgcctgcggctgacagagctgctgggggagagcgagcaccagctgcacctgaccaggtctgagatcgcccagctgagccaggagaagcgctacacctatgacaagctgggcaagctgcagaggagaaatgaggagctggaggagcagtgtgtgcagcacggccgggtgcatgagaccatgaagcagaggctgcggcagctggacaagcacagccaggccacagcccagcagctggtgcagctgctgagcaagcagaaccagctgctgctggagcggcagagcctgtctgaggaggtggaccggctgcggacccagctgcccagcatgccccagagcgactgctag

SEQ ID NO: 169367 - DNA, 729 bp, Artificial Sequence
  Description of Artificial Sequence: Synthetic coding sequence
atggatgacctgtgtgaggccaacggcacctttgccatcagcctcttcaagatcctgggggaggaggacaacagcagaaatgtgttcttcagccccatgagcatcagcagcgccctggccatggtgttcatgggcgccaagggcagcacagctgcccagatgagccaggccctgtgcctgtacaaggatggagacatccaccggggcttccagagcctgctgtctgaggtgaacagaacaggcacccagtacctgctgaggacagccaaccggctgtttggagagaagacctgtgacttcctgcctgacttcaaggagtactgccagaagttctaccaggccgagctggaggagctgagctttgctgaggacacagaagaatgtaggaagcacatcaatgactgggtggccgagaagacagagggcaagatcagcgaggtgctggatgctggcaccgtggaccccctgaccaagctggtgctggtgaatgccatctacttcaagggcaagtggaatgagcagtttgacaggaagtacacccggggcatgctgttcaagaccaatgaggagaagaagacagtgcagatgatgttcaaggaggccaagttcaagatgggctatgcagatgaggtgcacacccaggtgctggagctgccctacgtggaggaggagctgtccatggtgatcctgctgcctgatgacaacacagacctggccgtgaaggagtag

SEQ ID NO: 169368 - DNA, 1335 bp, Artificial Sequence
  Description of Artificial Sequence: Synthetic coding sequence
atgaaggtggtgcccagcctgctgctgtctgtgctgctggcccaggtgtggctggtgcccggcctggcccccagcccccagagccctgagaccccagccccccagaaccagaccagccgggtggtgcaggcccccaaggaggaggaggaggatgagcaggaggccagcgaggagaaggccagcgaggaggagaaggcctggctgatggccagccggcagcagctggccaaggagaccagcaactttggcttcagcctgctgaggaagatctccatgagacatgatggcaacatggtgttcagccccttcggcatgagcctggccatgacaggcctgatgctgggcgccaccggccccacagagacccagatcaagaggggcctgcacctgcaggccctgaagcccaccaagccaggcctgctgcccagcctcttcaagggcctgcgggagaccctgagcaggaacctggagctgggcctgacccagggcagctttgccttcatccacaaggactttgatgtgaaggagaccttcttcaacctgagcaagcgctactttgacacagaatgtgtgcccatgaacttcagaaatgccagccaggccaagaggctgatgaaccactacatcaacaaggagacccggggcaagatccccaagctgtttgatgagatcaaccctgagaccaagctgatcctggtggactacatcctcttcaagggcaagtggctgaccccatttgaccccgtcttcacagaggtggacaccttccacctggacaagtacaagaccatcaaggtgcccatgatgtacggggccggcaagtttgccagcacctttgacaagaacttccgctgccacgtgctgaagctgccctaccagggcaatgccaccatgctggtggtgctgatggagaagatgggagaccacctggccctggaggactacctgaccacagacctggtggagacctggctgaggaacatgaagaccaggaacatggaggtgttcttccccaagttcaagctggaccagaagtatgagatgcatgagctgctgcggcagatgggcatccgccgcatcttcagcccctttgctgacctgtctgagctgagcgccactggaagaaacctgcaggtgtcccgggtgctgcagaggacagtcatcgaggtggatgagcggggcacagaagctgtggccggcatcctgtctgagatcacagcctacagcatgcctcctgtgatcaaggtggaccggcccttccacttcatgatctatgaggagaccagcggcatgctgctcttcctgggccgggtggtgaaccccaccctgctgtag

SEQ ID NO: 169369 - DNA, 1335 bp, Artificial Sequence; identical to SEQ ID NO: 169368
  Description of Artificial Sequence: Synthetic coding sequence

SEQ ID NO: 169370 - DNA, 1335 bp, Artificial Sequence; identical to SEQ ID NO: 169368
  Description of Artificial Sequence: Synthetic coding sequence

SEQ ID NO: 169371 - DNA, 1455 bp, Artificial Sequence
  Description of Artificial Sequence: Synthetic coding sequence
atgagccgcagcacccaggagctgctgggctaccactgccgcctgcaggacaagctgcaggagcaggagggcagcctggccgctgagggccgccacagcctggccagcgctgctgaccacatgaaggtggtgcccagcctgctgctgtctgtgctgctggcccaggtgtggctggtgcccggcctggcccccagcccccagagccctgagaccccagccccccagaaccagaccagccgggtggtgcaggcccccaaggaggaggaggaggatgagcaggaggccagcgaggagaaggccagcgaggaggagaaggcctggctgatggccagccggcagcagctggccaaggagaccagcaactttggcttcagcctgctgaggaagatctccatgagacatgatggcaacatggtgttcagccccttcggcatgagcctggccatgacaggcctgatgctgggcgccaccggccccacagagacccagatcaagaggggcctgcacctgcaggccctgaagcccaccaagccaggcctgctgcccagcctcttcaagggcctgcgggagaccctgagcaggaacctggagctgggcctgacccagggcagctttgccttcatccacaaggactttgatgtgaaggagaccttcttcaacctgagcaagcgctactttgacacagaatgtgtgcccatgaacttcagaaatgccagccaggccaagaggctgatgaaccactacatcaacaaggagacccggggcaagatccccaagctgtttgatgagatcaaccctgagaccaagctgatcctggtggactacatcctcttcaagggcaagtggctgaccccatttgaccccgtcttcacagaggtggacaccttccacctggacaagtacaagaccatcaaggtgcccatgatgtacggggccggcaagtttgccagcacctttgacaagaacttccgctgccacgtgctgaagctgccctaccagggcaatgccaccatgctggtggtgctgatggagaagatgggagaccacctggccctggaggactacctgaccacagacctggtggagacctggctgaggaacatgaagaccaggaacatggaggtgttcttccccaagttcaagctggaccagaagtatgagatgcatgagctgctgcggcagatgggcatccgccgcatcttcagcccctttgctgacctgtctgagctgagcgccactggaagaaacctgcaggtgtcccgggtgctgcagaggacagtcatcgaggtggatgagcggggcacagaagctgtggccggcatcctgtctgagatcacagcctacagcatgcctcctgtgatcaaggtggaccggcccttccacttcatgatctatgaggagaccagcggcatgctgctcttcctgggccgggtggtgaaccccaccctgctgtag

SEQ ID NO: 169372 - DNA, 288 bp, Artificial Sequence
  Description of Artificial Sequence: Synthetic coding sequence
atggagaggatgctgcccctgctggccctgggcctgctggccgccggcttctgcccagctgtgctgtgccaccccaacagccccctggatgaggagaacctgacccaggagaaccaggaccggggcacccacgtggacctgggcctggccagcgccaacgtggactttgccttcagcctgtacaagcacccccaccgctggagcatccggctgtgcctgatgtacctgcggcgggcccagaagcacctgctgccccagcagagcaagagccccagcttcctgcactag

SEQ ID NO: 169373 - DNA, 1272 bp, Artificial Sequence
  Description of Artificial Sequence: Synthetic coding sequence
atggagaggatgctgcccctgctggccctgggcctgctggccgccggcttctgcccagctgtgctgtgccaccccaacagccccctggatgaggagaacctgacccaggagaaccaggaccggggcacccacgtggacctgggcctggccagcgccaacgtggactttgccttcagcctgtacaagcagctggtgctgaaggccccagacaagaatgtcatcttcagccccctgagcatcagcacagccctggccttcctgagcctgggcgcccacaacaccaccctgacagagatcctgaagggcctgaagttcaacctgacagagaccagcgaggccgagatccaccagagcttccagcacctgctgcggaccctgaaccagagcagtgatgagctgcagctgtccatgggaaatgccatgtttgtgaaggagcagctgagcctgctggaccgcttcacagaagatgccaagaggctgtatggcagcgaggcctttgccacagacttccaggacagcgctgctgccaagaagctgatcaatgactatgtgaagaatggcacccggggcaagatcacagacctgatcaaggacctggacagccagaccatgatggtgctggtgaactacatcttcttcaaggccaagtgggagatgccctttgacccccaggacacccaccagagccgcttctacctgagcaagaagaagtgggtgatggtgcccatgatgagcctgcaccacctgaccatcccctacttcagagatgaggagctgagctgcaccgtggtggagctgaagtacacaggaaatgccagcgccctcttcatcctgcctgaccaggacaagatggaggaggtggaggccatgctgctgcctgagaccctgaagcgctggagggacagcctggagttccgggagatcggggagctgtacctgcccaagttcagcatcagccgggactacaacctgaatgacatcctgctgcagctgggcatcgaggaggccttcaccagcaaggctgacctgagcggcatcactggagccaggaacctggccgtgtcccaggtggtgcacaaggctgtgctggatgtgtttgaggagggcacagaggccagcgctgccacagctgtgaagatcaccctgctgagcgccctggtggagaccaggaccatcgtgcgcttcaaccggcccttcctgatgatcatcgtgcccacagacacccagaacatcttcttcatgagcaaggtgaccaaccccaagcaggcctag

SEQ ID NO: 169374 - DNA, 1272 bp, Artificial Sequence; identical to SEQ ID NO: 169373
  Description of Artificial Sequence: Synthetic coding sequence

SEQ ID NO: 169375 - DNA, 1272 bp, Artificial Sequence; identical to SEQ ID NO: 169373
  Description of Artificial Sequence: Synthetic coding sequence

SEQ ID NO: 169376 - DNA, 1347 bp, Artificial Sequence
  Description of Artificial Sequence: Synthetic coding sequence
atgaagatccactacagccggcagacagccctggagagcaccagctacatccagctgcctgaggccgagctgaggatggagaggatgctgcccctgctggccctgggcctgctggccgccggcttctgcccagctgtgctgtgccaccccaacagccccctggatgaggagaacctgacccaggagaaccaggaccggggcacccacgtggacctgggcctggccagcgccaacgtggactttgccttcagcctgtacaagcagctggtgctgaaggccccagacaagaatgtcatcttcagccccctgagcatcagcacagccctggccttcctgagcctgggcgcccacaacaccaccctgacagagatcctgaagggcctgaagttcaacctgacagagaccagcgaggccgagatccaccagagcttccagcacctgctgcggaccctgaaccagagcagtgatgagctgcagctgtccatgggaaatgccatgtttgtgaaggagcagctgagcctgctggaccgcttcacagaagatgccaagaggctgtatggcagcgaggcctttgccacagacttccaggacagcgctgctgccaagaagctgatcaatgactatgtgaagaatggcacccggggcaagatcacagacctgatcaaggacctggacagccagaccatgatggtgctggtgaactacatcttcttcaaggccaagtgggagatgccctttgacccccaggacacccaccagagccgcttctacctgagcaagaagaagtgggtgatggtgcccatgatgagcctgcaccacctgaccatcccctacttcagagatgaggagctgagctgcaccgtggtggagctgaagtacacaggaaatgccagcgccctcttcatcctgcctgaccaggacaagatggaggaggtggaggccatgctgctgcctgagaccctgaagcgctggagggacagcctggagttccgggagattggagagctgtacctgcccaagttcagcatcagccgggactacaacctgaatgacatcctgctgcagctgggcatcgaggaggccttcaccagcaaggctgacctgagcggcatcaccggggccaggaacctggccgtgtcccaggtggtgcacaaggctgtgctggatgtgtttgaggagggcacagaggccagcgctgccacagctgtgaagatcaccctgctgagcgccctggtggagaccaggaccatcgtgcgcttcaaccggcccttcctgatgatcatcgtgcccacagacacccagaacatcttcttcatgagcaaggtgaccaaccccaagcaggcctag

SEQ ID NO: 169377 - DNA, 918 bp, Artificial Sequence
  Description of Artificial Sequence: Synthetic coding sequence
atggagaggatgctgcccctgctggccctgggcctgctggccgccggcttctgcccagctgtgctgtgccaccccaacagccccctggatgaggagaacctgacccaggagaaccaggaccggggcacccacgtggacctgggcctggccagcgccaacgtggactttgccttcagcctgtacaagcagctggtgctgaaggccccagacaagaatgtcatcttcagccccctgagcatcagcacagccctggccttcctgagcctgggcgcccacaacaccaccctgacagagatcctgaagggcctgaagttcaacctgacagagaccagcgaggccgagatccaccagagcttccagcacctgctgcggaccctgaaccagagcagtgatgagctgcagctgtccatgggaaatgccatgtttgtgaaggagcagctgagcctgctggaccgcttcacagaagatgccaagaggctgtatggcagcgaggcctttgccacagacttccaggacagcgctgctgccaagaagctgatcaatgactatgtgaagaatggcacccggggcaagatcacagacctgatcaaggacctggacagccagaccatgatggtgctggtgaactacatcttcttcaaggccaagtgggagatgccctttgacccccaggacacccaccagagccgcttctacctgagcaagaagaagtgggtgatggtgcccatgatgagcctgcaccacctgaccatcccctacttcagagatgaggagctgagctgcaccgtggtggagctgaagtacacaggaaatgccagcgccctcttcatcctgcctgaccaggacaagatggaggaggtggaggccatgctgctgcctgagaccctgaagcgctggagggacagcctggagttctag

SEQ ID NO: 169378 - DNA, 1284 bp, Artificial Sequence
  Description of Artificial Sequence: Synthetic coding sequence
atgcacctgattgactacctgctgctgctgctggtgggcctgctggccctgagccacggccagctgcacgtggagcatgatggagagagctgcagcaacagcagccaccagcagatcctggagaccggggagggcagccccagcctgaagatcgccccagccaatgctgactttgccttccgcttctactacctgattgccagcgagaccccaggcaagaacatcttcttcagccccctgagcatctctgctgcctatgccatgctgagcctgggcgcctgcagccacagccgcagccagatcctggagggcctgggcttcaacctgacagagctgtctgagagtgatgtgcaccggggcttccagcacctgctgcacaccctgaacctgcccggccacggcctggagaccagggtgggcagcgccctcttcctgagccacaacctgaagttcctggccaagttcctgaatgacaccatggctgtgtatgaggccaagctgttccacaccaacttctatgacacagtgggcaccatccagctgatcaatgaccacgtgaagaaggagacccggggcaagatcgtggacctggtgtctgagctgaagaaggatgtgctgatggtgctggtgaactacatctacttcaaggccctgtgggagaagcccttcatcagcagcaggaccacccccaaggacttctacgtggatgagaacaccaccgtgcgggtgcccatgatgctgcaggaccaggagcaccactggtacctgcatgaccgctacctgccctgcagcgtgctgaggatggactacaagggagatgccaccgtcttcttcatcctgcccaaccagggcaagatgagagaaattgaggaggtgctgaccccagagatgctgatgcgctggaacaacctgctgaggaagaggaacttctacaagaagctggagctgcacctgcccaagttcagcatcagcggcagctatgtgctggaccagatcctgccccggctgggcttcacagacctcttcagcaagtgggccgacctgagcggcatcaccaagcagcagaagctggaggccagcaagagcttccacaaggccaccctggatgtggatgaagctggaacagaagctgctgctgccaccagctttgccatcaagttcttcagcgcccagaccaacagacacatcctgcgcttcaaccggcccttcctggtggtgatcttcagcaccagcacccagagcgtgctcttcctgggcaaggtggtggaccccaccaagccctag

SEQ ID NO: 169379 - DNA, 1284 bp, Artificial Sequence; identical to SEQ ID NO: 169378
  Description of Artificial Sequence: Synthetic coding sequence

SEQ ID NO: 169380 - DNA, 1284 bp, Artificial Sequence; identical to SEQ ID NO: 169378
  Description of Artificial Sequence: Synthetic coding sequence

SEQ ID NO: 169381 - DNA, 1218 bp, Artificial Sequence
  Description of Artificial Sequence: Synthetic coding sequence
atgcccctgctgctgtacacctgcctgctgtggctgcccaccagcggcctgtggacagtgcaggccatggaccccaatgctgcctacgtgaacatgagcaaccaccaccggggcctggccagcgccaacgtggactttgccttcagcctgtacaagcacctggtggccctgagccccaagaagaacatcttcatcagccctgtgtccatctccatggccctggccatgctgagcctgggcacctgtggccacacccgggcccagctgctgcagggcctgggcttcaacctgacagagaggagtgaaacagagatccaccagggcttccagcacctgcaccagctgtttgccaagagtgacaccagcctggagatgaccatgggaaatgccctcttcctggatggcagcctggagctgctggagagcttctctgctgacatcaagcactactatgaaagtgaggtgctggccatgaacttccaggactgggccacagccagccggcagatcaacagctatgtgaagaacaagacccagggcaagatcgtggacctcttcagcggcctggacagccctgccatcctggtgctggtgaactacatcttcttcaagggcacctggacccagccctttgacctggccagcacccgggaggagaacttctacgtggatgagaccaccgtggtgaaggtgcccatgatgctgcagagcagcaccatctcctacctgcatgacagcgagctgccctgccagctggtgcagatgaactacgtgggcaatggcaccgtcttcttcatcctgcctgacaagggcaagatgaacacagtgattgctgccctgagccgggacaccatcaaccgctggagcgctggcctgaccagcagccaggtggacctgtacatccccaaggtgaccatctctggagtgtatgacctgggagatgtgctggaggagatgggcattgctgacctcttcaccaaccaggccaacttcagccgcatcacccaggatgcccagctgaagagcagcaaggtggtgcacaaggctgtgctgcagctgaatgaggagggcgtggacacagctggcagcactggagtgaccctgaacctgaccagcaagcccatcatcctgcgcttcaaccagcccttcatcatcatgatctttgaccacttcacctggagcagcctcttcctggcccgggtgatgaaccctgtgtag

SEQ ID NO: 169382 - DNA, 411 bp, Artificial Sequence
  Description of Artificial Sequence: Synthetic coding sequence
atgcccctgctgctgtacacctgcctgctgtggctgcccaccagcggcctgtggacagtgcaggccatggaccccaatgctgcctacgtgaacatgagcaaccaccaccggggcctggccagcgccaacgtggactttgccttcagcctgtacaagcacctggtggccctgagccccaagaagaacatcttcatcagccctgtgtccatctccatggccctggccatgctgagcctgggcacctgtggccacacccgggcccagctgctgcagggcctgggcttcaacctgacagagaggagtgaaacagagatccaccagggcttccagcacctgcaccagctgtttgccaagagtgacaccagcctggagatgaccatgggaaatgccctcttcctggatggcagctag

SEQ ID NO: 169383 - DNA, 1194 bp, Artificial Sequence
  Description of Artificial Sequence: Synthetic coding sequence
atggacagcctggccaccagcatcaaccagtttgccctggagctgagcaagaagctggccgagagcgcccagggcaagaacatcttcttcagctcctggagcatcagcaccagcctgaccatcgtgtacctgggcgccaagggcaccacagctgcccagatggcccaggtgctgcagttcaacagagaccagggcgtgaagtgtgaccctgagagcgagaagaagaggaagatggagttcaacctgagcaacagcgaggagatccacagcgacttccagaccctcatcagcgagatcctgaagcccaatgatgactacctgctgaagacagccaatgccatctatggagagaagacctacgccttccacaacaagtacctggaggacatgaagacctactttggagctgagccccagcctgtgaactttgtggaggccagtgaccagatcaggaaggacatcaacagctgggtggagcggcagacagagggcaagatccagaacctgctgcctgatgacagcgtggacagcaccaccaggatgatcctggtgaatgccctgtacttcaagggcatctgggagcaccagttcctggtgcagaacaccacagagaagcccttccgcatcaatgagaccaccagcaagcctgtgcagatgatgttcatgaagaagaagctgcacatcttccacatcgagaagcccaaggctgtgggcctgcagctgtactacaagagccgggacctgagcctgctgatcctgctgcctgaggacatcaatggcctggagcagctggagaaggccatcacctatgagaagctgaatgagtggaccagcgctgacatgatggagctgtatgaggtgcagctgcacctgcccaagttcaagctggaggacagctatgacctgaagagcaccctgagctccatgggcatgtctgatgccttcagccagagcaaggctgacttcagcggcatgagcagcgccaggaacctcttcctgagcaatgtgttccacaaggcctttgtggagatcaatgagcagggcacagaagctgctgctggcagcggcagcgagattgacatccgcatccgggtgcccagcattgagttcaatgccaaccaccccttcctgttcttcatccgccacaacaagaccaacaccatcctcttctacggccgcctgtgcagcccctag

SEQ ID NO: 169384 - DNA, 1020 bp, Artificial Sequence
  Description of Artificial Sequence: Synthetic coding sequence
atggacagcctgggcgctgtgtccacccggctgggctttgacctcttcaaggagctgaagaagaccaatgatggcaacatcttcttcagccctgtgggcatcctgacagccatcggcatggtgctgctgggcaccaggggggccacagccagccagctggaggaggtgttccacagcgagaaggagaccaagagcagccgcatcaaggccgaggagaaggaggtgattgaaaatacagaagctgtgcaccagcagttccagaagttcctgacagagatcagcaagctgaccaatgactatgagctgaacatcaccaaccggctgtttggagagaagacctacctgttcctgcagaagtacctggactatgtggagaagtactaccacgccagcctggagcctgtggactttgtgaatgctgctgatgagagcaggaagaagatcaacagctgggtggagagcaagaccaatgagaagatcaaggacctcttcccagatggcagcatcagcagcagcaccaagctggtgctggtgaacatggtgtacttcaagggccagtgggaccgggagttcaagaaggagaacaccaaggaggagaagttctggatgaacaagatcatcgacaagatcagccctgagaagctggtggagtggaccagccctggccacatggaggagaggaaggtgaacctgcacctgcccaggtttgaggtggaggatggctatgacctggaggccgtgctggccgccatgggcatgggagatgccttcagcgagcacaaggctgactacagcggcatgagcagcggcagcggcctgtatgcccagaagttcctgcacagcagctttgtggccgtgacagaggagggcacagaagctgctgctgccactggaattggcttcaccgtgaccagcgcccctggccatgaaaatgtgcactgcaaccaccccttcctgttcttcatccgccacaatgaaagcaacagcatcctcttcttcggccgcttcagcagcccctag

SEQ ID NO: 169385 - DNA, 1176 bp, Artificial Sequence
  Description of Artificial Sequence: Synthetic coding sequence
atggacagcctgggcgctgtgtccacccggctgggctttgacctcttcaaggagctgaagaagaccaatgatggcaacatcttcttcagccctgtgggcatcctgacagccatcggcatggtgctgctgggcaccaggggggccacagccagccagctggaggaggtgttccacagcgagaaggagaccaagagcagccgcatcaaggccgaggagaaggaggtgattgaaaatacagaagctgtgcaccagcagttccagaagttcctgacagagatcagcaagctgaccaatgactatgagctgaacatcaccaaccggctgtttggagagaagacctacctgttcctgcagaagtacctggactatgtggagaagtactaccacgccagcctggagcctgtggactttgtgaatgctgctgatgagagcaggaagaagatcaacagctgggtggagagcaagaccaatgagaagatcaaggacctcttcccagatggcagcatcagcagcagcaccaagctggtgctggtgaacatggtgtacttcaagggccagtgggaccgggagttcaagaaggagaacaccaaggaggagaagttctggatgaacaagagcaccagcaagtctgtgcagatgatgacccagagccacagcttctccttcaccttcctggaggacctgcaggccaagatcctgggcatcccctacaagaacaatgacctgtccatgtttgtgctgctgcccaatgacattgatggcctggagaagatcatcgacaagatcagccctgagaagctggtggagtggaccagccctggccacatggaggagaggaaggtgaacctgcacctgcccaggtttgaggtggaggatggctatgacctggaggccgtgctggccgccatgggcatgggagatgccttcagcgagcacaaggctgactacagcggcatgagcagcggcagcggcctgtatgcccagaagttcctgcacagcagctttgtggccgtgacagaggagggcacagaagctgctgctgccactggaattggcttcaccgtgaccagcgcccctggccatgaaaatgtgcactgcaaccaccccttcctgttcttcatccgccacaatgaaagcaacagcatcctcttcttcggccgcttcagcagcccctag

SEQ ID NO: 169386 - DNA, 930 bp, Artificial Sequence
  Description of Artificial Sequence: Synthetic coding sequence
atggacagcctgggcgctgtgtccacccggctgggctttgacctcttcaaggagctgaagaagaccaatgatggcaacatcttcttcagccctgtgggcatcctgacagccatcggcatggtgctgctgggcaccaggggggccacagccagccagctggaggaggtgttccacagcgagaaggagaccaagagcagccgcatcaaggccgaggagaaggaggtggagaagatcaaggacctcttcccagatggcagcatcagcagcagcaccaagctggtgctggtgaacatggtgtacttcaagggccagtgggaccgggagttcaagaaggagaacaccaaggaggagaagttctggatgaacaagagcaccagcaagtctgtgcagatgatgacccagagccacagcttctccttcaccttcctggaggacctgcaggccaagatcctgggcatcccctacaagaacaatgacctgtccatgtttgtgctgctgcccaatgacattgatggcctggagaagatcatcgacaagatcagccctgagaagctggtggagtggaccagccctggccacatggaggagaggaaggtgaacctgcacctgcccaggtttgaggtggaggatggctatgacctggaggccgtgctggccgccatgggcatgggagatgccttcagcgagcacaaggctgactacagcggcatgagcagcggcagcggcctgtatgcccagaagttcctgcacagcagctttgtggccgtgacagaggagggcacagaagctgctgctgccactggaattggcttcaccgtgaccagcgcccctggccatgaaaatgtgcactgcaaccaccccttcctgttcttcatccgccacaatgaaagcaacagcatcctcttcttcggccgcttcagcagcccctag

SEQ ID NO: 169387 - DNA, 1173 bp, Artificial Sequence
  Description of Artificial Sequence: Synthetic coding sequence
atgaacagcctgtctgaggccaacaccaagttcatgtttgacctcttccagcagttcaggaagagcaaggagaacaacatcttctacagccccatcagcatcaccagcgccctgggcatggtgctgctgggcgccaaggacaacacagcccagcagatcaagaaggtgctgcactttgaccaggtgacagagaacaccaccgggaaggccgccacctaccacgtggacagaagtggaaatgtgcaccaccagttccagaagctgctgacagagttcaacaagagcacagatgcctatgagctgaagatcgccaacaagctgtttggagagaagacctacctgttcctgcaggagtacctggatgccatcaagaagttctaccagacctctgtggagagcgtggactttgccaatgcccctgaggagagcaggaagaagatcaacagctgggtggagagccagaccaatgagaagatcaagaacctgatccctgagggcaacatcggcagcaacaccaccctggtgctggtgaatgccatctacttcaagggccagtgggagaagaagttcaacaaggaggacaccaaggaggagaagttctggcccaacaagaacacctacaagagcatccagatgatgaggcagtacaccagcttccactttgccagcctggaggatgtgcaggccaaggtgctggagatcccctacaagggcaaggacctgtccatgattgtgctgctgcccaatgaaattgatggcctgcagaagctggaggagaagctgacagctgagaagctgatggagtggaccagcctgcagaacatgagggagaccagggtggacctgcacctgccccgcttcaaggtggaggagagctatgacctgaaggacaccctgcggaccatgggcatggtggacatcttcaatggagatgctgacctgagcggcatgacaggcagccggggcctggtgctgagcggcgtgctgcacaaggcctttgtggaggtgacagaggagggcgctgaggccgctgctgccacagctgtggtgggcttcggcagcagccccaccagcaccaatgaggagttccactgcaaccaccccttcctgttcttcatccggcagaacaagaccaacagcatcctcttctacggccgcttcagcagcccctag

SEQ ID NO: 169388 - DNA, 1173 bp, Artificial Sequence
  Description of Artificial Sequence: Synthetic coding sequence
atgaacagcctgtctgaggccaacaccaagttcatgtttgacctcttccagcagttcaggaagagcaaggagaacaacatcttctacagccccatcagcatcaccagcgccctgggcatggtgctgctgggcgccaaggacaacacagcccagcagatcagcaaggtgctgcactttgaccaggtgacagagaacaccacagagaaggccgccacctaccacgtggacagaagtggaaatgtgcaccaccagttccagaagctgctgacagagttcaacaagagcacagatgcctatgagctgaagatcgccaacaagctgtttggagagaagacctaccagttcctgcaggagtacctggatgccatcaagaagttctaccagacctctgtggagagcacagactttgccaatgcccctgaggagagcaggaagaagatcaacagctgggtggagagccagaccaatgagaagatcaagaacctcttcccagatggcaccatcggaaatgacaccaccctggtgctggtgaatgccatctacttcaagggccagtgggagaacaagttcaagaaggagaacaccaaggaggagaagttctggcccaacaagaacacctacaagtctgtgcagatgatgaggcagtacaacagcttcaactttgccctgctggaggatgtgcaggccaaggtgctggagatcccctacaagggcaaggacctgtccatgattgtgctgctgcccaatgaaattgatggcctgcagaagctggaggagaagctgacagctgagaagctgatggagtggaccagcctgcagaacatgagggagacctgtgtggacctgcacctgccccgcttcaagatggaggagagctatgacctgaaggacaccctgcggaccatgggcatggtgaacatcttcaatggagatgctgacctgagcggcatgacctggagccacggcctgtctgtgtccaaggtgctgcacaaggcctttgtggaggtgacagaggagggcgtggaggccgctgctgccacagctgtggtggtggtggagctgagcagccccagcaccaatgaggagttctgctgcaaccaccccttcctgttcttcatccggcagaacaagaccaacagcatcctcttctacggccgcttcagcagcccctag

SEQ ID NO: 169389 - DNA, 1017 bp, Artificial Sequence
  Description of Artificial Sequence: Synthetic coding sequence
atgaacagcctgtctgaggccaacaccaagttcatgtttgacctcttccagcagttcaggaagagcaaggagaacaacatcttctacagccccatcagcatcaccagcgccctgggcatggtgctgctgggcgccaaggacaacacagcccagcagatcagcaaggtgctgcactttgaccaggtgacagagaacaccacagagaaggccgccacctaccacgtggacagaagtggaaatgtgcaccaccagttccagaagctgctgacagagttcaacaagagcacagatgcctatgagctgaagatcgccaacaagctgtttggagagaagacctaccagttcctgcaggagtacctggatgccatcaagaagttctaccagacctctgtggagagcacagactttgccaatgcccctgaggagagcaggaagaagatcaacagctgggtggagagccagaccaatgagaagatcaagaacctcttcccagatggcaccatcggaaatgacaccaccctggtgctggtgaatgccatctacttcaagggccagtgggagaacaagttcaagaaggagaacaccaaggaggagaagttctggcccaacaagctggaggagaagctgacagctgagaagctgatggagtggaccagcctgcagaacatgagggagacctgtgtggacctgcacctgccccgcttcaagatggaggagagctatgacctgaaggacaccctgcggaccatgggcatggtgaacatcttcaatggagatgctgacctgagcggcatgacctggagccacggcctgtctgtgtccaaggtgctgcacaaggcctttgtggaggtgacagaggagggcgtggaggccgctgctgccacagctgtggtggtggtggagctgagcagccccagcaccaatgaggagttctgctgcaaccaccccttcctgttcttcatccggcagaacaagaccaacagcatcctcttctacggccgcttcagcagcccctag

SEQ ID NO: 169390 - DNA, 1128 bp, Artificial Sequence
  Description of Artificial Sequence: Synthetic coding sequence
atggatgccctgcagctggccaacagcgcctttgctgtggacctcttcaagcagctgtgtgagaaggagcccctgggcaatgtgctcttcagccccatctgcctgagcaccagcctgagcctggcccaggtgggcgccaagggggacacagccaatgagatcggccaggtgctgcactttgaaaatgtgaaggatgtgcccttcggcttccagacagtgaccagtgatgtgaacaagctgagcagcttctacagcctgaagctgatcaagaggctgtatgtggacaagagcctgaacctgagcacagagttcatcagcagcaccaagaggccctatgccaaggagctggagaccgtggacttcaaggacaagctggaggagaccaagggccagatcaacaacagcatcaaggacctgacagatggccactttgagaacatcctggccgacaacagcgtgaatgaccagaccaagatcctggtggtgaatgctgcctactttgtgggcaagtggatgaagaagttcagcgagagcgagaccaaggagtgccccttccgggtgaacaagacagacaccaagcctgtgcagatgatgaacatggaggccaccttctgcatgggcaacatcgacagcatcaactgcaagatcatcgagctgcccttccagaacaagcacctgtccatgttcatcctgctgcccaaggatgtggaggatgagagcacaggcctggagaagattgagaagcagctgaacagcgagagcctgagccagtggaccaaccccagcaccatggccaatgccaaggtgaagctgagcatccccaagttcaaggtggagaagatgattgaccccaaggcctgcctggagaacctgggcctgaagcacatcttcagcgaggacaccagtgacttcagcggcatgtctgagaccaagggcgtggccctgagcaatgtcatccacaaggtgtgcctggagatcacagaagatggaggagacagcattgaggtgcctggggcccgcatcctgcagcacaaggatgagctgaatgctgaccaccccttcatctacatcatccgccacaacaagaccaggaacatcatcttcttcggcaagttctgcagcccctag

SEQ ID NO: 169391 - DNA, 390 bp, Artificial Sequence
  Description of Artificial Sequence: Synthetic coding sequence
atggatgccctgcagctggccaacagcgcctttgctgtggacctcttcaagcagctgtgtgagaaggagcccctgggcaatgtgctcttcagccccatctgcctgagcaccagcctgagcctggcccaggtgggcgccaagggggacacagccaatgagatcggccaggtgctgcactttgaaaatgtgaaggatgtgcccttcggcttccagacagtgaccagtgatgtgaacaagctgagcagcttctacagcctgaagctgatcaagaggctgtatgtggacaagagcctgaacctgagcacagagttcatcagcagcaccaagaggccctatgccaaggagctggagaccgtggacttcaaggacaagctggaggagaccaagtag

SEQ ID NO: 169392 - DNA, 1131 bp, Artificial Sequence
  Description of Artificial Sequence: Synthetic coding sequence
atggatgtgctggccgaggccaacggcacctttgccctgaacctgctgaagaccctgggcaaggacaacagcaagaatgtgttcttcagccccatgtccatgagctgtgccctggccatggtgtacatgggcgccaagggcaacacagctgcccagatggcccagatcctgtccttcaacaagagcggcggcggcggggacatccaccagggcttccagagcctgctgacagaggtgaacaagacaggcacccagtacctgctgaggatggccaaccggctgtttggagagaagagctgtgacttcctgagcagcttccgggacagctgccagaagttctaccaggccgagatggaggagctggacttcatctctgctgtggagaagagcaggaagcacatcaacacctgggtggccgagaagacagagggcaagattgctgagctgctgagccctggctctgtggaccccctgacccggctggtgctggtgaatgctgtgtacttccggggcaactgggatgagcagtttgacaaggagaacacagaggagcggctcttcaaggtgtccaagaatgaggagaagcctgtgcagatgatgttcaagcagagcaccttcaagaagacctacatcggggagatcttcacccagatcctggtgctgccctacgtgggcaaggagctgaacatgatcatcatgctgcctgatgagaccacagacctgaggacagtggagaaggagctgacctatgagaagtttgtggagtggacccggctggacatgatggatgaggaggaggtggaggtgtccctgccccgcttcaagctggaggagagctatgacatggagagcgtgctgaggaacctgggcatgacagatgcctttgagctgggcaaggctgacttcagcggcatgagccagacagacctgagcctgagcaaggtggtgcacaagagctttgtggaggtgaatgaggagggcacagaggccgccgccgccacagctgccatcatgatgatgagatgtgccaggtttgtgccccgcttctgtgccgaccaccccttcctgttcttcatccagcacagcaagaccaacggcatcctcttctgtggccgcttcagcagcccctag

SEQ ID NO: 169393 - DNA, 546 bp, Artificial Sequence
  Description of Artificial Sequence: Synthetic coding sequence
tgactgaacctgctgaagaccctgggcaaggacaacagcaagaatgtgttcttcagccccatgtccatgagctgtgccctggccatggtgtacatgggcgccaagggcaacacagctgcccagatggcccagatcctgtccttcaacaagagcggcggcggcggggacatccaccagggcttccagagcctgctgacagaggtgaacaagacaggcacccagtacctgctgaggatggccaaccgggagagctatgacatggagagcgtgctgaggaacctgggcatgacagatgcctttgagctgggcaaggctgacttcagcggcatgagccagacagacctgagcctgagcaaggtggtgcacaagagctttgtggaggtgaatgaggagggcacagaagctgctgctgccacagctgccatcatgatgatgagatgtgccaggtttgtgccccgcttctgtgccgaccaccccttcctgttcttcatccagcacagcaagaccaacggcatcctcttctgtggccgcttcagcagcccctag

SEQ ID NO: 169394 - DNA, 1131 bp, Artificial Sequence; identical to SEQ ID NO: 169392
  Description of Artificial Sequence: Synthetic coding sequence

SEQ ID NO: 169395 - DNA, 1131 bp, Artificial Sequence; identical to SEQ ID NO: 169392
  Description of Artificial Sequence: Synthetic coding sequence

SEQ ID NO: 169396 - DNA, 1131 bp, Artificial Sequence; identical to SEQ ID NO: 169392
  Description of Artificial Sequence: Synthetic coding sequence

SEQ ID NO: 169397 - DNA, 1131 bp, Artificial Sequence; identical to SEQ ID NO: 169392
  Description of Artificial Sequence: Synthetic coding sequence

SEQ ID NO: 169398 - DNA, 1131 bp, Artificial Sequence; identical to SEQ ID NO: 169392
  Description of Artificial Sequence: Synthetic coding sequence

SEQ ID NO: 169399 - DNA, 579 bp, Artificial Sequence
  Description of Artificial Sequence: Synthetic coding sequence
atggatgtgctggccgaggccaacggcacctttgccctgaacctgctgaagaccctgggcaaggacaacagcaagaatgtgttcttcagccccatgtccatgagctgtgccctggccatggtgtacatgggcgccaagggcaacacagctgcccagatggcccagatcctgtccttcaacaagagcggcggcggcggggacatccaccagggcttccagagcctgctgacagaggtgaacaagacaggcacccagtacctgctgaggatggccaaccgggagagctatgacatggagagcgtgctgaggaacctgggcatgacagatgcctttgagctgggcaaggctgacttcagcggcatgagccagacagacctgagcctgagcaaggtggtgcacaagagctttgtggaggtgaatgaggagggcacagaggccgccgccgccacagctgccatcatgatgatgagatgtgccaggtttgtgccccgcttctgtgccgaccaccccttcctgttcttcatccagcacagcaagaccaacggcatcctcttctgtggccgcttcagcagcccctag

SEQ ID NO: 169400 - DNA, 1143 bp, Artificial Sequence
  Description of Artificial Sequence: Synthetic coding sequence
atggccagcctggccgccgccaatgctgagttctgcttcaacctcttccgggagatggatgacaaccagggcaatggaaatgtgttcttcagcagcctgagcctgtttgctgccctggccctggtgcggctgggcgcccaggatgacagcctgagccagattgacaagctgctgcacgtgaacacagccagcggctacggcaacagcagcaacagccagagcggcctgcagagccagctgaagagggtcttcagtgacatcaatgccagccacaaggactatgacctgagcatcgtgaatggcctgtttgctgagaaggtgtatggcttccacaaggactacattgaatgtgccgagaagctgtatgatgccaaggtggagcgggtggacttcaccaaccacctggaggacaccaggaggaacatcaacaagtgggtggagaatgagacccacggcaagatcaagaatgtcatcggggagggcggcatcagcagcagcgctgtgatggtgctggtgaatgctgtgtacttcaagggcaagtggcagagcgccttcaccaagtctgagaccatcaactgccacttcaagagccccaagtgcagcggcaaggctgtggccatgatgcaccaggagaggaagttcaacctgtctgtgattgaggaccccagcatgaagatcctggagctgcgctacaacggcggcatcaacatgtatgtgctgctgcctgaaaatgacctgtctgaaattgagaacaagctgaccttccagaacctgatggagtggaccaaccccaggaggatgaccagcaaatatgtggaggtgttcttcccccagttcaagattgagaagaactatgagatgaagcagtacctgcgggccctgggcctgaaggacatctttgatgagagcaaggctgacctgagcggcatcgccagcggcggccgcctgtacatcagcaggatgatgcacaagagctacatcgaggtgacagaggagggcacagaggccacagctgccaccggcagcaacatcgtggagaagcagctgccccagagcaccctcttccgggctgaccaccccttcctgtttgtgatcaggaaggatgacatcatcctcttcagcggcaaggtgtcctgcccctag

SEQ ID NO: 169401 - DNA, 1143 bp, Artificial Sequence; identical to SEQ ID NO: 169400
  Description of Artificial Sequence: Synthetic coding sequence

SEQ ID NO: 169402 - DNA, 387 bp, Artificial Sequence
  Description of Artificial Sequence: Synthetic coding sequence
atggccagcctggccgccgccaatgctgagttctgcttcaacctcttccgggagatggatgacaaccagggcaatggaaatgtgttcttcagcagcctgagcctgtttgctgccctggccctggtgcggctgggcgcccaggatgacagcctgagccagattgacaagctgctgcacgtgaacacagccagcggctacggcaacagcagcaacagccagagcggcctgcagagccagctgaagagggtcttcagtgacatcaatgccagccacaaggactatgacctgagcatcgtgaatggcctgtttgctgagaaggtgtatggcttccacaaggactacattgaatgtgccgagaagctgtatgatgccaaggtggagaggtag

SEQ ID NO: 169403 - DNA, 387 bp, Artificial Sequence; identical to SEQ ID NO: 169402
  Description of Artificial Sequence: Synthetic coding sequence

SEQ ID NO: 169404 - DNA, 498 bp, Artificial Sequence
  Description of Artificial Sequence: Synthetic coding sequence
atggccagcctggccgccgccaatgctgagttctgcttcaacctcttccgggagatggatgacaaccagggcaatggaaatgtgttcttcagcagcctgagcctgtttgctgccctggccctggtgcggctgggcgcccaggatgacagcctgagccagattgacaagctgctgcacgtgaacacagccagcggctacggcaacagcagcaacagccagagcggcctgcagagccagctgaagagggtcttcagtgacatcaatgccagccacaaggactatgacctgagcatcgtgaatggcctgtttgctgagaaggtgtatggcttccacaaggactacattgaatgtgccgagaagctgtatgatgccaaggtggagcgggtggacttcaccaaccacctggaggacaccaggaggaacatcaacaagtgggtggagaatgagacccacggcaagatcaagaatgtcatcggggagggcggcatcagcagctag

SEQ ID NO: 169405 - DNA, 1092 bp, Artificial Sequence
  Description of Artificial Sequence: Synthetic coding sequence
atggccagcctggccgccgccaatgctgagttctgcttcaacctcttccgggagatggatgacaaccagggcaatggaaatgtgttcttcagcagcctgagcctgtttgctgccctggccctggtgcggctgggcgcccaggatgacagcctgagccagattgacaagagcggcctgcagagccagctgaagagggtcttcagtgacatcaatgccagccacaaggactatgacctgagcatcgtgaatggcctgtttgctgagaaggtgtatggcttccacaaggactacattgaatgtgccgagaagctgtatgatgccaaggtggagcgggtggacttcaccaaccacctggaggacaccaggaggaacatcaacaagtgggtggagaatgagacccacggcaagatcaagaatgtgattggagagggcggcatcagcagcagcgctgtgatggtgctggtgaatgctgtgtacttcaagggcaagtggcagagcgccttcaccaagtctgagaccatcaactgccacttcaagagccccaagtgcagcggcaaggctgtggccatgatgcaccaggagaggaagttcaacctgtctgtgattgaggaccccagcatgaagatcctggagctgcgctacaatggaggcatcaacatgtatgtgctgctgcctgaaaatgacctgtctgaaattgagaacaagctgaccttccagaacctgatggagtggaccaaccccaggaggatgaccagcaaatatgtggaggtgttcttcccccagttcaagattgagaagaactatgagatgaagcagtacctgcgggccctgggcctgaaggacatctttgatgagagcaaggctgacctgtctggaattgccagcggcggccgcctgtacatcagcaggatgatgcacaagagctacatcgaggtgacagaggagggcacagaggccacagctgccaccggcagcaacatcgtggagaagcagctgccccagagcaccctcttccgggctgaccaccccttcctgtttgtgatcaggaaggatgacatcatcctcttcagcggcaaggtgtcctgcccctag

SEQ ID NO: 169406 - DNA, 1143 bp, Artificial Sequence; identical to SEQ ID NO: 169400
  Description of Artificial Sequence: Synthetic coding sequence

SEQ ID NO: 169407 - DNA, 1125 bp, Artificial Sequence
  Description of Artificial Sequence: Synthetic coding sequence
atggatgacctgtgtgaggccaacggcacctttgccatcagcctcttcaagatcctgggggaggaggacaacagcagaaatgtgttcttcagccccatgagcatcagcagcgccctggccatggtgttcatgggcgccaagggcagcacagctgcccagatgagccaggccctgtgcctgtacaaggatggagacatccaccggggcttccagagcctgctgtctgaggtgaacagaacaggcacccagtacctgctgaggacagccaaccggctgtttggagagaagacctgtgacttcctgcctgacttcaaggagtactgccagaagttctaccaggccgagctggaggagctgagctttgctgaggacacagaagaatgtaggaagcacatcaatgactgggtggccgagaagacagagggcaagatcagcgaggtgctggatgctggcaccgtggaccccctgaccaagctggtgctggtgaatgccatctacttcaagggcaagtggaatgagcagtttgacaggaagtacacccggggcatgctgttcaagaccaatgaggagaagaagacagtgcagatgatgttcaaggaggccaagttcaagatgggctatgcagatgaggtgcacacccaggtgctggagctgccctacgtggaggaggagctgtccatggtgatcctgctgcctgatgacaacacagacctggccgtggtggagaaggccctgacctatgagaagttcaaggcctggaccaacagcgagaagctgaccaagagcaaggtgcaggtgttcctgccccggctgaagctggaggagagctatgacctggagcccttcctgcggcggctgggcatgattgatgcctttgatgaggccaaggctgacttcagcggcatgagcacagagaagaatgtgcccctgagcaaggtggcccacaagtgctttgtggaggtgaatgaggagggcacagaggccgccgccgccacagctgtggtgaggaacagccgctgcagcaggatggagccccgcttctgtgccgaccaccccttcctgttcttcatccgccaccacaagaccaactgcatcctcttctgtggccgcttcagcagcccctag

SEQ ID NO: 169408 - DNA, 1125 bp, Artificial Sequence; identical to SEQ ID NO: 169407
  Description of Artificial Sequence: Synthetic coding sequence

SEQ ID NO: 169409 - DNA, 495 bp, Artificial Sequence
  Description of Artificial Sequence: Synthetic coding sequence
atggatgacctgtgtgaggccaacggcacctttgccatcagcctcttcaagatcctgggggaggaggacaacagcagaaatgtgttcttcagccccatgagcatcagcagcgccctggccatggtgttcatgggcgccaagggcagcacagctgcccagatgagccaggccctgtgcctgtacaaggatggagacatccaccggggcttccagagcctgctgtctgaggtgaacagaacaggcacccagtacctgctgaggacagccaaccggctgtttggagagaagacctgtgacttcctgcctgacttcaaggagtactgccagaagttctaccaggccgagctggaggagctgagctttgctgaggacacagaagaatgtaggaagcacatcaatgactgggtggccgagaagacagagggcaagatcagcgaggtgctggatgctggcaccgtggaccccctgaccaagctggtgctggtgaatgcctag

SEQ ID NO: 169410 - DNA, 375 bp, Artificial Sequence
  Description of Artificial Sequence: Synthetic coding sequence
atggatgacctgtgtgaggccaacggcacctttgccatcagcctcttcaagatcctgggggaggaggacaacagcagaaatgtgttcttcagccccatgagcatcagcagcgccctggccatggtgttcatgggcgccaagggcagcacagctgcccagatgagccaggccctgtgcctgtacaaggatggagacatccaccggggcttccagagcctgctgtctgaggtgaacagaacaggcacccagtacctgctgaggacagccaaccggctgtttggagagaagacctgtgacttcctgcctgacttcaaggagtactgccagaagttctaccaggccgagctggaggagctgagctttgctgaagattag

SEQ ID NO: 169411 - DNA, 579 bp, Artificial Sequence
  Description of Artificial Sequence: Synthetic coding sequence
atgctgttcaagaccaatgaggagaagaagacagtgcagatgatgttcaaggaggccaagttcaagatgggctatgcagatgaggtgcacacccaggtgctggagctgccctacgtggaggaggagctgtccatggtgatcctgctgcctgatgacaacacagacctggccgtggtggagaaggccctgacctatgagaagttcaaggcctggaccaacagcgagaagctgaccaagagcaaggtgcaggtgttcctgccccggctgaagctggaggagagctatgacctggagcccttcctgcggcggctgggcatgattgatgcctttgatgaggccaaggctgacttcagcggcatgagcacagagaagaatgtgcccctgagcaaggtggcccacaagtgctttgtggaggtgaatgaggagggcacagaggccgccgccgccacagctgtggtgaggaacagccgctgcagcaggatggagccccgcttctgtgccgaccaccccttcctgttcttcatccgccaccacaagaccaactgcatcctcttctgtggccgcttcagcagcccctag

SEQ ID NO: 169412 - DNA, 1131 bp, Artificial Sequence
  Description of Artificial Sequence: Synthetic coding sequence
atggagaccctgagcaatgccagcggcacctttgccatccggctgctgaagatcctgtgccaggacaaccccagccacaacgtgttctgcagccctgtgtccatcagcagcgccctggccatggtgctgctgggcgccaagggcaacacagccacccagatggcccaggccctgagcctgaacacagaggaggacatccaccgggccttccagagcctgctgacagaggtgaacaaggccggcacccagtacctgctgaggacagccaaccggctgtttggagagaagacctgccagttcctgagcaccttcaaggagagctgcctgcagttctaccacgccgagctgaaggagctgtccttcatccgggctgctgaggagagcaggaagcacatcaacacctgggtgtccaagaagacagagggcaagattgaggagctgctgcccggcagcagcattgatgctgagacccggctggtgctggtgaatgccatctacttcaagggcaagtggaatgagccctttgatgagacctacacccgggagatgcccttcaagatcaaccaggaggagcagaggcctgtgcagatgatgtaccaggaggccaccttcaagctggcccacgtgggggaggtgcgggcccagctgctggagctgccctatgccaggaaggagctgagcctgctggtgctgctgcctgatgatggagtggagctgagcacagtggagaagagcctgacctttgagaagctgacagcctggaccaagccagactgcatgaagagcacagaggtggaggtgctgctgcccaagttcaagctgcaggaggactatgacatggagagcgtgctgcggcacctgggcatcgtggatgccttccagcagggcaaggctgacctgagcgccatgtctgctgagcgggacctgtgcctgagcaagtttgtgcacaagagctttgtggaggtgaatgaggagggcacagaagctgctgctgccagcagctgctttgtggtggccgagtgctgcatggagagcggcccccgcttctgtgccgaccaccccttcctgttcttcatccgccacaacagagccaacagcatcctcttctgtggccgcttcagcagcccctag

SEQ ID NO: 169413 - DNA, 1104 bp, Artificial Sequence
  Description of Artificial Sequence: Synthetic coding sequence
atgagcagccccccaccagcccggagcggcttctaccggcaggaggtgaccaagacagcctgggaggtgcgggctgtgtacagagacctgcagcctgtgggcagcggggcctacggggctgtgtgcagcgctgtggatggccgcactggagccaaggtggccatcaagaagctgtaccggcccttccagagcgagctgtttgccaagagggcctaccgggagctgcggctgctgaagcacatgagacatgaaaatgtgattggcctgctggatgtgttcaccccagatgagaccctggatgacttcacagacttctacctggtgatgcccttcatgggcacagacctgggcaagctgatgaagcatgagaagctgggagaagatcgcatccagttcctggtgtaccagatgctgaagggcctgcgctacatccacgccgccggcatcatccaccgggacctgaagccaggcaacctggccgtgaatgaagactgtgagctgaagatcctggactttggcctggcccggcaggccgacagcgagatgacaggctacgtggtgacccgctggtaccgggcccctgaggtgatcctgaactggatgagatacacccagacagtggacatctggagcgtgggctgcatcatggccgagatgatcaccgggaagaccctcttcaagggcagtgaccacctggaccagctgaaggagatcatgaaggtgacaggcaccccacctgctgagtttgtgcagaggctgcagagtgatgaggccaagaactacatgaagggcctgcctgagctggagaagaaggactttgccagcatcctgaccaatgccagccccctggccgtgaacctgctggagaagatgctggtgctggatgctgagcagagggtgacagctggggaggccctggcccacccctactttgagagcctgcatgacacagaagatgagccccaggtgcagaagtatgatgacagctttgatgatgtggacaggaccctggatgagtggaagagggtgacctacaaggaggtgctgtccttcaagccaccccggcagctgggcgcccgggtgtccaaggagacccccctgtag

SEQ ID NO: 169414 - DNA, 1500 bp, Artificial Sequence
  Description of Artificial Sequence: Synthetic coding sequence
atgaagcacagcctgaatgccctgctgatcttcctgatcatcaccagcgcctggggcggcagcaagggccccctggaccagctggagaagggcggggagacagcccagagcgctgacccccagtgggagcagctgaacaacaagaacctgtccatgcccctgctgcctgctgacttccacaaggagaacacagtgaccaatgactggatccctgagggggaggaggatgatgactacctggacctggagaagatcttctctgaagatgatgactacattgatattgtggacagcctgtctgtgagccccacagacagtgatgtgtctgctggcaacatcctgcagctgttccacggcaagagccgcatccagaggctgaacatcctgaatgccaagtttgccttcaacctgtacagagtgctgaaggaccaggtgaacacctttgacaacatcttcatcgcccctgtgggcatcagcacagccatgggcatgatcagcctgggcctgaagggggagacccatgagcaggtgcacagcatcctgcacttcaaggactttgtgaatgccagcagcaaatatgagatcaccaccatccacaacctcttcaggaagctgacccacaggctcttcagaagaaactttggctacaccctgcggtctgtgaatgacctgtacatccagaagcagttccccatcctgctggacttcaagaccaaggtgcgggagtactactttgctgaggcccagattgctgacttcagtgaccctgccttcatcagcaagaccaacaaccacatcatgaagctgaccaagggcctcatcaaggatgccctggagaacattgatcctgccacccagatgatgatcctgaactgcatctacttcaagggctcctgggtgaacaagtttcctgtggagatgacccacaaccacaacttccggctgaatgaaagagaggtggtgaaggtgtccatgatgcagaccaagggcaacttcctggccgccaatgaccaggagctggactgtgacatcctgcagctggagtatgtgggcggcatctccatgctgattgtggtgccccacaagatgagcggcatgaagaccctggaggcccagctgaccccccgggtggtggagcgctggcagaagtccatgaccaacagaacccgggaggtgctgctgcccaagttcaagctggagaagaactacaacctggtggagagcctgaagctgatgggcatccgcatgctgtttgacaagaatggaaacatggccggcatcagtgaccagagaattgccatcgacctcttcaagcaccagggcaccatcaccgtgaatgaggagggcacccaggccaccaccgtgaccaccgtgggcttcatgcccctgagcacccaggtgcgcttcaccgtggaccggcccttcctgttcctgatctatgagcacaggaccagctgcctgctcttcatgggccgggtggccaaccccagccgctcctag

SEQ ID NO: 169415 - DNA, 1197 bp, Artificial Sequence
  Description of Artificial Sequence: Synthetic coding sequence
atgaactggcacctgcccctcttcctgctggcctctgtgaccctgcccagcatctgcagccacttcaaccccctgagcctggaggagctgggcagcaacacaggcatccaggtgttcaaccagatcgtgaagagccggccccatgacaacatcgtcatcagcccccacggcatcgcctctgtgctgggcatgctgcagctgggcgcagatggccgcaccaagaagcagctggccatggtgatgagatatggagtgaatggagtgggcaagatcctgaagaagatcaacaaggccatcgtgtccaagaagaacaaggacatcgtgacagtggccaatgctgtgtttgtgaagaatgccagcgagattgaggtgccctttgtgaccaggaacaaggatgtgttccagtgtgaggtgagaaatgtgaactttgaggaccctgccagcgcctgtgacagcatcaatgcctgggtgaagaatgagacccgggacatgattgacaacctgctgagcccagacctgattgatggagtgctgacccggctggtgctggtgaatgctgtgtacttcaagggcctgtggaagagccgcttccagcctgagaacaccaagaagaggacctttgtggccgcagatggcaagagctaccaggtgcccatgctggcccagctgagcgtcttccgctgtggcagcaccagcgccccaaatgacctgtggtacaacttcatcgagctgccctaccatggagagagcatctccatgctgattgccctgcccacagagagcagcacccccctgagcgccatcatcccccacatcagcaccaagaccatcgacagctggatgagcatcatggtgcccaagagggtgcaggtgatcctgcccaagttcaccgctgtggcccagacagacctgaaggagcccctgaaggtgctgggcatcacagacatgtttgacagcagcaaggccaactttgccaagatcaccactggaagtgagaacctgcacgtgagccacatcctgcagaaggccaagattgaggtgtctgaagatggcaccaaggccagcgctgccaccacagccatcctgattgcccggagcagccccccctggttcatcgtggaccggcccttcctgttcttcatccgccacaaccccaccggggctgtgctcttcatgggccagatcaacaagccctag

SEQ ID NO: 169416 - DNA, 1194 bp, Artificial Sequence
  Description of Artificial Sequence: Synthetic coding sequence
atgaactggcacctgcccctcttcctgctggcctctgtgaccctgcccagcatctgcagccacttcaaccccctgagcctggaggagctgggcagcaacacaggcatccaggtgttcaaccagatcgtgaagagccggccccatgacaacatcgtcatcagcccccacggcatcgcctctgtgctgggcatgctgcagctgggcgcagatggccgcaccaagaagcagctggccatggtgatgagatatggagtgaatggagtgggcaagatcctgaagaagatcaacaaggccatcgtgtccaagaagaacaaggacatcgtgacagtggccaatgctgtgtttgtgaagaatgccagcgagattgaggtgccctttgtgaccaggaacaaggatgtgttccagtgtgaggtgagaaatgtgaactttgaggaccctgccagcgcctgtgacagcatcaatgcctgggtgaagaatgagacccgggacatgattgacaacctgctgagcccagacctgattgatggagtgctgacccggctggtgctggtgaatgctgtgtacttcaagggcctgtggaagagccgcttccagcctgagaacaccaagaagaggacctttgtggccgcagatggcaagagctaccaggtgcccatgctggcccagctgagcgtcttccgctgtggcagcaccagcgccccaaatgacctgtggtacaacttcatcgagctgccctaccatggagagagcatctccatgctgattgccctgcccacagagagcagcacccccctgagcgccatcatcccccacatcagcaccaagaccatcgacagctggatgagcatcatggtgcccaagagggtgcaggtgatcctgcccaagttcaccgctgtggcccagacagacctgaaggagcccctgaaggtgctgggcatcacagacatgtttgacagcagcaaggccaactttgccaagatcaccaggtctgagaacctgcacgtgagccacatcctgcagaaggccaagattgaggtgtctgaagatggcaccaaggccagcgctgccaccacagccatcctgattgcccggagcagccccccctggttcatcgtggaccggcccttcctgttcttcatccgccacaaccccactggagctgtgctcttcatgggccagatcaacaagccctag

SEQ ID NO: 169417 - DNA, 1194 bp, Artificial Sequence; identical to SEQ ID NO: 169416
  Description of Artificial Sequence: Synthetic coding sequence

SEQ ID NO: 169418 - DNA, 129 bp, Artificial Sequence
  Description of Artificial Sequence: Synthetic coding sequence
atgaactggcacctgcccctcttcctgctggcctctgtgaccctgcccagcatctgcagccacttcaaccccctgagcctggaggagctgggcagcaacacaggcatccaggtgttcaaccagatctag

SEQ ID NO: 169419 - DNA, 831 bp, Artificial Sequence
  Description of Artificial Sequence: Synthetic coding sequence
atgaactggcacctgcccctcttcctgctggcctctgtgaccctgcccagcatctgcagccacttcaaccccctgagcctggaggagctgggcagcaacacaggcatccaggtgttcaaccagatcgtgaagagccggccccatgacaacatcgtcatcagcccccacggcatcgcctctgtgctgggcatgctgcagctgggcgcagatggccgcaccaagaagcagctggccatggtgatgagatatggagtgaatggagtgggcaagatcctgaagaagatcaacaaggccatcgtgtccaagaagaacaaggacatcgtgacagtggccaatgctgtgtttgtgaagaatgccagcgagattgaggtgccctttgtgaccaggaacaaggatgtgttccagtgtgaggtgagaaatgtgaactttgaggaccctgccagcgcctgtgacagcatcaatgcctgggtgaagaatgagacccgggacatgattgacaacctgctgagcccagacctgattgatggagtgctgacccggctggtgctggtgaatgctgtgtacttcaagggcctgtggaagagccgcttccagcctgagaacaccaagaagaggacctttgtggccgcagatggcaagagctaccaggtgcccatgctggcccagctgagcgtcttccgctgtggcagcaccagcgccccaaatgacctgtggtacaacttcatcgagctgccctaccatggagagagcatctccatgctgattgccctgcccacagagagcagcacccccctgagcgccatcatcccccacatcagcaccaagacctag

SEQ ID NO: 169420 - DNA, 1230 bp, Artificial Sequence
  Description of Artificial Sequence: Synthetic coding sequence
atgtctgactgccgcagcagcctggtggagggcaccatgaactggcacctgcccctcttcctgctggcctctgtgaccctgcccagcatctgcagccacttcaaccccctgagcctggaggagctgggcagcaacacaggcatccaggtgttcaaccagatcgtgaagagccggccccatgacaacatcgtcatcagcccccacggcatcgcctctgtgctgggcatgctgcagctgggcgcagatggccgcaccaagaagcagctggccatggtgatgagatatggagtgaatggagtgggcaagatcctgaagaagatcaacaaggccatcgtgtccaagaagaacaaggacatcgtgacagtggccaatgctgtgtttgtgaagaatgccagcgagattgaggtgccctttgtgaccaggaacaaggatgtgttccagtgtgaggtgagaaatgtgaactttgaggaccctgccagcgcctgtgacagcatcaatgcctgggtgaagaatgagacccgggacatgattgacaacctgctgagcccagacctgattgatggagtgctgacccggctggtgctggtgaatgctgtgtacttcaagggcctgtggaagagccgcttccagcctgagaacaccaagaagaggacctttgtggccgcagatggcaagagctaccaggtgcccatgctggcccagctgagcgtcttccgctgtggcagcaccagcgccccaaatgacctgtggtacaacttcatcgagctgccctaccatggagagagcatctccatgctgattgccctgcccacagagagcagcacccccctgagcgccatcatcccccacatcagcaccaagaccatcgacagctggatgagcatcatggtgcccaagagggtgcaggtgatcctgcccaagttcaccgctgtggcccagacagacctgaaggagcccctgaaggtgctgggcatcacagacatgtttgacagcagcaaggccaactttgccaagatcaccaggtctgagaacctgcacgtgagccacatcctgcagaaggccaagattgaggtgtctgaagatggcaccaaggccagcgctgccaccacagccatcctgattgcccggagcagccccccctggttcatcgtggaccggcccttcctgttcttcatccgccacaaccccactggagctgtgctcttcatgggccagatcaacaagccctag

SEQ ID NO: 169421 - DNA, 264 bp, Artificial Sequence
  Description of Artificial Sequence: Synthetic coding sequence
atgaactggcacctgcccctcttcctgctggcctctgtgaccctgcccagcatctgcagccacttcaaccccctgagcctggaggagctgggcagcaacacaggcatccaggtgttcaaccagatcgtgaagagccggccccatgacaacatcgtcatcagcccccacggcatcgcctctgtgctgggcatgctgcagctgggcgcagatggccgcaccaagaagcagctggccatggtgatgagatatggagtgaatggatag

SEQ ID NO: 169422 - DNA, 1257 bp, Artificial Sequence
  Description of Artificial Sequence: Synthetic coding sequence
atgcaggccctggtgctgctgctgtgcatcggggccctgctgggccacagcagctgccagaacccagccagccccccagaggagggcagcccagaccctgacagcactggagccctggtggaggaggaggaccccttcttcaaggtgcctgtgaacaagctggccgctgctgtgagcaactttggctatgacctgtacagagtgcgcagcagcaccagccccaccaccaacgtgctgctgagccccctgtctgtggccacagccctgagcgccctgagcctgggcgctgagcagaggacagagagcatcatccaccgggccctgtactatgacctgatcagcagcccagacatccacggcacctacaaggagctgctggacacagtgacagccccccagaagaacctgaagagcgccagccgcatcgtgtttgagaagaagctgcgcatcaagagcagctttgtggcccccctggagaagagctatggcacccggccccgggtgctgaccggcaacccccggctggacctgcaggagatcaacaactgggtgcaggcccagatgaagggcaagctggcccggagcaccaaggagatcccagatgagatcagcatcctgctgctgggcgtggcccacttcaagggccagtgggtgaccaagtttgacagcaggaagaccagcctggaggacttctacctggatgaggagaggacagtgcgggtgcccatgatgtctgaccccaaggctgtgctgcgctatggcctggacagcgacctgagctgcaagatcgcccagctgcccctgaccggctccatgagcatcatcttcttcctgcccctgaaggtgacccagaacctgaccctgattgaggagagcctgaccagcgagttcatccatgacatcgaccgggagctgaagacagtgcaggccgtgctgactgtgcccaagctgaagctgtcctatgaaggagaggtgaccaagagcctgcaggagatgaagctgcagagcctgtttgacagcccagacttcagcaagatcaccgggaagcccatcaagctgacccaggtggagcaccgggccggctttgagtggaatgaagatggagctggcaccacccccagccctggcctgcagcctgcccacctgaccttccccctggactaccacctgaaccagcccttcatctttgtgctgcgggacacagacacaggagccctgctcttcatcggcaagatcctggacccccggggcccctag

SEQ ID NO: 169423 - DNA, 1233 bp, Artificial Sequence
  Description of Artificial Sequence: Synthetic coding sequence
atggccttcctgggcctcttcagcctgctggtgctgcagagcatggccactggagccaccttccctgaggaggccatcgctgacctgtctgtgaacatgtacaaccggctgcgggccaccggggaggatgagaacatcctcttcagccccctgagcatcgccctggccatgggcatgatggagctgggcgcccagggcagcacccagaaggagatccgccacagcatgggctatgacagcctgaagaatggagaggagttctccttcctgaaggagttcagcaacatggtgacagccaaggagagccagtatgtgatgaagatcgccaacagcctgtttgtgcagaatggcttccacgtgaatgaggagttcctgcagatgatgaagaagtacttcaatgctgctgtgaaccacgtggacttcagccagaatgtggccgtggccaactacatcaacaagtgggtggagaacaacaccaacaacctggtgaaggacctggtgagcccccgggactttgatgctgccacctacctggccctgatcaatgctgtgtacttcaagggcaactggaagagccagttccggcctgagaacaccaggaccttctccttcaccaaggatgatgagagcgaggtgcagatccccatgatgtaccagcagggcgagttctactatggagagttcagtgatggcagcaatgaagctgggggcatctaccaggtgctggagatcccctatgaaggagatgagatctccatgatgctggtgctgagccggcaggaggtgcccctggccaccctggagcccctggtgaaggcccagctggtggaggagtgggccaacagcgtgaagaagcagaaggtggaggtgtacctgccccgcttcaccgtggagcaggagattgacctgaaggatgtgctgaaggccctgggcatcacagagatcttcatcaaggatgccaacctgaccggcctgagtgacaacaaggagatcttcctgagcaaggccatccacaagagcttcctggaggtgaatgaggagggcagcgaggccgctgctgtgtctggcatgattgccatcagcaggatggctgtgctgtacccccaggtgattgtggaccaccccttcttcttcctgatccggaacagaagaacaggcaccatcctcttcatgggccgggtgatgcaccctgagaccatgaacaccagcggccatgactttgaggagctgtag

SEQ ID NO: 169424 - DNA, 1233 bp, Artificial Sequence; identical to SEQ ID NO: 169423
  Description of Artificial Sequence: Synthetic coding sequence

SEQ ID NO: 169425 - DNA, 738 bp, Artificial Sequence
  Description of Artificial Sequence: Synthetic coding sequence
atggccttcctgggcctcttcagcctgctggtgctgcagagcatggccactggagccaccttccctgaggaggccatcgctgacctgtctgtgaacatgtacaaccggctgcgggccaccggggaggatgagaacatcctcttcagccccctgagcatcgccctggccatgggcatgatggagctgggcgcccagggcagcacccagaaggagatccgccacagcatgggctatgacagcctgaagaatggagaggagttctccttcctgaaggagttcagcaacatggtgacagccaaggagagccagtatgtgatgaagatcgccaacagcctgtttgtgcagaatggcttccacgtgaatgaggagttcctgcagatgatgaagaagtacttcaatgctgctgtgaaccacgtggacttcagccagaatgtggccgtggccaactacatcaacaagtgggtggagaacaacaccaacaacctggtgaaggacctggtgagcccccgggactttgatgctgccacctacctggccctgatcaatgctgtgtacttcaagggcaactggaagagccagttccggcctgagaacaccaggaccttctccttcaccaaggatgatgagagcgaggtgcagatccccatgatgtaccagcagggcgagttctactatggagagttcagtgatggcagcaatgaagctgggggcatctaccaggtgctggagatcccctag

SEQ ID NO: 169426 - DNA, 483 bp, Artificial Sequence
  Description of Artificial Sequence: Synthetic coding sequence
atggccttcctgggcctcttcagcctgctggtgctgcagagcatggccactggagccaccttccctgaggaggccatcgctgacctgtctgtgaacatgtacaaccggctgcgggccaccggggaggatgagaacatcctcttcagccccctgagcatcgccctggccatgggcatgatggagctgggcgcccagggcagcacccagaaggagatccgccacagcatgggctatgacagcctgaagaatggagaggagttctccttcctgaaggagttcagcaacatggtgacagccaaggagagccagtatgtgatgaagatcgccaacagcctgtttgtgcagaatggcttccacgtgaatgaggagttcctgcagatgatgaagaagtacttcaatgctgctgtgaaccacgtggacttcagccagaatgtggccgtggccaactacatcaacaagtgggtggagaacaacaccaactag

SEQ ID NO: 169427 - DNA, 591 bp, Artificial Sequence
  Description of Artificial Sequence: Synthetic coding sequence
atggtgggcggcctgaagaggaagcacagcgacctggaggaggaggaggagcgctgggagtggagccctgctggcctgcagagctaccagcaggccctgctgcgcatcagcctggacaaggtgcagaggagcctgggcccccgggcccccagcctgcggagacatgtgctgatccacaacaccctgcagcagctgcaggccgccctgcggctggccccagccccagccctgcccccagagcccctcttcctgggggaggaggacttcagcctgagcgccaccatcggcagcatcctgcgggagctggacacctccatggatggaacagagcccccccagaaccctgtgacccccctgggcctgcagaatgaggtgcccccccagcctgaccctgtgttcctggaggccctgagcagccgctacctgggggacagcggcctggatgacttcttcctggacatcgacaccagcgctgtggagaaggagcccgcccgggcccctcctgagcccccccacaacctcttctgtgcccctggctcctgggagtggaatgagctggaccacatcatggagatcatcctgggcagctag

SEQ ID NO: 169428 - DNA, 591 bp, Artificial Sequence; identical to SEQ ID NO: 169427
  Description of Artificial Sequence: Synthetic coding sequence

SEQ ID NO: 169429 - DNA, 369 bp, Artificial Sequence
  Description of Artificial Sequence: Synthetic coding sequence
atgaagctgctgaccggcctggtgttctgcagcctggtgctgggcgtgagcagccgctccttcttctccttcctgggggaggcctttgatggagcccgggacatgtggagggcctacagcgacatgagggaggccaactacatcggcagtgacaagtacttccacgcccggggcaactatgatgctgccaagaggggccctggaggagcctgggccgctgaggtgatcacagatgcccgggagaacatccagcgcttctttggacatggagctgaggacagcctggccgaccaggccgccaatgagtggggccgcagcggcaaggaccccaaccacttccggcctgctggcctgcctgagaagtactag

SEQ ID NO: 169430 - DNA, 369 bp, Artificial Sequence; identical to SEQ ID NO: 169429
  Description of Artificial Sequence: Synthetic coding sequence

SEQ ID NO: 169431 - DNA, 369 bp, Artificial Sequence; identical to SEQ ID NO: 169429
  Description of Artificial Sequence: Synthetic coding sequence

SEQ ID NO: 169432 - DNA, 369 bp, Artificial Sequence
  Description of Artificial Sequence: Synthetic coding sequence
atgaagctgctgaccggcctggtgttctgcagcctggtgctgtctgtgagcagccgctccttcttctccttcctgggggaggcctttgatggagcccgggacatgtggagggcctacagcgacatgagggaggccaactacatcggcagtgacaagtacttccacgcccggggcaactatgatgctgccaagaggggccctggaggagcctgggccgctgaggtgatcagcaatgcccgggagaacatccagaggctgaccggcagaggagctgaggacagcctggccgaccaggccgccaacaagtggggccgcagcggccgggaccccaaccacttccggcctgctggcctgcctgagaagtactag

SEQ ID NO: 169433 - DNA, 252 bp, Artificial Sequence
  Description of Artificial Sequence: Synthetic coding sequence
atgaagctgctgaccggcctggtgttctgcagcctggtgctgtctgtgagcagccgctccttcttctccttcctgggggaggcctttgatggagcccgggacatgtggagggcctacagcgacatgagggaggccaactacatcggcagtgacaagtacttccacgcccggggcaactatgatgctgccaagaggggccctggaggagcctgggccgctgaggtgatcagcctcttctctgctgagctgtag

SEQ ID NO: 169434 - DNA, 369 bp, Artificial Sequence; identical to SEQ ID NO: 169432
  Description of Artificial Sequence: Synthetic coding sequence

SEQ ID NO: 169435 - DNA, 369 bp, Artificial Sequence; identical to SEQ ID NO: 169432
  Description of Artificial Sequence: Synthetic coding sequence

SEQ ID NO: 169436 - DNA, 393 bp, Artificial Sequence
  Description of Artificial Sequence: Synthetic coding sequence
atgaggctcttcaccggcatcgtgttctgcagcctggtgatgggcgtgaccagcgagagctggaggagcttcttcaaggaggccctgcagggcgtgggggacatgggccgggcctactgggacatcatgatcagcaaccaccagaacagcaaccgctacctgtatgcccggggcaactatgatgctgcccagaggggccctggaggagtgtgggccgccaagctgatcagccgcagccgggtgtacctgcagggcctgattgactgctacctgtttggaaacagcagcacagtgctggaggacagcaagagcaatgagaaggccgaggagtggggccgcagcggcaaggaccctgaccgcttccggccagatggcctgcccaagaagtactag

SEQ ID NO: 169437 - DNA, 1278 bp, Artificial Sequence
  Description of Artificial Sequence: Synthetic coding sequence
atgggagaagatgctgcccaggccgagaagttccagcaccctggcagtgacatgaggcaggagaagcccagcagccccagccccatgcccagcagcacccccagccccagcctgaacctgggcaacacagaggaggccatccgggacaacagccaggtgaatgctgtgacagtgctgaccctgctggacaagctggtgaacatgctggatgctgtgcaggagaaccagcacaagatggagcagaggcagatcagcctggagggctctgtgaagggcatccagaatgacctgaccaagctgagcaagtaccaggccagcaccagcaacacagtgtccaagctgctggagaagagcaggaaggtgtctgcccacaccagggctgtgaaggagaggatggaccggcagtgtgcccaggtgaagaggctggagaacaaccacgcccagctgctgcggaggaaccacttcaaggtgctgatcttccaggaggagaatgagatcccagcctctgtgtttgtgaagcagcctgtgtctggagctgtggagggcaaggaggagctgcctgatgagaacaagagcctggaggagaccctgcacacagtggacctgagcagtgatgatgacctgccccatgatgaggaggccctggaggacagcgctgaggagaaggtggaggagagcagagctgagaagatcaagaggagcagcctgaagaaggtggacagcctgaagaaggccttcagccggcagaacatcgagaagaagatgaacaagctgggcaccaagatcgtgtctgtggagcggcgggagaagatcaagaagagcctgaccagcaaccaccagaagatcagcagcggcaagagcagccccttcaaggtgagccccctgacctttggaaggaagaaggtgcgggagggggagagccatgctgaaaatgagaccaagtctgaggacctgcccagcagcgagcagatgcccaatgaccaggaggaggagagctttgctgagggccacagcgaggccagcctggccagcgccctggtggagggggagattgctgaggaggccgctgagaaggccaccagccggggcagcaacagcggcatggacagcaacatcgacctgaccatcgtggaggatgaggaggaggagagcgtggccctggagcaggcccagaaggtgcgctatgagggcagctatgccctgaccagcgaggaggccgagaggagtgatggagaccctgtgcagcctgctgtgctgcaggtgcaccagaccagctag

SEQ ID NO: 169438 - DNA, 1290 bp, Artificial Sequence
  Description of Artificial Sequence: Synthetic coding sequence
atggcccagcccggcaccctgaacctgaacaatgaggtggtgaagatgaggaaggaggtgaagaggatccgggtgctggtgatcaggaagctggtgcgctctgtgggccgcctgaagagcaagaagggcacagaagatgccctgctgaagaaccagaggcgggcccagaggctgctggaggagatccacgccatgaaggagctgaagccagacatcgtgaccaagagcgccctgggagatgacatcaactttgagaagatcttcaagaagccagacagcacagccacagagcgggccatcgcccggctggccgtgcaccccctgctgaagaagaagattgatgtgctgaaggctgctgtgcaggccttcaaggaggcccggcagaatgtggccgaggtggagagcagcaagaatgccagcgaggacaaccacagcgagaacaccctgtacagcaatgacaatggcagcaacctgcagcgggaggccaccgtcatcagcgagcagaaggtgaaggagaccaagatcctggccaagaagcccatccacaacagcaaggagaagatcgccaagatggagcacggccccaaggctgtgaccatcgccaacagccccagcaagcccagcgagaaggacagcgtggtgtccctggagagccagaagaccccagctgaccccaagctgaagaccctgagccagaccaagaagaacaagggcagtgacagcagcctgagcggcaacagtgatggaggagaggagttctgtgaggaggagaaggagtactttgatgacagcacagaggagcgcttctacaagcagagctccatgtctgaagattctgattctggagatgacttcttcatcggcaaggtgcggaggaccaggaagaaggagagcagctgccacagctctgtgaaggagcagaagcccctggagaaggtgttcctgaaggaggacacaggagagacccatggagacaccagaaatgacaagatcaagcccagcacagagaccaggaagctggagagcgtcttcttccacagcctgagcggcagcaagagcagcagaagaaacttcaaggagcaggcccccaagaccaggagcctggacttcccccagaatgagccccagatcaagaaccagttcaacaagaagctgagcggccgcctggagaacaccaagcagcagctgcagctgcccctgcaccccagctgggaggccagcagaagaaggaaggagcagcagagcaacattgctgtgttccagggcaagaagatcacctttgatgactag

SEQ ID NO: 169439 - DNA, 1296 bp, Artificial Sequence
  Description of Artificial Sequence: Synthetic coding sequence
atgacagtgaagacagaagctgccaagggcaccctgacctacagcaggatgaggggcatggtggccatcctgattgccttcatgaagcagaggaggatgggcctgaatgacttcatccagaagatcgccaacaacagctatgcctgcaagcaccctgaggtgcagagcatcctgaagatcagccagccccaggagcctgagctgatgaatgccaaccccagccccccacccagccccagccagcagatcaacctgggccccagcagcaacccccacgccaagcccagcgacttccacttcctgaaggtgattggcaagggcagctttgggaaggtgctgctggcccggcacaaggccgaggaggtgttctatgctgtgaaggtgctgcagaagaaggccatcctgaagaagaaggaggagaagcacatcatgtctgaaagaaatgtgctgctgaagaatgtgaagcaccccttcctggtgggcctgcacttctccttccagacagctgacaagctgtactttgtgctggactacatcaatggaggagagctgttctaccacctgcagcgggagcgctgcttcctggagccccgggcccgcttctatgctgctgagatcgccagcgccctgggctacctgcacagcctgaacatcgtgtacagagacctgaagccagagaacatcctgctggacagccagggccacatcgtgctgacagactttggcctgtgcaaggagaacatcgagcacaacagcaccaccagcaccttctgtggcaccccagagtacctggcccctgaggtgctgcacaagcagccctatgacagaacagtggactggtggtgcctgggcgctgtgctgtatgagatgctgtatggcctgccccccttctacagcaggaacacagctgagatgtatgacaacatcctgaacaagcccctgcagctgaagcccaacatcaccaacagcgcccggcacctgctggagggcctgctgcagaaggacaggaccaagaggctgggcgccaaggatgacttcatggagatcaagagccacgtgttcttcagcctcatcaactgggatgacctgatcaacaagaagatcaccccacccttcaaccccaacgtgtctggccccaatgacctgcggcactttgatcctgagttcacagaggagcctgtgcccaacagcatcggcaagagcccagacagcgtgctggtgacagcctctgtgaaggaggccgctgaggccttcctgggcttctcctatgccccacccacagacagcttcctgtag

SEQ ID NO: 169440 - DNA, 1266 bp, Artificial Sequence
  Description of Artificial Sequence: Synthetic coding sequence
atgaagcccagcaagcgcttcttcatcagcccccccagcagcacagccttcatgaagcagaggaggatgggcctgaatgacttcatccagaagatcgccaacaacagctatgcctgcaagcaccctgaggtgcagagcatcctgaagatcagccagccccaggagcctgagctgatgaatgccaaccccagccccccacccagccccagccagcagatcaacctgggccccagcagcaacccccacgccaagcccagcgacttccacttcctgaaggtgattggcaagggcagctttgggaaggtgctgctggcccggcacaaggccgaggaggtgttctatgctgtgaaggtgctgcagaagaaggccatcctgaagaagaaggaggagaagcacatcatgtctgaaagaaatgtgctgctgaagaatgtgaagcaccccttcctggtgggcctgcacttctccttccagacagctgacaagctgtactttgtgctggactacatcaatggaggagagctgttctaccacctgcagcgggagcgctgcttcctggagccccgggcccgcttctatgctgctgagatcgccagcgccctgggctacctgcacagcctgaacatcgtgtacagagacctgaagccagagaacatcctgctggacagccagggccacatcgtgctgacagactttggcctgtgcaaggagaacatcgagcacaacagcaccaccagcaccttctgtggcaccccagagtacctggcccctgaggtgctgcacaagcagccctatgacagaacagtggactggtggtgcctgggcgctgtgctgtatgagatgctgtatggcctgccccccttctacagcaggaacacagctgagatgtatgacaacatcctgaacaagcccctgcagctgaagcccaacatcaccaacagcgcccggcacctgctggagggcctgctgcagaaggacaggaccaagaggctgggcgccaaggatgacttcatggagatcaagagccacgtgttcttcagcctcatcaactgggatgacctgatcaacaagaagatcaccccacccttcaaccccaacgtgtctggccccaatgacctgcggcactttgatcctgagttcacagaggagcctgtgcccaacagcatcggcaagagcccagacagcgtgctggtgacagcctctgtgaaggaggccgctgaggccttcctgggcttctcctatgccccacccacagacagcttcctgtag

SEQ ID NO: 169441 - DNA, 1581 bp, Artificial Sequence
  Description of Artificial Sequence: Synthetic coding sequence
atggtgaacaaggacatgaatggcttccctgtgaagaagtgcagcgccttccagttcttcaagaagagggtgcggcgctggatcaagagccccatggtgtctgtggacaagcaccagagccccagcctgaagtacacaggcagctccatggtgcacatccccccaggagagccagactttgagagcagcctgtgccagacctgcctgggggagcacgccttccagaggggcgtgctgccccaggagaatgaaagctgctcctgggagacccagagcggctgtgaggtgcgggagccctgcaaccacgccaacatcctgaccaagccagaccccaggaccttctggaccaatgatgatcctgccttcatgaagcagaggaggatgggcctgaatgacttcatccagaagatcgccaacaacagctatgcctgcaagcaccctgaggtgcagagcatcctgaagatcagccagccccaggagcctgagctgatgaatgccaaccccagccccccacccagccccagccagcagatcaacctgggccccagcagcaacccccacgccaagcccagcgacttccacttcctgaaggtgattggcaagggcagctttgggaaggtgctgctggcccggcacaaggccgaggaggtgttctatgctgtgaaggtgctgcagaagaaggccatcctgaagaagaaggaggagaagcacatcatgtctgaaagaaatgtgctgctgaagaatgtgaagcaccccttcctggtgggcctgcacttctccttccagacagctgacaagctgtactttgtgctggactacatcaatggaggagagctgttctaccacctgcagcgggagcgctgcttcctggagccccgggcccgcttctacgccgctgagatcgccagcgccctgggctacctgcacagcctgaacatcgtgtacagagacctgaagccagagaacatcctgctggacagccagggccacatcgtgctgacagactttggcctgtgcaaggaaaatattgagcacaacagcaccaccagcaccttctgtggcaccccagagtacctggcccctgaggtgctgcacaagcagccctatgacagaacagtggactggtggtgcctgggcgctgtgctgtatgagatgctgtatggcctgccccccttctacagcaggaacacagctgagatgtatgacaacatcctgaacaagcccctgcagctgaagcccaacatcaccaacagcgcccggcacctgctggagggcctgctgcagaaggacaggaccaagaggctgggcgccaaggatgacttcatggagatcaagagccacgtgttcttcagcctcatcaactgggatgacctgatcaacaagaagatcaccccacccttcaaccccaacgtgtctggccccaatgacctgcggcactttgatcctgagttcacagaggagcctgtgcccaacagcatcggcaagagcccagattctgtgctggtgacagcctctgtgaaggaggccgctgaggccttcctgggcttctcctatgccccacccacagacagcttcctgtag

SEQ ID NO: 169442 - DNA, 1338 bp, Artificial Sequence
  Description of Artificial Sequence: Synthetic coding sequence
atgggagagatgcagggcgccctggcccgggcccggctggagagcctgctgcggcccaggcacaagaagagagctgaggcccagaagaggtctgagagcttcctgctgagcggcctggccttcatgaagcagaggaggatgggcctgaatgacttcatccagaagatcgccaacaacagctatgcctgcaagcaccctgaggtgcagagcatcctgaagatcagccagccccaggagcctgagctgatgaatgccaaccccagccccccacccagccccagccagcagatcaacctgggccccagcagcaacccccacgccaagcccagcgacttccacttcctgaaggtgattggcaagggcagctttgggaaggtgctgctggcccggcacaaggccgaggaggtgttctatgctgtgaaggtgctgcagaagaaggccatcctgaagaagaaggaggagaagcacatcatgtctgaaagaaatgtgctgctgaagaatgtgaagcaccccttcctggtgggcctgcacttctccttccagacagctgacaagctgtactttgtgctggactacatcaatggaggagagctgttctaccacctgcagcgggagcgctgcttcctggagccccgggcccgcttctatgctgctgagatcgccagcgccctgggctacctgcacagcctgaacatcgtgtacagagacctgaagccagagaacatcctgctggacagccagggccacatcgtgctgacagactttggcctgtgcaaggagaacatcgagcacaacagcaccaccagcaccttctgtggcaccccagagtacctggcccctgaggtgctgcacaagcagccctatgacagaacagtggactggtggtgcctgggcgctgtgctgtatgagatgctgtatggcctgccccccttctacagcaggaacacagctgagatgtatgacaacatcctgaacaagcccctgcagctgaagcccaacatcaccaacagcgcccggcacctgctggagggcctgctgcagaaggacaggaccaagaggctgggcgccaaggatgacttcatggagatcaagagccacgtgttcttcagcctcatcaactgggatgacctgatcaacaagaagatcaccccacccttcaaccccaacgtgtctggccccaatgacctgcggcactttgatcctgagttcacagaggagcctgtgcccaacagcatcggcaagagcccagacagcgtgctggtgacagcctctgtgaaggaggccgctgaggccttcctgggcttctcctatgccccacccacagacagcttcctgtag

SEQ ID NO: 169443 - DNA, 435 bp, Artificial Sequence
  Description of Artificial Sequence: Synthetic coding sequence
atggtgtctgtggacaagcaccagagccccagcctgaagtacacaggcagctccatggtgcacatccccccaggagagccagactttgagagcagcctgtgccagacctgcctgggggagcacgccttccagaggggcgtgctgccccaggagaatgaaagctgctcctgggagacccagagcggctgtgaggtgcgggagccctgcaaccacgccaacatcctgaccaagccagaccccaggaccttctggaccaatgatgatcctgccttcatgaagcagaggaggatgggcctgaatgacttcatccagaagatcgccaacaacagctatgcctgcaagcaccctgaggtgcagagcatcctgaagatcagccagccccaggagcctgagctgatgaatgccaaccccagccccccacccagccccagctag

SEQ ID NO: 169444 - DNA, 1380 bp, Artificial Sequence
  Description of Artificial Sequence: Synthetic coding sequence
atgagcagccagagcagcagcctgtctgaggcctgcagccgggaggcctacagcagccacaactgggccctgcccccagccagccgcagcaacccccagcctgcctacccctgggccaccaggaggatgaaggaggaggccatcaagccacccctgaaggccttcatgaagcagaggaggatgggcctgaatgacttcatccagaagatcgccaacaacagctatgcctgcaagcaccctgaggtgcagagcatcctgaagatcagccagccccaggagcctgagctgatgaatgccaaccccagccccccacccagccccagccagcagatcaacctgggccccagcagcaacccccacgccaagcccagcgacttccacttcctgaaggtgattggcaagggcagctttgggaaggtgctgctggcccggcacaaggccgaggaggtgttctatgctgtgaaggtgctgcagaagaaggccatcctgaagaagaaggaggagaagcacatcatgtctgaaagaaatgtgctgctgaagaatgtgaagcaccccttcctggtgggcctgcacttctccttccagacagctgacaagctgtactttgtgctggactacatcaatggaggagagctgttctaccacctgcagcgggagcgctgcttcctggagccccgggcccgcttctatgctgctgagatcgccagcgccctgggctacctgcacagcctgaacatcgtgtacagagacctgaagccagagaacatcctgctggacagccagggccacatcgtgctgacagactttggcctgtgcaaggagaacatcgagcacaacagcaccaccagcaccttctgtggcaccccagagtacctggcccctgaggtgctgcacaagcagccctatgacagaacagtggactggtggtgcctgggcgctgtgctgtatgagatgctgtatggcctgccccccttctacagcaggaacacagctgagatgtatgacaacatcctgaacaagcccctgcagctgaagcccaacatcaccaacagcgcccggcacctgctggagggcctgctgcagaaggacaggaccaagaggctgggcgccaaggatgacttcatggagatcaagagccacgtgttcttcagcctcatcaactgggatgacctgatcaacaagaagatcaccccacccttcaaccccaacgtgtctggccccaatgacctgcggcactttgatcctgagttcacagaggagcctgtgcccaacagcatcggcaagagcccagacagcgtgctggtgacagcctctgtgaaggaggccgctgaggccttcctgggcttctcctatgccccacccacagacagcttcctgtag

SEQ ID NO: 169445 - DNA, 183 bp, Artificial Sequence
  Description of Artificial Sequence: Synthetic coding sequence
atggtgaacaaggacatgaatggcttccctgtgaagaagtgcagcgccttccagttcttcaagaagagggtgcggcgctggatcaagagccccatggtgtctgtggacaagcaccagagccccagcctgaagtacacaggcagctccatggtgcacatccccccaggagagccagacttctag

SEQ ID NO: 169446 - DNA, 1284 bp, Artificial Sequence
  Description of Artificial Sequence: Synthetic coding sequence
atgcagggcctgctgaccagcggcaggaagcccagcggcggcggccgctgcaccggccggggcggctggaggggccagtggtgcctgaagccctggatgggcggcgctgacccccccacccccaccctgagctgcctgctgctgcctgtgcccccagagctgcctgaccactgctacaggatgaacagcagccctgctggcacccccagcccccagcccagccgggccaatggaaacatcaacctgggccccagcgccaaccccaatgcccagcccacagactttgacttcctgaaggtgattggaaaaggaaactacggcaaggtgctgctggccaagaggaagagtgatggagccttctatgctgtgaaggtgctgcagaagaagagcatcctgaagaagaaggagcagagccacatcatggccgagaggtctgtgctgctgaagaatgtgcgccaccccttcctggtgggcctgcgctacagcttccagaccccagagaagctgtactttgtgctggactatgtgaatggaggagagctgttcttccacctgcagcgggagcggcgcttcctggagccccgggcccgcttctacgccgctgaggtggccagcgccatcggctacctgcacagcctgaacatcatctacagagacctgaagccagagaacatcctgctggactgccagggccacgtggtgctgacagactttggcctgtgcaaggagggcgtggagcctgaggacaccaccagcaccttctgtggcaccccagagtacctggcccctgaggtgctgaggaaggagccctatgacagagctgtggactggtggtgcctgggcgctgtgctgtatgagatgctgcacggcctgccccccttctacagccaggatgtgtcccagatgtatgagaacatcctgcaccagcccctgcagatccctgggggccgcacagtggccgcctgtgacctgctgcagagcctgctgcacaaggaccagaggcagaggctgggcagcaaggctgacttcctggagatcaagaaccacgtgttcttcagccccatcaactgggatgacctgtaccacaagaggctgaccccacccttcaaccccaacgtgacaggccctgctgacctgaagcactttgatcctgagttcacccaggaggccgtgtccaagagcatcggctgcaccccagacacagtggccagcagcagcggggccagcagcgccttcctgggcttctcctatgccccagaagatgatgacatcctggactgctag

SEQ ID NO: 169447 - DNA, 1101 bp, Artificial Sequence
  Description of Artificial Sequence: Synthetic coding sequence
atgaacagcagccctgctggcacccccagcccccagcccagccgggccaatggaaacatcaacctgggccccagcgccaaccccaatgcccagcccacagactttgacttcctgaaggtgattggaaaaggaaactacggcaaggtgctgctggccaagaggaagagtgatggagccttctatgctgtgaaggtgctgcagaagaagagcatcctgaagaagaaggagagccacatcatggccgagaggtctgtgctgctgaagaatgtgcgccaccccttcctggtgggcctgcgctacagcttccagaccccagagaagctgtactttgtgctggactatgtgaatggaggagagctgttcttccacctgcagcgggagcggcgcttcctggagccccgggcccgcttctatgctgctgaggtggccagcgccatcggctacctgcacagcctgaacatcatctacagagacctgaagccagagaacatcctgctggactgccagggccacgtggtgctgacagactttggcctgtgcaaggagggcgtggagcctgaggacaccaccagcaccttctgtggcaccccagagtacctggcccctgaggtgctgaggaaggagccctatgacagagctgtggactggtggtgcctgggcgctgtgctgtatgagatgctgcacggcctgccccccttctacagccaggatgtgtcccagatgtatgagaacatcctgcaccagcccctgcagatccctgggggccgcacagtggccgcctgtgacctgctgcagagcctgctgcacaaggaccagaggcagaggctgggcagcaaggctgacttcctggagatcaagaaccacgtgttcttcagccccatcaactgggatgacctgtaccacaagaggctgaccccacccttcaaccccaacgtgactggacctgctgacctgaagcactttgatcctgagttcacccaggaggccgtgtccaagagcatcggctgcaccccagacacagtggccagcagcagcggggccagcagcgccttcctgggcttctcctatgccccagaagatgatgacatcctggactgctag

SEQ ID NO: 169448 - DNA, 1104 bp, Artificial Sequence
  Description of Artificial Sequence: Synthetic coding sequence
atgaacagcagccctgctggcacccccagcccccagcccagccgggccaatggaaacatcaacctgggccccagcgccaaccccaatgcccagcccacagactttgacttcctgaaggtgattggaaaaggaaactacggcaaggtgctgctggccaagaggaagagtgatggagccttctatgctgtgaaggtgctgcagaagaagagcatcctgaagaagaaggagcagagccacatcatggccgagaggtctgtgctgctgaagaatgtgcgccaccccttcctggtgggcctgcgctacagcttccagaccccagagaagctgtactttgtgctggactatgtgaatggaggagagctgttcttccacctgcagcgggagcggcgcttcctggagccccgggcccgcttctacgccgctgaggtggccagcgccatcggctacctgcacagcctgaacatcatctacagagacctgaagccagagaacatcctgctggactgccagggccacgtggtgctgacagactttggcctgtgcaaggagggcgtggagcctgaggacaccaccagcaccttctgtggcaccccagagtacctggcccctgaggtgctgaggaaggagccctatgacagagctgtggactggtggtgcctgggcgctgtgctgtatgagatgctgcacggcctgccccccttctacagccaggatgtgtcccagatgtatgagaacatcctgcaccagcccctgcagatccctgggggccgcacagtggccgcctgtgacctgctgcagagcctgctgcacaaggaccagaggcagaggctgggcagcaaggctgacttcctggagatcaagaaccacgtgttcttcagccccatcaactgggatgacctgtaccacaagaggctgaccccacccttcaaccccaacgtgacaggccctgctgacctgaagcactttgatcctgagttcacccaggaggccgtgtccaagagcatcggctgcaccccagacacagtggccagcagcagcggggccagcagcgccttcctgggcttctcctatgccccagaagatgatgacatcctggactgctag

SEQ ID NO: 169449 - DNA, 1104 bp, Artificial Sequence; identical to SEQ ID NO: 169448
  Description of Artificial Sequence: Synthetic coding sequence

SEQ ID NO: 169450 - DNA, 597 bp, Artificial Sequence
  Description of Artificial Sequence: Synthetic coding sequence
atgaacagcagccctgctggcacccccagcccccagcccagccgggccaatggaaacatcaacctgggccccagcgccaaccccaatgcccagcccacagactttgacttcctgaaggtgattggaaaaggaaactacggcaaggtgctgctggccaagaggaagagtgatggagccttctatgctgtgaaggtgctgcagaagaagagcatcctgaagaagaaggagagccacatcatggccgagaggtctgtgctgctgaagaatgtgcgccaccccttcctggtgggcctgcgctacagcttccagaccccagagaagctgtactttgtgctggactatgtgaatggaggagagctgttcttccacctgcagcgggagcggcgcttcctggagccccgggcccgcttctatgctgctgaggtggccagcgccatcggctacctgcacagcctgaacatcatctacagagacctgaagccagagaacatcctgctggactgccagggccacgtggtgctgacagactttggcctgtgcaaggagggcgtggagcctgaggacaccaccagcaccttctgtggcaccccagagtag

SEQ ID NO: 169451 - DNA, 1104 bp, Artificial Sequence; identical to SEQ ID NO: 169448
  Description of Artificial Sequence: Synthetic coding sequence

SEQ ID NO: 169452 - DNA, 1182 bp, Artificial Sequence
  Description of Artificial Sequence: Synthetic coding sequence
atgcagggcctgctgaccagcggcaggaagcccagcggcggcggccgctgcacagagctgcctgaccactgctacaggatgaacagcagccctgctggcacccccagcccccagcccagccgggccaatggaaacatcaacctgggccccagcgccaaccccaatgcccagcccacagactttgacttcctgaaggtgattggaaaaggaaactacggcaaggtgctgctggccaagaggaagagtgatggagccttctatgctgtgaaggtgctgcagaagaagagcatcctgaagaagaaggagcagagccacatcatggccgagaggtctgtgctgctgaagaatgtgcgccaccccttcctggtgggcctgcgctacagcttccagaccccagagaagctgtactttgtgctggactatgtgaatggaggagagctgttcttccacctgcagcgggagcggcgcttcctggagccccgggcccgcttctacgccgctgaggtggccagcgccatcggctacctgcacagcctgaacatcatctacagagacctgaagccagagaacatcctgctggactgccagggccacgtggtgctgacagactttggcctgtgcaaggagggcgtggagcctgaggacaccaccagcaccttctgtggcaccccagagtacctggcccctgaggtgctgaggaaggagccctatgacagagctgtggactggtggtgcctgggcgctgtgctgtatgagatgctgcacggcctgccccccttctacagccaggatgtgtcccagatgtatgagaacatcctgcaccagcccctgcagatccctgggggccgcacagtggccgcctgtgacctgctgcagagcctgctgcacaaggaccagaggcagaggctgggcagcaaggctgacttcctggagatcaagaaccacgtgttcttcagccccatcaactgggatgacctgtaccacaagaggctgaccccacccttcaaccccaacgtgacaggccctgctgacctgaagcactttgatcctgagttcacccaggaggccgtgtccaagagcatcggctgcaccccagacacagtggccagcagcagcggggccagcagcgccttcctgggcttctcctatgccccagaagatgatgacatcctggactgctag

SEQ ID NO: 169453 - DNA, 1491 bp, Artificial Sequence
  Description of Artificial Sequence: Synthetic coding sequence
atgcagagggaccacaccatggactacaaggagagctgccccagcgtgtccatccccagcagtgatgagcaccgggagaagaagaagcgcttcaccgtgtacaaggtgctggtgtctgtgggccgctctgagtggtttgtgttcagaagatatgcagagtttgacaagctgtacaacaccctgaagaagcagtttcctgccatggccctgaagatcccagccaagaggatctttggagacaactttgatcctgacttcatcaagcagaggcgggccggcctgaatgagttcatccagaacctggtgcgctacccagagctgtacaaccacccagatgtgcgggccttcctgcagatggacagccccaagcaccagagcgaccccagtgaagatgaagatgagaggagcagccagaagctgcacagcaccagccagaacatcaacctgggccccagcggcaacccccacgccaagcccacagactttgacttcctgaaggtgattggcaagggcagctttgggaaggtgctgctggccaagaggaagctggatggcaagttctatgctgtgaaggtgctgcagaagaagatcgtgctgaacaggaaggagcagaagcacatcatggccgagagaaatgtgctgctgaagaatgtgaagcaccccttcctggtgggcctgcactacagcttccagaccacagagaagctgtactttgtgctggactttgtgaatggaggagagctgttcttccacctgcagcgggagaggagcttccctgagcaccgggcccgcttctatgctgctgagatcgccagcgccctgggctacctgcacagcatcaagatcgtgtacagagacctgaagccagagaacatcctgctggacagcgtgggccacgtggtgctgacagactttggcctgtgcaaggagggcatcgccatcagtgacaccaccaccaccttctgtggcaccccagagtacctggcccctgaggtgatcaggaagcagccctatgacaacacagtggactggtggtgcctgggcgctgtgctgtatgagatgctgtatggcctgccccccttctactgcagagatgtggccgagatgtatgacaacatcctgcacaagcccctgagcctgcggcctggggtgtccctgacagcctggagcatcctggaggagctgctggagaaggaccggcagaaccggctgggcgccaaggaggacttcctggagatccagaaccaccccttctttgagagcctgtcctgggccgacctggtgcagaagaagatccccccacccttcaaccccaacgtggccggcccagatgacatccggaactttgacacagccttcacagaggagaccgtgccctacagcgtgtgtgtgtccagtgactacagcatcgtgaatgcctctgtgctggaggctgatgatgcctttgtgggcttctcctatgcccctccttctgaggacctcttcctgtag

SEQ ID NO: 169454 - DNA, 1491 bp, Artificial Sequence; identical to SEQ ID NO: 169453
  Description of Artificial Sequence: Synthetic coding sequence

SEQ ID NO: 169455 - DNA, 1491 bp, Artificial Sequence; identical to SEQ ID NO: 169453
  Description of Artificial Sequence: Synthetic coding sequence

SEQ ID NO: 169456 - DNA, 1491 bp, Artificial Sequence; identical to SEQ ID NO: 169453
  Description of Artificial Sequence: Synthetic coding sequence

SEQ ID NO: 169457 - DNA, 1395 bp, Artificial Sequence
  Description of Artificial Sequence: Synthetic coding sequence
atgcagagggaccacaccatggactacaaggagagctgccccagcgtgtccatccccagcagtgatgagcaccgggagaagaagaagcgcttcaccgtgtacaaggtgctggtgtctgtgggccgctctgagtggtttgtgttcagaagatatgcagagtttgacaagctgtacaacaccctgaagaagcagtttcctgccatggccctgaagatcccagccaagaggatctttggagacaactttgatcctgacttcatcaagcagaggcgggccggcctgaatgagttcatccagaacctggtgcgctacccagagctgtacaaccacccagatgtgcgggccttcctgcagatggacagccccaagcaccagagcgaccccagtgaagatgaagatgagaggagcagccagaagctgcacagcaccagccagaacatcaacctgggccccagcggcaacccccacgccaagcccacagactttgacttcctgaaggtgattggcaagggcagctttgggaaggtgctgctggccaagaggaagctggatggcaagttctatgctgtgaaggtgctgcagaagaagatcgtgctgaacaggaaggagcagaagcacatcatggccgagagaaatgtgctgctgaagaatgtgaagcaccccttcctggtgggcctgcactacagcttccagaccacagagaagctgtactttgtgctggactttgtgaatggaggagagctgttcttccacctgcagcgggagaggagcttccctgagcaccgggcccgcttctatgctgctgagatcgccagcgccctgggctacctgcacagcatcaagatcgtgtacagagacctgaagccagagaacatcctgctggacagcgtgggccacgtggtgctgacagactttggcctgtgcaaggagggcatcgccatcagtgacaccaccaccaccttctgtggcaccccagagccccccttctactgcagagatgtggccgagatgtatgacaacatcctgcacaagcccctgagcctgcggcctggggtgtccctgacagcctggagcatcctggaggagctgctggagaaggaccggcagaaccggctgggcgccaaggaggacttcctggagatccagaaccaccccttctttgagagcctgtcctgggccgacctggtgcagaagaagatccccccacccttcaaccccaacgtggccggcccagatgacatccggaactttgacacagccttcacagaggagaccgtgccctacagcgtgtgtgtgtccagtgactacagcatcgtgaatgcctctgtgctggaggctgatgatgcctttgtgggcttctcctatgcccctccttctgaggacctcttcctgtag

SEQ ID NO: 169458 - DNA, 1491 bp, Artificial Sequence; identical to SEQ ID NO: 169453
  Description of Artificial Sequence: Synthetic coding sequence

SEQ ID NO: 169459 - DNA, 1491 bp, Artificial Sequence; identical to SEQ ID NO: 169453
  Description of Artificial Sequence: Synthetic coding sequence

SEQ ID NO: 169460 - DNA, 1725 bp, Artificial Sequence; identical to SEQ ID NO: 146984
  Description of Artificial Sequence: Synthetic coding sequence

SEQ ID NO: 169461 - DNA, 1611 bp, Artificial Sequence
  Description of Artificial Sequence: Synthetic coding sequence
atggtgctggacctggacctcttccgggtggacaagggcggggaccctgccctgatccgggagacccaggagaagcgcttcaaggaccccggcctggtggaccagctggtgaaggctgacagcgagtggaggcgctgccgcttccgggctgacaacctgaacaagctgaagaacctgtgcagcaagaccatcggggagaagatgaagaagaaggagcctgtgggagatgatgaatctgtgcctgaaaatgtgctgagctttgatgacctgacagcagatgccctggccaacctgaaggtgtcccagatcaagaaggtgcggctgctgattgatgaggccatcctgaagtgtgatgctgagcgcatcaagctggaggccgagagatttgagaacctgcgggagatcggcaacctgctgcaccccagcgtgcccatcagcaatgatgaagatgtggacaacaaggtggagcgcatctggggagactgcaccgtgaggaagaagtacagccacgtggacctggtggtgatggtggatggctttgaaggagagaagggagctgtggtggccggcagccggggctacttcctgaagggcgtgctggtgttcctggagcaggccctgatccagtatgccctgcggaccctgggcagccggggctacatccccatctacacccccttcttcatgaggaaggaggtgatgcaggaggtggcccagctgagccagtttgatgaggagctgtacaaggtgattggaaaaggaagtgagaagagtgatgacaacagctatgatgagaagtacctgattgccaccagcgagcagcccatcgccgccctgcacagagatgagtggctgcggcctgaggacctgcccatcaagtatgccggcctgagcacctgcttccggcaggaggtgggcagccacggccgggacacccggggcatcttccgggtgcaccagtttgagaagattgagcagtttgtgtacagcagcccccatgacaacaagtcctgggagatgtttgaggagatgatcaccacagctgaggagttctaccagagcctgggcatcccctaccacatcgtgaacatcgtgtctggcagcctgaaccacgccgccagcaagaagctggacctggaggcctggttccctggcagcggggccttccgggagctggtgtcctgcagcaactgcacagactaccaggcccggcggctgcgcatccgctatggccagaccaagaagatgatggacaagaggaagaacaacctgcacctgagcacccagaacaagctggaggccagcctcttcagccccaagaaggtggagtttgtgcacatgctgaatgccaccatgtgtgccaccaccaggaccatctgtgccatcctggagaactaccagacagagaagggcatcaccgtgcctgagaagctgaaggagttcatgcctcctggcctgcaggagctgatcccctttgtgaagccagcccccatcgagcaggagcccagcaagaagcagaagaagcagcacgagggcagcaagaagaaggccgccgccagagatgtgaccctggagaaccggctgcagaacatggaggtgacagatgcctag

SEQ ID NO: 169462 - DNA, 1563 bp, Artificial Sequence
  Description of Artificial Sequence: Synthetic coding sequence
atggccgcctccatggcccggcggctgtggcccctgctgacccggcggggcttccggccccggggcggctgcatcagcaatgacagccccaggaggagcttcaccacagagaagaggaacagaaacctgctgtatgaatatgcccgggagggctacagcgccctgccccagctggacatcgagcgcttctgtgcctgcccagaggaggccgcccacgccctggagctgaggaagggggagctgcggtctgctgacctgcctgccatcatcagcacctggcaggagctgcggcagctgcaggagcagatccgcagcctggaggaggagaaggctgctgtgacagaggccgtgcgggccctgctggccaaccaggacagcggggaggtgcagcaggtgcggctggaccccggggccggcagcatcttcggccccaccttcctgcccttccctggccagctgagcctgctggtggaggcccagctggaggagcagttctacctgcaggccctgaagctgcccaaccagacccacccagatgtgcctgtgggagatgagagccaggcccgggtgctgcacatggtgggggacaagcctgtgttctccttccagccccggggccacctggagatcggggagaagctggacatcatccggcagaagaggctgagccacgtgtctggccacaggagctactacctgcggggggccggggccctgctgcagcacggcctggtgaacttcaccttcaacaagctgctgcggcggggcttcacccccatgacagtgcctgacctgctgcggggagctgtgtttgagggctgcggcatgaccccaaatgccaaccccagccagatctacaacatcgaccctgcccgcttcaaggacctgaacctggccggcacagctgaggtgggcctggccggctacttcatggaccacacagtggccttccgggacctgcctgtgaggatggtgtgcagcagcacctgctacagagctgagaccaacacaggccaggagccccggggcctgtacagagtgcaccacttcaccaaggtggagatgtttggagtgactggacctggcctggagcagagcagccagctgctggaggagttcctgagcctgcagatggagatcctgacagagctgggcctgcacttccgggtgctggacatgcccacccaggagctgggcctgcctgcctacaggaagtttgacatcgaggcctggatgcctggccggggccgctttggagaggtgaccagcgccagcaactgcacagacttccagagccggcggctgcacatcatgttccagacagaagctggggagctgcagtttgcccacacagtgaatgccacagcctgtgctgtgccccggctgctgattgccctgctggagagcaaccagcagaaggatggctctgtgctggtgcccccagccctgcagagctacctgggcacagaccgcatcacagcccccacccacgtgcccctgcagtacatcggccccaaccagcccaggaagccaggcctgcccggccagcctgctgtgtcctag

SEQ ID NO: 169463 - DNA, 426 bp, Artificial Sequence
  Description of Artificial Sequence: Synthetic coding sequence
atggagatgctgcagggcctgctgctgctgctgctgctgtccatgggcggggcctgggccagccgggagcccctgcggccctggtgccaccccatcaatgccatcctggccgtggagaaggagggctgccctgtgtgcatcaccgtgaacaccaccatctgtgccggctactgccccaccatgatgagggtgctgcaggccgtgctgccccccctgccccaggtggtgtgcacctacagagatgtgcgctttgagagcatccggctgcccggctgcccccggggcgtggaccctgtggtgtccttccctgtggccctgagctgccgctgtggcccctgccgccgcagcaccagtgactgtggcggccccaaggaccaccccctgacctgtgaccacccccagctgagcggcctgctcttcctgtag

SEQ ID NO: 169464 - DNA, 837 bp, Artificial Sequence
  Description of Artificial Sequence: Synthetic coding sequence
atgggcgcccggctgagcagaagaaggctgcctgctgaccccagcctggccctggatgccctgcccccagagctgctggtgcaggtgctgagccacgtgccccccaggagcctggtgacccgctgcaggcctgtgtgccgggcctggagggacatcgtggatggccccaccgtgtggctgctgcagctggcccgggacagatctgctgagggccgggccctgtatgctgtggcccagcgctgcctgcccagcaatgaagacaaggaggagttccccctgtgtgccctggcccgctactgcctgcgggccccctttggaagaaacctgatcttcaacagctgtggggagcagggcttccggggctgggaggtggagcacggcggcaatggctgggccatcgagaagaacctgacccctgtgcctggggcccccagccagacctgctttgtgaccagctttgagtggtgcagcaagaggcagctggtggacctggtgatggagggcgtgtggcaggagctgctggacagcgcccagatcgagatctgtgtggccgactggtggggcgcccgggagaactgtggctgtgtgtaccagctgcgggtgcggctgctggatgtgtatgagaaggaggtggtgaagttcagcgccagcccagaccctgtgctgcagtggacagagcggggctgccggcaggtgagccacgtgttcaccaactttgggaagggcatccgctacgtgtcctttgagcagtatggaagagatgtgtcctcctgggtgggccactacggggccctggtgacccacagctctgtgcgggtgcgcatccggctgtcctag

SEQ ID NO: 169465 - DNA, 864 bp, Artificial Sequence
  Description of Artificial Sequence: Synthetic coding sequence
ttcaagcagggcctgtggctgctggagatgggcgcccggctgagcagaagaaggctgcctgctgaccccagcctggccctggatgccctgcccccagagctgctggtgcaggtgctgagccacgtgcccccaagaagcctggtgacccgctgcaggcctgtgtgccgggcctggagggacatcgtggatggccccaccgtgtggctgctgcagctggcccgggacagatctgctgagggccgggccctgtatgctgtggcccagcgctgcctgcccagcaatgaagacaaggaggagttccccctgtgtgccctggcccgctactgcctgcgggcccccttcggcaggaacctgatcttcaacagctgtggggagcagggcttccggggctgggaggtggagcacggcggcaatggctgggccatcgagaagaacctgacccctgtgcctggggcccccagccagacctgctttgtgaccagctttgagtggtgcagcaagaggcagctggtggacctggtgatggagggcgtgtggcaggagctgctggacagcgcccagatcgagatctgtgtggccgactggtggggcgcccgggagaactgtggctgtgtgtaccagctgcgggtgcggctgctggatgtgtatgagaaggaggtggtgaagttcagcgccagcccagaccctgtgctgcagtggacagagcggggctgccggcaggtgagccacgtgttcaccaactttgggaagggcatccgctacgtgtcctttgagcagtatggaagagatgtgtcctcctgggtgggccactatggagccctggtgacccacagctctgtgcgggtgcgcatccggctgtcctag

SEQ ID NO: 169466 - DNA, 1563 bp, Artificial Sequence; identical to SEQ ID NO: 169462
  Description of Artificial Sequence: Synthetic coding sequence

SEQ ID NO: 169467 - DNA, 1557 bp, Artificial Sequence
  Description of Artificial Sequence: Synthetic coding sequence
atggagggcgtgtggcaggagctgctggacagcgcccagatcgagatctgtgtggccgactggtggggcgcccgggagaactgtggctgtgtgtaccagctgcgggtgcggctgctggatgtgtatgagaaggaggtggtgaagttcagcgccagcccagaccctgtgctgcagtggacagagcggggctgccggcaggtgagccacgtgttcaccaactttgggaagggcatccgctacgtgtcctttgagcagtatggccgggacatcagcacctggcaggagctgcggcagctgcaggagcagatccgcagcctggaggaggagaaggctgctgtgacagaggccgtgcgggccctgctggccaaccaggacagcggggaggtgcagcaggaccccaagtaccagggcctgcgggcccggggccgggagatcaggaaggagctggtgcacctgtacccccgggaggcccagctggaggagcagttctacctgcaggccctgaagctgcccaaccagacccacccagatgtgcctgtgggagatgagagccaggcccgggtgctgcacatggtgggggacaagcctgtgttctccttccagccccggggccacctggagatcggggagaagctggacatcatccggcagaagaggctgagccacgtgtctggccacaggagctactacctgcggggggccggggccctgctgcagcacggcctggtgaacttcaccttcaacaagctgctgcggcggggcttcacccccatgacagtgcctgacctgctgcggggagctgtgtttgagggctgcggcatgaccccaaatgccaaccccagccagatctacaacatcgaccctgcccgcttcaaggacctgaacctggccggcacagctgaggtgggcctggccggctacttcatggaccacacagtggccttccgggacctgcctgtgaggatggtgtgcagcagcacctgctacagagctgagaccaacacaggccaggagccccggggcctgtacagagtgcaccacttcaccaaggtggagatgtttggagtgactggacctggcctggagcagagcagccagctgctggaggagttcctgagcctgcagatggagatcctgacagagctgggcctgcacttccgggtgctggacatgcccacccaggagctgggcctgcctgcctacaggaagtttgacatcgaggcctggatgcctggccggggccgctttggagaggtgaccagcgccagcaactgcacagacttccagagccggcggctgcacatcatgttccagacagaagctggggagctgcagtttgcccacacagtgaatgccacagcctgtgctgtgccccggctgctgattgccctgctggagagcaaccagcagaaggatggctctgtgctggtgcccccagccctgcagagctacctgggcacagaccgcatcacagcccccacccacgtgcccctgcagtacatcggccccaaccagcccaggaagccaggcctgcccggccagcctgctgtgtcctag

SEQ ID NO: 169468 - DNA, 711 bp, Artificial Sequence
  Description of Artificial Sequence: Synthetic coding sequence
atggccgcctccatggcccggcggctgtggcccctgctgacccggcggggcttccggccccggggcggctgcatcagcaatgacagccccaggaggagcttcaccacagagaagaggaacagaaacctgctgtatgaatatgcccgggagggctacagcgccctgccccagctggacatcgagcgcttctgtgcctgcccagaggaggccgcccacgccctggagctgaggaagggggagctgcggtctgctgacctgcctgccatcatcagcacctggcaggagctgcggcagctgcaggagcagatccgcagcctggaggaggagaaggctgctgtgacagaggccgtgcgggccctgctggccaaccaggacagcggggaggtgcagcaggaccccaagtaccagggcctgcgggcccggggccgggagatcaggaaggagctggtgcacctgtacccccgggaggcccagctggaggagcagttctacctgcaggccctgaagctgcccaaccagacccacccagatgtgcctgtgggagatgagagccaggcccgggtgctgcacatggtgggggacaagccaggggcctgccccacctgcctggccaccggccccatcacctgtgccggcctggagcccagctgcagcacagcctggagcaccagccacagcaccagcttctctgctggggccagccccccatag

SEQ ID NO: 169469 - DNA, 1281 bp, Artificial Sequence
  Description of Artificial Sequence: Synthetic coding sequence
atgcacgccctgtttgctgacagctttgctgccctgggccgcctggacaacatcaccctggtgatggtgttccacccccagtacctggagagcttcctgaagacccagcactacctgctgcagatggatggccccctgcccctgcactaccgccactacatcggcatcatggctgctgcccggcaccagtgcagctacctggtgaacctgcacgtgaatgacttcctgcacgtgggcggggaccccaagtggctgaatggcctggagaatgccccccagaagctgcagaacctgggggagctgaacaaggtgctggcccaccggccctggctgatcaccaaggagcacatcgagggcctgctgaaggccgaggagcacagctggagcctggccgagctggtgcatgctgtggtgctgctgacccactaccacagcctggccagcttcaccttcggctgcggcatcagccctgagatccactgtgatggcggccacaccttccggcccccatctgtgagcaactactgcatctgtgacatcaccaacggcaaccacagcgtggatgagatgcctgtgaacagcgcagaaaatgtgtctgtgtctgacagcttctttgaggtggaggccctgatggagaagatgaggcagctgcaggagtgcagagatgaggaggaggccagccaggaggagatggccagcagatttgaaattgagaagcgggagagcatgtttgtgttcagcagtgatgatgaggaggtgaccccagcccgggctgtgagccgccactttgaggacaccagctatggctacaaggacttcagccgccacggcatgcacgtgcccaccttccgggtgcaggactactgctgggaggaccacggctacagcctggtgaacagactctacccagatgtgggccagctgattgatgagaagttccacatcgcctacaacctgacctacaacaccatggccatgcacaaggatgtggacacctccatgctgcggcgggccatctggaactacatccactgcatgtttggcatccgctatgatgattatgactatggagagatcaaccagctgctggacaggagcttcaaggtgtacatcaagacagtggtgtgcaccccagagaaggtgaccaagaggatgtatgacagcttctggaggcagttcaagcacagcgagaaggtgcacgtgaacctgctgctgattgaggccaggatgcaggccgagctgctgtatgccctgcgggccatcacccgctacatgacctag

SEQ ID NO: 169470 - DNA, 1479 bp, Artificial Sequence
  Description of Artificial Sequence: Synthetic coding sequence
atgaggctggccgccgccgccaatgaggcctacacagcccccctggccgtgtctggcctgctgggctgcaagcagtgtggcggcggccgggaccaggatgaggagctgggcatccgcatcccccggcccctgggccagggccccagccgcttcatccctgagaaggagatcctgcaggtgggctctgaagatgcccagatgcacgccctgtttgctgacagctttgctgccctgggccgcctggacaacatcaccctggtgatggtgttccacccccagtacctggagagcttcctgaagacccagcactacctgctgcagatggatggccccctgcccctgcactaccgccactacatcggcatcatggctgctgcccggcaccagtgcagctacctggtgaacctgcacgtgaatgacttcctgcacgtgggcggggaccccaagtggctgaatggcctggagaatgccccccagaagctgcagaacctgggggagctgaacaaggtgctggcccaccggccctggctgatcaccaaggagcacatcgagggcctgctgaaggccgaggagcacagctggagcctggccgagctggtgcatgctgtggtgctgctgacccactaccacagcctggccagcttcaccttcggctgcggcatcagccctgagatccactgtgatggcggccacaccttccggcccccatctgtgagcaactactgcatctgtgacatcaccaacggcaaccacagcgtggatgagatgcctgtgaacagcgcagaaaatgtgtctgtgtctgacagcttctttgaggtggaggccctgatggagaagatgaggcagctgcaggagtgcagagatgaggaggaggccagccaggaggagatggccagcagatttgaaattgagaagcgggagagcatgtttgtgttcagcagtgatgatgaggaggtgaccccagcccgggctgtgagccgccactttgaggacaccagctatggctacaaggacttcagccgccacggcatgcacgtgcccaccttccgggtgcaggactactgctgggaggaccacggctacagcctggtgaacagactctacccagatgtgggccagctgattgatgagaagttccacatcgcctacaacctgacctacaacaccatggccatgcacaaggatgtggacacctccatgctgcggcgggccatctggaactacatccactgcatgtttggcatccgctatgatgattatgactatggagagatcaaccagctgctggacaggagcttcaaggtgtacatcaagacagtggtgtgcaccccagagaaggtgaccaagaggatgtatgacagcttctggaggcagttcaagcacagcgagaaggtgcacgtgaacctgctgctgattgaggccaggatgcaggccgagctgctgtatgccctgcgggccatcacccgctacatgacctag

SEQ ID NO: 169471 - DNA, 1656 bp, Artificial Sequence
  Description of Artificial Sequence: Synthetic coding sequence
atggccgagggagaaaatgaggtgcgctgggatggcctgtgcagccgggacagcaccacccgggagacagccctggagaacatccggcagaccatcctgaggaagacagagtacctgcggtctgtgaaggagaccccccaccggcccagtgatggcctgagcaacacagagagcagtgatggcctgaacaagctgctggcccacctgctgatgctgagcaagcgctgccccttcaaggatgtgcgggagaagtctgagttcatcctgaagagcatccaggagctgggcatccgcatcccccggcccctgggccagggccccagccgcttcatccctgagaaggagatcctgcaggtgggctctgaagatgcccagatgcacgccctgtttgctgacagctttgctgccctgggccgcctggacaacatcaccctggtgatggtgttccacccccagtacctggagagcttcctgaagacccagcactacctgctgcagatggatggccccctgcccctgcactaccgccactacatcggcatcatggccgccgcccggcaccagtgcagctacctggtgaacctgcacgtgaatgacttcctgcacgtgggcggggaccccaagtggctgaatggcctggagaatgccccccagaagctgcagaacctgggggagctgaacaaggtgctggcccaccggccctggctgatcaccaaggagcacatcgagggcctgctgaaggccgaggagcacagctggagcctggccgagctggtgcatgctgtggtgctgctgacccactaccacagcctggccagcttcaccttcggctgcggcatcagccctgagatccactgtgatggcggccacaccttccggccccccagcgtgagcaactactgcatctgtgacatcaccaatggaaaccacagcgtggatgagatgcctgtgaacagcgcagaaaatgtgtctgtgtctgacagcttctttgaggtggaggccctgatggagaagatgaggcagctgcaggagtgcagagatgaggaggaggccagccaggaggagatggccagcagatttgaaattgagaagcgggagagcatgtttgtgttcagcagtgatgatgaggaggtgaccccagcccgggctgtgagccgccactttgaggacaccagctatggctacaaggacttcagcagacatggcatgcacgtgcccaccttccgggtgcaggactactgctgggaggaccacggctacagcctggtgaaccggctgtacccagatgtgggccagctgattgatgagaagttccacatcgcctacaacctgacctacaacaccatggccatgcacaaggatgtggacacctccatgctgcggcgggccatctggaactacatccactgcatgtttggcatccgctatgatgattatgactatggagagatcaaccagctgctggaccgctccttcaaggtgtacatcaagacagtggtgtgcaccccagagaaggtgaccaagaggatgtatgacagcttctggaggcagttcaagcacagcgagaaggtgcacgtgaacctgctgctgattgaggccaggatgcaggccgagctgctgtatgccctgcgggccatcacccgctacatgacctag

SEQ ID NO: 169472 - DNA, 1302 bp, Artificial Sequence
  Description of Artificial Sequence: Synthetic coding sequence
atgagagctgagggcctgggcggcctggagcgcttctgcagccctgggaagggccggggcctgcgggccctgcagcccttccaggtgggggacctgctcttcagctgcccagcctatgcctacgtgctgactgtgaatgaaagaggcaaccactgtgagtactgcttcaccaggaaggagggcctgagcaaatgtggccgctgcaagcaggccttctactgcaatgtggagtgccagaaggaggactggcccatgcacaagctggagtgcagccccatggtggtgtttggagagaactggaaccccagcgagaccgtgcggctgacagcccgcatcctggccaagcagaagatccaccctgagaggaccccatctgagaagctgctggccgtgaaggagtttgagagccacctggacaagctggacaatgagaagaaggacctgatccagagcgacattgctgccctgcaccacttctacagcaagcacctgggcttcccagacaatgacagcctggtggtgctgtttgcccaggtgaactgcaatggcttcaccattgaagatgaggagctgagccacctgggcagcgccatcttcccagatgtggccctgatgaaccacagctgctgccccaacgtcatcgtgacctacaagggcaccctggccgaggtgcgggctgtgcaggagatcaagccaggagaggaggtgttcaccagctacatcgacctgctgtaccccacagaggacagaaatgaccggctgcgggacagctacttcttcacctgtgagtgccaggagtgcaccaccaaggacaaggacaaggccaaggtggagatcaggaagctgagtgacccccccaaggccgaggccatccgggacatggtgcgctatgccagaaatgtcatcgaggagttccggcgggccaagcactacaagagccccagcgagctgctggagatctgtgagctgagccaggagaagatgagctctgtgtttgaggacagcaatgtgtacatgctgcacatgatgtaccaggccatgggcgtgtgcctgtacatgcaggactgggagggcgccctgcagtatggccagaagatcatcaagccctacagcaagcactaccccctgtacagcctgaatgtggcctccatgtggctgaagctgggccgcctgtacatgggcctggagcacaaggccgccggggagaaggccctgaagaaggccatcgccatcatggaggtggcccacggcaaggaccacccctacatcagcgagatcaagcaggagattgagagccactag

SEQ ID NO: 169473 - DNA, 819 bp, Artificial Sequence
  Description of Artificial Sequence: Synthetic coding sequence
atgagagctgagggcctgggcggcctggagcgcttctgcagccctgggaagggccggggcctgcgggccctgcagcccttccaggtgggggacctgctcttcagctgcccagcctatgcctacgtgctgactgtgaatgaaagaggcaaccactgtgagtactgcttcaccaggaaggagggcctgagcaaatgtggccgctgcaagcaggccttctactgcaatgtggagtgccagaaggaggactggcccatgcacaagctggagtgcagccccatggtggtgtttggagagaactggaaccccagcgagaccgtgcggctgacagcccgcatcctggccaagcagaagatccaccctgagaggaccccatctgagaagctgctggccgtgaaggagtttgagagccacctggacaagctggacaatgagaagaaggacctgatccagagcgacattgctgccctgcaccacttctacagcaagcacctgggcttcccagacaatgacagcctggtggtgctgtttgcccaggtgaactgcaatggcttcaccattgaagatgaggagctgagccacctgggcagcgccatcttcccagatgtggccctgatgaaccacagctgctgccccaacgtcatcgtgacctacaagggcaccctggccgaggtgcgggctgtgcaggagatcaagccaggagaggaggtgttcaccagctacatcgacctgctgtaccccacagaggacagaaatgaccggctgcgggacagctacttcttcacctgtgagtgccaggagtgcaccaccaaggacaagtag

SEQ ID NO: 169474 - DNA, 5712 bp, Artificial Sequence
  Description of Artificial Sequence: Synthetic coding sequence
atggctgctggcacctgggccgctgctgctgctgctgctgctgctgactactttgtgctggtggccttcggcccccacccccggggcagcggggagggccagggccagatcctgcagcgcttccctgagaaggactgggaggacaaccccttcccccagggcatcgagctgttctgccagcccagcggctggcagctgtgcccagagaggaacccccccaccttctttgtggccgtgctgacagacatcaacagcgagcggcactactgtgcctgcctgaccttctgggagcctgctgagcccagccaggagaccaccagggtggaggatgccacagagcgggaggaggagggagatgaaggaggccagacccacctgagccccacagccccagcccccagcgcccagctgtttgcccccaagaccctggtgctggtgtcccggctggaccacacagaggtgttcaggaacagcctgggcctcatctatgccatccacgtggagggcctgaatgtgtgcctggagaatgtcatcggcaacctgctgacctgcaccgtgcccctggccggcggcagccagaggaccatcagcctgggcgctggggaccggcaggtgatccagacccccctggccgacagcctgcctgtgagccgctgcagcgtggccctgctcttccggcagctgggcatcaccaacgtgctgagcctcttctgtgccgccctgacagagcacaaggtgctcttcctgagccgcagctaccagaggctggctgatgcctgccggggcctgctggccctgctcttccccctgcgctacagcttcacctacgtgcccatcctgcctgcccagctgctggaggtgctgagcacccccacccccttcatcatcggcgtgaatgctgccttccaggccgagacccaggagctgctggatgtgattgtggccgacctggatggcggcaccgtgaccatcccagaatgtgtgcacatcccccccctgcctgagcccctgcagagccagacccacagcgtgctgtccatggtgctggaccctgagctggagctggccgacctggccttccccccacccaccaccagcaccagcagcctgaagatgcaggacaaggagctgcgggctgtgttcctgcggctgtttgcccagctgctgcagggctaccgctggtgcctgcacgtggtgcgcatccaccctgagcctgtgatccgcttccacaaggccgccttcctgggccagaggggcctggtggaggatgacttcctgatgaaggtgctggagggcatggcctttgctggctttgtgtctgagcggggcgtgccctaccggcccacagacctgtttgatgagctggtggcccacgaggtggccaggatgagagcagatgagaaccacccccagagggtgctgcggcacgtgcaggagctggccgagcagctgtacaagaatgaaaacccctacccagctgtggccatgcacaaggtgcagaggcctggagagagcagccacctgcggcgggtgccccggcccttcccccggctggatgagggcaccgtgcagtggatcgtggaccaggccgccgccaagatgcagggcgcccccccagctgtgaaggccgagaggaggaccaccgtgcccagcggcccccccatgacagccatcctggagcgctgcagcggcctgcacgtgaacagcgcccggcggctggaggtggtgaggaactgcatctcctatgtgtttgagggcaagatgctggaggccaagaagctgctgcctgctgtgctgcgggccctgaagggccgggccgcccggcgctgcctggcccaggagctgcacctgcacgtgcagcagaacagagctgtgctggaccaccagcagtttgattttgtggtgaggatgatgaactgctgcctgcaggactgcaccagcctggatgaacatggaattgctgctgccctgctgcccctggtgacagccttctgcaggaagctgagccctggggtgacccagtttgcctacagctgtgtgcaggagcacgtggtgtggagcaccccccagttctgggaggccatgttttatggagatgtgcagacccacatccgggccctgtacctggagcccacagaggacctggccccagcccaggaggtgggggaggcccccagccaggaggatgagaggtctgccctggatgtggccagcgagcagaggcggctgtggcccaccctgagccgggagaagcagcaggagctggtgcagaaggaggagagcaccgtcttcagccaggccatccactacgccaacaggatgagctacctgctgctgcccctggacagcagcaagagccggctgctgcgggagagagctggcctgggggacctggagagcgccagcaacagcctggtgaccaacagcatggccggctctgtggccgagagctatgacacagagagcggctttgaagatgctgagacctgtgatgtggccggggctgtggtgcgcttcatcaacagatttgtggacaaggtgtgcacagaaagtggagtgaccagtgaccacctgaagggcctgcacgtgatggtgcctgacatcgtgcagatgcacatcgagaccctggaggccgtgcagcgggagagccggcggctgccccccatccagaagcccaagctgctgcggccccggctgctgcctggagaggagtgtgtgctggatggcctgcgggtgtacctgctgcctgatggccgggaggagggcgccggcggcagcgctgggggccctgccctgctgcctgctgagggcgctgtgttcctgaccacctacagagtcatcttcaccggcatgcccacagaccccctggtgggggagcaggtggtggtgcgctccttccctgtggccgccctgaccaaggagaagaggatctctgtgcagacccctgtggaccagctgctgcaggacggcctgcagctgcggagctgcaccttccagctgctgaagatggcctttgatgaggaggtgggcagtgacagcgctgagctgttcaggaagcagctgcacaagctgcgctaccccccagacatccgggccacctttgccttcaccctgggcagcgcccacaccccaggccggcccccccgggtgaccaaggacaagggccccagcctgcggaccctgagcaggaacctggtgaagaatgccaagaagaccatcggccggcagcacgtgaccaggaagaagtacaaccccccatcctgggagcaccggggccagcccccacctgaggaccaggaggatgagatctctgtgtctgaggagctggagcccagcaccctgacccccagcagcgccctgaagcccagcgacaggatgaccatgagcagcctggtggagcgggcctgctgccgggactaccagaggctgggcctgggcaccctgagcagcagcctgagccgggccaagtctgagcccttccgcatcagccctgtgaacaggatgtatgccatctgccgcagctacccaggcctgctgattgtgccccagagcgtgcaggacaatgccctgcagagggtgagccgctgctaccggcagaaccgcttccctgtggtgtgctggaggagcggccgcagcaaggctgtgctgctgcggagcggcggcctgcatggaaaaggagtggtgggcctcttcaaggcccagaatgcccccagccctggccagagccaggccgacagcagcagcctggagcaggagaagtacctgcaggccgtggtgtcctccatgcccaggtatgcagatgccagcggcaggaacaccctgagcggcttcagcagcgcccacatgggcagccacgtgcccagcccccgggcccgggtgaccaccctgagcaaccccatggccgccagcgccagcagaagaacagccccccggggcaagtggggctctgtgaggaccagcggccgcagcagcggcctgggcacagatgtgggcagccggctggccggcagagatgccctggccccaccccaggccaacggcggccccccagaccccggcttcctgcggccccagagagctgccctgtacatcctgggggacaaggcccagctgaagggcgtgcggagtgaccccctgcagcagtgggagctggtgcccatcgaggtgtttgaggcccggcaggtgaaggccagcttcaagaagctgctgaaggcctgtgtgcccggctgcccagctgctgagcccagccctgccagcttcctgcggagcctggaggacagcgagtggctgatccagatccacaagctgctgcaggtgtctgtgctggtggtggagctgctggacagcggcagctctgtgctggtgggcctggaggatggctgggacatcaccacccaggtggtgtccctggtgcagctgctgagtgaccccttctaccgcaccctggagggcttccggctgctggtggagaaggagtggctgagctttggccaccgcttcagccacagaggagcccacaccctggccggccagagcagcggcttcacccctgtgttcctgcagttcctggactgtgtgcaccaggtgcacctgcagttccccatggagtttgagttcagccagttctacctgaagttcctgggctaccaccacgtgagccgccgcttccgcaccttcctgctggacagcgactatgagcgcatcgagctgggcctgctgtatgaggagaagggggagcggcggggccaggtgccctgccgctctgtgtgggagtatgtggaccggctgagcaagaggacccctgtgttccacaactacatgtatgccccagaagatgctgaggtgctgcggccctacagcaatgtgagcaacctgaaggtgtgggacttctacacagaggagaccctggccgagggccccccctatgactgggagctggcccagggccccccagagcccccagaggaggagaggagtgatggaggagccccccagagcagaagaagagtggtgtggccctgctatgacagctgcccccgggcccagccagatgccatcagccggctgctggaggagctgcagaggctggagacagagctgggccagcctgctgagcgctggaaggacacctgggacagagtgaaggccgcccagaggctggagggccgcccagatggccggggcacccccagcagcctgctggtgtccacagccccccaccaccggcgcagcctgggcgtgtacctgcaggagggccctgtgggcagcaccctgagcctgagcctggacagcgaccagagcagcggcagcaccaccagcggcagccggcaggccgcccggcgcagcaccagcaccctgtacagccagttccagacagctgagagcgagaacagaagctatgagggcaccctgtacaagaagggggccttcatgaagccctggaaggcccgctggtttgtgctggacaagaccaagcaccagctgcgctactatgaccaccgggtggacacagagtgcaagggcgtgattgacctggccgaggtggaggccgtggcccctggcacccccaccatgggcgcccccaagacagtggatgagaaggccttctttgatgtgaagaccacccggcgggtgtacaacttctgtgcccaggatgtgcccagcgcccagcagtgggtggaccgcatccagagctgcctgagtgatgcctag

SEQ ID NO: 169475 - DNA, 2697 bp, Artificial Sequence
  Description of Artificial Sequence: Synthetic coding sequence
atggctgctggcacctgggccgctgctgctgctgctgctgctgctgactactttgtgctggtggccttcggcccccacccccggggcagcggggagggccagggccagatcctgcagcgcttccctgagaaggactgggaggacaaccccttcccccagggcatcgagctgttctgccagcccagcggctggcagctgtgcccagagaggaacccccccaccttctttgtggccgtgctgacagacatcaacagcgagcggcactactgtgcctgcctgaccttctgggagcctgctgagcccagccagcaggagaccaccagggtggaggatgccacagagcgggaggaggagggagatgagggcggccagacccacctgagccccacagccccagcccccagcgcccagctgtttgcccccaagaccctggtgctggtgtcccggctggaccacacagaggtgttcaggaacagcctgggcctcatctatgccatccacgtggagggcctgaatgtgtgcctggagaatgtgattggcaacctgctgacctgcaccgtgcccctggccggcggcagccagaggaccatcagcctgggcgctggggaccggcaggtgatccagacccccctggccgacagcctgcctgtgagccgctgcagcgtggccctgctcttccggcagctgggcatcaccaacgtgctgagcctcttctgtgccgccctgacagagcacaaggtgctcttcctgagccgcagctaccagaggctggctgatgcctgccggggcctgctggccctgctcttccccctgcgctacagcttcacctacgtgcccatcctgcctgcccagctgctggaggtgctgagcacccccacccccttcatcattggagtgaatgctgccttccaggccgagacccaggagctgctggatgtgattgtggccgacctggatggcggcaccgtgaccatcccagaatgtgtgcacatcccccccctgcctgagcccctgcagagccagacccacagcgtgctgtccatggtgctggaccctgagctggagctggccgacctggccttccccccacccaccaccagcaccagcagcctgaagatgcaggacaaggagctgcgggctgtgttcctgcggctgtttgcccagctgctgcagggctaccgctggtgcctgcacgtggtgcgcatccaccctgagcccgtcatccgcttccacaaggccgccttcctgggccagaggggcctggtggaggatgacttcctgatgaaggtgctggagggcatggcctttgctggctttgtgtctgagcggggcgtgccctaccggcccacagacctgtttgatgagctggtggcccacgaggtggccaggatgagagcagatgagaaccacccccagagggtgctgcggcacgtgcaggagctggccgagcagctgtacaagaatgaaaacccctacccagctgtggccatgcacaaggtgcagaggcctggagagagcagccacctgcggcgggtgccccggcccttcccccggctggatgagggcaccgtgcagtggatcgtggaccaggccgccgccaagatgcagggcgcccctcctgctgtgaaggccgagaggaggaccaccgtgcccagcggcccccccatgacagccatcctggagcgctgcagcggcctgcacgtgaacagcgcccggcggctggaggtggtgaggaactgcatctcctatgtgtttgagggcaagatgctggaggccaagaagctgctgcctgctgtgctgcgggccctgaagggccgggccgcccggcgctgcctggcccaggagctgcacctgcacgtgcagcagaacagagctgtgctggaccaccagcagtttgattttgtggtgaggatgatgaactgctgcctgcaggactgcaccagcctggatgagcacggcattgctgctgccctgctgcccctggtgacagccttctgcaggaagctgagccctggggtgacccagtttgcctacagctgtgtgcaggagcacgtggtgtggagcaccccccagttctgggaggccatgttttatggagatgtgcagacccacatccgggccctgtacctggagcccacagaggacctggccccagcccaggaggtgggggaggcccccagccaggaggatgagaggtctgccctggatgtggccagcgagcagaggcggctgtggcccaccctgagccgggagaagcagcaggagctggtgcagaaggaggagagcacagtgttcagccaggccatccactacgccaacaggatgagctacctgctgctgcccctggacagcagcaagagccggctgctgcgggagcgggccggcctgggggacctggagagcgccagcaacagcctggtgaccaacagcatggccggctctgtggccgagagctatgacacagaaagtggctttgaagatgctgagacctgtgatgtggccggggctgtggtgcgcttcatcaacagatttgtggacaaggtgtgcacagagagcggcgtgaccagtgaccacctgaagggcctgcacgtgatggtgcctgacatcgtgcagatgcacatcgagaccctggaggccgtgcagcgggagagccggcggctgccccccatccagaagcccaagctgctgcggccctag

SEQ ID NO: 169476 - DNA, 5682 bp, Artificial Sequence
  Description of Artificial Sequence: Synthetic coding sequence
atggcccggctggccgactactttgtgctggtggccttcggcccccacccccggggcagcggggagggccagggccagatcctgcagcgcttccctgagaaggactgggaggacaaccccttcccccagggcatcgagctgttctgccagcccagcggctggcagctgtgcccagagaggaacccccccaccttctttgtggccgtgctgacagacatcaacagcgagcggcactactgtgcctgcctgaccttctgggagcctgctgagcccagccaggagaccaccagggtggaggatgccacagagcgggaggaggagggagatgaaggaggccagacccacctgagccccacagccccagcccccagcgcccagctgtttgcccccaagaccctggtgctggtgtcccggctggaccacacagaggtgttcaggaacagcctgggcctcatctatgccatccacgtggagggcctgaatgtgtgcctggagaatgtcatcggcaacctgctgacctgcaccgtgcccctggccggcggcagccagaggaccatcagcctgggcgctggggaccggcaggtgatccagacccccctggccgacagcctgcctgtgagccgctgcagcgtggccctgctcttccggcagctgggcatcaccaacgtgctgagcctcttctgtgccgccctgacagagcacaaggtgctcttcctgagccgcagctaccagaggctggctgatgcctgccggggcctgctggccctgctcttccccctgcgctacagcttcacctacgtgcccatcctgcctgcccagctgctggaggtgctgagcacccccacccccttcatcatcggcgtgaatgctgccttccaggccgagacccaggagctgctggatgtgattgtggccgacctggatggcggcaccgtgaccatcccagaatgtgtgcacatcccccccctgcctgagcccctgcagagccagacccacagcgtgctgtccatggtgctggaccctgagctggagctggccgacctggccttccccccacccaccaccagcaccagcagcctgaagatgcaggacaaggagctgcgggctgtgttcctgcggctgtttgcccagctgctgcagggctaccgctggtgcctgcacgtggtgcgcatccaccctgagcctgtgatccgcttccacaaggccgccttcctgggccagaggggcctggtggaggatgacttcctgatgaaggtgctggagggcatggcctttgctggctttgtgtctgagcggggcgtgccctaccggcccacagacctgtttgatgagctggtggcccacgaggtggccaggatgagagcagatgagaaccacccccagagggtgctgcggcacgtgcaggagctggccgagcagctgtacaagaatgaaaacccctacccagctgtggccatgcacaaggtgcagaggcctggagagagcagccacctgcggcgggtgccccggcccttcccccggctggatgagggcaccgtgcagtggatcgtggaccaggccgccgccaagatgcagggcgcccccccagctgtgaaggccgagaggaggaccaccgtgcccagcggcccccccatgacagccatcctggagcgctgcagcggcctgcacgtgaacagcgcccggcggctggaggtggtgaggaactgcatctcctatgtgtttgagggcaagatgctggaggccaagaagctgctgcctgctgtgctgcgggccctgaagggccgggccgcccggcgctgcctggcccaggagctgcacctgcacgtgcagcagaacagagctgtgctggaccaccagcagtttgattttgtggtgaggatgatgaactgctgcctgcaggactgcaccagcctggatgaacatggaattgctgctgccctgctgcccctggtgacagccttctgcaggaagctgagccctggggtgacccagtttgcctacagctgtgtgcaggagcacgtggtgtggagcaccccccagttctgggaggccatgttttatggagatgtgcagacccacatccgggccctgtacctggagcccacagaggacctggccccagcccaggaggtgggggaggcccccagccaggaggatgagaggtctgccctggatgtggccagcgagcagaggcggctgtggcccaccctgagccgggagaagcagcaggagctggtgcagaaggaggagagcaccgtcttcagccaggccatccactacgccaacaggatgagctacctgctgctgcccctggacagcagcaagagccggctgctgcgggagagagctggcctgggggacctggagagcgccagcaacagcctggtgaccaacagcatggccggctctgtggccgagagctatgacacagagagcggctttgaagatgctgagacctgtgatgtggccggggctgtggtgcgcttcatcaacagatttgtggacaaggtgtgcacagaaagtggagtgaccagtgaccacctgaagggcctgcacgtgatggtgcctgacatcgtgcagatgcacatcgagaccctggaggccgtgcagcgggagagccggcggctgccccccatccagaagcccaagctgctgcggccccggctgctgcctggagaggagtgtgtgctggatggcctgcgggtgtacctgctgcctgatggccgggaggagggcgccggcggcagcgctgggggccctgccctgctgcctgctgagggcgctgtgttcctgaccacctacagagtcatcttcaccggcatgcccacagaccccctggtgggggagcaggtggtggtgcgctccttccctgtggccgccctgaccaaggagaagaggatctctgtgcagacccctgtggaccagctgctgcaggacggcctgcagctgcggagctgcaccttccagctgctgaagatggcctttgatgaggaggtgggcagtgacagcgctgagctgttcaggaagcagctgcacaagctgcgctaccccccagacatccgggccacctttgccttcaccctgggcagcgcccacaccccaggccggcccccccgggtgaccaaggacaagggccccagcctgcggaccctgagcaggaacctggtgaagaatgccaagaagaccatcggccggcagcacgtgaccaggaagaagtacaaccccccatcctgggagcaccggggccagcccccacctgaggaccaggaggatgagatctctgtgtctgaggagctggagcccagcaccctgacccccagcagcgccctgaagcccagcgacaggatgaccatgagcagcctggtggagcgggcctgctgccgggactaccagaggctgggcctgggcaccctgagcagcagcctgagccgggccaagtctgagcccttccgcatcagccctgtgaacaggatgtatgccatctgccgcagctacccaggcctgctgattgtgccccagagcgtgcaggacaatgccctgcagagggtgagccgctgctaccggcagaaccgcttccctgtggtgtgctggaggagcggccgcagcaaggctgtgctgctgcggagcggcggcctgcatggaaaaggagtggtgggcctcttcaaggcccagaatgcccccagccctggccagagccaggccgacagcagcagcctggagcaggagaagtacctgcaggccgtggtgtcctccatgcccaggtatgcagatgccagcggcaggaacaccctgagcggcttcagcagcgcccacatgggcagccacgtgcccagcccccgggcccgggtgaccaccctgagcaaccccatggccgccagcgccagcagaagaacagccccccggggcaagtggggctctgtgaggaccagcggccgcagcagcggcctgggcacagatgtgggcagccggctggccggcagagatgccctggccccaccccaggccaacggcggccccccagaccccggcttcctgcggccccagagagctgccctgtacatcctgggggacaaggcccagctgaagggcgtgcggagtgaccccctgcagcagtgggagctggtgcccatcgaggtgtttgaggcccggcaggtgaaggccagcttcaagaagctgctgaaggcctgtgtgcccggctgcccagctgctgagcccagccctgccagcttcctgcggagcctggaggacagcgagtggctgatccagatccacaagctgctgcaggtgtctgtgctggtggtggagctgctggacagcggcagctctgtgctggtgggcctggaggatggctgggacatcaccacccaggtggtgtccctggtgcagctgctgagtgaccccttctaccgcaccctggagggcttccggctgctggtggagaaggagtggctgagctttggccaccgcttcagccacagaggagcccacaccctggccggccagagcagcggcttcacccctgtgttcctgcagttcctggactgtgtgcaccaggtgcacctgcagttccccatggagtttgagttcagccagttctacctgaagttcctgggctaccaccacgtgagccgccgcttccgcaccttcctgctggacagcgactatgagcgcatcgagctgggcctgctgtatgaggagaagggggagcggcggggccaggtgccctgccgctctgtgtgggagtatgtggaccggctgagcaagaggacccctgtgttccacaactacatgtatgccccagaagatgctgaggtgctgcggccctacagcaatgtgagcaacctgaaggtgtgggacttctacacagaggagaccctggccgagggccccccctatgactgggagctggcccagggccccccagagcccccagaggaggagaggagtgatggaggagccccccagagcagaagaagagtggtgtggccctgctatgacagctgcccccgggcccagccagatgccatcagccggctgctggaggagctgcagaggctggagacagagctgggccagcctgctgagcgctggaaggacacctgggacagagtgaaggccgcccagaggctggagggccgcccagatggccggggcacccccagcagcctgctggtgtccacagccccccaccaccggcgcagcctgggcgtgtacctgcaggagggccctgtgggcagcaccctgagcctgagcctggacagcgaccagagcagcggcagcaccaccagcggcagccggcaggccgcccggcgcagcaccagcaccctgtacagccagttccagacagctgagagcgagaacagaagctatgagggcaccctgtacaagaagggggccttcatgaagccctggaaggcccgctggtttgtgctggacaagaccaagcaccagctgcgctactatgaccaccgggtggacacagagtgcaagggcgtgattgacctggccgaggtggaggccgtggcccctggcacccccaccatgggcgcccccaagacagtggatgagaaggccttctttgatgtgaagaccacccggcgggtgtacaacttctgtgcccaggatgtgcccagcgcccagcagtgggtggaccgcatccagagctgcctgagtgatgcctag

SEQ ID NO: 169477 - DNA, 5604 bp, Artificial Sequence
  Description of Artificial Sequence: Synthetic coding sequence
atggcccggctggccgactactttgtgctggtggccttcggcccccacccccggggcagcggggagggccagggccagatcctgcagcgcttccctgagaaggactgggaggacaaccccttcccccagggcatcgagctgttctgccagcccagcggctggcagctgtgcccagagaggaacccccccaccttctttgtggccgtgctgacagacatcaacagcgagcggcactactgtgcctgcctgaccttctgggagcctgctgagcccagccaggagaccaccagggtggaggatgccacagagcgggaggaggagggagatgaaggaggccagacccacctgagccccacagccccagcccccagcgcccagctgtttgcccccaagaccctggtgctggtgtcccggctggaccacacagaggtgttcaggaacagcctgggcctcatctatgccatccacgtggagggcctgaatgtgtgcctggagaatgtcatcggcaacctgctgacctgcaccgtgcccctggccggcggcagccagaggaccatcagcctgggcgctggggaccggcaggtgatccagacccccctggccgacagcctgcctgtgagccgctgcagcgtggccctgctcttccggcagctgggcatcaccaacgtgctgagcctcttctgtgccgccctgacagagcacaaggtgctcttcctgagccgcagctaccagaggctggctgatgcctgccggggcctgctggccctgctcttccccctgcgctacagcttcacctacgtgcccatcctgcctgcccagctgctggaggtgctgagcacccccacccccttcatcatcggcgtgaatgctgccttccaggccgagacccaggagctgctggatgtgattgtggccgacctggatggcggcaccgtgaccatcccagaatgtgtgcacatcccccccctgcctgagcccctgcagagccagacccacagcgtgctgtccatggtgctggaccctgagctggagctggccgacctggccttccccccacccaccaccagcaccagcagcctgaagatgcaggacaaggagctgcgggctgtgttcctgcggctgtttgcccagctgctgcagggctaccgctggtgcctgcacgtggtgcgcatccaccctgagcctgtgatccgcttccacaaggccgccttcctgggccagaggggcctggtggaggatgacttcctgatgaaggtgctggagggcatggcctttgctggctttgtgtctgagcggggcgtgccctaccggcccacagacctgtttgatgagctggtggcccacgaggtggccaggatgagagcagatgagaaccacccccagagggtgctgcggcacgtgcaggagctggccgagcagctgtacaagaatgaaaacccctacccagctgtggccatgcacaaggtgcagaggcctggagagagcagccacctgcggcgggtgccccggcccttcccccggctggatgagggcaccgtgcagtggatcgtggaccaggccgccgccaagatgcagggcgcccccccagctgtgaaggccgagaggaggaccaccgtgcccagcggcccccccatgacagccatcctggagcgctgcagcggcctgcacgtgaacagcgcccggcggctggaggtggtgaggaactgcatctcctatgtgtttgagggcaagatgctggaggccaagaagctgctgcctgctgtgctgcgggccctgaagggccgggccgcccggcgctgcctggcccaggagctgcacctgcacgtgcagcagaacagagctgtgctggaccaccagcagtttgattttgtggtgaggatgatgaactgctgcctgcaggactgcaccagcctggatgaacatggaattgctgctgccctgctgcccctggtgacagccttctgcaggaagctgagccctggggtgacccagtttgcctacagctgtgtgcaggagcacgtggtgtggagcaccccccagttctgggaggccatgttttatggagatgtgcagacccacatccgggccctgtacctggagcccacagaggacctggccccagcccaggaggtgggggaggcccccagccaggaggatgagaggtctgccctggatgtggccagcgagcagaggcggctgtggcccaccctgagccgggagaagcagcaggagctggtgcagaaggaggagagcaccgtcttcagccaggccatccactacgccaacaggatgagctacctgctgctgcccctggacagcagcaagagccggctgctgcgggagagagctggcctgggggacctggagagcgccagcaacagcctggtgaccaacagcatggccggctctgtggccgagagctatgacacagagagcggctttgaagatgctgagacctgtgatgtggccggggctgtggtgcgcttcatcaacagatttgtggacaaggtgtgcacagaaagtggagtgaccagtgaccacctgaagggcctgcacgtgatggtgcctgacatcgtgcagatgcacatcgagaccctggaggccgtgcagcgggagagccggcggctgccccccatccagaagcccaagctgctgcggccccggctgctgcctggagaggagtgtgtgctggatggcctgcgggtgtacctgctgcctgatggccgggaggagggcgccggcggcagcgctgggggccctgccctgctgcctgctgagggcgctgtgttcctgaccacctacagagtcatcttcaccggcatgcccacagaccccctggtgggggagcaggtggtggtgcgctccttccctgtggccgccctgaccaaggagaagaggatctctgtgcagacccctgtggaccagctgctgcaggacggcctgcagctgcggagctgcaccttccagctgctgaagatggcctttgatgaggaggtgggcagtgacagcgctgagctgttcaggaagcagctgcacaagctgcgctaccccccagacatccgggccacctttgccttcaccctgggcagcgcccacaccccaggccggcccccccgggtgaccaaggacaagggccccagcctgcggaccctgagcaggaacctggtgaagaatgccaagaagaccatcggccggcagcacgtgaccaggaagaagtacaaccccccatcctgggagcaccggggccagcccccacctgaggaccaggaggatgagatctctgtgtctgaggagctggagcccagcaccctgacccccagcagcgccctgaagcccagcgacaggatgaccatgagcagcctggtggagcgggcctgctgccgggactaccagaggctgggcctgggcaccctgagcagcagcctgagccgggccaagtctgagcccttccgcatcagccctgtgaacaggatgtatgccatctgccgcagctacccaggcctgctgattgtgccccagagcgtgcaggacaatgccctgcagagggtgagccgctgctaccggcagaaccgcttccctgtggtgtgctggaggagcggccgcagcaaggctgtgctgctgcggagcggcggcctgcatggaaaaggagtggtgggcctcttcaaggcccagaatgcccccagccctggccagagccaggccgacagcagcagcctggagcaggagaagtacctgcaggccgtggtgtcctccatgcccaggtatgcagatgccagcggcaggaacaccctgagcggcttcagcagcgcccacatgggcagccacggcaagtggggctctgtgaggaccagcggccgcagcagcggcctgggcacagatgtgggcagccggctggccggcagagatgccctggccccaccccaggccaacggcggccccccagaccccggcttcctgcggccccagagagctgccctgtacatcctgggggacaaggcccagctgaagggcgtgcggagtgaccccctgcagcagtgggagctggtgcccatcgaggtgtttgaggcccggcaggtgaaggccagcttcaagaagctgctgaaggcctgtgtgcccggctgcccagctgctgagcccagccctgccagcttcctgcggagcctggaggacagcgagtggctgatccagatccacaagctgctgcaggtgtctgtgctggtggtggagctgctggacagcggcagctctgtgctggtgggcctggaggatggctgggacatcaccacccaggtggtgtccctggtgcagctgctgagtgaccccttctaccgcaccctggagggcttccggctgctggtggagaaggagtggctgagctttggccaccgcttcagccacagaggagcccacaccctggccggccagagcagcggcttcacccctgtgttcctgcagttcctggactgtgtgcaccaggtgcacctgcagttccccatggagtttgagttcagccagttctacctgaagttcctgggctaccaccacgtgagccgccgcttccgcaccttcctgctggacagcgactatgagcgcatcgagctgggcctgctgtatgaggagaagggggagcggcggggccaggtgccctgccgctctgtgtgggagtatgtggaccggctgagcaagaggacccctgtgttccacaactacatgtatgccccagaagatgctgaggtgctgcggccctacagcaatgtgagcaacctgaaggtgtgggacttctacacagaggagaccctggccgagggccccccctatgactgggagctggcccagggccccccagagcccccagaggaggagaggagtgatggaggagccccccagagcagaagaagagtggtgtggccctgctatgacagctgcccccgggcccagccagatgccatcagccggctgctggaggagctgcagaggctggagacagagctgggccagcctgctgagcgctggaaggacacctgggacagagtgaaggccgcccagaggctggagggccgcccagatggccggggcacccccagcagcctgctggtgtccacagccccccaccaccggcgcagcctgggcgtgtacctgcaggagggccctgtgggcagcaccctgagcctgagcctggacagcgaccagagcagcggcagcaccaccagcggcagccggcaggccgcccggcgcagcaccagcaccctgtacagccagttccagacagctgagagcgagaacagaagctatgagggcaccctgtacaagaagggggccttcatgaagccctggaaggcccgctggtttgtgctggacaagaccaagcaccagctgcgctactatgaccaccgggtggacacagagtgcaagggcgtgattgacctggccgaggtggaggccgtggcccctggcacccccaccatgggcgcccccaagacagtggatgagaaggccttctttgatgtgaagaccacccggcgggtgtacaacttctgtgcccaggatgtgcccagcgcccagcagtgggtggaccgcatccagagctgcctgagtgatgcctag

SEQ ID NO: 169478 - DNA, 5550 bp, Artificial Sequence
  Description of Artificial Sequence: Synthetic coding sequence
atggcccggctggccgactacttcatcgtggtgggctatgaccacgagaagccaggcagcggggagggcctgggcaagatcatccagcgcttcccccagaaggactgggatgacacccccttcccccagggcatcgagctgttctgccagcccggcggctggcagctgagccgggagaggaagcagcccaccttctttgtggtggtgctgacagacatcgacagcgacagacactactgcagctgcctgaccttctatgaggccgagatcaacctgcagggcaccaagaaggaggagattgaaggagaggccaaggtgtctggcctcatccagcctgctgaggtgtttgcccccaagagcctggtgctggtgtcccggctgtactacccagagatcttccgggcctgcctgggcctcatctacacagtgtatgtggacagcctgaatgtgtccctggagagcctcatcgccaacctgtgtgcctgcctggtgcctgctgctgggggcagccagaagctgttcagcctgggcgctggggaccggcagctgatccagacccccctgcatgacagcctgcccatcaccggcacctctgtggccctgctcttccagcagctgggcatccagaatgtgctgagcctcttctgtgctgtgctgacagagaacaaggtgctcttccacagcgccagcttccagaggctgagtgatgcctgccgggccctggagagcctgatgttccccctgaagtacagctacccctacatccccatcctgcctgcccagctgctggaggtgctgagcagccccacccccttcatcatcggcgtgcacagcgtcttcaagacagatgtgcatgagctgctggatgtgatcatcgctgacctggatggcggcaccatcaagatccctgagtgcatccacctgagcagcctgcctgagcccctgctgcaccagacccagagcgccctgagcctcatcctgcacccagacctggaggtggccgaccacgccttccccccacccaggacagccctgagccacagcaagatgctggacaaggaggtgcgggctgtgttcctgcggctgtttgcccagctgttccagggctaccgcagctgcctgcagctgatccgcatccatgctgagcctgtgatccacttccacaagacagccttcctgggccagaggggcctggtggagaatgacttcctgaccaaggtgctgagcggcatggcctttgctggctttgtgtctgagcggggccccccctaccgcagctgtgacctgtttgatgagctggtggcctttgaggtggagcgcatcaaggtggaggagaacaaccctgtgaagatgatcaagcacgtgcgggagctggccgagcagctgttcaagaatgaaaaccccaacccccacatggccttccagaaggtgccccggcccacagagggcagccacctgcgggtgcacatcctgcccttccctgagatcaatgaggcccgggtgcaggagctgatccaggagaatgtggccaagaaccagaatgcccccccagccaccagaattgagaagaagtgtgtggtgcctgctggcccccctgtggtgtccatcatggacaaggtgaccaccgtcttcaacagcgcccagaggctggaggtggtgaggaactgcatctccttcatctttgagaacaagatcctggagacagagaagaccctgcctgctgccctgcgggccctgaagggcaaggccgcccggcagtgcctgacagatgagctgggcctgcacgtgcagcagaacagagccatcctggaccaccagcagtttgactacatcatccgcatgatgaactgcaccctgcaggactgcagcagcctggaggagtacaacattgctgctgccctgctgcccctgaccagcgccttctacaggaagctggcccctggggtgtcccagtttgcctacacctgtgtgcaggaccaccccatctggaccaaccagcagttctgggagaccaccttctacaatgctgtgcaggagcaggtgcgcagcctgtacctgagcgccaaggaggacaaccacgccccccacctgaagcagaaggacaagctgcctgatgaccactaccaggagaagacagccatggacctggccgctgagcagctgcggctgtggcccaccctgagcaagagcacccagcaggagctggtgcagcacgaggagagcaccgtcttcagccaggccatccactttgccaacctgatggtgaacctgctggtgcccctggacaccagcaagaacaagctgctgcggaccagcgcccctggggactgggagagcggcagcaacagcatcgtgaccaacagcattgctggctctgtggccgagagctatgacacagaaagtggctttgaggacagtgaaaatacagacatcgccaacagcgtggtgcgcttcatcacccgcttcatcgacaaggtgtgcacagagagcggcgtgacccaggaccacatcaagagcctgcactgcatgatccctggcatcgtggccatgcacatcgagaccctggaggccgtgcaccgggagagccggcggctgccccccatccagaagcccaagatcctgcggcctgccctgctgcccggggaggagatcgtgtgtgagggcctgcgggtgctgctggaccctgatggccgggaggaggccaccggcggcctgctgggcggcccccagctgctgcctgctgagggcgccctcttcctgaccacctaccgcatcctcttccggggcacccctcatgaccagctggtgggggagcagacagtggtgcgctccttccccatcgccagcatcaccaaggagaagaagatcaccatgcagaaccagctgcagcagaacatgcaggagggcctgcagatcaccagcgccagcttccagctgatcaaggtggcctttgatgaggaggtgtccccagaggtggtggagatcttcaagaagcagctgatgaagttccgctacccccagagcatcttcagcacctttgcctttgctgctggccagaccaccccccagatcatcctgcccaagcagaaggagaagaacaccagcttccgcaccttcagcaagaccatcgtgaagggggccaagagagctgggaagatgaccatcggccggcagtacctgctgaagaagaagacaggcaccatcgtggaggagcgggtgaaccggcccggctggaatgaagatgatgatgtgtctgtgtctgatgagagcgagctgcccaccagcaccaccctgaaggccagcgagaagagcaccatggagcagctggtggagaaggcctgcttccgggactaccagaggctgggcctgggcaccatcagcggcagcagcagccgcagcaggcctgagtacttccgcatcacagccagcaacaggatgtacagcctgtgccgcagctacccaggcctgctggtggtgccccaggccgtgcaggacagcagcctgccccgggtggcccgctgctaccgccacaaccggctgcctgtggtgtgctggaagaacagccgcagcggcaccctgctgctgcggagcggcggcttccatggaaaaggagtggtgggcctcttcaagagccagaacagcccccaggccgcccccaccagcagcctggagagcagcagcagcattgagcaggagaagtacctgcaggccctgctgaatgctgtgtctgtgcaccagaagctgcggggcaacagcaccctgactgtgcggcctgcctttgccctgagccctggggtgtgggccagcctgcggagcagcaccaggctcatcagcagccccaccagcttcattgatgtgggcgcccggctggccggcaaggaccacagcgccagcttcagcaacagcagctacctgcagaaccagctgctgaagaggcaggccgccctgtacatctttggagagaagagccagctgaggaacttcaaggtggagtttgccctgaactgtgaatttgtgcctgtggagttccacgagatccggcaggtgaaggccagcttcaagaagctgatgagggcctgcatccccagcaccatccccacagattctgaggtgaccttcctgaaggccctgggggacagcgagtggttcccccagctgcaccgcatcatgcagctggccgtggtggtgtctgaggtgctggagaatggcagctctgtgctggtgtgcctggaggagggctgggacatcacagcccaggtgaccagcctggtgcagctgctgagtgaccccttctaccgcaccctggagggcttccagatgctggtggagaaggagtggctgagctttggccacaagttcagccagaggagcagcctgaccctgaactgccagggcagcggctttgcccctgtgttcctgcagttcctggactgtgtgcaccaggtgcacaaccagtaccccacagaatttgagttcaacctgtactacctgaagttcctggccttccactacgtgagcaaccgcttcaagaccttcctgctggacagcgactatgaaaggctggagcacggcaccctgtttgatgacaagggggagaagcacgccaagaagggcgtgtgcatctgggagtgcatcgacaggatgcacaagaggagccccatcttcttcaactacctgtacagccccctggagattgaggccctgaagcccaacgtgaatgtgagcagcctgaagaagtgggactactacatcgaggagaccctgagcacaggccccagctatgactggatgatgctgacccccaagcacttccccagtgaagattctgacctggccggggaggccggccccaggagccagaggagaacagtgtggccctgctatgatgatgtgtcctgcacccagccagatgccctgaccagcctcttcagcgagattgagaagctggagcacaagctgaaccaggcccctgagaagtggcagcagctgtgggagcgggtgacagtggacctgaaggaggagcccaggacagacaggagccagaggcacctgagccgcagccctggcatcgtgtccaccaacctgcccagctaccagaagaggagcctgctgcacctgcctgacagctccatgggagaggagcagaacagcagcatcagccccagcaatggagtggagaggagagctgccaccctgtacagccagtacaccagcaagaatgatgagaacagaagctttgagggcaccctgtacaagagaggagccctgctgaagggctggaagccccgctggtttgtgctggatgtgaccaagcaccagctgcgctactatgattctggagaggacaccagctgcaagggccacatcgacctggccgaggtggagatggtgatcccagctggccccagcatgggcgcccccaagcacaccagtgacaaggccttctttgacctgaagaccagcaagagggtgtacaacttctgtgcccaggacggccagagcgcccagcagtggatggacaagatccagagctgcatcagtgatgcctag

SEQ ID NO: 169479 - DNA, 4791 bp, Artificial Sequence
  Description of Artificial Sequence: Synthetic coding sequence
atggagagccgggagaccctgagcagcagccggcagaggggcggggagagtgacttcctgcctgtgagcagcgccaagcccccagctgcccctggctgtgccggggagcccctgctgagcaccccaggccctgggaagggcatccctgtgggcggggagaggatggagcctgaggaggaggatgagctgggcagcggcagagatgtggacagcaacagcaatgctgacagcgagaagtgggtggccggagatggcctggaggagcaggagttcagcatcaaggaggccaacttcacagagggcagcctgaagctgaagatccagaccaccaagagggccaagaagccacccaagaacctggagaactacatctgccccccagagatcaagatcaccatcaagcagagcggggaccagaaggtgtcccgggccggcaagaacagcaaggccaccaaggaggaggagaggagccacagcaagaagaagctgctgacagccagtgacctggccgccagtgacctgaagggcttccagccccaggcctatgaaagaccccagaagcacagcaccctgcactatgacaccggcctgccccaggacttcaccggggacaccctgaagcccaagcaccagcagaagagcagcagccagaaccacatggactggagcaccaacagcgacagcggccctgtgacccagaactgcttcatcagccctgagagcggccgggagacagccagcaccagcaagatcccagccctggagcctgtggccagctttgccaaggcccagggcaagaagggcagcgctggcaacacctggagccagctgagcaacaacaacaaggacctgctgctgggcggcgtggcccccagccccagcagccacagcagccctgccccacccagcagcagcgcagaatgtaatggcctgcagcccctggtggaccaggacggcggcggcaccaaggagcccccagagccccccaccgtgggcagcaagaagaagagcagcaagaaggatgtgatcagccagaccatccccaacccagacctggactgggtgaagaatgcccagaaggcctttgacaacacagagggcaagcgggagggctacagcgctgacagcgcccaggaggccagccctgcccggcagaatgtgtcctctgccagcaacccagaaaatgacagcagccacgtgcgcatcaccatccccatcaaggcccccagcctggaccccaccaaccacaagaggaagaagaggcagagcatcaaggctgtggtggagaagatcatgcctgagaaggccctggccagcggcatcaccatgagcagcgaggtggtgaaccgcatcctgagcaacagcgagggcaacaagaaggacccccgggtgcccaagctgagcaagatgattgaaaatgaaagccccagcgtgggcctggagaccggcggcaatgctgagaaggtgattcctggaggagtgtccaagcccaggaagccacccatggtgatgaccccacccacctgcacagaccacagccccagcaggaagctgcctgagatccagcaccccaagtttgctgccaagaggcgctggacctgcagcaagcccaagcccagcaccatgctgcgggaggccgtgatggccaccagtgacaagctgatgctggagccccccagcgcctaccccatcacccccagcagccccctgtacaccaacacagacagcctgaccgtcatcacccctgtgaagaagaagaggggccggcccaagaagcagcccctgctgactgtggagaccatccacgagggcaccagcaccagccctgtgagccccatcagccgggagttccctggcaccaagaagaggaagagaagaagaaacctggccaagctggcccagctggtgcctggagaggacaagcccatgtctgagatgaagttccacaagaaggtgggcaagctgggcgtgctggacaagaagaccatcaagaccatcaacaagatgaagaccctgaagaggaagaacatcctgaaccagatcctgagctgcagcagctctgtggccctgaaggccaaggcccctcctgagaccagccctggagctgctgccatcgagagcaagctgggcaagcagatcaacgtgtccaagaggggcaccatctacatcggcaagaagaggggcaggaagcccagggctgagctgcccccaccttctgaggagcccaagacagccatcaagcaccccaggcctgtgagcagccagccagatgtgcctgctgtgcccagcaacttccagagcctggtggccagcagccctgctgccatgcaccccctgagcacccagctgggcggcagcaatggaaacctgagccctgccagcacagagaccaacttcagcgagctgaagaccatgcccaacctgcagcccatcagcgccctgcccaccaagacccagaagggcatccacagcggcacctggaagctgagccccccccggctgatggccaacagccccagccacctgtgtgaaattggcagcctgaaggagatcaccctgagccctgtgtctgagagccacagcgaggagaccatccccagcgacagcggcattggaacagacaacaacagcaccagtgaccaggccgagaagagcagcgagagcagaagacgctacagctttgacttctgcagcctggacaaccctgaggccatccccagcgacaccagcaccaagaacagacatggccaccggcagaagcacctgattgtggacaacttcctggcccacgagagcctgaagaagcccaagcacaagaggaagaggaagagcctgcagaacagagatgacctgcagttcctggccgacctggaggagctgatcaccaagttccaggtgttccgcatcagccacaggagctacaccttctaccacgagaacccctaccccagcatcttccgcatcaactttgaccactactaccctgtgccctacatccagtatgaccccctgctgtacctgcggaggaccagtgacctgaagagcaagaagaagaggggccggcctgccaagaccaatgacaccatgaccaaggtgcccttcctgcagggcttctcctaccccatccccagcggcagctactatgccccctacggcatgccctacacctccatgcccatgatgaacctgggctactacggccagtacccagcccccctgtacctgagccacaccctgggcgccgccagccccttcatgaggcccaccgtgcccccaccccagttccacaccaacagccacgtgaagatgtctggggccgccaagcacaaggccaagcatggagtgcacctgcagggccctgtgtccatgggcctgggggacatgcagcccagcctgaacccccccaaggtgggcagcgccagcctgagcagcggccgcctgcacaagaggaagcacaagcacaagcacaagcacaaggaggaccgcatcctgggcacccatgacaacctgagcggcctgtttgctgggaaggccaccggcttcagcagccacatcctgtctgagcggctgagcagcgctgacaaggagctgcccctggtgtctgagaagaacaagcacaaggagaagcagaagcaccagcacagcgaggccggccacaaggccagcaagaacaactttgaggtggacaccctgagcaccctgagcctgagtgatgcccagcactggacccaggccaaggagaagggggacctgagcagcgagcctgtggacagctgcaccaagcgctacagcggcagcggaggagatggcggcagcaccaggtctgagaacctggatgtgttcagcgagatgaaccccagcaatgacaagtgggacagtgatgtgtctggcagcaagaggaggagctatgagggcttcggcacctaccgggagaaggacatccaggccttcaagatgaacaggaaggagaggagcagctatgacagctccatgagccctggcatgcccagcccccacctgaaggtggaccagacagctgtgcacagcaagaatgaaggctctgtgcccaccatgatgaccaggaagaagccagctgctgtggacagcgtgaccatccccccagcccctgtgctgagcctgctggccgccagcgctgccaccagtgatgctgtgggcagcagcctgaagaagcgcttcaagagaagagaaattgaggccatccagtgtgaggtgaggaagatgtgcaactacaccaagatcctgagcaccaagaagaacctggaccacgtgaacaagatcctgaaggccaagaggctgcagaggcagagcaagacaggcaacaactttgtgaagaagagaagaggccggcccaggaagcagcccacccagtttgatgaggacagccgggaccagatgcctgtgctggagaagtgcatcgacctgcccagcaagaggggccagaagcccagcctgagccccctggtgctggagcctgctgccagccaggacaccatcatggccaccattgaagctgtgatccacatggcccgggaggccccacccctgcccccacctcctcctccacccctgcccccacctcctcctccacccctgcccccacctccacccctgcccaagaccccccggggcggcaagaggaagcacaagccccaggccccagcccagcccccccagcagagccccccccagcagcccctgccccaggaggaggaggtgaaggccaagaggcagaggaagagccggggcagcgagagcgaggtgctgccctag

SEQ ID NO: 169480 - DNA, 729 bp, Artificial Sequence
  Description of Artificial Sequence: Synthetic coding sequence
atggagagccgggagaccctgagcagcagccggcagaggggcggggagagtgacttcctgcctgtgagcagcgccaagcccccagctgcccctggctgtgccggggagcccctgctgagcaccccaggccctgggaagggcatccctgtgggcggggagaggatggagcctgaggaggaggatgagctgggcagcggcagagatgtggacagcaacagcaatgctgacagcgagaagtgggtggccggagatggcctggaggagcaggagttcagcatcaaggaggccaacttcacagagggcagcctgaagctgaagatccagaccaccaagagggccaagaagccacccaagaacctggagaactacatctgccccccagagatcaagatcaccatcaagcagagcggggaccagaaggtgtcccgggccggcaagaacagcaaggccaccaaggaggaggagaggagccacagcaagaagaagctgctgacagccagtgacctggccgccagtgacctgaagggcttccagccccagatcaaggacagcagcaaggaggaggtgtggaagaggcggggcggccagggcatccccttcaagaagcagttcctgagccaggagcgggccatgtgcttcagctgccccaggaaccccttccctgccaagccaggcagcctgaccctgcccttccacagcgagcctgctgtgtgggcccaggaggtgtag

SEQ ID NO: 169481 - DNA, 414 bp, Artificial Sequence
  Description of Artificial Sequence: Synthetic coding sequence
atggagagccgggagaccctgagcagcagccggcagaggggcggggagagtgacttcctgcctgtgagcagcgccaagcccccagctgcccctggctgtgccggggagcccctgctgagcaccccaggccctgggaagggcatccctgtgggcggggagaggatggagcctgaggaggaggatgagctgggcagcggcagagatgtggacagcaacagcaatgctgacagcgagaagtgggtggccggagatggcctggaggagcaggagttcagcatcaaggaggccaacttcacagagggcagcctgaagctgaagatccagaccaccaagagggccaagaagccacccaagaacctggagaactacatctgccccccagagatcaagatcaccatcaagcagagcggctag

SEQ ID NO: 169482 - DNA, 2055 bp, Artificial Sequence
  Description of Artificial Sequence: Synthetic coding sequence
atgtttgctgaggccgccaagaccacccggccctgtggcatggccgagttcaaggagaagccagaggcccccacagagcagctggatgtggcctgtggccaggagaacctgcctgtgggcgcctggcccccaggggccgccccagcccccttccagtacaccccagaccacgtggtgggccctggagctgacatcgaccccacccagatcaccttccctggctgcatctgtgtgaagaccccctgcctgcccggcacctgcagctgcctgcggcacggggagaactatgatgacaacagctgcctgcgggacatcggcagcggcggcaagtatgcagagcctgtgtttgaatgtaatgtgctgtgccgctgcagcgaccactgcaggaacagagtggtgcagaagggcctgcagttccacttccaggtgttcaagacccacaagaagggctggggcctgcggaccctggagttcatccccaagggccgctttgtgtgtgaatatgctggggaggtgctgggcttcagcgaggtgcagaggcgcatccacctgcagaccaagagtgacagcaactacatcatcgccatccgggagcacgtgtacaacggccaggtgatggagacctttgtggaccccacctacatcggcaacatcggccgcttcctgaaccacagctgtgagcccaacctgctgatgatccctgtgagaattgacagcatggtgcccaagctggccctgtttgctgccaaggacatcgtgcctgaggaggagctgtcctatgactacagcggccgctacctgaacctgactgtgtctgaggacaaggagcggctggaccacggcaagctgaggaagccctgctactgtggggccaagagctgcacagccttcctgccctttgacagcagcctgtactgccctgtggagaagagcaacatcagctgtggaaatgagaaggagcccagcatgtgtggcagcgcccccagcgtcttccccagctgcaagaggctgaccctggagaccatgaagatgatgctggacaagaagcagatccgggccatcttcctgtttgagttcaagatgggcaggaaggctgctgagaccaccaggaacatcaacaatgccttcggccctggaacagccaatgaaagaacagtgcagtggtggttcaagaagttctgcaagggagatgagagcctggaggatgaggagaggagcggccggcccagcgaggtggacaatgaccagctgcgggccatcattgaagctgaccccctgaccaccacccgggaggtggccgaggagctgaatgtgaaccacagcacagtggtgcgccacctgaagcagatcggcaaggtgaagaagctggacaagtgggtgccccatgagctgacagagaaccagaagaacagaagatttgaggtgagcagcagcctcatcctgaggaaccacaatgagcccttcctggaccgcatcgtgacctgtgatgagaagtggatcctgtatgacaacagaagaagaagtgcccagtggctggaccaggaggaggcccccaagcacttccccaagcccatcctgcaccccaagaaggtgatggtgaccatctggtggagcgctgctggcctcatccactacagcttcctgaaccctggagagaccatcaccagcgagaagtatgcccaggagattgatgagatgaaccagaagctgcagaggctgcagctggccctggtgaacaggaagggccccatcctgctgcatgacaatgcccggccccacgtggcccagcccaccctgcagaagctgaatgagctgggctatgaggtgctgccccaccccccctacagcccagacctgctgcccaccaactaccacgtgttcaagcacctgaacaacttcctgcagggcaagcgcttccacaaccagcaggatgctgaaaatgccttccaggagtttgtggagagccagagcacagacttctacgccaccggcatcaaccagctgatcagccgctggcagaagtgtgtggactgcaatggcagctactttgattag

SEQ ID NO: 169483 - DNA, 1098 bp, Artificial Sequence
  Description of Artificial Sequence: Synthetic coding sequence
atgtttgctgaggccgccaagaccacccggccctgtggcatggccgagttcaaggagaagccagaggcccccacagagcagctggatgtggcctgtggccaggagaacctgcctgtgggcgcctggcccccaggggccgccccagcccccttccagtacaccccagaccacgtggtgggccctggagctgacatcgaccccacccagatcaccttccctggctgcatctgtgtgaagaccccctgcctgcccggcacctgcagctgcctgcggcacggggagaactatgatgacaacagctgcctgcgggacatcggcagcggcggcaagtatgcagagcctgtgtttgaatgtaatgtgctgtgccgctgcagcgaccactgcaggaacagagtggtgcagaagggcctgcagttccacttccaggtgttcaagacccacaagaagggctggggcctgcggaccctggagttcatccccaagggccgctttgtgtgtgaatatgctggggaggtgctgggcttcagcgaggtgcagaggcgcatccacctgcagaccaagagtgacagcaactacatcatcgccatccgggagcacgtgtacaacggccaggtgatggagacctttgtggaccccacctacatcggcaacatcggccgcttcctgaaccacagctgtgagcccaacctgctgatgatccctgtgagaattgacagcatggtgcccaagctggccctgtttgctgccaaggacatcgtgcctgaggaggagctgtcctatgactacagcggccgctacctgaacctgactgtgtctgaggacaaggagcggctggaccacggcaagctgaggaagccctgctactgtggggccaagagctgcacagccttcctgccctttgacagcagcctgtactgccctgtggagaagagcaacatcagctgtggaaatgagaaggagcccagcatgtgtggcagcgcccccagcgtcttccccagctgcaagaggctgaccctggaggtgtccctcttcagtgacaagcagctggccccaccctacagcggccggcagtggctggccagcttcaccagcgcctag

SEQ ID NO: 169484 - DNA, 516 bp, Artificial Sequence
  Description of Artificial Sequence: Synthetic coding sequence
atgtttgctgaggccgccaagaccacccggccctgtggcatggccgagttcaaggagaagccagaggcccccacagagcagctggatgtggcctgtggccaggagaacctgcctgtgggcgcctggcccccaggggccgccccagcccccttccagtacaccccagaccacgtggtgggccctggagctgacatcgaccccacccagatcaccttccctggctgcatctgtgtgaagaccccctgcctgcccggcacctgcagctgcctgcggcacggggagaactatgatgacaacagctgcctgcgggacatcggcagcggcggcaagtatgcagagcctgtgtttgaatgtaatgtgctgtgccgctgcagcgaccactgcaggaacagagtggtgcagaagggcctgcagttccacttccaggtgttcaagacccacaagaagggctggggcctgcggaccctggagttcatccccaagggcaggaaggtggagcaccagctgtggaagtag

SEQ ID NO: 169485 - DNA, 1101 bp, Artificial Sequence
  Description of Artificial Sequence: Synthetic coding sequence
atggacagtgatgatgagatggtggaggaggccgtggagggccacctggatgatgatggcctgccccacggcttctgcaccgtgacctacagcagcacagacagatttgagggcaactttgtgcacggggagaagaatggccggggcaagttcttcttctttgatggcagcaccctggagggctactacgtggatgatgccctgcagggccagggcgtgtacacctatgaagatggcggcgtgctgcagggcacctacgtggatggagagctgaatggacctgcccaggagtatgacacagatggccgcctcatcttcaagggccagtacaaggacaacatcagacatggagtgtgctggatctactacccagatggcggcagcctggtgggggaggtgaatgaagatggagagatgaccggggagaagatcgcctacgtgtacccagatgagaggacagccctgtatggcaagttcattgatggagagatgattgagggcaagctggccaccctgatgagcacagaggagggccggccccactttgagctgatgcctggcaacagcgtgtaccactttgacaagagcaccagcagctgcatcagcaccaatgccctgctgcctgacccctatgaaagtgagcgggtgtatgtggccgagagcctcatcagcagcgctggggagggcctcttcagcaaggtggccgtgggccccaacacagtgatgtccttctacaacggggtgcgcatcacccaccaggaggtggacagccgggactgggccctgaatggaaacaccctgagcctggatgaggagaccgtgattgatgtgcctgagccctacaaccacgtgtccaagtactgtgccagcctgggccacaaggccaaccacagcttcacccccaactgcatctatgacatgtttgtgcaccccaggtttggccccatcaagtgcatccgcaccctgcgggctgtggaggctgatgaggagctgactgtggcctacggctatgaccacagccccccaggcaagagcggccctgaggcccctgagtggtaccaggtggagctgaaggccttccaggccacccagcagaagtag

SEQ ID NO: 169486 - DNA, 5124 bp, Artificial Sequence
  Description of Artificial Sequence: Synthetic coding sequence
atggaccaggagggcggcggagatggccagaaggcccccagcttccagtggaggaactacaagctgattgtggaccctgccctggaccctgccctgcggcggcccagccagaaggtgtaccgctatgatggagtgcacttctctgtgaatgacagcaagtacatccctgtggaggacctgcaggacccccgctgccacgtgcgcagcaagaacagagacttcagcctgcctgtgcccaagttcaagctggatgagttctacatcggccagatccccctgaaggaggtgacctttgcccggctgaatgacaacgtgcgggagaccttcctgaaggacatgtgcaggaaatatggagaggtggaggaggtggagatcctgctgcaccccaggaccaggaagcacctgggcctggcccgggtgctcttcaccagcaccaggggggccaaggagaccgtgaagaacctgcacctgacctctgtgatgggcaacatcatccacgcccagctggacatcaagggccagcagaggatgaagtactatgagctgattgtgaatggcagctacaccccccagacagtgcccactggaggcaaggccctgtctgagaagttccagggcagcggggccgccacagaaacagctgagagcagaagaagaagcagcagtgacacagctgcctacccagctggcaccacagctgtgggcaccccaggaaatggcaccccctgcagccaggacaccagcttcagcagcagccggcaggacacccccagcagctttggccagttcaccccccagagcagccagggcaccccctacaccagccggggcagcaccccctacagccaggacagcgcctacagcagcagcaccaccagcaccagcttcaagcccaggagaagtgagaacagctaccaggatgccttcagcagaagacacttcagcgccagcagcgccagcaccacagccagcacagccatcgccgccaccacagctgccacagccagcagcagcgccagcagcagcagcctgagcagcagcagcagcagcagcagcagcagcagcagcagccagttccgcagcagtgatgccaactacccagcctactatgagagctggaaccgctaccagaggcacaccagctaccccccaagaagagccacccgggaggagcccccaggggccccctttgctgaaaatacagctgagcgcttcccccccagctacaccagctacctgcccccagagcccagccggcccacagaccaggactacagacctccagccagcgaggcccctcctcctgagcccccagagcccggcggcggcggcggcggcggcggccccagccctgagcgggaggaggtgaggaccagccccaggcctgccagccctgcccggagcggcagccctgcccctgagaccaccaatgaatctgtgccctttgcccagcacagcagcctggacagccgcatcgagatgctgctgaaggagcagaggagcaagttctccttcctggccagtgacacagaggaggaggaggagaacagctccatggtgctgggcgcccgggacaccggcagcgaggtgcccagcggcagcggccacggcccctgcaccccacctccagccccagccaactttgaagatgtggcccccaccggcagcggggagcccggggccacccgggagagccccaaggccaacggccagaaccaggccagcccctgcagcagtggagatgacatggagatcagtgatgatgacagaggaggcagccccccaccagcccccaccccaccccagcagcccccacctcctcctcctcctcctcctcctcctccaccctacctggccagcctgcccctgggctacccaccccaccagcctgcctacctgctgccccccaggccagatggccccccacctcctgagtacccacctcctcctcctcctccaccccacatctatgactttgtgaacagcctggagctgatggaccggctgggcgcccagtggggcggcatgcccatgtccttccagatgcagacccagatgctgacccggctgcaccagctgcggcagggcaagggcctgattgctgccagcgctggccccccaggaggagcctttggagaggccttcctgcccttccccccaccccaggaggccgcctacggcctgccctatgccctgtatgcccagggccaggagggccgcggggcctacagccgggaggcctaccacctgcccatgcccatggctgctgagcccctgcccagcagctctgtgtctggagaggaggcccggctgcccccccgggaggaggccgagctggccgagggcaagaccctgcccacagctggcaccgtgggccgggtgctggccatgctggtgcaggagatgaagagcatcatgcagagggacctgaacaggaagatggtggagaatgtggccttcggggcctttgaccagtggtgggagagcaaggaggagaaggccaagcccttccagaatgctgccaagcagcaggccaaggaggaggacaaggagaagaccaagctgaaggagcccggcctgctgagcctggtggactgggccaagagcggcggcaccactggaattgaggcctttgccttcggcagcggcctgcggggggccctgcggctgcccagcttcaaggtgaagaggaaggagcccagcgagatcagcgaggccagcgaggagaagaggccccggcccagcaccccagctgaggaggatgaagatgatcctgagcaggagaaggaggccggggagcccggccggcccggcaccaagccacccaagagagatgaggagcggggcaagacccagggcaagcacaggaagagctttgccctggacagcgagggggaggaggccagccaggagagcagcagcgagaaggatgaagaagatgatgaagaagatgaggaggatgaggaccgggaggaggccgtggacaccaccaagaaggagacagaggtgtctgatggagaagatgaggagagtgacagcagcagcaagtgcagcctgtatgctgacagtgatggagaaaatgacagcaccagtgacagcgagagcagcagcagcagcagcagcagcagcagcagcagcagcagcagcagcagcagcagcagcagcagcagcagcgagagcagcagtgaagatgaggaggaggaggagaggcctgctgccctgcccagcgccagccccccaccccgggaggtgcctgtgcccaccccagcccctgtggaggtgcctgtgcctgagcgggtggccggcagccctgtgacccccctgcctgagcaggaggccagccctgcccggcctgctggccccacagaggagagcccccccagcgcccccctgcggcccccagagcccccagctggccccccagccccagcccccaggccagatgagcggcccagcagccccatccccctgctgcccccacccaagaagaggaggaagacagtgtccttcagcgccatcgaggtggtgcctgcccctgagcccccaccagccaccccaccccaggccaagtttcctggccctgccagcaggaaggccccccggggcgtggagaggaccatccggaacctgcccctggaccacgccagcctggtgaagtcctggccagaggaggtgtcccggggcggccgcagcagagctgggggccggggccgcctgacagaggaggaggaggccgagcctggaacagaggtggacctggccgtgctggccgacctggccctgaccccagcccggcggggcctgcctgccctgcctgctgtggaggacagcgaggccacagagaccagtgatgaggccgagcggccccggcccctgctgagccacatcctgctggagcacaactatgccctggccgtgaagcccaccccaccagccccagccctgcggcccccagagcctgtgcctgccccagctgccctcttcagcagccctgcagatgaggtgctggaggcccctgaggtggtggtggccgaggccgaggagcccaagccccagcagctgcagcagcagcgggaggagggggaggaggagggggaggaggagggggaggaggaggaggaggagagcagtgacagcagcagcagcagtgatggagagggcgccctgcggcggcgcagcctgcggagccacgccaggagaagaagacctcctcctcctcctcctcctcctccaccccgggcctatgagcccaggagtgaatttgagcagatgaccatcctgtatgacatctggaacagcggcctggacagcgaggacatgagctacctgcggctgacctatgagcggctgctgcagcagaccagcggggctgactggctgaatgacacccactgggtgcaccacaccatcaccaacctgaccacccccaagaggaagaggcggccccaggacggcccccgggagcaccagacaggcagcgcccggtctgagggctactaccccatcagcaagaaggagaaggacaagtacctggatgtgtgccctgtgtctgcccggcagctggagggcgtggacacccagggcaccaacagagtgctgtctgagcggcgctctgagcagaggcggctgctgagcgccatcggcaccagcgccatcatggacagcgacctgctgaagctgaaccagctgaagttcaggaagaagaagctgcgcttcggccgcagccgcatccacgagtggggcctgtttgccatggagcccatcgccgcagatgagatggtgattgaatatgtgggccagaacatccggcagatggtggccgacatgagggagaagcgctacgtgcaggagggcatcggcagcagctacctgttccgggtggaccatgacaccatcattgatgccaccaagtgtggcaacctggcccgcttcatcaaccactgctgcacccccaactgctacgccaaggtgatcaccatcgagagccagaagaagatcgtcatctacagcaagcagcccatcggcgtggatgaggagatcacctatgactacaagttccccctggaggacaacaagatcccctgcctgtgtggcacagagagctgccggggcagcctgaactag

SEQ ID NO: 169487 - DNA, 213 bp, Artificial Sequence
  Description of Artificial Sequence: Synthetic coding sequence
atggaccaggagggcggcggagatggccagaaggcccccagcttccagtggaggaactacaagctgattgtggaccctgccctggaccctgccctgcggcggcccagccagaaggtgtaccgctatgatggagtgcacttctctgtgaatgacagcaagtacatccctgtggaggacctgcaggacccccgctgccacgtgcgcagcaagtag

SEQ ID NO: 169488 - DNA, 744 bp, Artificial Sequence
  Description of Artificial Sequence: Synthetic coding sequence
atggaccaggagggcggcggagatggccagaaggcccccagcttccagtggaggaactacaagctgattgtggaccctgccctggaccctgccctgcggcggcccagccagaaggtgtaccgctatgatggagtgcacttctctgtgaatgacagcaagtacatccctgtggaggacctgcaggacccccgctgccacgtgcgcagcaagaacagagacttcagcctgcctgtgcccaagttcaagctggatgagttctacatcggccagatccccctgaaggaggtgacctttgcccggctgaatgacaacgtgcgggagaccttcctgaaggacatgtgcaggaaatatggagaggtggaggaggtggagatcctgctgcaccccaggaccaggaagcacctgggcctggcccgggtgctcttcaccagcaccaggggggccaaggagaccgtgaagaacctgcacctgacctctgtgatgggcaacatcatccacgcccagctggacatcaagggccagcagaggatgaagtactatgagctgattgtgaatggcagctacaccccccagacagtgcccactggaggcaaggccctgtctgagaagttccagggcagcggggccgccacagaaacagctgagagcagaagaagaagcagcagtgacacagctgcctacccagctggcaccacagctgtgggcaccccaggaaatggcaccccctgcagccaggacacctag

SEQ ID NO: 169489 - DNA, 5772 bp, Artificial Sequence
  Description of Artificial Sequence: Synthetic coding sequence
atggagaacagccaccccccccaccaccaccaccagcagcccccaccccagcccggccccagcggggagaggaggaaccaccactggaggagctacaagctgatgattgatcctgccctgaagaagggccaccacaagctgtaccgctatgatggccagcacttcagcctggccatgagcagcaacagacctgtggagatcgtggaggacccccgggtggtgggcatctggaccaagaacaaggagctggagctgtctgtgcccaagttcaagattgatgagttctacgtgggccctgtgccccccaagcaggtgacctttgccaagctgaatgacaacatccgggagaacttcctgcgggacatgtgcaagaagtacggggaggtggaggaggtggagatcctgtacaaccccaagaccaagaagcacctgggcatcgccaaggtggtgtttgccaccgtgcggggggccaaggatgctgtgcagcacctgcacagcacctctgtgatgggcaacatcatccacgtggagctggacaccaagggggagaccaggatgaggttctatgagctgctggtgacaggccgctacaccccccagaccctgcctgtgggggagctggatgctgtgagccccatcgtgaatgagaccctgcagctgagtgatgccctgaagaggctgaaggatggcggcctgtctgctggctgcggcagcggcagcagctctgtgacccccaacagcggcggcacccccttcagccaggacacagcctacagcagctgccgcctggacacccccaacagctatggccagggcacccccctgaccccccggctgggcacccccttcagccaggacagcagctacagcagccggcagcccacccccagctacctgttcagccaggaccctgctgtgaccttcaaggccaggagacatgagagcaagttcacagatgcctacaacagaagacatgagcaccactacgtgcacaacagccctgctgtgacagctgtggccggggccacagctgccttccggggcagcagtgacctgccctttggagctgtgggcggcaccggcggcagcagcggcccccccttcaaggcccagccccaggacagcgccacctttgcccacaccccacctccagcccaggccaccccagcccctggcttcaagagcgccttcagcccctaccagacccctgtggcccacttccccccacctcctgaggagcccacagccacagctgccttcggggcccgggacagcggggagttcagaagagccccagcccccccacccctgcccccagctgagcccctggccaaggagaagccaggcaccccacctggccccccacctccagacaccaacagcatggagctgggcggccggcccaccttcggctggagccctgagccctgtgacagccctggcacccccaccctggagagcagccctgctggccctgagaagccccatgacagcctggacagcagaattgagatgctgctgaaggagcagaggaccaagctgctcttcctgcgggagccagacagcgacacagagctgcagatggagggcagccccatcagcagcagcagcagccagctgagccccctggcccccttcggcaccaacagccagcccggcttccggggccccaccccacccagcagccggcccagcagcacaggcctggaggacatcagccccacccccctgcctgacagtgatgaagatgaggagctggacctgggcctgggcccccggcccccacctgagcccggccccccagaccctgctggcctgctgagccagacagctgaggtggccctggacctggtgggggacaggacccccaccagcgagaagatggatgagggccagcagagcagtggagaggacatggagatcagtgatgatgagatgcccagcgcccccatcaccagcgctgactgccccaagcccatggtggtgaccccaggagctgctgctgtggccgcccccagcgtgctggcccccaccctgcccctgcccccacctcctggcttcccccccctgcccccacctcctcctcctcctccaccccagcccggcttccccatgcccccacccctgcccccacctcctcctcctcctcctccagcccaccctgctgtgacagtgcccccaccacccctgcctgcccctcctggggtgcccccaccacccatcctgccccccctgccccccttccccccaggcctcttccctgtgatgcaggtggacatgagccacgtgctgggcggccagtggggcggcatgcccatgtccttccagatgcagacccaggtgctgagccggctgatgacaggccagggcgcctgcccctacccacccttcatggctgctgctgctgctgctgccagcgctggcctgcagtttgtgaacctgcccccctaccggggccccttcagcctgagcaacagcggccctggccggggccagcactggccacccctgcccaagtttgaccccagcgtgcccccacctggctacatgccccggcaggaggacccccacaaggccaccgtggatggagtgctgctggtggtgctgaaggagctgaaggccatcatgaagagggacctgaacaggaagatggtggaggtggtggccttccgggcctttgatgagtggtgggacaagaaggagaggatggccaaggccagcctgacccctgtgaagtctggagagcacaaggatgaagatcggcccaagcccaaggaccgcatcgccagctgcctgctggagagctggggcaagggggagggcctgggctatgagggcctgggcctgggcatcggcctgcggggggccatccggctgcccagcttcaaggtgaagaggaaggagcccccagacaccaccagcagcggggaccagaagaggctgcggcccagcacctctgtggatgaggaggatgaggagagcgagcgggagcgggaccgggacatggctgacaccccctgtgagctggccaagagggaccccaagggcgtgggcgtgagaagaagacctgcccggcccctggagctggacagcggcggggaggaggatgagaaggagagcctgtctgaggagcaggagagcacagaggaggaggaggaggccgaggaggaggaggaggaggaggatgatgatgatgatgacagtgatgacagagatgaaagtgaaaatgatgatgaggacacagccctgtctgaggccagcgagaaggatgaaggagacagtgatgaggaggagaccgtgtccatcgtgaccagcaaggccgaggccaccagcagcagcgagagcagcgagagcagcgagtttgagagcagcagcgagagcagccccagcagcagtgaagatgaggaggaggtggtggcccgggaggaggaggaggaggaggaggaggaggagatggtggccgaggagagcatggccagcgctggccctgaggactttgagcaggatggagaggaggccgccctggcccctggggccccagctgtggacagcctgggcatggaggaggaggtggacattgaaacagaagctgtggcccctgaggagcggcccagcatgctggatgagccccccctgcctgtgggcgtggaggagcctgctgacagccgggagcccccagaggagcccggcctgagccaggagggcgccatgctgctgagccctgagcccccagccaaggaggtggaggcccggccccccctgagccctgagcgggcccctgagcatgacctggaggtggagcctgagccccccatgatgctgcccctgcccctgcagccccccctgcccccacccaggcctccccggccccccagccccccacctgagcctgagaccacagatgccagccaccccagcgtgcccccagagcccctggccgaggaccaccccccccacaccccaggcctgtgtggcagcctggccaagagccagagcacagaaacagtgcctgccaccccaggaggagagccccccctgagcggcggcagcagcggcctgagcctgagcagcccccaggtgcccggcagccccttctcctacccagcccccagccccagcctgagcagcggcggcctgcccaggaccccaggccgggacttctccttcacccccaccttcagcgagcccagcggccccctgctgctgcctgtgtgccccctgcccactggaagaagagatgagaggagcggccccctggccagccctgtgctgctggagaccggcctgcccctgcccctgcccctgcccctgcccctgcccctggccctgcctgctgtgctgcgggcccaggcccgggcccccacccccctgccccccctgctgcctgcccccctggccagctgccccccacccatgaagaggaagccaggccggccccggcgcagccccccatccatgctgagcctggatggccccctggtgcggcccccagctggggccgccctgggccgggagctgctgctgctgcccggccagccccagacccctgtgttccccagcacccatgaccccaggacagtgaccctggacttcagaaatgccggcatcccagcccctcctccacccctgcccccccagcccccacctcctcctcctcctcctcctgtggagcccaccaagctgcccttcaaggagctggacaaccagtggcccagcgaggccatccccccaggcccccggggcagagatgaggtgacagaggagtacatggagctggccaagagccggggcccctggaggcggccccccaagaagagacatgaggacctggtgcccccagctggcagccctgagctgagccccccccagcccctcttccggcccaggagtgaatttgaggagatgaccatcctgtatgacatctggaatggaggcattgatgaggaggacatccgcttcctgtgtgtgacctatgaaaggctgctgcagcaggacaatggcatggactggctgaatgacaccctgtgggtgtaccaccccagcaccagcctgagcagcgccaagaagaagaagagagatgatggcatccgggagcacgtgacaggctgtgcccggtctgagggcttctacaccatcgacaagaaggacaagctgcgctacctgaacagcagccgggccagcacagatgagcccccagctgacacccagggcatgagcatcccagcccagccccacgccagcacccgggccggcagcgagcggcgctctgagcagaggcggctgctgagcagcttcaccggcagctgtgacagcgacctgctgaagttcaaccagctgaagttcaggaagaagaagctgaagttctgcaagagccacatccatgactggggcctgtttgccatggagcccatcgccgcagatgagatggtgattgaatatgtgggccagaacatccggcaggtgattgctgacatgagggagaagagatatgaagatgagggcatcggcagcagctacatgttccgggtggaccatgacaccatcattgatgccaccaagtgtggcaactttgcccgcttcatcaaccacagctgcaaccccaactgctacgccaaggtgatcaccgtggagagccagaagaagatcgtcatctacagcaagcagcacatcaacgtgaatgaggagatcacctatgactacaagttccccattgaagatgtgaagatcccctgcctgtgtggcagcgagaactgccggggcaccctgaactag

SEQ ID NO: 169490 - DNA, 5772 bp, Artificial Sequence; identical to SEQ ID NO: 169489
  Description of Artificial Sequence: Synthetic coding sequence

SEQ ID NO: 169491 - DNA, 7695 bp, Artificial Sequence
  Description of Artificial Sequence: Synthetic coding sequence
atgaagcagctgcagccccagcccccacccaagatgggagacttctatgaccctgagcaccccaccccagaggaggaggagaatgaggccaagattgaaaatgtgcagaagacaggcttcatcaagggccccatgtttaaaggagtggccagcagccgcttcctgcccaagggcaccaagaccaaggtgaacctggaggagcagggccggcagaaggtgtccttctccttcagcctgaccaagaagaccctgcagaaccgcttcctgacagccctgggcaatgagaagcagagcgacacccccaaccccccagctgtgcccctgcaggtggacagcacccccaagatgaagatggagatcggggacaccctgagcacagctgaggagagcagcccccccaagagccgggtggagctgggcaagatccacttcaagaagcacctgctgcacgtgaccagccggcccctgctggccaccaccacagctgtggccagcccccccacccacgccgcccccctgcctgctgtgattgctgagagcaccaccgtggacagcccccccagcagccccccacctcctcctcctccagcccaggccaccaccctgagcagccctgcccctgtgacagagcctgtggccctgccccacacccccatcaccgtgctgatggccgcccctgtgcccctgcctgtggatgtggccgtgcgcagcctgaaggagccccccatcatcatcgtgcctgagagcctggaggccgacaccaagcaggacaccatcagcaacagcctggaggagcacgtgacccagatcctgaatgagcaggccgacatcagcagcaagaaggaggacagccacatcggcaaggatgaggagatcccagacagcagcaagatcagcctgagctgcaagaagacaggcagcaagaagaagagcagccagagcgagggcatcttcctgggcagcgagagtgatgaagattctgtgaggaccagcagcagccagaggagccatgacctgaagttcagcgccagcattgagaaggagcgggacttcaagaagagcagcgcccccctgaagtctgaggacctgggcaagcccagccgcagcaagacagacagagatgacaagtacttctcctacagcaagctggagcgggacaccaggtatgtgagcagccgctgccgctctgagcgggagaggagaagaagccgcagccacagccgctctgagcggggcagcaggaccaacctgagctacagccgctctgagaggagccactactatgacagcgaccggcgctaccacaggagcagcccctaccgggagaggacccgctacagccggccctacacagacaacagagcccgggagagcagtgacagcgaggaggagtacaagaagacctacagcaggaggaccagcagccacagcagcagctacagagacctgcggaccagcagctacagcaagagtgaccgggactgcaagacagagaccagctacctggagatggagcggcggggcaagtacagcagcaagctggagcgggagagcaagaggaccagtgaaaatgaggccatcaagcgctgctgcagccccccaaatgagctgggcttccggcggggcagcagctacagcaagcatgacagcagcgccagccgctacaagagcaccctgagcaagcccatccccaagagtgacaagttcaagaacagcttctgctgcacagagctgaatgaggagatcaagcagagccacagcttcagcctgcagaccccctgcagcaagggcagcgagctgaggatgatcaacaagaaccctgagcgggagaaggccggcagccctgcccccagcaaccggctgaatgacagccccaccctgaagaagctggatgagctgcccatcttcaagtctgagttcatcacccatgacagccatgacagcatcaaggagctggacagcctgagcaaggtgaagaatgaccagctgcgctccttctgccccatcgagctgaacatcaatggcagccctggagctgagagtgacctggccaccttctgcaccagcaagacagatgctgtgctgatgaccagtgatgattctgtgactggaagtgagctgagccccctggtgaaggcctgcatgctgagcagcaatggcttccagaacatcagccgctgcaaggagaaggacctggatgacacctgcatgctgcacaagaagtctgagagccccttccgggagacagagcccctggtgagcccccaccaggacaagctgatgtccatgcctgtgatgacagtggactacagcaagacagtggtgaaggagcctgtggacaccagggtgtcctgctgcaagaccaaggacagcgacatctactgcaccctgaatgacagcaaccccagcctgtgcaacagcgaggccgagaacatcgagcccagcgtgatgaagatcagcagcaacagcttcatgaatgtgcacctggagagcaagcctgtgatctgtgacagcaggaacctgacagaccacagcaagtttgcctgtgaggagtacaagcagagcatcggcagcaccagcagcgcctctgtgaaccactttgatgacctgtaccagcccatcggcagcagcggcatcgccagcagcctgcagagcctgcccccaggcatcaaggtggacagcctgaccctgctgaagtgtggggagaacaccagccctgtgctggatgctgtgctgaagagcaagaagagcagcgagttcctgaagcacgccggcaaggagaccatcgtggaggtgggcagtgacctgcctgattctggaaaaggatttgccagcagagaaaatagaagaaacaacggcctgagcggcaagtgcctgcaggaggcccaggaggagggcaacagcatcctgcctgagcggcggggccggcctgagatcagcctggatgagcggggggagggcggccacgtgcacaccagtgatgacagcgaggtggtgttcagcagctgtgacctgaacctgaccatggaggacagtgatggagtgacctacgccctgaagtgtgacagcagcggccacgcccctgagatcgtgtccacagtgcatgaggactacagcggcagcagcgagagcagcaatgatgaaagtgacagcgaggacacagacagtgatgacagcagcatccccaggaaccggctgcagagcgtggtggtggtgcccaagaacagcaccctgcccatggaggagaccagcccctgcagcagccgcagcagccagagctaccgccactacagcgaccactgggaggatgagcggctggagagcagaagacacctgtatgaggagaagtttgagagcatcgccagcaaggcctgcccccagacagacaagttcttcctgcacaagggcacagagaagaaccctgagatctccttcacccagagcagcaggaagcagattgacaaccggctgcctgagctgagccacccccagagtgatggagtggacagcaccagccacacagatgtgaagagtgaccccctgggccaccccaacagcgaggagaccgtgaaggccaagatccccagccggcagcaggaggagctgcccatctacagcagtgactttgaagatgtgcccaacaagtcctggcagcagaccaccttccagaacagaccagacagccggctgggcaagacagagctgtccttcagcagcagctgtgagatcccccacgtggatggcctgcacagcagcgaggagctgaggaacctgggctgggacttcagccaggagaagcccagcaccacctaccagcagcctgacagcagctatggagcctgtggcggccacaagtaccagcagaatgctgagcagtatggaggcacccgggactactggcagggcaatggctactgggaccccaggagcggccggcccccaggcaccggggtggtgtatgacaggacccagggccaggtgcctgacagcctgacagatgaccgggaggaggaggagaactgggaccagcaggacggcagccacttcagtgaccagagcgacaagttcctgctgagcctgcagaaggacaagggctctgtgcaggcccctgagatcagcagcaacagcatcaaggacaccctggccgtgaatgagaagaaggacttcagcaagaacctggagaagaatgacatcaaggaccggggccccctgaagaagaggcggcaggagattgaaagtgacagcgagagtgatggagagctgcaggacaggaagaaggtgcgggtggaggtggagcagggcgagacctctgtgcccccaggcagcgccctggtgggccccagctgtgtgatggatgacttccgggacccccagcgctggaaggaatgtgccaagcagggcaagatgccctgctactttgacctgattgaggagaatgtgtacctgacagagaggaagaagaacaagagccaccgggacatcaagaggatgcagtgtgagtgcacccccctgagcaaggatgagcgggcccagggcgagatcgcctgtggggaggactgcctgaaccggctgctgatgattgagtgcagcagccgctgccccaatggagactactgcagcaacagacgcttccagaggaagcagcacgcagatgtggaggtgatcctgacagagaagaagggctggggcctgcgggccgccaaggacctgcccagcaacacctttgtgctggagtactgtggggaggtgctggaccacaaggagttcaaggcccgggtgaaggagtatgccaggaacaagaacatccactactacttcatggccctgaagaatgatgagatcattgatgccacccagaagggcaactgcagccgcttcatgaaccacagctgtgagcccaactgtgagacccagaagtggacagtgaatggccagctgcgggtgggcttcttcaccaccaagctggtgcccagcggcagcgagctgacctttgactaccagttccagagatatggcaaggaggcccagaagtgcttctgtggcagcgccaactgccggggctacctgggcggggagaacagagtgtccatccgggccgccggcggcaagatgaagaaggagaggagcaggaagaaggacagcgtggatggagagctggaggccctgatggagaatggagagggcctgagtgacaagaaccaggtgctgagcctgagccggctgatggtgagaattgagaccctggagcagaagctgacctgcctggagctgatccagaacacccacagccagagctgcctgaagagcttcctggagcggcacggcctgagcctgctgtggatctggatggccgagctgggagatggccgggagagcaaccagaagctgcaggaggagatcatcaagaccctggagcacctgcccatccccaccaagaacatgctggaggagagcaaggtgctgcccatcatccagcgctggagccagaccaagacagctgtgccccccctgtctgaaggagatggctacagcagcgagaacaccagccgggcccacacccccctgaacaccccagaccccagcaccaagctgagcacagaggccgacacagacacccccaagaagctgatgttccggcggctgaagatcatcagcgagaacagcatggattctgccatcagtgatgccaccagcgagctggagggcaaggatggcaaggaggacctggaccagctggagaatgtgcctgtggaggaggaggaggagctgcagagccagcagctgctgccccagcagctgcctgagtgcaaggtggacagcgagaccaacatcgaggccagcaagctgcccaccagcgagcctgaggctgatgctgagattgagcccaaggagagcaatggcaccaagctggaggagcccatcaatgaggagacccccagccaggatgaggaggagggcgtgtctgatgtggagagcgagaggagccaggagcagcctgacaagacagtggacatcagtgacctggccaccaagctgctggacagctggaaggacctgaaggaggtgtaccgcatccccaagaagagccagacagagaaggagaacaccaccacagagcggggcagagatgctgtgggcttccgggaccagaccccagcccccaagacccccaacagaagccgggagcgggaccctgacaagcagacccagaacaaggagaagaggaagagaagaagcagcctgagcccccccagcagcgcctatgaaagaggcaccaagaggccagatgacagatatgacacccccaccagcaagaagaaggtgcgcatcaaggacaggaacaagctgagcacagaggagaggaggaagctgtttgagcaggaggtggcccagcgggaggcccagaagcagcagcagcagatgcagaacctgggcatgaccagccccctgccctatgacagcctgggctacaatgccccccaccacccctttgctggctacccacctggctaccccatgcaggcctacgtggaccccagcaaccccaatgctgggaaggtgctgctgcccacccccagcatggaccctgtgtgcagccctgccccctatgaccacgcccagcccctggtgggccacagcacagagcccctgagcgcccctcctcctgtgcctgtggtgccccacgtggccgcccctgtggaggtgagcagcagccagtatgtggcccagagtgatggagtggtgcaccaggacagctctgtggccgtgctgcctgtgcctgcccctggccctgtgcagggccagaactacagcgtgtgggacagcaaccagcagagcgtgtctgtgcagcagcagtacagccctgcccagagccaggccaccatctactaccagggccagacctgccccaccgtgtatggagtgaccagcccctacagccagaccaccccacccatcgtgcagagctatgcccagcccagcctgcagtacatccagggccagcagatcttcaccgcccacccccagggcgtggtggtgcagcctgctgctgctgtgaccaccatcgtggcccctggccagccccagcccctgcagcccagcgagatggtggtgaccaacaacctgctggacctgcccccacccagcccccccaagcccaagaccatcgtgctgccccccaactggaagacagcccgggaccctgagggcaagatctactactaccacgtgatcacccggcagacccagtgggacccccccacctgggagagccctggagatgatgccagcctggagcatgaagctgagatggacctgggcacccccacctatgatgagaaccccatgaaggccagcaagaagcccaagacagctgaggccgacaccagcagcgagctggccaagaagagcaaggaggtgttcaggaaggagatgagccagttcatcgtgcagtgcctgaacccctacaggaagccagactgcaaggtgggccgcatcaccaccacagaggacttcaagcacctggccaggaagctgacccacggcgtgatgaacaaggagctgaagtactgcaagaaccctgaggacctggagtgcaatgaaaatgtgaagcacaagaccaaggagtacatcaagaagtacatgcagaagtttggagctgtgtacaagcccaaggaggacacagagctggagtag

SEQ ID NO: 169492 - DNA, 7695 bp, Artificial Sequence
  Description of Artificial Sequence: Synthetic coding sequence
atgaagcagctgcagccccagcccccacccaagatgggagacttctatgaccctgagcaccccaccccagaggagcaggagcctgaggccaagattgaaaatgtgcagaagacaggcttcatcaagggccccatgtttaaaggagtggccagcagccgcttcctgcccaagggcaccaagaccaaggtgaacctggaggagcagggccggcagaaggtgtccttctccttcagcctgaccaagaagaccctgcagaaccgcttcctgacagccctgggcaatgagaagcagagcgacacccccaaccccccagctgtgcccctgcaggtggacagcacccccaagatgaagatggagatcggggacaccctgagcacagctgaggagagcagcccccccaagagccgggtggagctgggcaagatccacttcaagaagcacctgctgcacgtgaccagccggcccctgctggccaccaccacagctgtggccagcccccccacccacgccgcccccctgcctgctgtgattgctgagagcaccaccgtggacagcccccccagcagccccccacctcctcctcctccagcccaggccaccaccctgagcagccctgcccctgtgacagagcctgtggccctgccccacacccccatcaccgtgctgatggccgcccctgtgcccctgcctgtggatgtggccgtgcgcagcctgaaggagccccccatcatcatcgtgcctgagagcctggaggccgacaccaagcaggacaccatcagcaacagcctggaggagcacgtgacccagatcctgaatgagcaggccgacatcagcagcaagaaggaggacagccacatcggcaaggatgaggagatcccagacagcagcaagatcagcctgagctgcaagaagacaggcagcaagaagaagagcagccagagcgagggcatcttcctgggcagcgagagtgatgaagattctgtgaggaccagcagcagccagaggagccatgacctgaagttcagcgccagcattgagaaggagcgggacttcaagaagagcagcgcccccctgaagtctgaggacctgggcaagcccagccgcagcaagacagacagagatgacaagtacttctcctacagcaagctggagcgggacaccaggtatgtgagcagccgctgccgctctgagcgggagaggagaagaagccgcagccacagccgctctgagcggggcagcaggaccaacctgagctacagccgctctgagaggagccactactatgacagcgaccggcgctaccacaggagcagcccctaccgggagaggacccgctacagccggccctacacagacaacagagcccgggagagcagtgacagcgaggaggagtacaagaagacctacagcaggaggaccagcagccacagcagcagctacagagacctgcggaccagcagctacagcaagagtgaccgggactgcaagacagagaccagctacctggagatggagcggcggggcaagtacagcagcaagctggagcgggagagcaagaggaccagtgaaaatgaggccatcaagcgctgctgcagccccccaaatgagctgggcttccggcggggcagcagctacagcaagcatgacagcagcgccagccgctacaagagcaccctgagcaagcccatccccaagagtgacaagttcaagaacagcttctgctgcacagagctgaatgaggagatcaagcagagccacagcttcagcctgcagaccccctgcagcaagggcagcgagctgaggatgatcaacaagaaccctgagcgggagaaggccggcagccctgcccccagcaaccggctgaatgacagccccaccctgaagaagctggatgagctgcccatcttcaagtctgagttcatcacccatgacagccatgacagcatcaaggagctggacagcctgagcaaggtgaagaatgaccagctgcgctccttctgccccatcgagctgaacatcaatggcagccctggagctgagagtgacctggccaccttctgcaccagcaagacagatgctgtgctgatgaccagtgatgattctgtgactggaagtgagctgagccccctggtgaaggcctgcatgctgagcagcaatggcttccagaacatcagccgctgcaaggagaaggacctggatgacacctgcatgctgcacaagaagtctgagagccccttccgggagacagagcccctggtgagcccccaccaggacaagctgatgtccatgcctgtgatgacagtggactacagcaagacagtggtgaaggagcctgtggacaccagggtgtcctgctgcaagaccaaggacagcgacatctactgcaccctgaatgacagcaaccccagcctgtgcaacagcgaggccgagaacatcgagcccagcgtgatgaagatcagcagcaacagcttcatgaatgtgcacctggagagcaagcctgtgatctgtgacagcaggaacctgacagaccacagcaagtttgcctgtgaggagtacaagcagagcatcggcagcaccagcagcgcctctgtgaaccactttgatgacctgtaccagcccatcggcagcagcggcatcgccagcagcctgcagagcctgcccccaggcatcaaggtggacagcctgaccctgctgaagtgtggggagaacaccagccctgtgctggatgctgtgctgaagagcaagaagagcagcgagttcctgaagcacgccggcaaggagaccatcgtggaggtgggcagtgacctgcctgattctggaaaaggatttgccagcagagaaaatagaagaaacaacggcctgagcggcaagtgcctgcaggaggcccaggaggagggcaacagcatcctgcctgagcggcggggccggcctgagatcagcctggatgagcggggggagggcggccacgtgcacaccagtgatgacagcgaggtggtgttcagcagctgtgacctgaacctgaccatggaggacagtgatggagtgacctacgccctgaagtgtgacagcagcggccacgcccctgagatcgtgtccacagtgcatgaggactacagcggcagcagcgagagcagcaatgatgaaagtgacagcgaggacacagacagtgatgacagcagcatccccaggaaccggctgcagagcgtggtggtggtgcccaagaacagcaccctgcccatggaggagaccagcccctgcagcagccgcagcagccagagctaccgccactacagcgaccactgggaggatgagcggctggagagcagaagacacctgtatgaggagaagtttgagagcatcgccagcaaggcctgcccccagacagacaagttcttcctgcacaagggcacagagaagaaccctgagatctccttcacccagagcagcaggaagcagattgacaaccggctgcctgagctgagccacccccagagtgatggagtggacagcaccagccacacagatgtgaagagtgaccccctgggccaccccaacagcgaggagaccgtgaaggccaagatccccagccggcagcaggaggagctgcccatctacagcagtgactttgaagatgtgcccaacaagtcctggcagcagaccaccttccagaacagaccagacagccggctgggcaagacagagctgtccttcagcagcagctgtgagatcccccacgtggatggcctgcacagcagcgaggagctgaggaacctgggctgggacttcagccaggagaagcccagcaccacctaccagcagcctgacagcagctatggagcctgtggcggccacaagtaccagcagaatgctgagcagtatggaggcacccgggactactggcagggcaatggctactgggaccccaggagcggccggcccccaggcaccggggtggtgtatgacaggacccagggccaggtgcctgacagcctgacagatgaccgggaggaggaggagaactgggaccagcaggacggcagccacttcagtgaccagagcgacaagttcctgctgagcctgcagaaggacaagggctctgtgcaggcccctgagatcagcagcaacagcatcaaggacaccctggccgtgaatgagaagaaggacttcagcaagaacctggagaagaatgacatcaaggaccggggccccctgaagaagaggcggcaggagattgaaagtgacagcgagagtgatggagagctgcaggacaggaagaaggtgcgggtggaggtggagcagggcgagacctctgtgcccccaggcagcgccctggtgggccccagctgtgtgatggatgacttccgggacccccagcgctggaaggaatgtgccaagcagggcaagatgccctgctactttgacctgattgaggagaatgtgtacctgacagagaggaagaagaacaagagccaccgggacatcaagaggatgcagtgtgagtgcacccccctgagcaaggatgagcgggcccagggcgagatcgcctgtggggaggactgcctgaaccggctgctgatgattgagtgcagcagccgctgccccaatggagactactgcagcaacagacgcttccagaggaagcagcacgcagatgtggaggtgatcctgacagagaagaagggctggggcctgcgggccgccaaggacctgcccagcaacacctttgtgctggagtactgtggggaggtgctggaccacaaggagttcaaggcccgggtgaaggagtatgccaggaacaagaacatccactactacttcatggccctgaagaatgatgagatcattgatgccacccagaagggcaactgcagccgcttcatgaaccacagctgtgagcccaactgtgagacccagaagtggacagtgaatggccagctgcgggtgggcttcttcaccaccaagctggtgcccagcggcagcgagctgacctttgactaccagttccagagatatggcaaggaggcccagaagtgcttctgtggcagcgccaactgccggggctacctgggcggggagaacagagtgtccatccgggccgccggcggcaagatgaagaaggagaggagcaggaagaaggacagcgtggatggagagctggaggccctgatggagaatggagagggcctgagtgacaagaaccaggtgctgagcctgagccggctgatggtgagaattgagaccctggagcagaagctgacctgcctggagctgatccagaacacccacagccagagctgcctgaagagcttcctggagcggcacggcctgagcctgctgtggatctggatggccgagctgggagatggccgggagagcaaccagaagctgcaggaggagatcatcaagaccctggagcacctgcccatccccaccaagaacatgctggaggagagcaaggtgctgcccatcatccagcgctggagccagaccaagacagctgtgccccccctgtctgaaggagatggctacagcagcgagaacaccagccgggcccacacccccctgaacaccccagaccccagcaccaagctgagcacagaggccgacacagacacccccaagaagctgatgttccggcggctgaagatcatcagcgagaacagcatggattctgccatcagtgatgccaccagcgagctggagggcaaggatggcaaggaggacctggaccagctggagaatgtgcctgtggaggaggaggaggagctgcagagccagcagctgctgccccagcagctgcctgagtgcaaggtggacagcgagaccaacatcgaggccagcaagctgcccaccagcgagcctgaggctgatgctgagattgagcccaaggagagcaatggcaccaagctggaggagcccatcaatgaggagacccccagccaggatgaggaggagggcgtgtctgatgtggagagcgagaggagccaggagcagcctgacaagacagtggacatcagtgacctggccaccaagctgctggacagctggaaggacctgaaggaggtgtaccgcatccccaagaagagccagacagagaaggagaacaccaccacagagcggggcagagatgctgtgggcttccgggaccagaccccagcccccaagacccccaacagaagccgggagcgggaccctgacaagcagacccagaacaaggagaagaggaagagaagaagcagcctgagcccccccagcagcgcctatgaaagaggcaccaagaggccagatgacagatatgacacccccaccagcaagaagaaggtgcgcatcaaggacaggaacaagctgagcacagaggagaggaggaagctgtttgagcaggaggtggcccagcgggaggcccagaagcagcagcagcagatgcagaacctgggcatgaccagccccctgccctatgacagcctgggctacaatgccccccaccacccctttgctggctacccacctggctaccccatgcaggcctacgtggaccccagcaaccccaatgctgggaaggtgctgctgcccacccccagcatggaccctgtgtgcagccctgccccctatgaccacgcccagcccctggtgggccacagcacagagcccctgagcgcccctcctcctgtgcctgtggtgccccacgtggccgcccctgtggaggtgagcagcagccagtatgtggcccagagtgatggagtggtgcaccaggacagctctgtggccgtgctgcctgtgcctgcccctggccctgtgcagggccagaactacagcgtgtgggacagcaaccagcagagcgtgtctgtgcagcagcagtacagccctgcccagagccaggccaccatctactaccagggccagacctgccccaccgtgtatggagtgaccagcccctacagccagaccaccccacccatcgtgcagagctatgcccagcccagcctgcagtacatccagggccagcagatcttcaccgcccacccccagggcgtggtggtgcagcctgctgctgctgtgaccaccatcgtggcccctggccagccccagcccctgcagcccagcgagatggtggtgaccaacaacctgctggacctgcccccacccagcccccccaagcccaagaccatcgtgctgccccccaactggaagacagcccgggaccctgagggcaagatctactactaccacgtgatcacccggcagacccagtgggacccccccacctgggagagccctggagatgatgccagcctggagcatgaagctgagatggacctgggcacccccacctatgatgagaaccccatgaaggccagcaagaagcccaagacagctgaggccgacaccagcagcgagctggccaagaagagcaaggaggtgttcaggaaggagatgagccagttcatcgtgcagtgcctgaacccctacaggaagccagactgcaaggtgggccgcatcaccaccacagaggacttcaagcacctggccaggaagctgacccacggcgtgatgaacaaggagctgaagtactgcaagaaccctgaggacctggagtgcaatgaaaatgtgaagcacaagaccaaggagtacatcaagaagtacatgcagaagtttggagctgtgtacaagcccaaggaggacacagagctggagtag

SEQ ID NO: 169493 - DNA, 5145 bp, Artificial Sequence
  Description of Artificial Sequence: Synthetic coding sequence
atgaagcagctgcagccccagcccccacccaagatgggagacttctatgaccctgagcaccccaccccagagaagaaggagcgggaggccaagattgaaaatgtgcagaagacaggcttcatcaagggccccatgtttaaaggagtggccagcagccgcttcctgcccaagggcaccaagaccaaggtgaacctggaggagcagggccggcagaaggtgtccttctccttcagcctgaccaagaagaccctgcagaaccgcttcctgacagccctgggcaatgagaagcagagcgacacccccaaccccccagctgtgcccctgcaggtggacagcacccccaagatgaagatggagatcggggacaccctgagcacagctgaggagagcagcccccccaagagccgggtggagctgggcaagatccacttcaagaagcacctgctgcacgtgaccagccggcccctgctggccaccaccacagctgtggccagcccccccacccacgccgcccccctgcctgctgtgattgctgagagcaccaccgtggacagcccccccagcagccccccacctcctcctcctccagcccaggccaccaccctgagcagccctgcccctgtgacagagcctgtggccctgccccacacccccatcaccgtgctgatggccgcccctgtgcccctgcctgtggatgtggccgtgcgcagcctgaaggagccccccatcatcatcgtgcctgagagcctggaggccgacaccaagcaggacaccatcagcaacagcctggaggagcacgtgacccagatcctgaatgagcaggccgacatcagcagcaagaaggaggacagccacatcggcaaggatgaggagatcccagacagcagcaagatcagcctgagctgcaagaagacaggcagcaagaagaagagcagccagagcgagggcatcttcctgggcagcgagagtgatgaagattctgtgaggaccagcagcagccagaggagccatgacctgaagttcagcgccagcattgagaaggagcgggacttcaagaagagcagcgcccccctgaagtctgaggacctgggcaagcccagccgcagcaagacagacagagatgacaagtacttctcctacagcaagctggagcgggacaccaggtatgtgagcagccgctgccgctctgagcgggagaggagaagaagccgcagccacagccgctctgagcggggcagcaggaccaacctgagctacagccgctctgagaggagccactactatgacagcgaccggcgctaccacaggagcagcccctaccgggagaggacccgctacagccggccctacacagacaacagagcccgggagagcagtgacagcgaggaggagtacaagaagacctacagcaggaggaccagcagccacagcagcagctacagagacctgcggaccagcagctacagcaagagtgaccgggactgcaagacagagaccagctacctggagatggagcggcggggcaagtacagcagcaagctggagcgggagagcaagaggaccagtgaaaatgaggccatcaagcgctgctgcagccccccaaatgagctgggcttccggcggggcagcagctacagcaagcatgacagcagcgccagccgctacaagagcaccctgagcaagcccatccccaagagtgacaagttcaagaacagcttctgctgcacagagctgaatgaggagatcaagcagagccacagcttcagcctgcagaccccctgcagcaagggcagcgagctgaggatgatcaacaagaaccctgagcgggagaaggccggcagccctgcccccagcaaccggctgaatgacagccccaccctgaagaagctggatgagctgcccatcttcaagtctgagttcatcacccatgacagccatgacagcatcaaggagctggacagcctgagcaaggtgaagaatgaccagctgcgctccttctgccccatcgagctgaacatcaatggcagccctggagctgagagtgacctggccaccttctgcaccagcaagacagatgctgtgctgatgaccagtgatgattctgtgactggaagtgagctgagccccctggtgaaggcctgcatgctgagcagcaatggcttccagaacatcagccgctgcaaggagaaggacctggatgacacctgcatgctgcacaagaagtctgagagccccttccgggagacagagcccctggtgagcccccaccaggacaagctgatgtccatgcctgtgatgacagtggactacagcaagacagtggtgaaggagcctgtggacaccagggtgtcctgctgcaagaccaaggacagcgacatctactgcaccctgaatgacagcaaccccagcctgtgcaacagcgaggccgagaacatcgagcccagcgtgatgaagatcagcagcaacagcttcatgaatgtgcacctggagagcaagcctgtgatctgtgacagcaggaacctgacagaccacagcaagtttgcctgtgaggagtacaagcagagcatcggcagcaccagcagcgcctctgtgaaccactttgatgacctgtaccagcccatcggcagcagcggcatcgccagcagcctgcagagcctgcccccaggcatcaaggtggacagcctgaccctgctgaagtgtggggagaacaccagccctgtgctggatgctgtgctgaagagcaagaagagcagcgagttcctgaagcacgccggcaaggagaccatcgtggaggtgggcagtgacctgcctgattctggaaaaggatttgccagcagagaaaatagaagaaacaacggcctgagcggcaagtgcctgcaggaggcccaggaggagggcaacagcatcctgcctgagcggcggggccggcctgagatcagcctggatgagcggggggagggcggccacgtgcacaccagtgatgacagcgaggtggtgttcagcagctgtgacctgaacctgaccatggaggacagtgatggagtgacctacgccctgaagtgtgacagcagcggccacgcccctgagatcgtgtccacagtgcatgaggactacagcggcagcagcgagagcagcaatgatgaaagtgacagcgaggacacagacagtgatgacagcagcatccccaggaaccggctgcagagcgtggtggtggtgcccaagaacagcaccctgcccatggaggagaccagcccctgcagcagccgcagcagccagagctaccgccactacagcgaccactgggaggatgagcggctggagagcagaagacacctgtatgaggagaagtttgagagcatcgccagcaaggcctgcccccagacagacaagttcttcctgcacaagggcacagagaagaaccctgagatctccttcacccagagcagcaggaagcagattgacaaccggctgcctgagctgagccacccccagagtgatggagtggacagcaccagccacacagatgtgaagagtgaccccctgggccaccccaacagcgaggagaccgtgaaggccaagatccccagccggcagcaggaggagctgcccatctacagcagtgactttgaagatgtgcccaacaagtcctggcagcagaccaccttccagaacagaccagacagccggctgggcaagacagagctgtccttcagcagcagctgtgagatcccccacgtggatggcctgcacagcagcgaggagctgaggaacctgggctgggacttcagccaggagaagcccagcaccacctaccagcagcctgacagcagctatggagcctgtggcggccacaagtaccagcagaatgctgagcagtatggaggcacccgggactactggcagggcaatggctactgggaccccaggagcggccggcccccaggcaccggggtggtgtatgacaggacccagggccaggtgcctgacagcctgacagatgaccgggaggaggaggagaactgggaccagcaggacggcagccacttcagtgaccagagcgacaagttcctgctgagcctgcagaaggacaagggctctgtgcaggcccctgagatcagcagcaacagcatcaaggacaccctggccgtgaatgagaagaaggacttcagcaagaacctggagaagaatgacatcaaggaccggggccccctgaagaagaggcggcaggagattgaaagtgacagcgagagtgatggagagctgcaggacaggaagaaggtgcgggtggaggtggagcagggcgagacctctgtgcccccaggcagcgccctggtgggccccagctgtgtgatggatgacttccgggacccccagcgctggaaggaatgtgccaagcagggcaagatgccctgctactttgacctgattgaggagaatgtgtacctgacagagaggaagaagaacaagagccaccgggacatcaagaggatgcagtgtgagtgcacccccctgagcaaggatgagcgggcccagggcgagatcgcctgtggggaggactgcctgaaccggctgctgatgattgagtgcagcagccgctgccccaatggagactactgcagcaacagacgcttccagaggaagcagcacgcagatgtggaggtgatcctgacagagaagaagggctggggcctgcgggccgccaaggacctgcccagcaacacctttgtgctggagtactgtggggaggtgctggaccacaaggagttcaaggcccgggtgaaggagtatgccaggaacaagaacatccactactacttcatggccctgaagaatgatgagatcattgatgccacccagaagggcaactgcagccgcttcatgaaccacagctgtgagcccaactgtgagacccagaagtggacagtgaatggccagctgcgggtgggcttcttcaccaccaagctggtgcccagcggcagcgagctgacctttgactaccagttccagagatatggcaaggaggcccagaagtgcttctgtggcagcgccaactgccggggctacctgggcggggagaacagagtgtccatccgggccgccggcggcaagatgaagaaggagaggagcaggaagaaggacagctag

SEQ ID NO: 169494 - DNA, 3876 bp, Artificial Sequence
  Description of Artificial Sequence: Synthetic coding sequence
atgagcagcctgcccggctgcatcggcctggatgctgccacagccaccgtggagagcgaggagattgctgagctgcagcaggccgtggtggaggagctgggcatctccatggaggagctgcggcacttcattgatgaggagctggagaagatggactgtgtgcagcagaggaagaagcagctggccgagctggagacctgggtgatccagaaggagagcgaggtggcccacgtggaccagctgtttgatgatgccagcagagctgtgaccaactgtgagagcctggtgaaggacttctacagcaagctgggcctgcagtacagagacagcagcagtgaagatgagagcagccggcccacagagatcatcgagatcccagatgaagatgatgatgtgctgagcattgattctggagatgctggcagcaggacccccaaggaccagaagctgcgggaggccatggccgccctgaggaagagcgcccaggatgtgcagaagttcatggatgctgtgaacaagaagagcagcagccaggacctgcacaagggcaccctgagccagatgtctggagagctgagcaaggatggagacctgattgtgtccatgaggatcctgggcaagaagaggaccaagacctggcacaagggcaccctgattgccatccagacagtgggccctgggaagaagtacaaggtgaagtttgacaacaagggcaagagcctgctgagcggcaaccacatcgcctatgactaccaccccccagctgacaagctgtatgtgggcagccgggtggtggccaagtacaaggatggcaaccaggtgtggctgtatgccggcatcgtggccgagacccccaacgtgaagaacaagctgcgcttcctgatcttctttgatgatggctacgccagctatgtgacccagagcgagctgtaccccatctgccggcccctgaagaagacctgggaggacatcgaggacatcagctgccgggacttcatcgaggagtatgtgacagcctaccccaaccggcccatggtgctgctgaagagcggccagctgatcaagacagagtgggagggcacctggtggaagagccgggtggaggaggtggatggcagcctggtgcgcatcctcttcctggatgacaagagatgtgagtggatctaccggggcagcacccggctggagcccatgttctccatgaagaccagcagcgccagcgccctggagaagaagcagggccagctgcggacccggcccaacatgggcgctgtgcgcagcaagggccctgtggtgcagtacacccaggacctgactggaacaggcacccagttcaagcctgtggagcccccccagcccacagcccccccagccccacccttccccccagccccacccctgagcccccaggccggggacagcgacctggagagccagctggcccagagcaggaagcaggtggccaagaagagcaccagcttccggcccggctctgtgggcagcggccacagcagccccaccagccctgccctgtctgaaaatgtgtctgggggcaagccaggcatcaaccagacctaccgcagccccctgggcagcacagccagcgccccagcccccagcgccctgcctgcccccccagcccctcctgtgttccacggcatgctggagcgggccccagctgagcccagctaccgggcccccatggagaagctgttctacctgccccacgtgtgcagctacacctgcctgagccgggtgcggcccatgagaaatgagcagtaccggggcaagaaccccctgctggtgcccctgctgtatgacttccggaggatgacagccaggagaagagtgaacaggaagatgggcttccacgtgatctacaagaccccctgtggcctgtgcctgcggaccatgcaggagattgagcgctacctgtttgagaccggctgtgacttcctgttcctggagatgttctgcctggacccctacgtgctggtggacaggaagttccagccctacaagcccttctactacatcctggacatcacctacggcaaggaggatgtgcccctgagctgtgtgaatgaaattgacaccaccccaccaccccaggtggcctacagcaaggagcgcatccctggaaaaggagtcttcatcaacacaggccctgagttcctggtgggctgtgactgcaaggatggctgccgggacaagagcaaatgtgcctgccaccagctgaccatccaggccacagcctgcaccccaggcggccagatcaaccccaacagcggctaccagtacaagaggctggaggagtgcctgcccaccggggtgtatgagtgcaacaagcgctgcaagtgtgaccccaacatgtgcaccaaccggctggtgcagcacggcctgcaggtgcggctgcagctgttcaagacccagaacaagggctggggcatccgctgcctggatgacatcgccaagggcagctttgtgtgcatctatgccggcaagatcctgacagatgactttgctgacaaggagggcctggagatgggagatgagtactttgccaacctggaccacatcgagagcgtggagaacttcaaggagggctatgaaagtgatgccccctgcagcagtgacagcagtggagtggacctgaaggaccaggaggatggcaacagcggcacagaggaccctgaggagagcaatgatgacagcagtgatgacaacttctgcaaggatgaggacttcagcaccagctctgtgtggaggagctatgccacccggcggcagacccggggccagaaggaaaatggcctgtctgagaccaccagcaaggacagccaccccccagacctgggccccccccacatccctgtgccccccagcatccctgtgggcggctgcaacccccccagcagcgaggagacccccaagaacaaggtggcctcctggctgagctgcaacagcgtgtctgagggcggctttgctgacagcgacagccacagcagcttcaagaccaatgaaggaggagagggccgggccggcggcagcaggatggaggccgagaaggccagcaccagcggcctgggcatcaaggatgaaggagacatcaagcaggccaagaaggaggacacagatgacaggaacaagatgtctgtggtgacagagagcagcagaaattatggctacaaccccagccctgtgaagccagagggcctgcggcggccccccagcaagacctccatgcaccagagccggcggctgatggccagcgcccagagcaacccagatgatgtgctgaccctgagcagcagcacagagagcgagggggagagcggcaccagcaggaagcccacagctggccagaccagcgccacagctgtggacagtgatgacatccagaccatcagcagcggctctgaaggagatgactttgaggacaagaagaacatgacaggccccatgaagaggcaggtggccgtgaagagcacccggggctttgccctgaagagcacccatggaattgccatcaagagcaccaacatggcctctgtggacaagggggagagcgcccctgtgaggaagaacacccggcagttctatgatggagaggagagctgctacatcattgatgccaagctggagggcaacctgggccgctacctgaaccacagctgcagccccaacctgtttgtgcagaatgtgtttgtggacacccatgacctgcgcttcccctgggtggccttctttgccagcaagaggatccgggccggcacagagctgacctgggactacaactatgaggtgggctctgtggagggcaaggagctgctgtgctgctgcggggccattgaatgtcggggccgcctgctgtag

SEQ ID NO: 169495 - DNA, 1194 bp, Artificial Sequence
  Description of Artificial Sequence: Synthetic coding sequence
atgagcagcctgcccggctgcatcggcctggatgctgccacagccaccgtggagagcgaggagattgctgagctgcagcaggccgtggtggaggagctgggcatctccatggaggagctgcggcacttcattgatgaggagctggagaagatggactgtgtgcagcagaggaagaagcagctggccgagctggagacctgggtgatccagaaggagagcgaggtggcccacgtggaccagctgtttgatgatgccagcagagctgtgaccaactgtgagagcctggtgaaggacttctacagcaagctgggcctgcagtacagagacagcagcagtgaagatgagagcagccggcccacagagatcatcgagatcccagatgaagatgatgatgtgctgagcattgattctggagatgctggcagcaggacccccaaggaccagaagctgcgggaggccatggccgccctgaggaagagcgcccaggatgtgcagaagttcatggatgctgtgaacaagaagagcagcagccaggacctgcacaagggcaccctgagccagatgtctggagagctgagcaaggatggagacctgattgtgtccatgaggatcctgggcaagaagaggaccaagacctggcacaagggcaccctgattgccatccagacagtgggccctgggaagaagtacaaggtgaagtttgacaacaagggcaagagcctgctgagcggcaaccacatcgcctatgactaccaccccccagctgacaagctgtatgtgggcagccgggtggtggccaagtacaaggatggcaaccaggtgtggctgtatgccggcatcgtggccgagacccccaacgtgaagaacaagctgcgcttcctgatcttctttgatgatggctacgccagctatgtgacccagagcgagctgtaccccatctgccggcccctgaagaagacctgggaggacatcgaggacatcagctgccgggacttcatcgaggagtatgtgacagcctaccccaaccggcccatggtgctgctgaagagcggccagctgatcaagacagagtgggagggcacctggtggaagagccgggtggaggaggtggatggcagcctggtgcgcatcctcttcctggtgctcttcttcagcaccatcctggaggccgaggtgggcggcggcggcacctag

SEQ ID NO: 169496 - DNA, 750 bp, Artificial Sequence
  Description of Artificial Sequence: Synthetic coding sequence
atgagcagcctgcccggctgcatcggcctggatgctgccacagccaccgtggagagcgaggagattgctgagctgcagcaggccgtggtggaggagctgggcatctccatggaggagctgcggcacttcattgatgaggagctggagaagatggactgtgtgcagcagaggaagaagcagctggccgagctggagacctgggtgatccagaaggagagcgaggtggcccacgtggaccagctgtttgatgatgccagcagagctgtgaccaactgtgagagcctggtgaaggacttctacagcaagctgggcctgcagtacagagacagcagcagtgaagatgagagcagccggcccacagagatcatcgagatcccagatgaagatgatgatgtgctgagcattgattctggagatgctggcagcaggacccccaaggaccagaagctgcgggaggccatggccgccctgaggaagagcgcccaggatgtgcagaagttcatggatgctgtgaacaagaagagcagcagccaggacctgcacaagggcaccctgagccagatgtctggagagctgagcaaggatggagacctgattgtgtccatgaggatcctgggcaagaagaggaccaagacctggcacaagggcaccctgattgccatccagacagtgggcttctccttcagcctgatgatggccatgctgcccatgagccacagcaggaactgcatcccctttgctggccactag

SEQ ID NO: 169497 - DNA, 3873 bp, Artificial Sequence
  Description of Artificial Sequence: Synthetic coding sequence
atgagcagcctgcccggctgcatcggcctggatgctgccacagccaccgtggagagcgaggagattgctgagctgcagcaggccgtggtggaggagctgggcatctccatggaggagctgcggcacttcattgatgaggagctggagaagatggactgtgtgcagcagaggaagaagcagctggccgagctggagacctgggtgatccagaaggagagcgaggtggcccacgtggaccagctgtttgatgatgccagcagagctgtgaccaactgtgagagcctggtgaaggacttctacagcaagctgggcctgcagtacagagacagcagcagtgaagatgagagcagccggcccacagagatcatcgagatcccagatgaagatgatgatgtgctgagcattgattctggagatgctggcagcaggacccccaaggaccagaagctgcgggaggccatggccgccctgaggaagagcgcccaggatgtgcagaagttcatggatgctgtgaacaagaagagcagcagccaggacctgcacaagggcaccctgagccagatgtctggagagctgagcaaggatggagacctgattgtgtccatgaggatcctgggcaagaagaggaccaagacctggcacaagggcaccctgattgccatccagacagtgggccctgggaagaagtacaaggtgaagtttgacaacaagggcaagagcctgctgagcggcaaccacatcgcctatgactaccaccccccagctgacaagctgtatgtgggcagccgggtggtggccaagtacaaggatggcaaccaggtgtggctgtatgccggcatcgtggccgagacccccaacgtgaagaacaagctgcgcttcctgatcttctttgatgatggctacgccagctatgtgacccagagcgagctgtaccccatctgccggcccctgaagaagacctgggaggacatcgaggacatcagctgccgggacttcatcgaggagtatgtgacagcctaccccaaccggcccatggtgctgctgaagagcggccagctgatcaagacagagtgggagggcacctggtggaagagccgggtggaggaggtggatggcagcctggtgcgcatcctcttcctggatgacaagagatgtgagtggatctaccggggcagcacccggctggagcccatgttctccatgaagaccagcagcgccagcgccctggagaagaagcagggccagctgcggacccggcccaacatgggcgctgtgcgcagcaagggccctgtggtgcagtacacccaggacctgactggaacaggcacccagttcaagcctgtggagcccccccagcccacagcccccccagccccacccttccccccagccccacccctgagcccccaggccggggacagcgacctggagagccagctggcccagagcaggaagcaggtggccaagaagagcaccagcttccggcccggctctgtgggcagcggccacagcagccccaccagccctgccctgtctgaaaatgtgtctgggggcaagccaggcatcaaccagacctaccgcagccccctgggcagcacagccagcgccccagcccccagcgccctgcctgcccccccagcccctcctgtgttccacggcatgctggagcgggccccagctgagcccagctaccgggcccccatggagaagctgttctacctgccccacgtgtgcagctacacctgcctgagccgggtgcggcccatgagaaatgagcagtaccggggcaagaaccccctgctggtgcccctgctgtatgacttccggaggatgacagccaggagaagagtgaacaggaagatgggcttccacgtgatctacaagaccccctgtggcctgtgcctgcggaccatgcaggagattgagcgctacctgtttgagaccggctgtgacttcctgttcctggagatgttctgcctggacccctacgtgctggtggacaggaagttccagccctacaagcccttctactacatcctggacatcacctacggcaaggaggatgtgcccctgagctgtgtgaatgaaattgacaccaccccaccaccccaggtggcctacagcaaggagcgcatccctggaaaaggagtcttcatcaacacaggccctgagttcctggtgggctgtgactgcaaggatggctgccgggacaagagcaaatgtgcctgccaccagctgaccatccaggccacagcctgcaccccaggcggccagatcaaccccaacagcggctaccagtacaagaggctggaggagtgcctgcccaccggggtgtatgagtgcaacaagcgctgcaagtgtgaccccaacatgtgcaccaaccggctggtgcagcacggcctgcaggtgcggctgcagctgttcaagacccagaacaagggctggggcatccgctgcctggatgacatcgccaagggcagctttgtgtgcatctatgccggcaagatcctgacagatgactttgctgacaaggagggcctggagatgggagatgagtactttgccaacctggaccacatcgagagcgtggagaacttcaaggagggctatgaaagtgatgccccctgcagcagtgacagcagtggagtggacctgaaggaccaggaggatggcaacagcggcacagaggaccctgaggagagcaatgatgacagcagtgatgacaacttctgcaaggatgaggacttcagcaccagctctgtgtggaggagctatgccacccggcggcagacccggggccagaaggaaaatggcctgtctgagaccaccagcaaggacagccaccccccagacctgggccccccccacatccctgtgccccccagcatccctgtgggcggctgcaacccccccagcagcgaggagacccccaagaacaaggtggcctcctggctgagctgcaacagcgtgtctgagggcggctttgctgacagcgacagccacagcagcttcaagaccaatgaaggaggagagggccgggccggcggcagcaggatggaggccgagaaggccagcaccagcggcctgggcatcaaggatgaaggagacatcaagcaggccaagaaggaggacacagatgacaggaacaagatgtctgtggtgacagagagcagcagaaattatggctacaaccccagccctgtgaagccagagggcctgcggcggccccccagcaagacctccatgcaccagagccggcggctgatggccagcgcccagagcaacccagatgatgtgctgaccctgagcagcagcacagagagcgagggggagagcggcaccagcaggaagcccacagctggccagaccagcgccacagctgtggacagtgatgacatccagaccatcagcagcggctctgaaggagatgactttgaggacaagaagaacatgacaggccccatgaagaggcaggtggccgtgaagagcacccggggctttgccctgaagagcacccatggaattgccatcaagagcaccaacatggcctctgtggacaagggggagagcgcccctgtgaggaagaacacccggcagttctatgatggagaggagagctgctacatcattgatgccaagctggagggcaacctgggccgctacctgaaccacagctgcagccccaacctgtttgtgcagaatgtgtttgtggacacccatgacctgcgcttcccctgggtggccttctttgccagcaagatccgggccggcacagagctgacctgggactacaactatgaggtgggctctgtggagggcaaggagctgctgtgctgctgcggggccatcgagtgccggggccgcctgctgtag

SEQ ID NO: 169498 - DNA, 504 bp, Artificial Sequence
  Description of Artificial Sequence: Synthetic coding sequence
atgagcagcctgcccggctgcatcggcctggatgctgccacagccaccgtggagagcgaggagattgctgagctgcagcaggccgtggtggaggagctgggcatctccatggaggagctgcggcacttcattgatgaggagctggagaagatggactgtgtgcagcagaggaagaagcagctggccgagctggagaccgtgggccctgggaagaagtacaaggtgaagtttgacaacaagggcaagagcctgctgagcggcaaccacatcgcctatgactaccaccccccagctgacaagctgtatgtgggcagccgggtggtggccaagtacaaggatggcaaccaggtgtggctgtatgccggcatcgtggccgagaccccaaatgtgaagaacaagctgcgcttcctgatcttctttgatgatggctacgccagctatgtgacccagagcgagctgtaccccatctgccggccccgggagtgcttcagcctcatcccctag

SEQ ID NO: 169499 - DNA, 471 bp, Artificial Sequence
  Description of Artificial Sequence: Synthetic coding sequence
atgagcagcctgcccggctgcatcggcctggatgctgccacagccaccgtggagagcgaggagattgctgagctgcagcaggccgtggtggaggagctgggcatctccatggaggagctgcggcacttcattgatgaggagctggagaagatggactgtgtgcagcagaggaagaagcagctggccgagctggagacctgggtgatccagaaggagagcgaggtggcccacgtggaccagctgtttgatgatgccagcagagctgtgaccaactgtgagagcctggtgaaggacttctacagcaagctgggcctgcagtacagagacagcagcagtgaagatgagagcagccggcccacagagatcatcgagatcccagatgaagatgatgatgtgctgagcattgattctggagatgctggcagcaggacccccaaggaccagaagctgcgggaggccatggccgcctag

SEQ ID NO: 169500 - DNA, 3780 bp, Artificial Sequence
  Description of Artificial Sequence: Synthetic coding sequence
atgagcagcctgcccggctgcatcggcctggatgctgccacagccaccgtggagagcgaggagattgctgagctgcagcaggccgtggtggaggagctgggcatctccatggaggagctgcggcacttcattgatgaggagctggagaagatggactgtgtgcagcagaggaagaagcagctggccgagctggagacctgggtgatccagaaggagagcgaggtggcccacgtggaccagctgtttgatgatgccagcagagctgtgaccaactgtgagagcctggtgaaggacttctacagcaagctgggcctgcagtacagagacagcagcagtgaagatgagagcagccggcccacagagatcatcgagatcccagatgaagatgatgatgtgctgagcattgattctggagatgctggcagcaggacccccaaggaccagaagctgcgggaggccatggccgccctgaggaagagcgcccaggatgtgcagaagttcatggatgctgtgaacaagaagagcagcagccaggacctgcacaagggcaccctgagccagatgtctggagagctgagcaaggatggagacctgattgtgtccatgaggatcctgggcaagaagaggaccaagacctggcacaagggcaccctgattgccatccagacagtgggccctgggaagaagtacaaggtgaagtttgacaacaagggcaagagcctgctgagcggcaaccacatcgcctatgactaccaccccccagctgacaagctgtatgtgggcagccgggtggtggccaagtacaaggatggcaaccaggtgtggctgtatgccggcatcgtggccgagacccccaacgtgaagaacaagctgcgcttcctgatcttctttgatgatggctacgccagctatgtgacccagagcgagctgtaccccatctgccggcccctgaagaagacctgggaggacatcgaggacatcagctgccgggacttcatcgaggagtatgtgacagcctaccccaaccggcccatggtgctgctgaagagcggccagctgatcaagacagagtgggagggcacctggtggaagagccgggtggaggaggtggatggcagcctggtgcgcatcctcttcctggatgacaagagatgtgagtggatctaccggggcagcacccggctggagcccatgttctccatgaagaccagcagcgccagcgccctggagaagaagcagggccagctgcggacccggcccaacatgggcgctgtgcgcagcaagggccctgtggtgcagtacacccaggacctgactggaacaggcacccagttcaagcctgtggagcccccccagcccacagcccccccagccccacccttccccccagccccacccctgagcccccaggccggggacagcgacctggagagccagctggcccagagcaggaagcaggtggccaagaagagcaccagcttccggcccggctctgtgggcagcggccacagcagccccaccagccctgccctgtctgaaaatgtgtctgggggcaagccaggcatcaaccagacctaccgcagccccctgggcagcacagccagcgccccagcccccagcgccctgcctgcccccccagcccctcctgtgttccacggcatgctggagcgggccccagctgagcccagctaccgggcccccatggagaagctgttctacctgccccacgtgtgcagctacacctgcctgagccgggtgcggcccatgagaaatgagcagtaccggggcaagaaccccctgctggtgcccctgctgtatgacttccggaggatgacagccaggagaagagtgaacaggaagatgggcttccacgtgatctacaagaccccctgtggcctgtgcctgcggaccatgcaggagattgagcgctacctgtttgagaccggctgtgacttcctgttcctggagatgttctgcctggacccctacgtgctggtggacaggaagttccagccctacaagcccttctactacatcctggacatcacctacggcaaggaggatgtgcccctgagctgtgtgaatgaaattgacaccaccccaccaccccaggtggcctacagcaaggagcgcatccctggaaaaggagtcttcatcaacacaggccctgagttcctggtgggctgtgactgcaaggatggctgccgggacaagagcaaatgtgcctgccaccagctgaccatccaggccacagcctgcaccccaggcggccagatcaaccccaacagcggctaccagtacaagaggctggaggagtgcctgcccaccggggtgtatgagtgcaacaagcgctgcaagtgtgaccccaacatgtgcaccaaccggctggtgcagcacggcctgcaggtgcggctgcagctgttcaagacccagaacaagggctggggcatccgctgcctggatgacatcgccaagggcagctttgtgtgcatctatgccggcaagatcctgacagatgactttgctgacaaggagggcctggagatgggagatgagtactttgccaacctggaccacatcgagagcgtggagaacttcaaggagggctatgaaagtgatgccccctgcagcagtgacagcagtggagtggacctgaaggaccaggaggatggcaacagcggcacagaggaccctgaggagagcaatgatgacagcagtgatgacaacttctgcaaggatgaggacttcagcaccagctctgtgtggaggagctatgccacccggcggcagacccggggccagaaggaaaatggcctgtctgagaccaccagcaaggacagccaccccccagacctgggccccccccacatccctgtgccccccagcatccctgtgggcggctgcaacccccccagcagcgaggagacccccaagaacaaggtggcctcctggctgagctgcaacagcgtgtctgagggcggctttgctgacagcgacagccacagcagcttcaagaccaatgaaggaggagagggccgggccggcggcagcaggatggaggccgagaaggccagcaccagcggcctgggcatcaaggatgaaggagacatcaagcaggccaagaaggaggacacagatgacaggaacaagatgtctgtggtgacagagagcagcagaaattatggctacaaccccagccctgtgaagccagagggcctgcggcggccccccagcaagacctccatgcaccagagccggcggctgatggccagcgcccagagcaacccagatgatgtgctgaccctgagcagcagcacagagagcgagggggagagcggcaccagcaggaagcccacagctggccagaccagcgccacagctgtggacagtgatgacatccagaccatcagcagcggctctgaaggagatgactttgaggacaagaagaacatgacaggccccatgaagaggcaggtggccgtgaagagcacccggggctttgccctgaagagcacccatggaattgccatcaagagcaccaacatggcctctgtggacaagggggagagcgcccctgtgaggaagaacacccggcagttctatgatggagaggagagctgctacatcattgatgccaagctggagggcaacctgggccgctacctgaatgtgcggcccctgagcccccccctggatgctggcctgagccacggcccccagatctccttcaacatcctgtacaagcccttcagctgctacaagctgctgatcagcaagtag

SEQ ID NO: 169501 - DNA, 492 bp, Artificial Sequence
  Description of Artificial Sequence: Synthetic coding sequence
atgagcagcctgcccggctgcatcggcctggatgctgccacagccaccgtggagagcgaggagattgctgagctgcagcaggccgtggtggaggagctgggcatctccatggaggagctgcggcacttcattgatgaggagctggagaagatggactgtgtgcagcagaggaagaagcagctggccgagctggagacctgggtgatccagaaggagagcgaggtggcccacgtggaccagctgtttgatgatgccagcagagctgtgaccaactgtgagagcctggtgaaggacttctacagcaagctgggcctgcagtacagagacagcagcagtgaagatgagagcagccggcccacagagatcatcgagatcccagatgaagatgatgatgtgctgagcattgattctggagatgctggcagcaggacccccaaggaccagaagctgcgggaggccatggccgccctgaggaagagcgcccaggactag

SEQ ID NO: 169502 - DNA, 1911 bp, Artificial Sequence
  Description of Artificial Sequence: Synthetic coding sequence
atgagcagcctgcccggctgcatcggcctggatgctgccacagccaccgtggagagcgaggagattgctgagctgcagcaggccgtggtggaggagctgggcatctccatggaggagctgcggcacttcattgatgaggagctggagaagatggactgtgtgcagcagaggaagaagcagctggccgagctggagacctgggtgatccagaaggagagcgaggtggcccacgtggaccagctgtttgatgatgccagcagagctgtgaccaactgtgagagcctggtgaaggacttctacagcaagctgggcctgcagtacagagacagcagcagtgaagatgagagcagccggcccacagagatcatcgagatcccagatgaagatgatgatgtgctgagcattgattctggagatgctggcagcaggacccccaaggaccagaagctgcgggaggccatggccgccctgaggaagagcgcccaggatgtgcagaagttcatggatgctgtgaacaagaagagcagcagccaggacctgcacaagggcaccctgagccagatgtctggagagctgagcaaggatggagacctgattgtgtccatgaggatcctgggcaagaagaggaccaagacctggcacaagggcaccctgattgccatccagacagtgggccctgggaagaagtacaaggtgaagtttgacaacaagggcaagagcctgctgagcggcaaccacatcgcctatgactaccaccccccagctgacaagctgtatgtgggcagccgggtggtggccaagtacaaggatggcaaccaggtgtggctgtatgccggcatcgtggccgagacccccaacgtgaagaacaagctgcgcttcctgatcttctttgatgatggctacgccagctatgtgacccagagcgagctgtaccccatctgccggcccctgaagaagacctgggaggacatcgaggacatcagctgccgggacttcatcgaggagtatgtgacagcctaccccaaccggcccatggtgctgctgaagagcggccagctgatcaagacagagtgggagggcacctggtggaagagccgggtggaggaggtggatggcagcctggtgcgcatcctcttcctggatgacaagagatgtgagtggatctaccggggcagcacccggctggagcccatgttctccatgaagaccagcagcgccagcgccctggagaagaagcagggccagctgcggacccggcccaacatgggcgctgtgcgcagcaagggccctgtggtgcagtacacccaggacctgactggaacaggcacccagttcaagcctgtggagcccccccagcccacagcccccccagccccacccttccccccagccccacccctgagcccccaggccggggacagcgagagcctggagagccagctggcccagagcaggaagcaggtggccaagaagagcaccagcttccggcccggctctgtgggcagcggccacagcagccccaccagccctgccctgtctgaaaatgtgtctgggggcaagccaggcatcaaccagacctaccgcagccccctgggcagcacagccagcgccccagcccccagcgccctgcctgcccccccagcccctcctgtgttccacggcatgctggagcgggccccagctgagcccagctaccgggcccccatggagaagctgttctacctgccccacgtgtgcagctacacctgcctgagccgggtgcggcccatgagaaatgagcagtaccggggcaagaaccccctgctggtgcccctgctgtatgacttccggaggatgacagcccggcggcgggtgaacaggaagatgggcttccacgtgatctacaagaccccctgtggcctgtgcctgtag

SEQ ID NO: 169503 - DNA, 2160 bp, Artificial Sequence
  Description of Artificial Sequence: Synthetic coding sequence
atgggagagaagaatggagatgccaagaccttctggatggagctggaggatgatggcaaggtggacttcatctttgagcaggtgcagaatgtgctgcagagcctgaagcagaagatcaaggatggcagcgccaccaacaaggagtacatccaggccatgatcctggtgaatgaggccaccatcatcaacagcagcaccagcatcaagggggccagccagaaggaggtgaatgcccagagcagtgaccccatgcctgtgacccagaaggagcaggagaacaagagcaatgccttccccagcaccagctgtgagaacagcttccctgaggactgcaccttcctgaccacagagaacaaggagatcctgagcctggaggacaaggtggtggacttccgggagaaggacagcagcagcaacctgagctaccagagccatgactgcagcggggcctgcctgatgaagatgcccctgaacctgaagggggagaaccccctgcagctgcccatcaagtgccacttccagaggagacatgccaagaccaacagccacagcagcgccctgcacgtgtcctacaagaccccctgtggccgcagcctgagaaatgtggaggaggtgttccgctacctgctggagacagagtgcaacttcctgttcacagacaacttctccttcaacacctacgtgcagctggccaggaactaccccaagcagaaggaggtggtgtctgatgtggacatcagcaatggagtggagagcgtgcccatctccttctgcaatgaaattgacagcaggaagctgccccagttcaagtacaggaagacagtgtggccccgggcctacaacctgaccaacttcagctccatgttcacagacagctgtgactgcagcgagggctgcatcgacatcaccaagtgtgcctgcctgcagctgacagccagaaatgccaagaccagccccctgagcagtgacaagatcaccaccggctacaagtacaagaggctgcagaggcagatccccaccggcatctatgagtgcagcctgctgtgcaagtgcaaccggcagctgtgccagaacagagtggtgcagcacggcccccaggtgcggctgcaggtgttcaagacagagcagaagggctggggcgtgcgctgcctggatgacatcgaccggggcacctttgtgtgcatctacagcggccgcctgctgagccgggccaacacagagaagagctatggaattgatgaaaatggaagagatgagaacaccatgaagaacatcttcagcaagaagaggaagctggaggtggcctgcagcgactgtgaggtggaggtgctgcccctgggcctggagacccaccccaggacagccaagacagagaagtgcccccccaagttcagcaacaaccccaaggagctgactgtggagaccaagtatgacaacatcagccgcatccagtaccacagcgtcatccgggaccctgagagcaagacagccatcttccagcacaacgggaagaagatggagtttgtgtcctctgagagcgtgaccccagaagataatgatggcttcaagccaccccgggagcacctgaacagcaagaccaagggggcccagaaggacagcagcagcaaccacgtggatgaatttgaggacaacctgctgattgaaagtgatgtgattgacatcaccaagtaccgggaggagaccccacccaggagccgctgcaaccaggccaccaccctggacaaccagaacatcaagaaggccatcgaggtgcagatccagaagccccaggagggccgcagcacagcctgccagaggcagcaggtgttctgtgatgaggagctgctgtctgagaccaagaacaccagcagtgacagcctgaccaagttcaacaagggaaatgtgttcctgctggatgccaccaaggagggcaatgtgggccgcttcctgaaccacagctgctgccccaacctgctggtgcagaatgtgtttgtggagacccacaacagaaacttccccctggtggccttcttcaccaaccgctacgtgaaggccaggacagagctgacctgggactatggctatgaagctggcaccgtgcctgagaaggagatcttctgccagtgtggggtgaacaagtgcaggaagaagatcctgtag

SEQ ID NO: 169504 - DNA, 2124 bp, Artificial Sequence
  Description of Artificial Sequence: Synthetic coding sequence
atgggagagaagaatggagatgccaagaccttctggatggagctggaggatgatggcaaggtggacttcatctttgagcaggtgcagaatgtgctgcagagcctgaagcagaagatcaaggatggcagcgccaccaacaaggagtacatccaggccatgatcctggtgaatgaggccaccatcatcaacagcagcaccagcatcaaggaccccatgcctgtgacccagaaggagcaggagaacaagagcaatgccttccccagcaccagctgtgagaacagcttccctgaggactgcaccttcctgaccacagagaacaaggagatcctgagcctggaggacaaggtggtggacttccgggagaaggacagcagcagcaacctgagctaccagagccatgactgcagcggggcctgcctgatgaagatgcccctgaacctgaagggggagaaccccctgcagctgcccatcaagtgccacttccagaggagacatgccaagaccaacagccacagcagcgccctgcacgtgtcctacaagaccccctgtggccgcagcctgagaaatgtggaggaggtgttccgctacctgctggagacagagtgcaacttcctgttcacagacaacttctccttcaacacctacgtgcagctggccaggaactaccccaagcagaaggaggtggtgtctgatgtggacatcagcaatggagtggagagcgtgcccatctccttctgcaatgaaattgacagcaggaagctgccccagttcaagtacaggaagacagtgtggccccgggcctacaacctgaccaacttcagctccatgttcacagacagctgtgactgcagcgagggctgcatcgacatcaccaagtgtgcctgcctgcagctgacagccagaaatgccaagaccagccccctgagcagtgacaagatcaccaccggctacaagtacaagaggctgcagaggcagatccccaccggcatctatgagtgcagcctgctgtgcaagtgcaaccggcagctgtgccagaacagagtggtgcagcacggcccccaggtgcggctgcaggtgttcaagacagagcagaagggctggggcgtgcgctgcctggatgacatcgaccggggcacctttgtgtgcatctacagcggccgcctgctgagccgggccaacacagagaagagctatggaattgatgaaaatggaagagatgagaacaccatgaagaacatcttcagcaagaagaggaagctggaggtggcctgcagcgactgtgaggtggaggtgctgcccctgggcctggagacccaccccaggacagccaagacagagaagtgcccccccaagttcagcaacaaccccaaggagctgactgtggagaccaagtatgacaacatcagccgcatccagtaccacagcgtcatccgggaccctgagagcaagacagccatcttccagcacaacgggaagaagatggagtttgtgtcctctgagagcgtgaccccagaagataatgatggcttcaagccaccccgggagcacctgaacagcaagaccaagggggcccagaaggacagcagcagcaaccacgtggatgaatttgaggacaacctgctgattgaaagtgatgtgattgacatcaccaagtaccgggaggagaccccacccaggagccgctgcaaccaggccaccaccctggacaaccagaacatcaagaaggccatcgaggtgcagatccagaagccccaggagggccgcagcacagcctgccagaggcagcaggtgttctgtgatgaggagctgctgtctgagaccaagaacaccagcagtgacagcctgaccaagttcaacaagggaaatgtgttcctgctggatgccaccaaggagggcaatgtgggccgcttcctgaaccacagctgctgccccaacctgctggtgcagaatgtgtttgtggagacccacaacagaaacttccccctggtggccttcttcaccaaccgctacgtgaaggccaggacagagctgacctgggactatggctatgaagctggcaccgtgcctgagaaggagatcttctgccagtgtggggtgaacaagtgcaggaagaagatcctgtag

SEQ ID NO: 169505 - DNA, 975 bp, Artificial Sequence
  Description of Artificial Sequence: Synthetic coding sequence
atgagccggcccagcagcacaggccccagcgccaacaagccctgcagcaagcagcccccaccccagccccagcacacccccagccctgctgcccccccagctgctgccaccatctctgctgctggccctggcagcagcgctgtgcctgctgctgctgctgtgatcagcggccctgggggcggcggcggggccggccctgtgagcccccagcaccacgagctgaccagcctgtttgaatgtcctgtgtgctttgattatgtgctgccccccatcctgcagtgccaggccggccacctggtgtgcaaccagtgccggcagaagctgagctgctgccccacctgccgcggggccctgacccccagcatccggaacctggccatggagaaggtggccagcgctgtgctcttcccctgcaagtatgccaccaccggctgcagcctgaccctgcaccacacagagaagccagagcacgaggacatctgtgagtaccggccctacagctgcccctgccctggggccagctgcaagtggcagggcagcctggaggccgtgatgagccacctgatgcacgcccacaagagcatcaccaccctgcagggagaagatattgtgttcctggccacagacatcaacctgcctggagctgtggactgggtgatgatgcagagctgcttcggccaccacttcatgctggtgctggagaagcaggagaagtatgagggccaccagcagttctttgccatcgtgctgctgattggcaccaggaagcaggctgaaaattttgcctaccgcctggagctgaatggaaacagaagaaggctgacctgggaggccacccccaggagcatccatgatggagtggccgccgccatcatgaacagcgactgcctggtgtttgacacagccatcgcccacctgtttgctgacaatggaaacctgggcatcaacgtgaccatcagcacctgctgcccctag

SEQ ID NO: 169506 - DNA, 990 bp, Artificial Sequence
  Description of Artificial Sequence: Synthetic coding sequence
atgatgagcaacagcagcagcgagattgatgtgatcaagacccgcatccccacctatgatgaagatgacaacaccatcctgtatgcctatgagaccaagccagagtttgtgaacaaggagcccaacatcgtgtctgatgccagctgcaacacagaggagcagctgaagacagtggatgatgtgctgatccactgccaggtgatctatgatgccctgcagaacctggacaagaagattgatgtgatccggaggaaggtgtccaagatccagcgcttccacgcccggagcctgtggaccaaccacaagagatatggctacaagaagcacagctaccgcctggtgaagaagctgaagctgcagaagatgaagaagaatgaggtgtatgagaccttctcctacccagagagctacagccccaccctgcctgtgtccagaagagagaacaacagccccagcaacctgccccggcccagcttctgcatggaggagtaccagagagctgagctggaggaggaccccatcctgagcaggacccccagccctgtgcaccccagcgacttcagcgagcacaactgccagccctactatgccagtgatggagccacctacggcagcagcagcggcctgtgcctgggcaaccccagggctgacagcatccacaacacctacagcacagaccacgccagcgctgccccacccagcgtgaccaggagccctgtggagaatgatggctacatcgaggagggcagcatcaccaagcaccccagcacctggagcgtggaggccgtggtgctcttcctgaagcagacagaccccctggccctgtgccccctggtggacctcttccgcagccatgaaattgatggcaaggccctgctgctgctgaccagtgatgtgctgctgaagcacctgggcgtgaagctgggcacagctgtgaagctgtgctactacatcgaccggctgaagcagggcaaatgttttgagaactag

SEQ ID NO: 169507 - DNA, 909 bp, Artificial Sequence
  Description of Artificial Sequence: Synthetic coding sequence
atgatgagcaacagcagcagcgagattgatgtgcaggagcccaacatcgtgtctgatgccagctgcaacacagaggagcagctgaagacagtggatgatgtgctgatccactgccaggtgatctatgatgccctgcagaacctggacaagaagattgatgtgatccggaggaaggtgtccaagatccagcgcttccacgcccggagcctgtggaccaaccacaagagatatggctacaagaagcacagctaccgcctggtgaagaagctgaagctgcagaagatgaagaagaatgaggtgtatgagaccttctcctacccagagagctacagccccaccctgcctgtgtcccggcgggagaacaacagccccagcaacctgccccggcccagcttctgcatggaggagtaccagagagctgagctggaggaggaccccatcctgagcaggacccccagccctgtgcaccccagcgacttcagcgagcacaactgccagccctactatgccagtgatggagccacctacggcagcagcagcggcctgtgcctgggcaaccccagggctgacagcatccacaacacctacagcacagaccacgccagcgctgcccctccttctgtgaccaggagccctgtggagaatgatggctacatcgaggagggcagcatcaccaagcaccccagcacctggagcgtggaggccgtggtgctcttcctgaagcagacagaccccctggccctgtgccccctggtggacctcttccgcagccatgaaattgatggcaaggccctgctgctgctgaccagtgatgtgctgctgaagcacctgggcgtgaagctgggcacagctgtgaagctgtgctactacatcgaccggctgaagcagggcaagtgctttgaaaattag

SEQ ID NO: 169508 - DNA, 627 bp, Artificial Sequence
  Description of Artificial Sequence: Synthetic coding sequence
atgaagaagaatgaggtgtatgagaccttctcctacccagagagctacagccccaccctgcctgtgtcccggcgggagaacaacagccccagcaacctgccccggcccagcttctgcatggaggagtaccagagagctgagctggaggaggaccccatcctgagcaggacccccagccctgtgcaccccagcgacttcagcgagcacaactgccagccctactatgccagtgatggagccacctacggcagcagcagcggcctgtgcctgggcaaccccagggctgacagcatccacaacacctacagcacagaccacgccagcgctgcccctccttctgtgaccaggagccctgtggagaatgatggctacatcgaggagggcagcatcaccaagcaccccagcacctggagcgtggaggccgtggtgctcttcctgaagcagacagaccccctggccctgtgccccctggtggacctcttccgcagccatgaaattgatggcaaggccctgctgctgctgaccagtgatgtgctgctgaagcacctgggcgtgaagctgggcacagctgtgaagctgtgctactacatcgaccggctgaagcagggcaagtgctttgaaaattag

SEQ ID NO: 169509 - DNA, 627 bp, Artificial Sequence; identical to SEQ ID NO: 169508
  Description of Artificial Sequence: Synthetic coding sequence

SEQ ID NO: 169510 - DNA, 447 bp, Artificial Sequence
  Description of Artificial Sequence: Synthetic coding sequence
atgatgagcaacagcagcagcgagattgatgtgcaggagcccaacatcgtgtctgatgccagctgcaacacagaggagcagctgaagacagtggatgatgtgctgatccactgccaggtgatctatgatgccctgcagaacctggacaagaagattgatgtgatccggaggaaggtgtccaagatccagcgcttccacgcccggagcctgtggaccaaccacaagagatatggctacaagaagcacagctaccgcctggtgaagaagctgaagctgcagaagatgaagaagaatgaggtgtatgagaccttctcctacccagagagctacagccccaccctgcctgtgtcccggcgggagaacaacagccccagcaacctgccccggcccagcttctgcatggaggagtaccagagagctgagctggaggaggaccccatcctgtag

SEQ ID NO: 169511 - DNA, 2103 bp, Artificial Sequence
  Description of Artificial Sequence: Synthetic coding sequence
atgggccagacagtgaatgaagattccatggatgtgaagaaggagaaccaggagaagaccccccagagcagcaccagctctgtgcagagagatgacttccactgggaggagtacctgaaggagaccggcagcatcagcgcccccagcgagtgcttccggcagagccagatcccccctgtgaatgacttcaaggtgggcatgaagctggaggcccgggaccccagaaatgccacctctgtgtgcatcgccaccgtcatcggcatcactggagcccggctgcggctgcggctggatggcagtgacaacagaaatgacttctggaggctggtggacagcccagacatccagcctgtgggcacctgtgagaaggagggggacctgctgcagccccccctgggctaccagatgaacaccagctcctggcccatgttcctgctgaagaccctgaatggcagcgagatggccagcgccaccctcttcaagaaggagccccccaagccacccctgaacaacttcaaggtgggcatgaagctggaggccatcgacaagaagaacccctacctgatctgcccagccaccatcggagatgtgaagggagatgaggtgcacatcacctttgatggctggagcggggcctttgactactggtgcaagtatgacagccgggacatcttccctgctggctggtgccgcctgactggagatgtgctgcagcccccaggcacctctgtgcccatcgtgaagaacatcgccaagacagagagcagccccagcgaggccagccagcacagcatgcagagcccccagaagaccaccctcatcctgcccacccagcaggtgagaagaagcagccgcatcaagcccccaggccccacagctgtgcccaagaggagcagctctgtgaagaacatcacccccaggaagaagggccccaacagcggcaagaaggagaagcccctgcctgtgatctgcagcaccagcgctgccagcctgaagagcctgacccgggaccggggcatgctgtacaaggatgtggccagcggcccctgcaagatcgtgatgagcacagtgtgtgtgtatgtgaacaagcacggcaactttggcccccacctggaccccaagaggatccagcagctgcctgaccactttggacctggccctgtgaatgtggtgctgcggagaattgtgcaggcctgtgtggactgtgccctggagaccaagacagtgtttggctacctgaagccagacaacagaggaggagaggtgatcacagccagctttgatggagagacccacagcatccagctgccccctgtgaacagcgccagctttgccctgcgcttcctggagaacttctgccacagcctgcagtgtgacaacctgctgagcagccagcccttcagcagcagccggggccacacccacagcagcgctgagcatgacaagaaccagagcgccaaggaggatgtgacagagcggcagagcaccaagaggagcccccagcagacagtgccctacgtggtgcccctgagccccaagctgcccaagaccaaggagtatgccagcgagggggagcccctgtttgctgggggcagcgccatccccaaggaggagaacctgtctgaggacagcaagagcagcagcctgaacagcggcaactacctgaacccagcctgcaggaaccccatgtacatccacacctctgtgtcccaggacttcagccgctctgtgcccggcaccaccagcagccccctggtgggggacatcagccccaagagcagcccccatgaggtgaagttccagatgcagaggaagtctgaggcccccagctacatcgctgtgcctgaccccagcgtgctgaagcagggcttcagcaaggaccccagcacctggagcgtggatgaggtgatccagttcatgaagcacacagacccccagatcagcggccccctggccgacctcttccggcagcacgagattgatggcaaggccctcttcctgctgaagagtgatgtgatgatgaagtacatgggcctgaagctgggccctgccctgaagctgtgctactacatcgagaagctgaaggagggcaagtacagctag

SEQ ID NO: 169512 - DNA, 1038 bp, Artificial Sequence
  Description of Artificial Sequence: Synthetic coding sequence
atgcagagcccccagaagaccaccctcatcctgcccacccagcaggtgagaagaagcagccgcatcaagcccccaggccccacagctgtgcccaagaggagcagctctgtgaagaacatcacccccaggaagaagggccccaacagcggcaagaaggagaagcccctgcctgtgatctgcagcaccagcgctgccagcctgaagagcctgacccgggaccggggcatgctgtacaaggatgtggccagcggcccctgcaagatcgtgatgagcacagtgtgtgtgtatgtgaacaagcacggcaactttggcccccacctggaccccaagaggatccagcagctgcctgaccactttggacctggccctgtgaatgtggtgctgcggagaattgtgcaggcctgtgtggactgtgccctggagaccaagacagtgtttggctacctgaagccagacaacagaggaggagaggtgatcacagccagctttgatggagagacccacagcatccagctgccccctgtgaacagcgccagctttgccctgcgcttcctggagaacttctgccacagcctgcagtgtgacaacctgctgagcagccagcccttcagcagcagccggggccacacccacagcagcgctgagcatgacaagaaccagagcgccaaggaggatgtgacagagcggcagagcaccaagaggagcccccagcagacagtgccctacgtggtgcccctgagccccaagctgcccaagaccaaggagtatgccagcgagggggagcccctgtttgctgggggcagcgccatccccaaggaggagaacctgtctgaggacagcaagagcagcagcctgaacagcggcaactacctgaacccagcctgcaggaaccccatgtacatccacacctctgtgtcccaggacttcagccgctctgtgcccggcaccaccagcagccccctggtgggggacatcagccccaagagcagcccccatgaggtgaagttccagatgcagaggaagtctgagggcaactag

SEQ ID NO: 169513 - DNA, 378 bp, Artificial Sequence
  Description of Artificial Sequence: Synthetic coding sequence
tgagccaaggaggatgtgacagagcggcagagcaccaagaggagcccccagcagacagtgccctacgtggtgcccctgagccccaagctgcccaagaccaaggagtatgccagcgagggggagcccctgtttgctgggggcagcgccatccccaaggaggagaacctgtctgaggacagcaagagcagcagcctgaacagcggcaactacctgaacccagcctgcaggaaccccatgtacatccacacctctgtgtcccaggacttcagccgctctgtgcccggcaccaccagcagccccctggtgggggacatcagccccaagagcagcccccatgaggtgaagttccagatgcagaggaagtctgagggcaactag

SEQ ID NO: 169514 - DNA, 1734 bp, Artificial Sequence
  Description of Artificial Sequence: Synthetic coding sequence
atgggccagacagtgaatgaagattccatggatgtgaagaaggagaaccaggagaagaccccccagagccagatcccccctgtgaatgacttcaaggtgggcatgaagctggaggcccgggaccccagaaatgccacctctgtgtgcatcgccaccgtcatcggcatcactggagcccggctgcggctgcggctggatggcagtgacaacagaaatgacttctggaggctggtggacagcccagacatccagcctgtgggcacctgtgagaaggagggggacctgctgcagccccccctgggctaccagatgaacaccagctcctggcccatgttcctgctgaagaccctgaatggcagcgagatggccagcgccaccctcttcaagaaggagccccccaagccacccctgaacaacttcaaggtgggcatgaagctggaggccatcgacaagaagaacccctacctgatctgcccagccaccatcggagatgtgaagggagatgaggtgcacatcacctttgatggctggagcggggcctttgactactggtgcaagtatgacagccgggacatcttccctgctggctggtgccgcctgactggagatgtgctgcagcccccaggcacctctgtgcccatcgtgaagaacatcgccaagacagagagcagccccagcgaggccagccagcacagcatgcagagcccccagaagaccaccctcatcctgcccacccagcaggtgagaagaagcagccgcatcaagcccccaggccccacagctgtgcccaagaggagcagctctgtgaagaacatcacccccaggaagaagggccccaacagcggcaagaaggagaagcccctgcctgtgatctgcagcaccagcgctgccagcctgaagagcctgacccgggaccggggcatgctgtacaaggatgtggccagcggcccctgcaagatcgtgatgagcacagtgtgtgtgtatgtgaacaagcacggcaactttggcccccacctggaccccaagaggatccagcagctgcctgaccactttggacctggccctgtgaatgtggtgctgcggagaattgtgcaggcctgtgtggactgtgccctggagaccaagacagtgtttggctacctgaagccagacaacagaggaggagaggtgatcacagccagctttgatggagagacccacagcatccagctgccccctgtgaacagcgccagctttgccctgcgcttcctggagaacttctgccacagcctgcagtgtgacaacctgctgagcagccagcccttcagcagcagccggggccacacccacagcagcgctgagcatgacaagaaccagagcgccaaggaggatgtgacagagcggcagagcaccaagaggagcccccagcagacagtgccctacgtggtgcccctgagccccaagctgcccaagaccaaggagtatgccagcgagggggagcccctgtttgctgggggcagcgccatccccaaggaggagaacctgtctgaggacagcaagagcagcagcctgaacagcggcaactacctgaacccagcctgcaggaaccccatgtacatccacacctctgtgtcccaggacttcagccgctctgtgcccggcaccaccagcagccccctggtgggggacatcagccccaagagcagcccccatgaggtgaagttccagatgcagaggaagtctgagggcaactag

SEQ ID NO: 169515 - DNA, 615 bp, Artificial Sequence
  Description of Artificial Sequence: Synthetic coding sequence
atgcagagctatgccagcgccatgctgagcgtcttcaacagtgatgactacagccctgctgtgcaggagaacatcccagccctgcggcgcagcagcagcttcctgtgcacagagagctgcaacagcaagtaccagtgtgagaccggggagaacagcaaaggaaatgtgcaggacagagtgaagaggcccatgaatgccttcatcgtgtggagccgggaccagaggaggaagatggccctggagaaccccaggatgaggaacagcgagatcagcaagcagctgggctaccagtggaagatgctgacagaggccgagaagtggcccttcttccaggaggcccagaagctgcaggccatgcaccgggagaagtaccccaactacaagtaccggcccaggaggaaggccaagatgctgcccaagaactgcagcctgctgcctgctgaccctgcctctgtgctgtgcagcgaggtgcagctggacaacagactctacagagatgactgcaccaaggccacccacagcaggatggagcaccagctgggccacctgccccccatcaatgctgccagcagcccccagcagagggaccgctacagccactggaccaagctgtag

SEQ ID NO: 169516 - DNA, 594 bp, Artificial Sequence
  Description of Artificial Sequence: Synthetic coding sequence
atgcagagctatgccagcgccatgctgagcgtcttcaacagtgatgactacagccctgctgtgcaggagaacatcccagccctgcggcgcagcagcagcttcctgtgcacagagagctgcaacagcaagtaccagtgtgagaccggggagaacagcaaaggaaatgtgcaggacagagtgaagaggcccatgaatgccttcatcgtgtggagccgggaccagaggaggaagatggccctggagaaccccaggatgaggaacagcgagatcagcaagcagctgggctaccagtggaagatgctgacagaggccgagaagtggcccttcttccaggaggcccagaagctgcaggccatgcaccgggagaagtaccccaactacaagtaccggcccaggaggaaggccaagatgctgcccaagaactgcagcctgctgcctgctgaccctgcctctgtgctgtgcagcgaggtgcagctggacaacagactctacagagatgactgcaccaaggccacccacagcaggatggagcaccagctgggccacctgccccccatcaatgctgccagcgctgccaccggccccctgcagtag

SEQ ID NO: 169517 - DNA, 498 bp, Artificial Sequence
  Description of Artificial Sequence: Synthetic coding sequence
atgcagagctatgccagcgccatgctgagcgtcttcaacagtgatgactacagccctgctgtgcaggagaacatcccagccctgcggcgcagcagcagcttcctgtgcacagagagctgcaacagcaagtaccagtgtgagaccggggagaacagcaaaggaaatgtgcaggacagagtgaagaggcccatgaatgccttcatcgtgtggagccgggaccagaggaggaagatggccctggagaaccccaggatgaggaacagcgagatcagcaagcagctgggctaccagtggaagatgctgacagaggccgagaagtggcccttcttccaggaggcccagaagctgcaggccatgcaccgggagaagtaccccaactacaagtaccggcccaggaggaaggccaagatgctgcccaagaactgcagcctgctgcctgctgaccctgcctctgtgctgtgcagcgaggtgcagggccagcaggtggtgcagggctag

SEQ ID NO: 169518 - DNA, 3729 bp, Artificial Sequence
  Description of Artificial Sequence: Synthetic coding sequence
atgaagaacctgctgacagagaagtgcatcagcagccacaacttccaccagaaggtgatcaagcagaggatggagaagaaggtggacagccgctacttcaaggatggagctgtgaagaagccctacagcgccaagaccctgagcaacaagaagagcagcgccagctttggcatcagaagagagctgcccagcaccagccacctggtgcagtaccggggcacccacacctgcacccggcagggccgcctgcgggagctgcgcatccgctgtgtggccaggaagttcctgtacctgtggatccgcatgaccttcggccgggtcttccccagcaaggcccgcttctactatgagcagaggctgctgaggaaggtgtttgaggagtggaaggaggagtggtgggtgttccagcacgagtggaagctgtgtgtgcgggctgactgccactaccgctactacctgtacaacctgatgttccagacctggaagacctacgtgcggcagcagcaggagatgaggaacaagtacatccgggcagaggtgcatgatgccaagcagaagatgaggcaggcctggaagtcctggctgatctacgtggtggtgcggaggaccaagctgcagatgcagaccacagccctggagttccggcagaggatcatcctgcgggtgtggtggagcacctggaggcagaggctgggccaggtgcgggtgtcccgggccctgcacgccagcgccctgaagcaccgggccctgagcctgcaggtgcaggcctggagccagtggagggagcagctgctgtatgtgcagaaggagaagcagaaggtggtgtctgctgtgaagcaccaccagcactggcagaagaggcgcttcctgaaggcctggctggagtacctgcaggtgcggcgggtgaagaggcagcagaatgagatggccgagcgcttccaccacgtgacagtgctgcagatctacttctgtgactggcagcaggcctgggagcggcgggagagcctgtatgcccaccacgcccaggtggagaagctggccaggaagatggccctgcggcgggccttcacccactggaagcactacatgctgctgtgtgccgaggaggccgcccagtttgagatggccgaggagcaccaccgccacagccagctgtacttctgcttccgggccctgaaggacaacgtgacccacgcccacctgcagcagatcagaagaaacctggcccaccagcagcacggcgtgaccctgctgcaccgcttctggaacctgtggaggagccagatcgagcagaagaaggagcgggagctgctgcccctgctgcatgctgcctgggaccactaccgcatcgccctgctgtgcaagtgcatcgagctgtggctgcagtacacccagaagaggcgctacaagcagctgctgcaggcccgggcagatggccacttccagcagagggccctgcctgctgccttccacacctggaaccggctgtggcgctggaggcaccaggagaatgtgctgagcgcccgggccacccgcttccaccgggagaccctggagaagcaggtgttcagcctgtggaggcagaagatgttccagcacagagaaaatcggctggccgagaggatggccatcctgcatgctgagcggcagctgctgtaccgctcctggttcatgtggcaccagcaggccgccgcccggcaccaggagcaggagtggcagacagtggcctgtgcccaccaccgccacggccgcctgaagaaggccttctgcctgtggagggagagcgcccagggcctgaggacagagaggacaggccgggtgcgggctgctgagttccacatggcccagctgctgcgctgggcctggagccagtggagagaatgtctggccctgcggggagctgagcggcagaagctgatgagagctgacctgcaccaccagcacagcgtgctgcaccgggccctgcaggcctgggtgacctaccagggccgggtgcgcagcatcctgcgggaggtggccgcccgggagagccagcacaaccggcagctgctgcggggggccctgcggcgctggaaggagaacaccatggcccgggtggatgaggccaagaagaccttccaggccagcacccactacagaaggaccatctgcagcaaggtgctggtgcagtggagggaggccgtgtctgtgcagatgtactaccggcagcaggaggactgtgccatctgggaggcccagaaggtgctggaccggggctgcctgcggacctggttccagcgctggtgggactgcagccgccgcagcgcccagcagaggctgcagctggagagagctgtgcagcaccaccaccggcagctgctgctggagggcctggcccgctggaagacccaccacctgcagtgtgtgaggaagaggctgctgcaccggcagagcacccagctgctggcccagaggctgagcaggacctgcttccggcagtggaggcagcagctggccgcccggcggcaggagcagagggccaccgtgcgggccctgtggttctgggccttcagcctgcaggccaaggtgtgggccacctggctggcctttgtgctggagaggaggaggaagaaggcccggctgcagtgggccctgcaggcctaccagggccagctgctgcaggagggcgccacccggctgctgcgctttgctgcctccatgaaggccagccggcagcagctgcaggcccagcagcaggtgcaggccgcccacagcctgcacagagctgtgcggcgctgtgccaccctgtggaagcagaaggtgctgggccggggcggcaagccccagcccctggccgccatcgcccccagcaggaaggtgacctttgagggccccctgctgaacagaattgctgctggagctggagatggcaccctggagaccaagaggccccaggccagccggcccctgggcgccctgggccgcctggccgctgaggagccccacgccctggagctgaacacagcccacagcgccaggaagcagccccggcggccccacttcctgctggagcccgcccagagccagaggccccagaagccccaggagcacggcctgggcatggcccagcctgctgcccccagcctgacccggcccttcctggccgaggcccccacagccctggtgccccacagccccctgcccggggccctgagcagcgcccctggccccaagcagcccccaacagccagcacaggccctgagctgctgctgctgcccctgagcagcttcatgccctgtggggccgccgccccagcccgggtgtctgcccagagggccaccccccgggacaagccccctgtgcccagcagcctggcctctgtgcctgacccccacctgctgctgcccggggacttcagcgccaccagggctggccctggcctgagcacagctggcagcctggacctggaggccgagctggaggagatccagcagcagctgctgcactaccagaccaccaagcagaacctgtggagctgccggcggcaggccagcagcctgcggcgctggctggagctgaaccgggaggagcccggccctgaggaccaggaggtggagcagcaggtgcagaaggagctggagcaggtggagatgcagatccagctgctggccgaggagctgcaggcccagaggcagcccatcggggcctgtgtggcccgcatccaggccctgcggcaggccctgtgctag

SEQ ID NO: 169519 - DNA, 3483 bp, Artificial Sequence
  Description of Artificial Sequence: Synthetic coding sequence
atgaagaacctgctgacagagaagtgcatcagcagccacaacttccaccagaaggtgatcaagcagaggatggagaagaaggtggacagccgcttctactatgagcagaggctgctgaggaaggtgtttgaggagtggaaggaggagtggtgggtgttccagcacgagtggaagctgtgtgtgcgggctgactgccactaccgctactacctgtacaacctgatgttccagacctggaagacctacgtgcggcagcagcaggagatgaggaacaagtacatccgggcagaggtgcatgatgccaagcagaagatgaggcaggcctggaagtcctggctgatctacgtggtggtgcggaggaccaagctgcagatgcagaccacagccctggagttccggcagaggatcatcctgcgggtgtggtggagcacctggaggcagaggctgggccaggtgcgggtgtcccgggccctgcacgccagcgccctgaagcaccgggccctgagcctgcaggtgcaggcctggagccagtggagggagcagctgctgtatgtgcagaaggagaagcagaaggtggtgtctgctgtgaagcaccaccagcactggcagaagaggcgcttcctgaaggcctggctggagtacctgcaggtgcggcgggtgaagaggcagcagaatgagatggccgagcgcttccaccacgtgacagtgctgcagatctacttctgtgactggcagcaggcctgggagcggcgggagagcctgtatgcccaccacgcccaggtggagaagctggccaggaagatggccctgcggcgggccttcacccactggaagcactacatgctgctgtgtgccgaggaggccgcccagtttgagatggccgaggagcaccaccgccacagccagctgtacttctgcttccgggccctgaaggacaacgtgacccacgcccacctgcagcagatcagaagaaacctggcccaccagcagcacggcgtgaccctgctgcaccgcttctggaacctgtggaggagccagatcgagcagaagaaggagcgggagctgctgcccctgctgcatgctgcctgggaccactaccgcatcgccctgctgtgcaagtgcatcgagctgtggctgcagtacacccagaagaggcgctacaagcagctgctgcaggcccgggcagatggccacttccagcagagggccctgcctgctgccttccacacctggaaccggctgtggcgctggaggcaccaggagaatgtgctgagcgcccgggccacccgcttccaccgggagaccctggagaagcaggtgttcagcctgtggaggcagaagatgttccagcacagagaaaatcggctggccgagaggatggccatcctgcatgctgagcggcagctgctgtaccgctcctggttcatgtggcaccagcaggccgccgcccggcaccaggagcaggagtggcagacagtggcctgtgcccaccaccgccacggccgcctgaagaaggccttctgcctgtggagggagagcgcccagggcctgaggacagagaggacaggccgggtgcgggctgctgagttccacatggcccagctgctgcgctgggcctggagccagtggagagaatgtctggccctgcggggagctgagcggcagaagctgatgagagctgacctgcaccaccagcacagcgtgctgcaccgggccctgcaggcctgggtgacctaccagggccgggtgcgcagcatcctgcgggaggtggccgcccgggagagccagcacaaccggcagctgctgcggggggccctgcggcgctggaaggagaacaccatggcccgggtggatgaggccaagaagaccttccaggccagcacccactacagaaggaccatctgcagcaaggtgctggtgcagtggagggaggccgtgtctgtgcagatgtactaccggcagcaggaggactgtgccatctgggaggcccagaaggtgctggaccggggctgcctgcggacctggttccagcgctggtgggactgcagccgccgcagcgcccagcagaggctgcagctggagagagctgtgcagcaccaccaccggcagctgctgctggagggcctggcccgctggaagacccaccacctgcagtgtgtgaggaagaggctgctgcaccggcagagcacccagctgctggcccagaggctgagcaggacctgcttccggcagtggaggcagcagctggccgcccggcggcaggagcagagggccaccgtgcgggccctgtggttctgggccttcagcctgcaggccaaggtgtgggccacctggctggcctttgtgctggagaggaggaggaagaaggcccggctgcagtgggccctgcaggcctaccagggccagctgctgcaggagggcgccacccggctgctgcgctttgctgcctccatgaaggccagccggcagcagctgcaggcccagcagcaggtgcaggccgcccacagcctgcacagagctgtgcggcgctgtgccaccctgtggaagcagaaggtgctgggccggggcggcaagccccagcccctggccgccatcgcccccagcaggaaggtgacctttgagggccccctgctgaacagaattgctgctggagctggagatggcaccctggagaccaagaggccccaggccagccggcccctgggcgccctgggccgcctggccgctgaggagccccacgccctggagctgaacacagcccacagcgccaggaagcagccccggcggccccacttcctgctggagcccgcccagagccagaggccccagaagccccaggagcacggcctgggcatggcccagcctgctgcccccagcctgacccggcccttcctggccgaggcccccacagccctggtgccccacagccccctgcccggggccctgagcagcgcccctggccccaagcagcccccaacagccagcacaggccctgagctgctgctgctgcccctgagcagcttcatgccctgtggggccgccgccccagcccgggtgtctgcccagagggccaccccccgggacaagccccctgtgcccagcagcctggcctctgtgcctgacccccacctgctgctgcccggggacttcagcgccaccagggctggccctggcctgagcacagctggcagcctggacctggaggccgagctggaggagatccagcagcagctgctgcactaccagaccaccaagcagaacctgtggagctgccggcggcaggccagcagcctgcggcgctggctggagctgaaccgggaggagcccggccctgaggaccaggaggtggagcagcaggtgcagaaggagctggagcaggtggagatgcagatccagctgctggccgaggagctgcaggcccagaggcagcccatcggggcctgtgtggcccgcatccaggccctgcggcaggccctgtgctag

SEQ ID NO: 169520 - DNA, 3096 bp, Artificial Sequence
  Description of Artificial Sequence: Synthetic coding sequence
atgaagaacctgctgacagagaagtgcatcagcagccacaacttccaccagaaggtgatcaagcagaggatggagaagaaggtggacagccgcttctactatgagcagaggctgctgaggaaggtgtttgaggagtggaaggaggagtggtgggtgttccagcacgagtggaagctgtgtgtgcgggctgactgccactacagagtgtggtggagcacctggaggcagaggctgggccaggtgcgggtgtcccgggccctgcacgccagcgccctgaagcaccgggccctgagcctgcaggtgcaggcctggagccagtggagggagcagctgctgtatgtgcagaaggagaagcagaaggtggtgtctgctgtgaagcaccaccagcactggcagaagaggcgcttcctgaaggcctggctggagtacctgcaggtgagaagagtgaagaggcagcagaatgagatggccgagcgcttccaccacgtgacagtgctgcagatctacttctgtgactggcagcaggcctgggagcggcgggagagcctgtatgcccaccacgcccaggtggagaagctggccaggaagatggccctgcggcgggccttcacccactggaagcactacatgctgctgtgtgccgaggaggccgcccagtttgagatggccgaggagcaccaccgccacagccagctgtacttctgcttccgggccctgaaggacaacgtgacccacgcccacctgcagcagatcagaagaaacctggcccaccagcagcacggcgtgaccctgctgcaccgcttctggaacctgtggaggagccagatcgagcagaagaaggagcgggagctgctgcccctgctgcacgccgcctgggaccactacagaattgccctgctgtgcaagtgcatcgagctgtggctgcagtacacccagaagaggcgctacaagcagctgctgcaggcccgggcagatggccacttccagcagagggccctgcctgctgccttccacacctggaaccggctgtggcgctggaggcaccaggagaatgtgctgagcgcccgggccacccgcttccaccgggagaccctggagaagcaggtgttcagcctgtggaggcagaagatgttccagcaccgggagaaccggctggccgagaggatggccatcctgcacgccgagcggcagctgctgtaccgctcctggttcatgtggcaccagcaggccgccgcccggcaccaggagcaggagtggcagacagtggcctgtgcccaccacagacatggccgcctgaagaaggccttctgcctgtggagggagagcgcccagggcctgaggacagagaggacaggccgggtgcgggctgctgagttccacatggcccagctgctgcgctgggcctggagccagtggagggagtgcctggccctgcggggagctgagcggcagaagctgatgagagctgacctgcaccaccagcacagcgtgctgcaccgggccctgcaggcctgggtgacctaccagggccgggtgcgcagcatcctgcgggaggtggccgcccgggagagccagcacaaccggcagctgctgcggggggccctgcggcgctggaaggagaacaccatggcccgggtggatgaggccaagaagaccttccaggccagcacccactacagaaggaccatctgcagcaaggtgctggtgcagtggagggaggccgtgtctgtgcagatgtactaccggcagcaggaggactgtgccatctgggaggcccagaaggtgctggaccggggctgcctgcggacctggttccagcgctggtgggactgcagcagaagaagtgcccagcagaggctgcagctggagagagctgtgcagcaccaccaccggcagctgctgctggagggcctggcccgctggaagacccaccacctgcagtgtgtgaggaagaggctgctgcaccggcagagcacccagctgctggcccagaggctgagcaggacctgcttccggcagtggaggcagcagctggccgcccggcggcaggagcagagggccaccgtgcgggccctgtggttctgggccttcagcctgcaggccaaggtgtgggccacctggctggcctttgtgctggagaggaggaggaagaaggcccggctgcagtgggccctgcaggcctaccagggccagctgctgcaggagggcgccacccggctgctgcgctttgctgcctccatgaaggccagccggcagcagctgcaggcccagcagcaggtgcaggccgcccacagcctgcacagagctgtgagaagatgtgccaccctgtggaagcagaaggtgctgggccggggcggcaagccccagcccctggccgccatcgcccccagcaggaaggtgacctttgagggccccctgctgaacagaattgctgctggagctggagatggcaccctggagaccaagaggccccaggccagccggcccctgggcgccctgggccgcctggccgctgaggagccccacgccctggagctgaacacagcccacagcgccaggaagcagccccggcggccccacttcctgctggagcccgcccagagccagaggccccagaagccccaggagcacggcctgggcatggcccagcctgctgcccccagcctgacccggcccttcctggccgaggcccccacagccctggtgccccacagccccctgcccggggccctgagcagcgcccctggccccaagcagcccccaacagccagcactggacctgagctgctgctgctgcccctgagcagcttcatgccctgtggggctgctgccccagcccgggtgtctgcccagagggccaccccccgggacaagccccctgtgcccagcagcctggcctctgtgcctgacccccacctgctgctgcccggggacttcagcgccacccgggccggccctggcctgagcacagctgcctggaccctgcggctgaacctgcggcgcagcagcagcaactactgcaccaccaggcctcccagcaggaccagcggccctgtgggcggcaagagagctgcctgtgccggcggctggagctag

SEQ ID NO: 169521 - DNA, 2976 bp, Artificial Sequence
  Description of Artificial Sequence: Synthetic coding sequence
atgaagaacctgctgacagagaagtgcatcagcagccacaacttccaccagaaggtgatcaagcagaggatggagaagaaggtggacagccgctacttcaaggatggagctgtgaagaagccctacagcgccaagaccctgagcaacaagaagagcagcgccagctttggcatcagaagagagctgcccagcaccagccacctggtgcagtaccggggcacccacacctgcacccggcagggccgcctgcgggagctgcgcatccgcttctactatgagcagaggctgctgaggaaggtgtttgaggagtggaaggaggagtggtgggtgttccagcacgagtggaagctgtgtgtgcgggctgactgccactaccgctactacctgtacaacctgatgttccagacctggaagacctacgtgcggcagcagcaggagatgaggaacaagtacatccgggcagaggtgcatgatgccaagcagaagatgaggcaggcctggaagtcctggctgatctacgtggtggtgcggaggaccaagctgcagatgcagaccacagccctggagttccggcagaggatcatcctgcgggtgtggtggagcacctggaggcagaggctgggccaggtgcgggtgtcccgggccctgcacgccagcgccctgaagcaccgggccctgagcctgcaggtgcaggcctggagccagtggagggagcagctgctgtatgtgcagaaggagaagcagaaggtggtgtctgctgtgaagcaccaccagcactggcagaagaggcgcttcctgaaggcctggctggagtacctgcaggtgcggcgggtgaagaggcagcagaatgagatggccgagcgcttccaccacgtgacagtgctgcagatctacttctgtgactggcagcaggcctgggagcggcgggagagcctgtatgcccaccacgcccaggtggagaagctggccaggaagatggccctgcggcgggccttcacccactggaagcactacatgctgctgtgtgccgaggaggccgcccagtttgagatggccgaggagcaccaccgccacagccagctgtacttctgcttccgggccctgaaggacaacgtgacccacgcccacctgcagcagatcagaagaaacctggcccaccagcagcacggcgtgaccctgctgcaccgcttctggaacctgtggaggagccagatcgagcagaagaaggagcgggagctgctgcccctgctgcatgctgcctgggaccactaccgcatcgccctgctgtgcaagtgcatcgagctgtggctgcagtacacccagaagaggcgctacaagcagctgctgcaggcccgggcagatggccacttccagcagagggccctgcctgctgccttccacacctggaaccggctgtggcgctggaggcaccaggagaatgtgctgagcgcccgggccacccgcttccaccgggagaccctggagaagcaggtgttcagcctgtggaggcagaagatgttccagcacagagaaaatcggctggccgagaggatggccatcctgcatgctgagcggcagctgctgtaccgctcctggttcatgtggcaccagcaggccgccgcccggcaccaggagcaggagtggcagacagtggcctgtgcccaccaccgccacggccgcctgaagaaggccttctgcctgtggagggagagcgcccagggcctgaggacagagaggacaggccgggtgcgggctgctgagttccacatggcccagctgctgcgctgggcctggagccagtggagagaatgtctggccctgcggggagctgagcggcagaagctgatgagagctgacctgcaccaccagcacagcgtgctgcaccgggccctgcaggcctgggtgacctaccagggccgggtgcgcagcatcctgcgggaggtggccgcccgggagagccagcagctgcaggcccagcagcaggtgcaggccgcccacagcctgcacagagctgtgagaagatgtgccaccctgtggaagcagaaggtgctgggccggggcggcaagccccagcccctggccgccatcgcccccagcaggaaggtgacctttgagggccccctgctgaacagaattgctgctggagctggagatggcaccctggagaccaagaggccccaggccagccggcccctgggcgccctgggccgcctggccgctgaggagccccacgccctggagctgaacacagcccacagcgccaggaagcagccccggcggccccacttcctgctggagcccgcccagagccagaggccccagaagccccaggagcacggcctgggcatggcccagcctgctgcccccagcctgacccggcccttcctggccgaggcccccacagccctggtgccccacagccccctgcccggggccctgagcagcgcccctggccccaagcagcccccaacagccagcactggacctgagctgctgctgctgcccctgagcagcttcatgccctgtggggctgctgccccagcccgggtgtctgcccagagggccaccccccgggacaagccccctgtgcccagcagcctggcctctgtgcctgacccccacctgctgctgcccggggacttcagcgccacccgggccggccctggcctgagcacagctggcagcctggacctggaggccgagctggaggagatccagcagcagctgctgcactaccagaccaccaagcagaacctgtggagctgccggcggcaggccagcagcctgcggcgctggctggagctgaaccgggaggagcccggccctgaggaccaggaggtggagcagcaggtgcagaaggagctggagcaggtggagatgcagatccagctgctggccgaggagctgcaggcccagaggcagcccatcggggcctgtgtggcccgcatccaggccctgcggcaggccctgtgctag

SEQ ID NO: 169522 - DNA, 3636 bp, Artificial Sequence
  Description of Artificial Sequence: Synthetic coding sequence
atgaagaacctgctgacagagaagtgcatcagcagccacaacttccaccagaaggtgatcaagcagaggatggagaagaaggtggacagccgctacttcaaggatggagctgtgaagaagccctacagcgccaagaccctgagcaacaagaagagcagcgccagctttggcatcagaagagagctgcccagcaccagccacctggtgcagtaccggggcacccacacctgcacccggcagggccgcctgcgggagctgcgcatccgctgtgtggccaggaagttcctgtacctgtggatccgcatgaccttcggccgggtcttccccagcaaggcccgcttctactatgagcagaggctgctgaggaaggtgtttgaggagtggaaggaggagtggtgggtgttccagcacgagtggaagctgtgtgtgcgggctgactgccactaccgctactacctgtacaacctgatgttccagacctggaagacctacgtgcggcagcagcaggagatgaggaacaagtacatccgggcagaggtgcatgatgccaagcagaagatgaggcaggcctggaagtcctggctgatctacgtggtggtgcggaggaccaagctgcagatgcagaccacagccctggagttccggcagaggatcatcctgcgggtgtggtggagcacctggaggcagaggctgggccaggtgcgggtgtcccgggccctgcacgccagcgccctgaagcaccgggccctgagcctgcaggtgcaggcctggagccagtggagggagcagctgctgtatgtgcagaaggagaagcagaaggtggtgtctgctgtgaagcaccaccagcactggcagaagaggcgcttcctgaaggcctggctggagtacctgcaggtgcggcgggtgaagaggcagcagaatgagatggccgagcgcttccaccacgtgacagtgctgcagatctacttctgtgactggcagcaggcctgggagcggcgggagagcctgtatgcccaccacgcccaggtggagaagctggccaggaagatggccctgcggcgggccttcacccactggaagcactacatgctgctgtgtgccgaggaggccgcccagtttgagatggccgaggagcaccaccgccacagccagctgctgctgcaccgcttctggaacctgtggaggagccagatcgagcagaagaaggagcgggagctgctgcccctgctgcacgccgcctgggaccactacagaattgccctgctgtgcaagtgcatcgagctgtggctgcagtacacccagaagaggcgctacaagcagctgctgcaggcccgggcagatggccacttccagcagagggccctgcctgctgccttccacacctggaaccggctgtggcgctggaggcaccaggagaatgtgctgagcgcccgggccacccgcttccaccgggagaccctggagaagcaggtgttcagcctgtggaggcagaagatgttccagcaccgggagaaccggctggccgagaggatggccatcctgcacgccgagcggcagctgctgtaccgctcctggttcatgtggcaccagcaggccgccgcccggcaccaggagcaggagtggcagacagtggcctgtgcccaccacagacatggccgcctgaagaaggccttctgcctgtggagggagagcgcccagggcctgaggacagagaggacaggccgggtgcgggctgctgagttccacatggcccagctgctgcgctgggcctggagccagtggagggagtgcctggccctgcggggagctgagcggcagaagctgatgagagctgacctgcaccaccagcacagcgtgctgcaccgggccctgcaggcctgggtgacctaccagggccgggtgcgcagcatcctgcgggaggtggccgcccgggagagccagcacaaccggcagctgctgcggggggccctgcggcgctggaaggagaacaccatggcccgggtggatgaggccaagaagaccttccaggccagcacccactacagaaggaccatctgcagcaaggtgctggtgcagtggagggaggccgtgtctgtgcagatgtactaccggcagcaggaggactgtgccatctgggaggcccagaaggtgctggaccggggctgcctgcggacctggttccagcgctggtgggactgcagcagaagaagtgcccagcagaggctgcagctggagagagctgtgcagcaccaccaccggcagctgctgctggagggcctggcccgctggaagacccaccacctgcagtgtgtgaggaagaggctgctgcaccggcagagcacccagctgctggcccagaggctgagcaggacctgcttccggcagtggaggcagcagctggccgcccggcggcaggagcagagggccaccgtgcgggccctgtggttctgggccttcagcctgcaggccaaggtgtgggccacctggctggcctttgtgctggagaggaggaggaagaaggcccggctgcagtgggccctgcaggcctaccagggccagctgctgcaggagggcgccacccggctgctgcgctttgctgcctccatgaaggccagccggcagcagctgcaggcccagcagcaggtgcaggccgcccacagcctgcacagagctgtgagaagatgtgccaccctgtggaagcagaaggtgctgggccggggcggcaagccccagcccctggccgccatcgcccccagcaggaaggtgacctttgagggccccctgctgaacagaattgctgctggagctggagatggcaccctggagaccaagaggccccaggccagccggcccctgggcgccctgggccgcctggccgctgaggagccccacgccctggagctgaacacagcccacagcgccaggaagcagccccggcggccccacttcctgctggagcccgcccagagccagaggccccagaagccccaggagcacggcctgggcatggcccagcctgctgcccccagcctgacccggcccttcctggccgaggcccccacagccctggtgccccacagccccctgcccggggccctgagcagcgcccctggccccaagcagcccccaacagccagcactggacctgagctgctgctgctgcccctgagcagcttcatgccctgtggggctgctgccccagcccgggtgtctgcccagagggccaccccccgggacaagccccctgtgcccagcagcctggcctctgtgcctgacccccacctgctgctgcccggggacttcagcgccacccgggccggccctggcctgagcacagctggcagcctggacctggaggccgagctggaggagatccagcagcagctgctgcactaccagaccaccaagcagaacctgtggagctgccggcggcaggccagcagcctgcggcgctggctggagctgaaccgggaggagcccggccctgaggaccaggaggtggagcagcaggtgcagaaggagctggagcaggtggagatgcagatccagctgctggccgaggagctgcaggcccagaggcagcccatcggggcctgtgtggcccgcatccaggccctgcggcaggccctgtgctag

SEQ ID NO: 169523 - DNA, 3483 bp, Artificial Sequence; identical to SEQ ID NO: 169519
  Description of Artificial Sequence: Synthetic coding sequence

SEQ ID NO: 169524 - DNA, 240 bp, Artificial Sequence
  Description of Artificial Sequence: Synthetic coding sequence
atgaagaacctgctgacagagaagtgcatcagcagccacaacttccaccagaaggtgatcaagcagaggatggagaagaaggtggacagccgctacttcaaggatggagctgtgaagaagccctacagcgccaagaccctgagcaacaagaagagcagcgccagctttggcatcagaagagagctgcccagcaccagccacctggtgcagtaccggggcacccacacctgcaccaggtag

SEQ ID NO: 169525 - DNA, 3564 bp, Artificial Sequence
  Description of Artificial Sequence: Synthetic coding sequence
atgaagaacctgctgacagagaagtgcatcagcagccacaacttccaccagaaggtgatcaagcagaggatggagaagaaggtggacagccgctacttcaaggatggagctgtgaagaagccctacagcgccaagaccctgagcaacaagaagagcagcgccagctttggcatcagaagagagctgcccagcaccagccacctggtgcagtaccggggcacccacacctgcacccggcagggccgcctgcgggagctgcgcatccgcttctactatgagcagaggctgctgaggaaggtgtttgaggagtggaaggaggagtggtgggtgttccagcacgagtggaagctgtgtgtgcgggctgactgccactaccgctactacctgtacaacctgatgttccagacctggaagacctacgtgcggcagcagcaggagatgaggaacaagtacatccgggcagaggtgcatgatgccaagcagaagatgaggcaggcctggaagtcctggctgatctacgtggtggtgcggaggaccaagctgcagatgcagaccacagccctggagttccggcagaggatcatcctgcgggtgtggtggagcacctggaggcagaggctgggccaggtgcgggtgtcccgggccctgcacgccagcgccctgaagcaccgggccctgagcctgcaggtgcaggcctggagccagtggagggagcagctgctgtatgtgcagaaggagaagcagaaggtggtgtctgctgtgaagcaccaccagcactggcagaagaggcgcttcctgaaggcctggctggagtacctgcaggtgcggcgggtgaagaggcagcagaatgagatggccgagcgcttccaccacgtgacagtgctgcagatctacttctgtgactggcagcaggcctgggagcggcgggagagcctgtatgcccaccacgcccaggtggagaagctggccaggaagatggccctgcggcgggccttcacccactggaagcactacatgctgctgtgtgccgaggaggccgcccagtttgagatggccgaggagcaccaccgccacagccagctgctgctgcaccgcttctggaacctgtggaggagccagatcgagcagaagaaggagcgggagctgctgcccctgctgcacgccgcctgggaccactacagaattgccctgctgtgcaagtgcatcgagctgtggctgcagtacacccagaagaggcgctacaagcagctgctgcaggcccgggcagatggccacttccagcagagggccctgcctgctgccttccacacctggaaccggctgtggcgctggaggcaccaggagaatgtgctgagcgcccgggccacccgcttccaccgggagaccctggagaagcaggtgttcagcctgtggaggcagaagatgttccagcaccgggagaaccggctggccgagaggatggccatcctgcacgccgagcggcagctgctgtaccgctcctggttcatgtggcaccagcaggccgccgcccggcaccaggagcaggagtggcagacagtggcctgtgcccaccacagacatggccgcctgaagaaggccttctgcctgtggagggagagcgcccagggcctgaggacagagaggacaggccgggtgcgggctgctgagttccacatggcccagctgctgcgctgggcctggagccagtggagggagtgcctggccctgcggggagctgagcggcagaagctgatgagagctgacctgcaccaccagcacagcgtgctgcaccgggccctgcaggcctgggtgacctaccagggccgggtgcgcagcatcctgcgggaggtggccgcccgggagagccagcacaaccggcagctgctgcggggggccctgcggcgctggaaggagaacaccatggcccgggtggatgaggccaagaagaccttccaggccagcacccactacagaaggaccatctgcagcaaggtgctggtgcagtggagggaggccgtgtctgtgcagatgtactaccggcagcaggaggactgtgccatctgggaggcccagaaggtgctggaccggggctgcctgcggacctggttccagcgctggtgggactgcagcagaagaagtgcccagcagaggctgcagctggagagagctgtgcagcaccaccaccggcagctgctgctggagggcctggcccgctggaagacccaccacctgcagtgtgtgaggaagaggctgctgcaccggcagagcacccagctgctggcccagaggctgagcaggacctgcttccggcagtggaggcagcagctggccgcccggcggcaggagcagagggccaccgtgcgggccctgtggttctgggccttcagcctgcaggccaaggtgtgggccacctggctggcctttgtgctggagaggaggaggaagaaggcccggctgcagtgggccctgcaggcctaccagggccagctgctgcaggagggcgccacccggctgctgcgctttgctgcctccatgaaggccagccggcagcagctgcaggcccagcagcaggtgcaggccgcccacagcctgcacagagctgtgagaagatgtgccaccctgtggaagcagaaggtgctgggccggggcggcaagccccagcccctggccgccatcgcccccagcaggaaggtgacctttgagggccccctgctgaacagaattgctgctggagctggagatggcaccctggagaccaagaggccccaggccagccggcccctgggcgccctgggccgcctggccgctgaggagccccacgccctggagctgaacacagcccacagcgccaggaagcagccccggcggccccacttcctgctggagcccgcccagagccagaggccccagaagccccaggagcacggcctgggcatggcccagcctgctgcccccagcctgacccggcccttcctggccgaggcccccacagccctggtgccccacagccccctgcccggggccctgagcagcgcccctggccccaagcagcccccaacagccagcactggacctgagctgctgctgctgcccctgagcagcttcatgccctgtggggctgctgccccagcccgggtgtctgcccagagggccaccccccgggacaagccccctgtgcccagcagcctggcctctgtgcctgacccccacctgctgctgcccggggacttcagcgccacccgggccggccctggcctgagcacagctggcagcctggacctggaggccgagctggaggagatccagcagcagctgctgcactaccagaccaccaagcagaacctgtggagctgccggcggcaggccagcagcctgcggcgctggctggagctgaaccgggaggagcccggccctgaggaccaggaggtggagcagcaggtgcagaaggagctggagcaggtggagatgcagatccagctgctggccgaggagctgcaggcccagaggcagcccatcggggcctgtgtggcccgcatccaggccctgcggcaggccctgtgctag

SEQ ID NO: 169526 - DNA, 378 bp, Artificial Sequence
  Description of Artificial Sequence: Synthetic coding sequence
atggatgctgtggccgtgtaccacggcaagatcagccgggagactggagagaagctgctgctggccaccggcctggatggcagctacctgctgcgggacagcgagagcgtgcctggggtgtactgcctgtgtgtgctgtaccacggctacatctacacctacagagtgtcccagacagaaacaggctcctggagcgctgagacagcccctggggtgcacaagcgctacttcaggaagatcaagaacctgatcagcgccttccagaagccagaccagggcatcgtcatccccctgcagtaccctgtggagaagaagagcagcgcccggagcacccagggcatccgggaggaccctgatgtgtgcctgaaggccccctag

SEQ ID NO: 169527 - DNA, 387 bp, Artificial Sequence
  Description of Artificial Sequence: Synthetic coding sequence
atggatgctgtggccgtgtaccacggcaagatcagccgggagactggagagaagctgctgctggccaccggcctggatggcagctacctgctgcgggacagcgagagcgtgcctggggtgtactgcctgtgtgtgctgtaccacggctacatctacacctacagagtgtcccagacagaaacaggctcctggagcgctgagacagcccctggggtgcacaagcgctacttcaggaagatcaagaacctgatcagcgccttccagaagccagaccagggcatcgtcatccccctgcagtaccctgtggagaagaagagcagcgcccggagcacccagggcaccaccggcatcagagaagatcctgatgtgtgcctgaaggccccctag

SEQ ID NO: 169528 - DNA, 177 bp, Artificial Sequence
  Description of Artificial Sequence: Synthetic coding sequence
atggatgctgtggccgtgtaccacggcaagatcagccgggagactggagagaagctgctgctggccaccggcctggatggcagctacctgctgcgggacagcgagagcgtgcctggggtgtactgcctgtgtgtgctgcaccactggggctacatcaagttcatcaacaagctgtag

SEQ ID NO: 169529 - DNA, 234 bp, Artificial Sequence
  Description of Artificial Sequence: Synthetic coding sequence
atggacctgccctactaccacggccgcctgaccaagcaggactgtgagaccctgctgctgaaggagggcgtggatggcaacttcctgctgcgggacagcgagagcatccctggggtgctgtgcctgtgtgtgtccttcaagaacatcgtgtacacctaccgcatcttccgggagaagcacggctactaccgcatccagaacagcaacagcgactatgtggatgtgctgccctag

SEQ ID NO: 169530 - DNA, 399 bp, Artificial Sequence
  Description of Artificial Sequence: Synthetic coding sequence
atggacctgccctactaccacggccgcctgaccaagcaggactgtgagaccctgctgctgaaggagggcgtggatggcaacttcctgctgcgggacagcgagagcatccctggggtgctgtgcctgtgtgtgtccttcaagaacatcgtgtacacctaccgcatcttccgggagaagcacggctactaccgcatccagacagctgagggcagccccaagcaggtgttccccagcctgaaggagctgatcagcaagtttgagaagcccaaccagggcatggtggtgcacctgctgaagcccatcaagaggaccagccccagcctgcgctggaggggcctgaagctggagctggagacctttgtgaacagcaacagcgactatgtggatgtgctgccctag

SEQ ID NO: 169531 - DNA, 2271 bp, Artificial Sequence
  Description of Artificial Sequence: Synthetic coding sequence
atgaatggagcccccagcccagaagatggagccagccccagcagcccccccctgcccccacctcctcctccttcctggagggagttctgtgagagccacgcccgggctgctgccctggactttgcccggcgcttccggctgtacctggccagccacccccagtatgccggccctggagctgaggccgccttcagccgccgctttgctgagctgttcctgcagcactttgaggccgaggtggcccgggccagcggcagcctgagcccccccatcctggcccccctgagccctggagctgagatcagcccccatgacctgagcctggagagctgccgggtgggcggccccctggccgtgctgggccccagccgcagcagcgaggacctggccggccccctgcccagctctgtgagcagcagcagcaccaccagcagcaagcccaagctgaagaagcgcttcagcctgcggtctgtgggccgctctgtgcggggctctgtgcggggcatcctgcagtggaggggcaccgtggacccccccagcagcgctggccccctggagaccagcagcggcccccctgtgctgggcggcaacagcaacagcaacagcagtggaggagctggcaccgtgggccggggcctggtgtctgatggcaccagccctggagagcgctggacccacagatttgagcggctgcggctgagccggggcggcggggccctgaaggatggagctggcatggtgcagcgggaggagctgctgtccttcatgggcgctgaggaggccgccccagaccctgctggggtgggccggggcggcggcgtggccggccccccatctgggggcggcggccagccccagtggcagaagtgccgcctgctgctgcggtctgagggggagggcggcggcggcagccggctggagttctttgtgccccccaaggccagccggccccggctgagcatcccctgcagcagcatcacagatgtgaggaccaccacagccctggagatgccagaccgggagaacacctttgtggtgaaggtggagggccccagcgagtacatcatggagaccgtggatgcccagcacgtgaaggcctgggtgtctgacatccaggagtgcctgagccctggcccctgcccagccaccagcccccggcccatgaccctgcccctggcccctggcaccagcttcctgacccgggagaacacagacagcctggagctgagctgcctgaaccacagcgagagcctgcccagccaggacctgctgctgggccccagcgagagcaatgaccggctgagccagggcgcctatggaggcctgagtgaccggcccagcgccagcatcagccccagcagcgccagcattgctgccagccactttgacagcatggagctgctgcccccagagctgcccccacgcatccccatcgaggagggcccccccaccggcaccgtgcaccccctgagcgccccctacccacccctggacaccccagagacagccaccggcagcttcctgttccagggcgagcctgagggcggggagggggaccagcccctgagcggctacccctggttccacggcatgctgagccggctgaaggccgcccagctggtgctgactggaggcaccggcagccatggagtcttcctggtgcggcagagcgagacccggcggggggagtatgtgctgaccttcaacttccagggcaaggccaagcacctgcggctgagcctgaatgaggagggccagtgccgggtgcagcacctgtggttccagagcatctttgacatgctggagcacttccgggtgcaccccatccccctggagagcggcggcagcagtgatgtggtgctggtgtcctatgtgcccagcagccagaggcagcaggagcccaccaccagccatgaccccccccagcccccagagccccccagctggacagaccccccccagcctggagctgaggaggccagccgggcccctgaggtggccgctgctgctgctgctgctgccaaggagcggcaggagaaggagaaggccggcggcggcggcgtgcctgaggagctggtgcctgtggtggagctggtgcctgtggtggagctggaggaggccatcgcccctggcagcgaggcccagggcgccggcagcggaggagatgctggggtgccccccatggtgcagctgcagcagagccccctgggcggagatggagaggagggcggccacccccgggccatcaacaaccagtacagctttgtgtag

SEQ ID NO: 169532 - DNA, 2016 bp, Artificial Sequence
  Description of Artificial Sequence: Synthetic coding sequence
atgaatggagcccccagcccagaagatggagccagccccagcagcccccccctgcccccacctcctcctccttcctggagggagttctgtgagagccacgcccgggctgctgccctggactttgcccggcgcttccggctgtacctggccagccacccccagtatgccggccctggagctgaggccgccttcagccgccgctttgctgagctgttcctgcagcactttgaggccgaggtggcccgggccagcggcagcctgagcccccccatcctggcccccctgagccctggagctgagatcagcccccatgacctgagcctggagagctgccgggtgggcggccccctggccgtgctgggccccagccgcagcagcgaggacctggccggccccctgcccagctctgtgagcagcagcagcaccaccagcagcaagcccaagctgaagaagcgcttcagcctgcggtctgtgggccgctctgtgcggggctctgtgcggggcatcctgcagtggaggggcaccgtggacccccccagcagcgctggccccctggagaccagcagcggcccccctgtgctgggcggcaacagcaacagcaacagcagtggaggagctggcaccgtgggccggggcctggtgtctgatggcaccagccctggagagcgctggacccacagatttgagcggctgcggctgagccggggcggcggggccctgaaggatggagctggcatggtgcagcgggaggagctgctgtccttcatgggcgctgaggaggccgccccagaccctgctggggtgggccggggcggcggcgtggccggccccccatctgggggcggcggccagccccagtggcagaagtgccgcctgctgctgcggtctgagggggagggcggcggcggcagccggctggagttctttgtgccccccaaggccagccggccccggctgagcatcccctgcagcagcatcacagatgtgaggaccaccacagccctggagatgccagaccgggagaacacctttgtggtgaaggtggagggccccagcgagtacatcatggagaccgtggatgcccagcacgtgaaggcctgggtgtctgacatccaggagtgcctgagccctggcccctgcccagccaccagcccccggcccatgaccctgcccctggcccctggcaccagcttcctgacccgggagaacacagacagcctggagctgagctgcctgaaccacagcgagagcctgcccagccaggacctgctgctgggccccagcgagagcaatgaccggctgagccagggcgcctatggaggcctgagtgaccggcccagcgccagcatcagccccagcagcgccagcattgctgccagccactttgacagcatggagctgctgcccccagagctgcccccacgcatccccatcgaggagggcccccccaccggcaccgtgcaccccctgagcgccccctacccacccctggacaccccagagacagccaccggcagcttcctgttccagggcgagcctgagggcggggagggggaccagcccctgagcggctacccctggttccacggcatgctgagccggctgaaggccgcccagctggtgctgactggaggcaccggcagccatggagtcttcctggtgcggcagagcgagacccggcggggggagtatgtgctgaccttcaacttccagggcaaggccaagcacctgcggctgagcctgaatgaggagggccagtgccgggtgcagcacctgtggttccagagcatctttgacatgctggagcacttccgggtgcaccccatccccctggagagcggcggcagcagtgatgtggtgctggtgtcctatgtgcccagcagccagaggcagcagggccgggagcaggccggcagccatgctggggtgtgtgaaggagatggctgccacccagatgccagctgcaccctgatgccctttggagccagtgactgtgtgacagaccacctgccctag

SEQ ID NO: 169533 - DNA, 2052 bp, Artificial Sequence
  Description of Artificial Sequence: Synthetic coding sequence
atgaatggagcccccagcccagaagatggagccagccccagcagcccccccctgcccccacctcctcctccttcctggagggagttctgtgagagccacgcccgggctgctgccctggactttgcccggcgcttccggctgtacctggccagccacccccagtatgccggccctggagctgaggccgccttcagccgccgctttgctgagctgttcctgcagcactttgaggccgaggtggcccgggccagcggcagcctgagcccccccatcctggcccccctgagccctggagctgagatcagcccccatgacctgagcctggagagctgccgggtgggcggccccctggccgtgctgggccccagccgcagcagcgaggacctggccggccccctgcccagctctgtgagcagcagcagcaccaccagcagcaagcccaagctgaagaagcgcttcagcctgcggtctgtgggccgctctgtgcggggctctgtgcggggcatcctgcagtggaggggcaccgtggacccccccagcagcgctggccccctggagaccagcagcggcccccctgtgctgggcggcaacagcaacagcaacagcagtggaggagctggcaccgtgggccggggcctggtgtctgatggcaccagccctggagagcgctggacccacagatttgagcggctgcggctgagccggggcggcggggccctgaaggatggagctggcatggtgcagcgggaggagctgctgtccttcatgggcgctgaggaggccgccccagaccctgctggggtgggccggggcggcggcgtggccggccccccatctgggggcggcggccagccccagtggcagaagtgccgcctgctgctgcggtctgagggggagggcggcggcggcagccggctggagttctttgtgccccccaaggccagccggccccggctgagcatcccctgcagcagcatcacagatgtgaggaccaccacagccctggagatgccagaccgggagaacacctttgtggtgaaggtggagggccccagcgagtacatcatggagaccgtggatgcccagcacgtgaaggcctgggtgtctgacatccaggagtgcctgagccctggcccctgcccagccaccagcccccggcccatgaccctgcccctggcccctggcaccagcttcctgacccgggagaacacagacagcctggagctgagctgcctgaaccacagcgagagcctgcccagccaggacctgctgctgggccccagcgagagcaatgaccggctgagccagggcgcctatggaggcctgagtgaccggcccagcgccagcatcagccccagcagcgccagcattgctgccagccactttgacagcatggagctgctgcccccagagctgcccccacgcatccccatcgaggagggcccccccaccggcaccgtgcaccccctgagcgccccctacccacccctggacaccccagagacagccaccggcagcttcctgttccagggcgagcctgagggcggggagggggaccagcccctgagcggctacccctggttccacggcatgctgagccggctgaaggccgcccagctggtgctgactggaggcaccggcagccatggagtcttcctggtgcggcagagcgagacccggcggggggagtatgtgctgaccttcaacttccagggcaaggccaagcacctgcggctgagcctgaatgaggagggccagtgccgggtgcagcacctgtggttccagagcatctttgacatgctggagcacttccgggtgcaccccatccccctggagagcggcggcagcagtgatgtggtgctggtgtcctatgtgcccagcagccagaggcagcagggcgagcagagccgctctgctggggaggaggtgcctgtgcaccccaggtctgaggccggcagccggctgggcgccatgaggggctgtgcccgggagatggatgccacccccatgcccccagcccccagctgccccagcgagcgggtgacagtgtag

SEQ ID NO: 169534 - DNA, 2016 bp, Artificial Sequence; identical to SEQ ID NO: 169532
  Description of Artificial Sequence: Synthetic coding sequence

SEQ ID NO: 169535 - DNA, 1008 bp, Artificial Sequence
  Description of Artificial Sequence: Synthetic coding sequence
atgccagaccgggagaacacctttgtggtgaaggtggagggccccagcgagtacatcatggagaccgtggatgcccagcacgtgaaggcctgggtgtctgacatccaggagtgcctgagccctggcccctgcccagccaccagcccccggcccatgaccctgcccctggcccctggcaccagcttcctgacccgggagaacacagacagcctggagctgagctgcctgaaccacagcgagagcctgcccagccaggacctgctgctgggccccagcgagagcaatgaccggctgagccagggcgcctatggaggcctgagtgaccggcccagcgccagcatcagccccagcagcgccagcattgctgccagccactttgacagcatggagctgctgcccccagagctgcccccacgcatccccatcgaggagggcccccccaccggcaccgtgcaccccctgagcgccccctacccacccctggacaccccagagacagccaccggcagcttcctgttccagggcgagcctgagggcggggagggggaccagcccctgagcggctacccctggttccacggcatgctgagccggctgaaggccgcccagctggtgctgactggaggcaccggcagccatggagtcttcctggtgcggcagagcgagacccggcggggggagtatgtgctgaccttcaacttccagggcaaggccaagcacctgcggctgagcctgaatgaggagggccagtgccgggtgcagcacctgtggttccagagcatctttgacatgctggagcacttccgggtgcaccccatccccctggagagcggcggcagcagtgatgtggtgctggtgtcctatgtgcccagcagccagaggcagcagggccgggagcaggccggcagccatgctggggtgtgtgaaggagatggctgccacccagatgccagctgcaccctgatgccctttggagccagtgactgtgtgacagaccacctgccctag

SEQ ID NO: 169536 - DNA, 1122 bp, Artificial Sequence
  Description of Artificial Sequence: Synthetic coding sequence
atggccgaggccagccggccccggctgagcatcccctgcagcagcatcacagatgtgaggaccaccacagccctggagatgccagaccgggagaacacctttgtggtgaaggtggagggccccagcgagtacatcatggagaccgtggatgcccagcacgtgaaggcctgggtgtctgacatccaggagtgcctgagccctggcccctgcccagccaccagcccccggcccatgaccctgcccctggcccctggcaccagcttcctgacccgggagaacacagacagcctggagctgagctgcctgaaccacagcgagagcctgcccagccaggacctgctgctgggccccagcgagagcaatgaccggctgagccagggcgcctatggaggcctgagtgaccggcccagcgccagcatcagccccagcagcgccagcattgctgccagccactttgacagcatggagctgctgcccccagagctgcccccacgcatccccatcgaggagggcccccccaccggcaccgtgcaccccctgagcgccccctacccacccctggacaccccagagacagccaccggcagcttcctgttccagggcgagcctgagggcggggagggggaccagcccctgagcggctacccctggttccacggcatgctgagccggctgaaggccgcccagctggtgctgactggaggcaccggcagccatggagtcttcctggtgcggcagagcgagacccggcggggggagtatgtgctgaccttcaacttccagggcaaggccaagcacctgcggctgagcctgaatgaggagggccagtgccgggtgcagcacctgtggttccagagcatctttgacatgctggagcacttccgggtgcaccccatccccctggagagcggcggcagcagtgatgtggtgctggtgtcctatgtgcccagcagccagaggcagcagggcgagcagagccgctctgctggggaggaggtgcctgtgcaccccaggtctgaggccggcagccggctgggcgccatgaggggctgtgcccgggagatggatgccacccccatgcccccagcccccagctgccccagcgagcgggtgacagtgtag

SEQ ID NO: 169537 - DNA, 1728 bp, Artificial Sequence
  Description of Artificial Sequence: Synthetic coding sequence
atgaatggacctgccctgcagcccagcagccccagcagcgcccccagcgccagccctgctgctgccccccggggctggagcgagttctgtgagctgcatgctgtggccgccgcccgggagctggcccggcagtactggctgtttgcccgggagcacccccagcacgcccccctgcgggcagagctggtgtccctgcagttcacagacctcttccagcgctacttctgccgggaggtgagagatggccgggcccctggccgggactacagagacaccggccggggccccccagccaaggccgaggccagccctgagcccggccctggccctgctgcccctggcctgcccaaggcccggagcagcgaggagctggccccacccaggcctcctggcccctgcagcttccagcacttcagaagaagcctgcggcacatcttcagaagaagatctgctggggagctgcctgctgcccacacagctgctgcccctggcaccccaggagaggccgctgagaccccagcccggcccggcctggccaagaagttcctgccctggagcctggcccgggagcccccacctgaggccctgaaggaggccgtgctgcgctacagcctggctgatgaggcctccatggattctggggcccgctggcagaggggccgcctggccctgcggcgggcccctggcccagatggccctgacagagtgctggagctgtttgacccccccaagagcagccggcccaagctgcaggccgcctgcagcagcatccaggaggtgcgctggtgcacccggctggagatgccagacaacctgtacacctttgtgctgaaggtgaaggacagaacagacatcatctttgaggtgggagatgagcagcagctgaacagctggatggccgagctgtctgagtgcaccggccggggcctggagagcacagaagctgagatgcacatccccagcgccctggagcccagcaccagcagcagcccccggggcagcacagacagcctgaaccagggcgccagccctgggggcctgctggaccctgcctgccagaagacagaccacttcctgagctgctacccctggttccacggccccatcagccgggtgaaggccgcccagctggtgcagctgcagggcccagatgcccacggcgtcttcctggtgcggcagagcgagaccaggagaggagaatatgtgctgaccttcaacttccagggcatcgccaagcacctgcggctgagcctgacagagcggggccagtgccgggtgcagcacctgcacttccccagcgtggtggacatgctgcaccacttccagaggagccccatccccctggagtgtggggccgcctgtgatgtgcggctgagcagctatgtggtggtggtgtcccagcccccaggcagctgcaacacagtgctcttccccttcagcctgccccactgggacagcgagagcctgccccactggggcagcgagctgggcctgccccacctgagcagcagcggctgcccccggggcctgagccctgagggcctgcccggccgcagcagccccccagagcagatcttccacctggtgcccagccctgaggagctggccaacagcctgcagcacctggagcacgagcctgtgaacagagcccgggacagcgactatgagatggacagcagcagccgcagccacctgcgggccatcgacaaccagtacacccccctgtag

SEQ ID NO: 169538 - DNA, 1122 bp, Artificial Sequence
  Description of Artificial Sequence: Synthetic coding sequence
atgggcttccctgtgctgtgccggggctggaggaggacctggccaggctgtgcctcctggctgggcgcccccccaccccagaagcccctgctgagccccctgctgctgaaccacaggagcagcaagagcagccggcccaagctgcaggccgcctgcagcagcatccaggaggtgcgctggtgcacccggctggagatgccagacaacctgtacacctttgtgctgaaggtgaaggacagaacagacatcatctttgaggtgggagatgagcagcagctgaacagctggatggccgagctgtctgagtgcaccggccggggcctggagagcacagaagctgagatgcacatccccagcgccctggagcccagcaccagcagcagcccccggggcagcacagacagcctgaaccagggcgccagccctgggggcctgctggaccctgcctgccagaagacagaccacttcctgagctgctacccctggttccacggccccatcagccgggtgaaggccgcccagctggtgcagctgcagggcccagatgcccacggcgtcttcctggtgcggcagagcgagaccaggagaggagaatatgtgctgaccttcaacttccagggcatcgccaagcacctgcggctgagcctgacagagcggggccagtgccgggtgcagcacctgcacttccccagcgtggtggacatgctgcaccacttccagaggagccccatccccctggagtgtggggccgcctgtgatgtgcggctgagcagctatgtggtggtggtgtcccagcccccaggcagctgcaacacagtgctcttccccttcagcctgccccactgggacagcgagagcctgccccactggggcagcgagctgggcctgccccacctgagcagcagcggctgcccccggggcctgagccctgagggcctgcccggccgcagcagccccccagagcagatcttccacctggtgcccagccctgaggagctggccaacagcctgcagcacctggagcacgagcctgtgaacagagcccgggacagcgactatgagatggacagcagcagccgcagccacctgcgggccatcgacaaccagtacacccccctgtag

SEQ ID NO: 169539 - DNA, 1209 bp, Artificial Sequence
  Description of Artificial Sequence: Synthetic coding sequence
atgatcccccccagcagccccagagaagatggagtggatggcctgcccaaggaggccgtgggcgctgagcagccccccagccctgccagcaccagcagccaggagagcaagctgcagaagctgaagaggagcctgtccttcaagaccaagagcctgcggagcaagtctgctgacaacttcttccagaggaccaacagcgaggacatgaagctgcaggcccacatggtggccgagatcagccccagcagcagccccctgcctgcccctggcagcctgaccagcaccccagcccgggccggcctgcaccctgggggcaaggcccacgccttccaggagtacatcttcaagaagcccaccttctgtgatgtgtgcaaccacatgattgtgggcaccaatgccaagcacggcctgcgctgcaaggcctgcaagatgagcatccaccacaagtgcacagatggcctggccccccagcgctgcatgggcaagctgcccaagggcttccgccgctactacagcagccccctgctgatccacgagcagtttggctgcatcaaggaggtgatgcccatcgcctgtggcaacaaggtggaccctgtgtatgagaccctgcgcttcggcaccagcctggcccagaggaccaagaagggcagcagcggcagcggcagtgacagcccccacaggaccagcaccagtgacctggtggaggtgcctgaggaggccaatggacctgggggcggctatgacctgaggaagaggagcaacagcgtcttcacctacccagaaaatggaacagatgacttccgggaccctgccaagaacatcaaccaccagggcagcctgagcaaggaccccctgcagatgaacacctacgtggccctgtacaagtttgtgccccaggagaatgaagacctggagatgaggcctggggacatcatcaccctgctggaggacagcaatgaagactggtggaagggcaagatccaggacagaattggcttcttccctgccaactttgtgcagaggctgcagcagaatgagaagatcttccgctgtgtgaggaccttcatcggctgcaaggagcagggccagatcaccctgaaggagaaccagatctgtgtgtcctctgaggaggagcaggacggcttcatccgggtgctgagcggcaagaagaagggcctcatccccctggatgtgctggagaacatctag

SEQ ID NO: 169540 - DNA, 1005 bp, Artificial Sequence
  Description of Artificial Sequence: Synthetic coding sequence
atgaagctgcaggcccacatggtggccgagatcagccccagcagcagccccctgcctgcccctggcagcctgaccagcaccccagcccgggccggcctgcaccctgggggcaaggcccacgccttccaggagtacatcttcaagaagcccaccttctgtgatgtgtgcaaccacatgattgtgggcaccaatgccaagcacggcctgcgctgcaaggcctgcaagatgagcatccaccacaagtgcacagatggcctggccccccagcgctgcatgggcaagctgcccaagggcttccgccgctactacagcagccccctgctgatccacgagcagtttggctgcatcaaggaggtgatgcccatcgcctgtggcaacaaggtggaccctgtgtatgagaccctgcgcttcggcaccagcctggcccagaggaccaagaagggcagcagcggcagcggcagtgacagcccccacaggaccagcaccagtgacctggtggaggtgcctgaggaggccaatggacctgggggcggctatgacctgaggaagaggagcaacagcgtcttcacctacccagaaaatggaacagatgacttccgggaccctgccaagaacatcaaccaccagggcagcctgagcaaggaccccctgcagatgaacacctacgtggccctgtacaagtttgtgccccaggagaatgaagacctggagatgaggcctggggacatcatcaccctgctggaggacagcaatgaagactggtggaagggcaagatccaggacagaattggcttcttccctgccaactttgtgcagaggctgcagcagaatgagaagatcttccgctgtgtgaggaccttcatcggctgcaaggagcagggccagatcaccctgaaggagaaccagatctgtgtgtcctctgaggaggagcaggacggcttcatccgggtgctgagcggcaagaagaagggcctcatccccctggatgtgctggagaacatctag

SEQ ID NO: 169541 - DNA, 4422 bp, Artificial Sequence
  Description of Artificial Sequence: Synthetic coding sequence
gtggccatcatcgccggcaactttgagctggccgagtacatcaagaaccacaaggagacagacatcgtgcccttccgggaggccccagcctacagcaacagaagaagaagaccacccaacaccctggccgccccccgggtgctgctgcggagcaacagcgacaacaacctgaatgccagcgccccagactgggccgtgtgcagcacagccaccagccacaggagcctgagcccccagctgctgcagcagatgcccagcaagccagagggcgccgccaagaccatcggcagctatgtgcccggccccaggagccgcagccccagcctgaaccggctgggcggcgctggagaagatggcaagaggccccagcccctgtggcacgtgggcagcccctttgccctgggcgccaacaaggacagcctgagcgcctttgagtacccaggccccaagaggaagctgtacagcgctgtgcccggccgcctgtttgtggccgtgaagccctaccagccccaggtggatggagagatccccctgcacagaggagacagagtgaaggtgctgagcattggagagggcggcttctgggagggcagcgcccggggccacatcggctggttcccagcagaatgtgtggaggaggtgcagtgcaagccccgggacagccaggccgagaccagggctgacaggagcaagaagctgttccgccactacacagtgggcagctatgacagctttgacaccagcagtgactgcatcatcgaggagaagacagtggtgctgcagaagaaggacaatgaaggcttcggctttgtgctgcggggggccaaggctgacacccccatcgaggagttcacccccaccccagccttccctgccctgcagtacctggagagcgtggatgagggcggcgtggcctggcaggccggcctgaggactggagacttcctgattgaggtgaacaatgaaaatgtggtgaaggtgggccaccggcaggtggtgaacatgatccggcagggcggcaaccacctggtgctgaaggtggtgacagtgaccaggaacctggaccctgatgacacagccaggaagaaggcccctcctccacccaagagggcccccaccacagccctgaccctgcggagcaagtccatgaccagcgagctggaggagctggtggacaaggacaagccagaggagatcgtgcctgccagcaagcccagcagagctgctgagaacatggctgtggagccccgggtggccaccatcaagcagaggcccagcagccgctgcttccctgctggcagtgacatgaacagcgtgtatgaaaggcagggcattgctgtgatgacccccaccgtgcccggcagccccaaggcccccttcctgggcatcccccggggcaccatgaggcggcagaagagcattgacagccgcatcttcctgagcggcatcacagaggaggagcggcagttcctggccccacccatgctgaagttcaccaggagcctgtccatgccagacaccagcgaggacatccccccaccaccccagagcgtgccccccagccccccaccacccagccccaccacctacaactgccccaagagccccaccccccgggtgtatggcaccatcaagccagccttcaaccagaacagcgctgccaaggtgtccccagccaccaggagtgacacagtggccaccatgatgagggagaagggcatgtacttcagaagagagctggaccgctacagcctggacagcgaggacctgtacagcagaaatgccggcccccaggccaacttcaggaacaagaggggccagatgcctgagaacccctacagcgaggtgggcaagatcgccagcaaggctgtgtatgtgcctgccaagccagcccggaggaagggcatgctggtgaagcagagcaatgtggaggacagccctgagaagacctgcagcatccccatccccaccatcatcgtgaaggagcccagcaccagcagcagcggcaagagcagccagggcagctccatggagattgacccccaggcccctgagccccccagccagctgcggccagatgagagcctgactgtgagcagcccctttgctgctgccatcgccggggctgtgcgggaccgggagaagaggctggaggcccggaggaacagccctgccttcctgagcacagacctgggagatgaagatgtgggcctgggccccccagcccccaggacccggcccagcatgtttcctgaggagggggactttgctgatgaagattctgctgagcagctgagcagccccatgcccagcgccaccccccgggagcctgagaaccactttgtgggcggcgctgaggccagcgcccctggagaggccggccggcccctgaacagcaccagcaaggcccagggccctgagagcagccctgctgtgcccagcgccagcagcggcacagctggccctggcaactacgtgcaccccctgaccggccgcctgctggaccccagcagccccctggccctggccctgagcgcccgggaccgggccatgaaggagagccagcagggccccaagggggaggcccccaaggctgacctgaacaagcccctgtacatcgacaccaagatgaggcccagcctggatgctggcttccccaccgtgacccggcagaacacccggggccccctgcggcggcaggagacagagaacaagtatgaaacagacctgggccgggacagaaaaggagatgacaagaagaacatgctgattgacatcatggacaccagccagcagaagtctgctggcctgctgatggtgcacacagtggatgccaccaagctggacaatgccctgcaggaggaggatgagaaggccgaggtggagatgaagccagacagcagccccagcgaggtgcctgagggcgtgtctgaaacagaaggagccctgcagatctctgctgcccctgagcccaccaccgtgcccggccgcaccatcgtggccgtgggctccatggaggaggccgtcatcctgcccttccgcatccccccaccacccctggcctctgtggacctggatgaggacttcatcttcacagagcccctgcccccacccctggagtttgccaacagctttgacatcccagatgaccgggccgcctctgtgcctgccctgagtgacctggtgaagcagaagaagagtgacaccccccagagccccagcctgaacagcagccagcccaccaacagcgctgacagcaagaagccagccagcctgagcaactgcctgcctgccagcttcctgcccccacctgagagctttgatgctgtggccgacagcggcatcgaggaggtggacagccgcagcagcagtgaccaccacctggagaccaccagcaccatcagcacagtgagcagcatcagcaccctgagcagcgagggcggagaaaatgtggacacctgcaccgtgtatgcagatggccaggccttcatggtggacaagccccctgtgccccccaagcccaagatgaagcccatcatccacaagagcaatgccctgtaccaggatgccctggtggaggaggatgtggacagctttgtgatccccccaccagcccctcctcctcctcctggcagcgcccagcccggcatggccaaggtgctgcagcccaggaccagcaagctgtggggagatgtgacagagatcaagagccccatcctgagcggccccaaggccaacgtcatcagcgagctgaacagcatcctgcagcagatgaaccgggagaagctggccaagccaggagagggcctggacagccccatgggcgccaagagcgccagcctggcccccaggagccctgagatcatgagcaccatcagcggcaccaggagcaccaccgtgaccttcaccgtgcggcccggcaccagccagcccatcaccctgcagagccggcccccagactatgagagcaggaccagcggcacccggcgggcccccagccctgtggtgagccccacagagatgaacaaggagaccctgcctgcccccctgtctgctgccacagccagccccagccctgccctgagtgatgtgttcagcctgcccagccagcccccatctggggacctgtttggcctgaacccagctggccgcagccgcagccccagccccagcatcctgcagcagcccatcagcaacaagcccttcaccaccaagcctgtgcacctgtggaccaagccagatgtggccgactggctggagagcctgaacctgggggagcacaaggaggccttcatggacaatgaaattgatggcagccacctgcccaacctgcagaaggaggacctgattgacctgggcgtgaccagggtgggccacaggatgaacatcgagcgggccctgaagcagctgctggacagatag

SEQ ID NO: 169542 - DNA, 5553 bp, Artificial Sequence
  Description of Artificial Sequence: Synthetic coding sequence
atgcccaggagccccaccagcagtgaagatgagatggcccagagcttcagtgactacagcgtgggcagcgagagtgacagcagcaaggaggagaccatctatgacaccatccgggccacagctgagaagccaggaggagccaggacagaggagagccagggcaacaccctggtgatccgggtggtgattcatgacctgcagcagaccaagtgcatccgcttcaacccagatgccaccgtgtgggtggccaagcagaggatcctgtgcaccctgacccagagcctgaaggatgtgctgaactacggcctcttccagcctgccagcaatggaagagatggcaagttcctggatgaggagcggctgctgcgggagtacccccagcctgtgggggagggcgtgcccagcctggagttccgctacaagaagagggtgtacaagcaggccagcctggatgagaagcagctggccaagctgcacaccaagaccaacctgaagaagtgcatggaccacatccagcaccggctggtggagaagatcaccaagatgctggaccggggcctggaccccaacttccatgaccctgagaccggggagacccccctgaccctggccgcccagctggatgacagcgtggaggtgatcaaggccctgaagaatggaggagcccacctggacttccgggccaaggatggcatgacagccctgcacaaggccgcccgggccaggaaccaggtggccctgaagaccctgctggagctgggcgccagcccagactacaaggacagctatggcctgacccccctgtaccacacagccatcgtgggcggggacccctactgctgtgagctgctgctgcacgagcacgccaccgtgtgctgcaaggatgaaaatggctggcatgagatccaccagagccgctgctggggccacatcagcgagccccaccacaccctgctgagcggcagcgcccggagccagcagagccgcagcgccagcagcgccctgcacgtgtgtgccatgtacagcagcttcagctgtgtgcgcatcagcctgctcttccacggccgcatcacagagctgaagcagtacaagaagagcacccccttccaggtggccatcatcgccggcaactttgagctggccgagtacatcaagaaccacaaggagacagacatcgtgcccttccgggaggccccagcctacagcaacagaagaagaagaccacccaacaccctggccgccccccgggtgctgctgcggagcaacagcgacaacaacctgaatgccagcgccccagactgggccgtgtgcagcacagccaccagccacaggagcctgagcccccagctgctgcagcagatgcccagcaagccagagggcgccgccaagaccatcggcagctatgtgcccggccccaggagccgcagccccagcctgaaccggctgggcggcgctggagaagatggcaagaggccccagcccctgtggcacgtgggcagcccctttgccctgggcgccaacaaggacagcctgagcgcctttgagtacccaggccccaagaggaagctgtacagcgctgtgcccggccgcctgtttgtggccgtgaagccctaccagccccaggtggatggagagatccccctgcacagaggagacagagtgaaggtgctgagcattggagagggcggcttctgggagggcagcgcccggggccacatcggctggttcccagcagaatgtgtggaggaggtgcagtgcaagccccgggacagccaggccgagaccagggctgacaggagcaagaagctgttccgccactacacagtgggcagctatgacagctttgacaccagcagtgactgcatcatcgaggagaagacagtggtgctgcagaagaaggacaatgaaggcttcggctttgtgctgcggggggccaaggctgacacccccatcgaggagttcacccccaccccagccttccctgccctgcagtacctggagagcgtggatgagggcggcgtggcctggcaggccggcctgaggactggagacttcctgattgaggtgaacaatgaaaatgtggtgaaggtgggccaccggcaggtggtgaacatgatccggcagggcggcaaccacctggtgctgaaggtggtgacagtgaccaggaacctggaccctgatgacacagccaggaagaaggcccctcctccacccaagagggcccccaccacagccctgaccctgcggagcaagtccatgaccagcgagctggaggagctggtggacaagggcgtcatcaggaaggtgtctgacaagccagaggagatcgtgcctgccagcaagcccagcagagctgctgagaacatggctgtggagccccgggtggccaccatcaagcagaggcccagcagccgctgcttccctgctggcagtgacatgaacagcgtgtatgagcggcagggcattgctgtgatgacccccaccgtgcccggcagccccaaggcccccttcctgggcatcccccggggcaccatgaggcggcagaagagcattgacagccgcatcttcctgagcggcatcacagaggaggagcggcagttcctggccccacccatgctgaagttcaccaggagcctgtccatgccagacaccagcgaggacatccccccaccaccccagagcgtgccccccagccccccaccacccagccccaccacctacaactgccccaagagccccaccccccgggtgtatggcaccatcaagccagccttcaaccagaacagcgctgccaaggtgtccccagccaccaggagtgacacagtggccaccatgatgagggagaagggcatgtacttccggcgggagctggaccgctacagcctggacagtgaagatctctacagcagaaatgccggcccccaggccaacttcaggaacaagaggggccagatgcctgagaacccctacagcgaggtgggcaagatcgccagcaaggctgtgtatgtgcctgccaagccagcccggaggaagggcatgctggtgaagcagagcaatgtggaggacagccctgagaagacctgcagcatccccatccccaccatcatcgtgaaggagcccagcaccagcagcagcggcaagagcagccagggcagctccatggagattgacccccaggcccctgagccccccagccagctgcggccagatgagagcctgactgtgagcagcccctttgctgctgccatcgccggggctgtgcgggaccgggagaagaggctggaggcccggaggaacagccctgccttcctgagcacagacctgggagatgaagatgtgggcctgggccccccagcccccaggacccggcccagcatgtttcctgaggagggggactttgctgatgaggacagcgctgagcagctgagcagccccatgcccagcgccaccccccgggagcctgagaaccactttgtgggcggcgctgaggccagcgcccctggagaggccggccggcccctgaacagcaccagcaaggcccagggccctgagagcagccctgctgtgcccagcgccagcagcggcacagctggccctggcaactacgtgcaccccctgaccggccgcctgctggaccccagcagccccctggccctggccctgagcgcccgggaccgggccatgaaggagagccagcagggccccaagggggaggcccccaaggctgacctgaacaagcccctgtacatcgacaccaagatgaggcccagcctggatgctggcttccccaccgtgacccggcagaacacccggggccccctgcggcggcaggagacagagaacaagtatgaaacagacctgggccgggacagaaaaggagatgacaagaagaacatgctgattgacatcatggacaccagccagcagaagtctgctggcctgctgatggtgcacacagtggatgccaccaagctggacaatgccctgcaggaggaggatgagaaggccgaggtggagatgaagccagacagcagccccagcgaggtgcctgagggcgtgtctgaaacagagggcgccctgcagatctctgctgcccctgagcccaccaccgtgcccggccgcaccatcgtggccgtgggctccatggaggaggccgtcatcctgcccttccgcatccccccaccacccctggcctctgtggacctggatgaggacttcatcttcacagagcccctgcccccacccctggagtttgccaacagctttgacatcccagatgacagagctgcctctgtgcctgccctgagtgacctggtgaagcagaagaagagtgacaccccccagagccccagcctgaacagcagccagcccaccaacagcgctgacagcaagaagccagccagcctgagcaactgcctgcctgccagcttcctgcccccacctgagagctttgatgctgtggccgacagcggcatcgaggaggtggacagccgcagcagcagtgaccaccacctggagaccaccagcaccatcagcacagtgagcagcatcagcaccctgagcagcgagggcggggagaatgtggacacctgcaccgtgtatgcagatggccaggccttcatggtggacaagccccctgtgccccccaagcccaagatgaagcccatcatccacaagagcaatgccctgtaccaggatgccctggtggaggaggatgtggacagctttgtgattcctcctccagcccctcctcctcctcctggcagcgcccagcccggcatggccaaggtgctgcagcccaggaccagcaagctgtggggagatgtgacagagatcaagagccccatcctgagcggccccaaggccaacgtcatcagcgagctgaacagcatcctgcagcagatgaaccgggagaagctggccaagccaggagagggcctggacagccccatgggcgccaagagcgccagcctggcccccaggagccctgagatcatgagcaccatcagcggcaccaggagcaccaccgtgaccttcaccgtgcggcccggcaccagccagcccatcaccctgcagagccggcccccagactatgagagcaggaccagcggcacccggcgggcccccagccctgtggtgagccccacagagatgaacaaggagaccctgcctgcccccctgtctgctgccacagccagccccagccctgccctgagtgatgtgttcagcctgcccagccagccccccagcggggacctgtttggcctgaacccagctggccgcagccgcagccccagccccagcatcctgcagcagcccatcagcaacaagcccttcaccaccaagcctgtgcacctgtggaccaagccagatgtggccgactggctggagagcctgaacctgggggagcacaaggaggccttcatggacaatgaaattgatggcagccacctgcccaacctgcagaaggaggacctgattgacctgggcgtgaccagggtgggccacaggatgaacatcgagcgggccctgaagcagctgctggacagatag

SEQ ID NO: 169543 - DNA, 846 bp, Artificial Sequence
  Description of Artificial Sequence: Synthetic coding sequence
atgatgatgaatgtgcctgggggcggcgctgctgctgtgatgatgacaggctacaacaacggccgctgccccaggaacagcctgtacagcgactgcatcatcgaggagaagacagtggtgctgcagaagaaggacaatgaaggatttggatttgtgctgcggggggccaaggctgacacccccatcgaggagttcacccccaccccagccttccctgccctgcagtacctggagagcgtggatgaaggaggagtggcctggcaggccggcctgaggactggagacttcctgattgaggtgaacaatgaaaatgtggtgaaggtgggccaccggcaggtggtgaacatgatccggcagggcggcaaccacctggtgctgaaggtggtgacagtgaccaggaacctggaccctgatgacacagccaggaagaaggcccctcctccacccaagagggcccccaccacagccctgaccctgcggagcaagtccatgaccagcgagctggaggagctggtggacaagggcgtcatcaggaagggcaaggacaagccagaggagatcgtgcctgccagcaagcccagcagagctgctgagaacatggctgtggagccccgggtggccaccatcaagcagaggcccagcagccgctgcttccctgctggcagtgacatgaacagcgtgtatgaaaggcagggcattgctgtgatgacccccaccgtgcccggcagccccaaggcccccttcctgggcatcccccggggcaccatgaggcggcagaagagcatcggcaagaagtgtggcaccccaccccagaagctgcccctgggcttccagacccagccctag

SEQ ID NO: 169544 - DNA, 3762 bp, Artificial Sequence
  Description of Artificial Sequence: Synthetic coding sequence
atgatgaatgtgcctgggggcggcgctgctgctgtgatgatgacaggctacaacaacggccgctgccccaggaacagcctgtacagcgactgcatcatcgaggagaagacagtggtgctgcagaagaaggacaatgaaggcttcggctttgtgctgcggggggccaaggctgacacccccatcgaggagttcacccccaccccagccttccctgccctgcagtacctggagagcgtggatgagggcggcgtggcctggcaggccggcctgaggactggagacttcctgattgaggtgaacaatgaaaatgtggtgaaggtgggccaccggcaggtggtgaacatgatccggcagggcggcaaccacctggtgctgaaggtggtgacagtgaccaggaacctggaccctgatgacacagccaggaagaaggcccctcctccacccaagagggcccccaccacagccctgaccctgcggagcaagtccatgaccagcgagctggaggagctggtggacaaggacaagccagaggagatcgtgcctgccagcaagcccagcagagctgctgagaacatggctgtggagccccgggtggccaccatcaagcagaggcccagcagccgctgcttccctgctggcagtgacatgaacagcgtgtatgaaaggcagggcattgctgtgatgacccccaccgtgcccggcagccccaaggcccccttcctgggcatcccccggggcaccatgaggcggcagaagagcattgacagccgcatcttcctgagcggcatcacagaggaggagcggcagttcctggccccacccatgctgaagttcaccaggagcctgtccatgccagacaccagcgaggacatccccccaccaccccagagcgtgccccccagccccccaccacccagccccaccacctacaactgccccaagagccccaccccccgggtgtatggcaccatcaagccagccttcaaccagaacagcgctgccaaggtgtccccagccaccaggagtgacacagtggccaccatgatgagggagaagggcatgtacttcagaagagagctggaccgctacagcctggacagcgaggacctgtacagcagaaatgccggcccccaggccaacttcaggaacaagaggggccagatgcctgagaacccctacagcgaggtgggcaagatcgccagcaaggctgtgtatgtgcctgccaagccagcccggaggaagggcatgctggtgaagcagagcaatgtggaggacagccctgagaagacctgcagcatccccatccccaccatcatcgtgaaggagcccagcaccagcagcagcggcaagagcagccagggcagctccatggagattgacccccaggcccctgagccccccagccagctgcggccagatgagagcctgactgtgagcagcccctttgctgctgccatcgccggggctgtgcgggaccgggagaagaggctggaggcccggaggaacagccctgccttcctgagcacagacctgggagatgaagatgtgggcctgggccccccagcccccaggacccggcccagcatgtttcctgaggagggggactttgctgatgaagattctgctgagcagctgagcagccccatgcccagcgccaccccccgggagcctgagaaccactttgtgggcggcgctgaggccagcgcccctggagaggccggccggcccctgaacagcaccagcaaggcccagggccctgagagcagccctgctgtgcccagcgccagcagcggcacagctggccctggcaactacgtgcaccccctgaccggccgcctgctggaccccagcagccccctggccctggccctgagcgcccgggaccgggccatgaaggagagccagcagggccccaagggggaggcccccaaggctgacctgaacaagcccctgtacatcgacaccaagatgaggcccagcctggatgctggcttccccaccgtgacccggcagaacacccggggccccctgcggcggcaggagacagagaacaagtatgaaacagacctgggccgggacagaaaaggagatgacaagaagaacatgctgattgacatcatggacaccagccagcagaagtctgctggcctgctgatggtgcacacagtggatgccaccaagctggacaatgccctgcaggaggaggatgagaaggccgaggtggagatgaagccagacagcagccccagcgaggtgcctgagggcgtgtctgaaacagaaggagccctgcagatctctgctgcccctgagcccaccaccgtgcccggccgcaccatcgtggccgtgggctccatggaggaggccgtcatcctgcccttccgcatccccccaccacccctggcctctgtggacctggatgaggacttcatcttcacagagcccctgcccccacccctggagtttgccaacagctttgacatcccagatgaccgggccgcctctgtgcctgccctgagtgacctggtgaagcagaagaagagtgacaccccccagagccccagcctgaacagcagccagcccaccaacagcgctgacagcaagaagccagccagcctgagcaactgcctgcctgccagcttcctgcccccacctgagagctttgatgctgtggccgacagcggcatcgaggaggtggacagccgcagcagcagtgaccaccacctggagaccaccagcaccatcagcacagtgagcagcatcagcaccctgagcagcgagggcggagaaaatgtggacacctgcaccgtgtatgcagatggccaggccttcatggtggacaagccccctgtgccccccaagcccaagatgaagcccatcatccacaagagcaatgccctgtaccaggatgccctggtggaggaggatgtggacagctttgtgatccccccaccagcccctcctcctcctcctggcagcgcccagcccggcatggccaaggtgctgcagcccaggaccagcaagctgtggggagatgtgacagagatcaagagccccatcctgagcggccccaaggccaacgtcatcagcgagctgaacagcatcctgcagcagatgaaccgggagaagctggccaagccaggagagggcctggacagccccatgggcgccaagagcgccagcctggcccccaggagccctgagatcatgagcaccatcagcggcaccaggagcaccaccgtgaccttcaccgtgcggcccggcaccagccagcccatcaccctgcagagccggcccccagactatgagagcaggaccagcggcacccggcgggcccccagccctgtggtgagccccacagagatgaacaaggagaccctgcctgcccccctgtctgctgccacagccagccccagccctgccctgagtgatgtgttcagcctgcccagccagcccccatctggggacctgtttggcctgaacccagctggccgcagccgcagccccagccccagcatcctgcagcagcccatcagcaacaagcccttcaccaccaagcctgtgcacctgtggaccaagccagatgtggccgactggctggagagcctgaacctgggggagcacaaggaggccttcatggacaatgaaattgatggcagccacctgcccaacctgcagaaggaggacctgattgacctgggcgtgaccagggtgggccacaggatgaacatcgagcgggccctgaagcagctgctggacagatag

SEQ ID NO: 169545 - DNA, 843 bp, Artificial Sequence
  Description of Artificial Sequence: Synthetic coding sequence
atgatgaatgtgcctgggggcggcgctgctgctgtgatgatgacaggctacaacaacggccgctgccccaggaacagcctgtacagcgactgcatcatcgaggagaagacagtggtgctgcagaagaaggacaatgaaggcttcggctttgtgctgcggggggccaaggctgacacccccatcgaggagttcacccccaccccagccttccctgccctgcagtacctggagagcgtggatgagggcggcgtggcctggcaggccggcctgaggactggagacttcctgattgaggtgaacaatgaaaatgtggtgaaggtgggccaccggcaggtggtgaacatgatccggcagggcggcaaccacctggtgctgaaggtggtgacagtgaccaggaacctggaccctgatgacacagccaggaagaaggcccctcctccacccaagagggcccccaccacagccctgaccctgcggagcaagtccatgaccagcgagctggaggagctggtggacaaggcctctgtgaggaagaagaaggacaagccagaggagatcgtgcctgccagcaagcccagcagagctgctgagaacatggctgtggagccccgggtggccaccatcaagcagaggcccagcagccgctgcttccctgctggcagtgacatgaacagcgtgtatgagcggcagggcattgctgtgatgacccccaccgtgcccggcagccccaaggcccccttcctgggcatcccccggggcaccatgaggcggcagaagagcatcggcaagaagtgtggcaccccaccccagaagctgcccctgggcttccagacccagccctag

SEQ ID NO: 169546 - DNA, 4413 bp, Artificial Sequence
  Description of Artificial Sequence: Synthetic coding sequence
atgaagagcctgctgaatgccttcaccaagaaggaggtgcccttccgggaggccccagcctacagcaacagaagaagaagaccacccaacaccctggccgccccccgggtgctgctgcggagcaacagcgacaacaacctgaatgccagcgccccagactgggccgtgtgcagcacagccaccagccacaggagcctgagcccccagctgctgcagcagatgcccagcaagccagagggcgccgccaagaccatcggcagctatgtgcccggccccaggagccgcagccccagcctgaaccggctgggcggcgctggagaagatggcaagaggccccagcccctgtggcacgtgggcagcccctttgccctgggcgccaacaaggacagcctgagcgcctttgagtacccaggccccaagaggaagctgtacagcgctgtgcccggccgcctgtttgtggccgtgaagccctaccagccccaggtggatggagagatccccctgcacagaggagacagagtgaaggtgctgagcattggagagggcggcttctgggagggcagcgcccggggccacatcggctggttcccagcagaatgtgtggaggaggtgcagtgcaagccccgggacagccaggccgagaccagggctgacaggagcaagaagctgttccgccactacacagtgggcagctatgacagctttgacaccagcagtgactgcatcatcgaggagaagacagtggtgctgcagaagaaggacaatgaaggcttcggctttgtgctgcggggggccaaggctgacacccccatcgaggagttcacccccaccccagccttccctgccctgcagtacctggagagcgtggatgagggcggcgtggcctggcaggccggcctgaggactggagacttcctgattgaggtgaacaatgaaaatgtggtgaaggtgggccaccggcaggtggtgaacatgatccggcagggcggcaaccacctggtgctgaaggtggtgacagtgaccaggaacctggaccctgatgacacagccaggaagaaggcccctcctccacccaagagggcccccaccacagccctgaccctgcggagcaagtccatgaccagcgagctggaggagctggtggacaaggcctctgtgaggaagaagaaggacaagccagaggagatcgtgcctgccagcaagcccagcagagctgctgagaacatggctgtggagccccgggtggccaccatcaagcagaggcccagcagccgctgcttccctgctggcagtgacatgaacagcgtgtatgagcggcagggcattgctgtgatgacccccaccgtgcccggcagccccaaggcccccttcctgggcatcccccggggcaccatgaggcggcagaagagcattgacagccgcatcttcctgagcggcatcacagaggaggagcggcagttcctggccccacccatgctgaagttcaccaggagcctgtccatgccagacaccagcgaggacatccccccaccaccccagagcgtgccccccagccccccaccacccagccccaccacctacaactgccccaagagccccaccccccgggtgtatggcaccatcaagccagccttcaaccagaacagcgctgccaaggtgtccccagccaccaggagtgacacagtggccaccatgatgagggagaagggcatgtacttccggcgggagctggaccgctacagcctggacagtgaagatctctacagcagaaatgccggcccccaggccaacttcaggaacaagaggggccagatgcctgagaacccctacagcgaggtgggcaagatcgccagcaaggctgtgtatgtgcctgccaagccagcccggaggaagggcatgctggtgaagcagagcaatgtggaggacagccctgagaagacctgcagcatccccatccccaccatcatcgtgaaggagcccagcaccagcagcagcggcaagagcagccagggcagctccatggagattgacccccaggcccctgagccccccagccagctgcggccagatgagagcctgactgtgagcagcccctttgctgctgccatcgccggggctgtgcgggaccgggagaagaggctggaggcccggaggaacagccctgccttcctgagcacagacctgggagatgaagatgtgggcctgggccccccagcccccaggacccggcccagcatgtttcctgaggagggggactttgctgatgaggacagcgctgagcagctgagcagccccatgcccagcgccaccccccgggagcctgagaaccactttgtgggcggcgctgaggccagcgcccctggagaggccggccggcccctgaacagcaccagcaaggcccagggccctgagagcagccctgctgtgcccagcgccagcagcggcacagctggccctggcaactacgtgcaccccctgaccggccgcctgctggaccccagcagccccctggccctggccctgagcgcccgggaccgggccatgaaggagagccagcagggccccaagggggaggcccccaaggctgacctgaacaagcccctgtacatcgacaccaagatgaggcccagcctggatgctggcttccccaccgtgacccggcagaacacccggggccccctgcggcggcaggagacagagaacaagtatgaaacagacctgggccgggacagaaaaggagatgacaagaagaacatgctgattgacatcatggacaccagccagcagaagtctgctggcctgctgatggtgcacacagtggatgccaccaagctggacaatgccctgcaggaggaggatgagaaggccgaggtggagatgaagccagacagcagccccagcgaggtgcctgagggcgtgtctgaaacagagggcgccctgcagatctctgctgcccctgagcccaccaccgtgcccggccgcaccatcgtggccgtgggctccatggaggaggccgtcatcctgcccttccgcatccccccaccacccctggcctctgtggacctggatgaggacttcatcttcacagagcccctgcccccacccctggagtttgccaacagctttgacatcccagatgacagagctgcctctgtgcctgccctgagtgacctggtgaagcagaagaagagtgacaccccccagagccccagcctgaacagcagccagcccaccaacagcgctgacagcaagaagccagccagcctgagcaactgcctgcctgccagcttcctgcccccacctgagagctttgatgctgtggccgacagcggcatcgaggaggtggacagccgcagcagcagtgaccaccacctggagaccaccagcaccatcagcacagtgagcagcatcagcaccctgagcagcgagggcggggagaatgtggacacctgcaccgtgtatgcagatggccaggccttcatggtggacaagccccctgtgccccccaagcccaagatgaagcccatcatccacaagagcaatgccctgtaccaggatgccctggtggaggaggatgtggacagctttgtgattcctcctccagcccctcctcctcctcctggcagcgcccagcccggcatggccaaggtgctgcagcccaggaccagcaagctgtggggagatgtgacagagatcaagagccccatcctgagcggccccaaggccaacgtcatcagcgagctgaacagcatcctgcagcagatgaaccgggagaagctggccaagccaggagagggcctggacagccccatgggcgccaagagcgccagcctggcccccaggagccctgagatcatgagcaccatcagcggcaccaggagcaccaccgtgaccttcaccgtgcggcccggcaccagccagcccatcaccctgcagagccggcccccagactatgagagcaggaccagcggcacccggcgggcccccagccctgtggtgagccccacagagatgaacaaggagaccctgcctgcccccctgtctgctgccacagccagccccagccctgccctgagtgatgtgttcagcctgcccagccagccccccagcggggacctgtttggcctgaacccagctggccgcagccgcagccccagccccagcatcctgcagcagcccatcagcaacaagcccttcaccaccaagcctgtgcacctgtggaccaagccagatgtggccgactggctggagagcctgaacctgggggagcacaaggaggccttcatggacaatgaaattgatggcagccacctgcccaacctgcagaaggaggacctgattgacctgggcgtgaccagggtgggccacaggatgaacatcgagcgggccctgaagcagctgctggacagatag

SEQ ID NO: 169547 - DNA, 816 bp, Artificial Sequence
  Description of Artificial Sequence: Synthetic coding sequence
atgatgatgaatgtgcctgggggcggcgctgctgctgtgatgatgacaggctacaacaacggccgctgccccaggaacagcctgtacagcgactgcatcatcgaggagaagacagtggtgctgcagaagaaggacaatgaaggatttggatttgtgctgcggggggccaaggctgacacccccatcgaggagttcacccccaccccagccttccctgccctgcagtacctggagagcgtggatgaaggaggagtggcctggcaggccggcctgaggactggagacttcctgattgaggtgaacaatgaaaatgtggtgaaggtgggccaccggcaggtggtgaacatgatccggcagggcggcaaccacctggtgctgaaggtggtgacagtgaccaggaacctggaccctgatgacacagccaggaagaaggcccctcctccacccaagagggcccccaccacagccctgaccctgcggagcaagtccatgaccagcgagctggaggagctggacaagccagaggagatcgtgcctgccagcaagcccagcagagctgctgagaacatggctgtggagccccgggtggccaccatcaagcagaggcccagcagccgctgcttccctgctggcagtgacatgaacagcgtgtatgaaaggcagggcattgctgtgatgacccccaccgtgcccggcagccccaaggcccccttcctgggcatcccccggggcaccatgaggcggcagaagagcatcggcaagaagtgtggcaccccaccccagaagctgcccctgggcttccagacccagccctag

SEQ ID NO: 169548 - DNA, 3765 bp, Artificial Sequence
  Description of Artificial Sequence: Synthetic coding sequence
atgatgatgaatgtgcctgggggcggcgctgctgctgtgatgatgacaggctacaacaacggccgctgccccaggaacagcctgtacagcgactgcatcatcgaggagaagacagtggtgctgcagaagaaggacaatgaaggatttggatttgtgctgcggggggccaaggctgacacccccatcgaggagttcacccccaccccagccttccctgccctgcagtacctggagagcgtggatgaaggaggagtggcctggcaggccggcctgaggactggagacttcctgattgaggtgaacaatgaaaatgtggtgaaggtgggccaccggcaggtggtgaacatgatccggcagggcggcaaccacctggtgctgaaggtggtgacagtgaccaggaacctggaccctgatgacacagccaggaagaaggcccctcctccacccaagagggcccccaccacagccctgaccctgcggagcaagtccatgaccagcgagctggaggagctggtggacaaggacaagccagaggagatcgtgcctgccagcaagcccagcagagctgctgagaacatggctgtggagccccgggtggccaccatcaagcagaggcccagcagccgctgcttccctgctggcagtgacatgaacagcgtgtatgagcggcagggcattgctgtgatgacccccaccgtgcccggcagccccaaggcccccttcctgggcatcccccggggcaccatgaggcggcagaagagcattgacagccgcatcttcctgagcggcatcacagaggaggagcggcagttcctggccccacccatgctgaagttcaccaggagcctgtccatgccagacaccagcgaggacatccccccaccaccccagagcgtgccccccagccccccaccacccagccccaccacctacaactgccccaagagccccaccccccgggtgtatggcaccatcaagccagccttcaaccagaacagcgctgccaaggtgtccccagccaccaggagtgacacagtggccaccatgatgagggagaagggcatgtacttccggcgggagctggaccgctacagcctggacagtgaagatctctacagcagaaatgccggcccccaggccaacttcaggaacaagaggggccagatgcctgagaacccctacagcgaggtgggcaagatcgccagcaaggctgtgtatgtgcctgccaagccagcccggaggaagggcatgctggtgaagcagagcaatgtggaggacagccctgagaagacctgcagcatccccatccccaccatcatcgtgaaggagcccagcaccagcagcagcggcaagagcagccagggcagctccatggagattgacccccaggcccctgagccccccagccagctgcggccagatgagagcctgactgtgagcagcccctttgctgctgccatcgccggggctgtgcgggaccgggagaagaggctggaggcccggaggaacagccctgccttcctgagcacagacctgggagatgaagatgtgggcctgggccccccagcccccaggacccggcccagcatgtttcctgaggagggggactttgctgatgaggacagcgctgagcagctgagcagccccatgcccagcgccaccccccgggagcctgagaaccactttgtgggcggcgctgaggccagcgcccctggagaggccggccggcccctgaacagcaccagcaaggcccagggccctgagagcagccctgctgtgcccagcgccagcagcggcacagctggccctggcaactacgtgcaccccctgaccggccgcctgctggaccccagcagccccctggccctggccctgagcgcccgggaccgggccatgaaggagagccagcagggccccaagggggaggcccccaaggctgacctgaacaagcccctgtacatcgacaccaagatgaggcccagcctggatgctggcttccccaccgtgacccggcagaacacccggggccccctgcggcggcaggagacagagaacaagtatgaaacagacctgggccgggacagaaaaggagatgacaagaagaacatgctgattgacatcatggacaccagccagcagaagtctgctggcctgctgatggtgcacacagtggatgccaccaagctggacaatgccctgcaggaggaggatgagaaggccgaggtggagatgaagccagacagcagccccagcgaggtgcctgagggcgtgtctgaaacagagggcgccctgcagatctctgctgcccctgagcccaccaccgtgcccggccgcaccatcgtggccgtgggctccatggaggaggccgtcatcctgcccttccgcatccccccaccacccctggcctctgtggacctggatgaggacttcatcttcacagagcccctgcccccacccctggagtttgccaacagctttgacatcccagatgacagagctgcctctgtgcctgccctgagtgacctggtgaagcagaagaagagtgacaccccccagagccccagcctgaacagcagccagcccaccaacagcgctgacagcaagaagccagccagcctgagcaactgcctgcctgccagcttcctgcccccacctgagagctttgatgctgtggccgacagcggcatcgaggaggtggacagccgcagcagcagtgaccaccacctggagaccaccagcaccatcagcacagtgagcagcatcagcaccctgagcagcgagggcggggagaatgtggacacctgcaccgtgtatgcagatggccaggccttcatggtggacaagccccctgtgccccccaagcccaagatgaagcccatcatccacaagagcaatgccctgtaccaggatgccctggtggaggaggatgtggacagctttgtgattcctcctccagcccctcctcctcctcctggcagcgcccagcccggcatggccaaggtgctgcagcccaggaccagcaagctgtggggagatgtgacagagatcaagagccccatcctgagcggccccaaggccaacgtcatcagcgagctgaacagcatcctgcagcagatgaaccgggagaagctggccaagccaggagagggcctggacagccccatgggcgccaagagcgccagcctggcccccaggagccctgagatcatgagcaccatcagcggcaccaggagcaccaccgtgaccttcaccgtgcggcccggcaccagccagcccatcaccctgcagagccggcccccagactatgagagcaggaccagcggcacccggcgggcccccagccctgtggtgagccccacagagatgaacaaggagaccctgcctgcccccctgtctgctgccacagccagccccagccctgccctgagtgatgtgttcagcctgcccagccagccccccagcggggacctgtttggcctgaacccagctggccgcagccgcagccccagccccagcatcctgcagcagcccatcagcaacaagcccttcaccaccaagcctgtgcacctgtggaccaagccagatgtggccgactggctggagagcctgaacctgggggagcacaaggaggccttcatggacaatgaaattgatggcagccacctgcccaacctgcagaaggaggacctgattgacctgggcgtgaccagggtgggccacaggatgaacatcgagcgggccctgaagcagctgctggacagatag

SEQ ID NO: 169549 - DNA, 915 bp, Artificial Sequence
  Description of Artificial Sequence: Synthetic coding sequence
atgcccaggagccccaccagcagtgaagatgagatggcccagagcttcagtgactacagcgtgggcagcgagagtgacagcagcaaggaggagaccatctatgacaccatccgggccacagctgagaagccaggaggagccaggacagaggagagccagggcaacaccctggtgatccgggtggtgattcatgacctgcagcagaccaagtgcatccgcttcaacccagatgccaccgtgtgggtggccaagcagaggatcctgtgcaccctgacccagagcctgaaggatgtgctgaactacggcctcttccagcctgccagcaatggaagagatggcaagttcctggatgaggagcggctgctgcgggagtacccccagcctgtgggggagggcgtgcccagcctggagttccgctacaagaagagggtgtacaagcaggccagcctggatgagaagcagctggccaagctgcacaccaagaccaacctgaagaagtgcatggaccacatccagcaccggctggtggagaagatcaccaagatgctggaccggggcctggaccccaacttccatgaccctgagaccggggagacccccctgaccctggccgcccagctggatgacagcgtggaggtgatcaaggccctgaagaatggaggagcccacctggacttccgggccaaggatggcatgacagccctgcacaaggccgcccgggccaggaaccaggtggccctgaagaccctgctggagctgggcgccagcccagactacaaggacagctatggcctgacccccctgtaccacacagccatcgtgggcggggacccctactgctgtgagctgctgctgcacgagcacgccaccgtgtgctgcaaggatgaaaatggctggcatgagatccaccagtag

SEQ ID NO: 169550 - DNA, 5244 bp, Artificial Sequence
  Description of Artificial Sequence: Synthetic coding sequence
atggatggccctggggccagcgctgtggtggtgcgggtgggcatcccagacctgcagcagaccaagtgcctgcggctggaccctgctgcccctgtgtgggccgccaagcagagggtgctgtgtgccctgaaccacagcctgcaggatgccctgaactacggcctcttccagccccccagccggggccgggccggcaagttcctggatgaggagcggctgctgcaggagtacccacccaacctggacacccccctgccctacctggagttccgctacaagagaagagtgtatgcccagaacctgattgatgacaagcagtttgccaagctgcacaccaaggccaacctgaagaagttcatggactatgtgcagctgcacagcacagacaaggtggcccggctgctggacaagggcctggaccccaacttccatgaccctgacagcggggagtgccccctgagcctggccgcccagctggacaatgccacagacctgctgaaggtgctgaagaatggaggagcccacctggacttccgcaccagagatggcctgacagctgtgcactgtgccacccggcagagaaatgctgctgccctgaccaccctgctggacctgggcgccagcccagactacaaggacagccggggcctgacccccctgtaccacagcgccctgggcggcggagatgccctgtgctgtgagctgctgctgcatgaccacgcccagctgggcatcacagatgaaaatggctggcaggagatccaccaggcctgccgcttcggccacgtgcagcacctggagcacctgctcttctacggggctgacatgggcgcccagaatgccagcggcaacacagccctgcacatctgtgccctgtacaaccaggagagctgtgcccgggtgctgctcttccggggggccaacagagatgtgaggaactacaacagccagacagccttccaggtggccatcatcgccggcaactttgagctggccgaggtgatcaagacccacaaggacagtgatgtggtgcccttccgggagacccccagctatgccaagagaagaaggctggccggccccagcggcctggccagcccccggcccctgcagaggtctgccagtgacatcaacctgaagggggaggcccagcctgctgccagccctggccccagcctgcggagcctgccccaccagctgctgctgcagaggctgcaggaggagaaggaccgggacagagatgctgaccaggagagcaacatcagcggccccctggccggccgggccggccagagcaagatcagtgaccccggccctggccctggaggagtgggcggggcccccctgcccccacctggggcccccaggagctgcatccgcatccgggcccgcttccctgcccccccagcccccccagcccccccaccccggggccccaagaggaagctgtacagcgctgtgcccggcaggaagttcatcgctgtgaaggcccacagcccccagggcgagggggagatccccctgcacagaggagaggccgtgaaggtgctgagcattggagagggcggcttctgggagggcaccgtgaagggccgcacaggctggttccctgctgactgtgtggaggaggtgcagatgaggcagcacgacaccaggcctgagacccgggaggacaggaccaagaggctcttccgccactacacagtgggcagctatgacagcctgaccagccacagcgactatgtgattgatgacaaggtggccgtgctgcagaagagggaccacgagggcttcggctttgtgctgcggggggccaaggccgagacccccatcgaggagttcacccccaccccagccttccctgccctgcagtacctggagagcgtggatgtggagggcgtggcctggagggctggcctgaggactggagacttcctgattgaggtgaatggagtgaatgtggtgaaggtgggccacaagcaggtggtggccctgatccggcagggcggcaaccggctggtgatgaaggtggtgtctgtgaccaggaagccagaggaggatggagccaggagaagagcccctcctccacccaagagggcccccagcaccaccctgaccctgcggagcaagtccatgacagctgagctggaggagctggccagcatcagaagaaggaagggggagaagctggatgagatgctggccgctgctgctgagcccaccctgcggccagacattgctgatgctgacagcagagctgccaccgtgaagcagaggcccaccagccgccgcatcaccccagctgagatcagcagcctgtttgagcggcagggcctgcccggccctgagaagctgcccggcagcctgaggaagggcatccccaggaccaagtctgtgggagaagatgagaagctggccagcctgctggagggccgcttccccaggagcacctccatgcaggaccctgtgcgggagggccggggcatccccccaccaccccagacagcccctcctcctcctccagccccctactactttgacagcggccccccaccagccttcagccccccacctcctcctggccgggcctatgacacagtgcgcagcagcttcaagccaggcctggaggcccggctgggcgctggggccgccggcctgtatgagcctggagctgccctgggccccctgccctacccagagcggcagaagagggcccgctccatgatcatcctgcaggacagcgcccctgagagcggagatgccccccggcccccacctgctgccaccccacctgagcggcccaagaggcggccccggcccccaggccctgacagcccctatgccaacctgggcgccttcagcgccagcctgtttgcccccagcaagccccagaggaggaagagccccctggtgaagcagctgcaggtggaggatgcccaggagagagctgccctggccgtgggcagccctggccctgggggcggcagctttgcccgggagcccagccccacccaccggggccccaggcctgggggcctggactatggagctggagatggccctggcctggcctttggaggccctggccctgccaaggaccggcggctggaggagcggcggcgcagcacagtgttcctgtctgtgggcgccatcgagggcagcgcccctggagctgacctgcccagcctgcagcccagccgcagcattgatgagcggctgctgggcaccggccccacagctggccgggacctgctgctgcccagccctgtgtctgccctgaagcccctggtgtctggccccagcctgggccccagcggcagcaccttcatccaccccctgaccgggaagcccctggaccccagcagccccctggccctggccctggccgcccgggagcgggccctggccagccaggcccccagccgcagccccacccctgtgcacagcccagatgctgacaggcctggccccctgtttgtggatgtgcaggcccgggaccctgagcggggcagcctggccagccctgccttcagccccaggagccctgcctggatccctgtgcctgcccggcgggaggccgagaaggtgccccgggaggagaggaagagccctgaggacaagaagtccatgatcctgtctgtgctggacaccagcctgcagaggcctgctggcctcatcgtggtgcacgccaccagcaatggccaggagcccagccggctgggcggcgctgaggaggagcggcccggcaccccagagctggccccagcccccatgcagagcgctgctgtggccgagcccctgcccagcccccgggcccagcccccaggcggcaccccagcagatgctggccctggccagggcagcagcgaggaggagcctgagctggtgtttgctgtgaacctgcccccagcccagctgagcagcagtgatgaggagacccgggaggagctggcccgcatcggcctggtgcccccacctgaggagtttgccaatggagtgctgctggccacccccctggccggccctggccccagccccaccaccgtgcccagccctgccagcggcaagcccagcagcgagcccccaccagcccctgagagcgctgctgacagcggcgtggaggaggccgacaccaggagcagcagtgacccccacctggagaccaccagcaccatcagcacagtgtcctccatgagcaccctgagcagcgagagcggggagctgacagacacccacaccagctttgctgatggccacaccttcctgctggagaagccccctgtgccccccaagcccaagctgaagagccccctgggcaagggccctgtgaccttccgggaccccctgctgaagcagagcagtgacagcgagctgatggcccagcagcaccacgccgccagcgctggcctggccagcgctgctggccctgcccggccccgctacctgttccagaggaggagcaagctgtggggagaccctgtggagagccggggcctgcccggcccagaagatgacaagcccaccgtcatcagcgagctgagcagccggctgcagcagctgaacaaggacaccaggagcctgggggaggagcctgtgggcggcctgggcagcctgctggaccctgccaagaagagccccatcgctgctgcccggctcttcagcagcctgggggagctgagcagcatcagcgcccagaggagccctgggggccctgggggcggggccagctacagcgtgcggcccagcggccgctaccctgtggcccggcgggcccccagccctgtgaagccagccagcctggagcgggtggagggcctgggcgctggggccggcggggccggccggcccttcggcctgaccccacccaccatcctgaagagcagcagcctgagcatcccccatgagcccaaggaggtgcgctttgtggtgcgctctgtgtctgcccggagccgcagccccagccccagccccctgcccagccctgccagcggccctggccctggggcccctggcccccggcggcccttccagcagaagcccctgcagctgtggagcaagtttgatgtgggggactggctggagagcatccacctgggggagcaccgggacagatttgaggaccacgagattgagggcgcccacctgcctgccctgaccaaggatgactttgtggagctgggcgtgaccagggtgggccacaggatgaacatcgagcgggccctgcggcagctggatggcagctag

SEQ ID NO: 169551 - DNA, 5229 bp, Artificial Sequence
  Description of Artificial Sequence: Synthetic coding sequence
atggatggccctggggccagcgctgtggtggtgcgggtgggcatcccagacctgcagcagaccaagtgcctgcggctggaccctgctgcccctgtgtgggccgccaagcagagggtgctgtgtgccctgaaccacagcctgcaggatgccctgaactacggcctcttccagccccccagccggggccgggccggcaagttcctggatgaggagcggctgctgcaggagtacccacccaacctggacacccccctgccctacctggagttccgctacaagagaagagtgtatgcccagaacctgattgatgacaagcagtttgccaagctgcacaccaaggccaacctgaagaagttcatggactatgtgcagctgcacagcacagacaaggtggcccggctgctggacaagggcctggaccccaacttccatgaccctgacagcggggagtgccccctgagcctggccgcccagctggacaatgccacagacctgctgaaggtgctgaagaatggaggagcccacctggacttccgcaccagagatggcctgacagctgtgcactgtgccacccggcagagaaatgctgctgccctgaccaccctgctggacctgggcgccagcccagactacaaggacagccggggcctgacccccctgtaccacagcgccctgggcggcggagatgccctgtgctgtgagctgctgctgcatgaccacgcccagctgggcatcacagatgaaaatggctggcaggagatccaccaggcctgccgcttcggccacgtgcagcacctggagcacctgctcttctacggggctgacatgggcgcccagaatgccagcggcaacacagccctgcacatctgtgccctgtacaaccaggagagctgtgcccgggtgctgctcttccggggggccaacagagatgtgaggaactacaacagccagacagccttccaggtggccatcatcgccggcaactttgagctggccgaggtgatcaagacccacaaggacagtgatgtggtgcccttccgggagacccccagctatgccaagagaagaaggctggccggccccagcggcctggccagcccccggcccctgcagaggtctgccagtgacatcaacctgaagggggaggcccagcctgctgccagccctggccccagcctgcggagcctgccccaccagctgctgctgcagaggctgcaggaggagaaggaccgggacagagatgctgaccaggagagcaacatcagcggccccctggccggccgggccggccagagcaagatcagcgagcccggggcccccaggagctgcatccgcatccgggcccgcttccctgcccccccagcccccccagcccccccaccccggggccccaagaggaagctgtacagcgctgtgcccggcaggaagttcatcgctgtgaaggcccacagcccccagggcgagggggagatccccctgcacagaggagaggccgtgaaggtgctgagcatcggggagggcggcttctgggagggcaccgtgaagggccgcacaggctggttccctgctgactgtgtggaggaggtgcagatgaggcagcacgacaccaggcctgagacccgggaggacaggaccaagaggctcttccgccactacacagtgggcagctatgacagcctgaccagccacagcgactatgtgattgatgacaaggtggccgtgctgcagaagagggaccacgagggctttggatttgtgctgcggggggccaaggccgagacccccatcgaggagttcacccccaccccagccttccctgccctgcagtacctggagagcgtggatgtggagggcgtggcctggagggctggcctgaggactggagacttcctgattgaggtgaatggagtgaatgtggtgaaggtgggccacaagcaggtggtggccctgatccggcagggcggcaaccggctggtgatgaaggtggtgtctgtgaccaggaagccagaagaagatggagcccggcggcgggcccctcctccacccaagagggcccccagcaccaccctgaccctgcggagcaagtccatgacagctgagctggaggagctgggggagtggaggggccgggagggcagcgagaagctggatgagatgctggccgctgctgctgagcccaccctgcggccagacattgctgatgctgacagcagagctgccaccgtgaagcagaggcccaccagccgccgcatcaccccagctgagatcagcagcctgtttgagcggcagggcctgcccggccctgagaagctgcccggcagcctgaggaagggcatccccaggaccaagtctgtgggagaagatgagaagctggccagcctgctggagggccgcttccccaggagcacctccatgcaggaccctgtgcgggagggccggggcatccccccaccaccccagacagcccctcctcctcctccagccccctactactttgacagcggccccccaccagccttcagccccccacctcctcctggccgggcctatgacacagtgcgcagcagcttcaagccaggcctggaggcccggctgggcgctggggccgccggcctgtatgagcctggagctgccctgggccccctgccctacccagagcggcagaagagggcccgctccatgatcatcctgcaggacagcgcccctgagagcggagatgccccccggcccccacctgctgccaccccacctgagcggcccaagaggcggccccggcccccaggccctgacagcccctatgccaacctgggcgccttcagcgccagcctgtttgcccccagcaagccccagaggaggaagagccccctggtgaagcagctgcaggtggaggatgcccaggagagagctgccctggccgtgggcagccctggccctgggggcggcagctttgcccgggagcccagccccacccaccggggccccaggcctgggggcctggactatggagctggagatggccctggcctggcctttggaggccctggccctgccaaggaccggcggctggaggagcggcggcgcagcacagtgttcctgtctgtgggcgccatcgagggcagcgcccctggagctgacctgcccagcctgcagcccagccgcagcattgatgagcggctgctgggcaccggccccacagctggccgggacctgctgctgcccagccctgtgtctgccctgaagcccctggtgtctggccccagcctgggccccagcggcagcaccttcatccaccccctgaccgggaagcccctggaccccagcagccccctggccctggccctggccgcccgggagcgggccctggccagccaggcccccagccgcagccccacccctgtgcacagcccagatgctgacaggcctggccccctgtttgtggatgtgcaggcccgggaccctgagcggggcagcctggccagccctgccttcagccccaggagccctgcctggatccctgtgcctgcccggcgggaggccgagaaggtgccccgggaggagaggaagagccctgaggacaagaagtccatgatcctgtctgtgctggacaccagcctgcagaggcctgctggcctcatcgtggtgcacgccaccagcaatggccaggagcccagccggctgggcggcgctgaggaggagcggcccggcaccccagagctggccccagcccccatgcagagcgctgctgtggccgagcccctgcccagcccccgggcccagcccccaggcggcaccccagcagatgctggccctggccagggcagcagcgaggaggagcctgagctggtgtttgctgtgaacctgcccccagcccagctgagcagcagtgatgaggagacccgggaggagctggcccgcatcggcctggtgcccccacctgaggagtttgccaatggagtgctgctggccacccccctggccggccctggccccagccccaccaccgtgcccagccctgccagcggcaagcccagcagcgagcccccaccagcccctgagagcgctgctgacagcggcgtggaggaggccgacaccaggagcagcagtgacccccacctggagaccaccagcaccatcagcacagtgtcctccatgagcaccctgagcagcgagagcggggagctgacagacacccacaccagctttgctgatggccacaccttcctgctggagaagccccctgtgccccccaagcccaagctgaagagccccctgggcaagggccctgtgaccttccgggaccccctgctgaagcagagcagtgacagcgagctgatggcccagcagcaccacgccgccagcgctggcctggccagcgctgctggccctgcccggccccgctacctgttccagaggaggagcaagctgtggggagaccctgtggagagccggggcctgcccggcccagaagatgacaagcccaccgtcatcagcgagctgagcagccggctgcagcagctgaacaaggacaccaggagcctgggggaggagcctgtgggcggcctgggcagcctgctggaccctgccaagaagagccccatcgctgctgcccgctgccgcagccccatggtgggcctgcggctcttcagcagcctgggggagctgagcagcatcagcgcccagaggagccctgggggccctgggggcggggccagctacagcgtgcggcccagcggccgctaccctgtggcccggcgggcccccagccctgtgaagccagccagcctggagcgggtggagggcctgggcgctggggccggcggggccggccggcccttcggcctgaccccacccaccatcctgaagagcagcagcctgagcatcccccatgagcccaaggaggtgcgctttgtggtgcgctctgtgtctgcccggagccgcagccccagccccagccccctgcccagccctgccagcggccctggccctggggcccctggcccccggcggcccttccagcagaagcccctgcagctgtggagcaagtttgatgtgggggactggctggagagcatccacctgggggagcaccgggacagatttgaagatcatgaaattgaaggagcccacctgcctgccctgaccaaggatgactttgtggagctgggcgtgaccagggtgggccacaggatgaacatcgagcgggccctgcggcagctggatggcagctag

SEQ ID NO: 169552 - DNA, 2736 bp, Artificial Sequence
  Description of Artificial Sequence: Synthetic coding sequence
atgccaccccggcgcagcatcgtggaggtgaaggtgctggatgtgcagaagagaagagtgcccaacaagcactacgtgtacatcatccgggtgacctggagcagcggcagcacagaggccatctaccgccgctacagcaagttctttgacctgcagatgcagatgctggacaagttccccatggagggcggccagaaggaccccaagcagaggatcatccccttcctgcccgggaagatcctcttcagaagaagccacatcagagatgtggccgtgaagaggctcatccccattgatgagtactgcaaggccctgatccagctgcccccctacatcagccagtgtgatgaggtgctgcagttctttgagaccaggcctgaggacctgaacccccccaaggaggagcacatcggcaagaagaagagcggcggggaccagacctctgtggaccccatggtgctggagcagtatgtggtggtggccaactaccagaagcaggagagcagcgagatcagcctgtctgtgggccaggtggtggacatcatcgagaagaatgaaagtggctggtggtttgtgtccacagctgaggagcagggctgggtgcctgccacctgcctggagggccaggatggagtgcaggatgagttcagcctgcagcctgaggaggaggagaagtacaccgtcatctacccctacacagcccgggaccaggatgagatgaacctggagagaggagctgtggtggaggtgatccagaagaacctggagggctggtggaagatccgctaccagggcaaggagggctgggccccagccagctacctgaagaagaacagcggggagcccctgccccccaagccaggccctggcagccccagccaccctggggccctggacctggatggagtgtcccggcagcagaatgctgtgggccgggagaaggagctgctgagcagccagagagatggccgctttgagggccggcctgtgcctgatggagatgccaagcagaggagccccaagatgaggcagaggcctcctccaagaagagacatgaccatcccccggggcctgaacctgcccaagccacccatccccccccaggtggaggaggagtactacaccatcgccgagttccagaccaccatcccagatggcatctccttccaggccggcctgaaggtggaggtgattgagaagaacctgagcggctggtggtacatccagatcgaggacaaggagggctgggccccagccaccttcatcgacaagtacaagaagaccagcaatgccagccggcccaacttcctggcccccctgccccatgaggtgacccagctgcggctgggggaggccgccgccctggagaacaacacaggcagcgaggccaccggccccagccggcccctgcctgatgcccctcatggagtgatggacagcggcctgccctggagcaaggactggaagggcagcaaggatgtgctgaggaaggccagcagtgacatgtctgccagcgctggctatgaggagatcagtgaccctgacatggaggagaagcccagcctgccccccaggaaggagagcatcatcaagtctgagggggagctgctggagcgggagcgggagcggcagaggacagagcagctgcggggccccacccccaagcccccaggagtcatcctgcccatgatgcctgccaagcacatccccccagcccgggacagccggcggcctgagcccaagccagacaagagccgcctcttccagctgaagaatgacatgggcctggagtgtggccacaaggtgctggccaaggaggtgaagaagcccaacctgcggcccatcagcaagagcaagacagacctgcctgaggagaagccagatgccaccccccagaaccccttcctgaagagccggccccaggtgcggcccaagccagcccccagccccaagacagagcccccccagggcgaggaccaggtggacatctgcaacctgcggagcaagctgcggcctgccaagagccaggacaagagcctgctggatggagagggcccccaggccgtgggcggccaggatgtggccttcagccgctccttcctgcccggggagggccctggccgggcccaggacagaacaggcaagcaggacggcctgagccccaaggagatcagctgccgggccccacccaggcctgccaagaccacagatcctgtgtccaagtctgtgcctgtgcccctgcaggaggccccccagcagaggcctgtggtgcccccccggcggcccccaccacccaagaagaccagcagcagcagccggcccctgcctgaggtgcggggcccccagtgtgagggccacgagagccgggccgcccccaccccaggccgggccctgctggtgccccccaaggccaagcccttcctgagcaacagcctgggcggccaggatgacacccggggcaagggcagcctgggcccctggggcaccgggaagatcggggagaaccgggagaaggctgctgctgcctctgtgcccaatgctgatggcctgaaggacagcctgtatgtggccgtggccgactttgaaggagacaaggacaccagcagcttccaggagggcaccgtgtttgaggtgcgggagaagaacagcagcggctggtggttctgccaggtgctgagcggggcccccagctgggagggctggatccccagcaactacctgaggaagaagccctag

SEQ ID NO: 169553 - DNA, 2805 bp, Artificial Sequence
  Description of Artificial Sequence: Synthetic coding sequence
atggaggagatctggaagttcagcacctacctgaacctgggctacgtgtccatgtgcctggagcacctgctgtttgaccacaagtactggctgaactgcatcctggtggaggacacagagatccaggtgtctgtggatgacaagcacctggagaccatctacctgggcctgctgatccaggagggccacttcttctgccgggccctgtgcagcgtgaccccacctgctgagaaggagggagaatgtctgaccctgtgcaagaatgagctgatctctgtgaagatggccgaggccggcagcgagctggagggcgtgtccctggtgacaggccagaggggcctggtgctggtgtctgccctggagcccctgcccctgcccttccaccagtggttcctgaagaactacccaggcagctgtggcctgagcaggaagagggactggacaggcagctaccagatcggccggggccgctgcaaggccctgaccggctatgagcccggggagaaggatgagctgaacttctaccagggcgagagcattgagatcattggatttgtgattcctggcctgcagtggttcatcggcaagagcaccagcagcggccaggtgggctttgtgcccaccagaaatattgatcctgacagctacagccccatgagcagaaattctgccttcctgagtgatgaggagcgctgcagcctgctggccctgggcagtgacaagcagacagagtgcagcagcttcctgcacaccctggccaggacagacatcacctctgtgtaccgcctgagcggctttgagagcatccagaaccccccaaatgacctgagcgccagccagcctgagggcttcaaggaggtgcggcccggccgggcctgggaggagcaccaggccgtgggcagccggcagagcagcagcagcgaggacagcagcctggaggaggagctgctgagcgccaccagtgacagctaccgcctgcctgagccagatgacctggatgatcctgagctgctgatggacctgagcacaggccaggaggaggaggccgagaactttgcccccatcctggccttcctggaccacgagggctatgctgaccacttcaagagcctgtatgacttctccttctccttcctgaccagcagcttctacagcttctctgaagaagatgaatttgtggcctacctggaggccagcaggaagtgggccaagaagagccacatgacctgggcccacgcccggctgtgcttcctgctgggccgcctgagcatcaggaaggtgaagctgagccaggcccgggtgtactttgaggaggccatccacatcctgaatggagcctttgaggacctgagcctggtggccaccctgtacatcaacctggccgccatctacctgaagcagaggctgcggcacaagggcagcgccctgctggagaaggccggggccctgctggcctgcctgcctgaccgggagagcagcgccaagcatgagctggatgtggtggcctacgtgctgcggcagggcatcgtggtgggcagcagccccctggaggcccgggcctgcttcctggccatccggctgctgctgagcctgggcagacatgaggaggtgctgccctttgctgagcggctgcagctgctgagcggccaccccccagccagcgaggccgtggcctctgtgctgtccttcctgtatgacaagaagtacctgccccacctggccgtggcctctgtgcagcagcacggcatccagagcgcccagggcatgagcctgcccatctggcaggtgcacctggtgctgcagaacaccaccaagctgctgggcttccccagccctggctggggcgaggtgtctgccctggcctgccccatgctgcggcaggccctggccgcctgtgaggagctggccgacaggagcacccagagggccctgtgcctgatcctgagcaaggtgtacctggagcacaggagcccagatggagccatccactacctgagccaggccctggtgctgggccagctgctgggggagcaggagagctttgagagcagcctgtgcctggcctgggcctacctgctggccagccaggccaagaaggccctggatgtgctggagcccctgctgtgcagcctgaaggagacagagagcctgacccagaggggcgtcatctacaacctgctgggcctggccctgcagggcgagggccgggtgaacagagctgccaagagctacctgcgggccctgaacagagcccaggaggtgggagatgtgcacaaccaggccgtggccatggccaacctgggccacctgagcctgaagtcctgggcccagcacccagccaggaactacctgctgcaggccgtgcggctgtactgtgagctgcaggccagcaaggagacagacatggagctggtgcaggtgttcctgtggctggcccaggtgctggtgtctggccaccagctgacccacggcctgctgtgctatgagatggccctgctgtttggcctgcggcaccgccacctgaagagcaaatatgtgccctgctgctgggaggccatcgagaagtctgtgggcagcagcttcatccacttcctgagccaggtgatctccttcatgagcctgctgtgtgtgcaggtgtccttccggccccccaaccccagcgccatcagcacagccctgtgcccccagaccctgcggcatgccagccccaccatgagcacaggctggccctggctgagcaacagcggcaccggccgctggaagggcggctgctggagcccctggggcagcttcatcggcacctag

SEQ ID NO: 169554 - DNA, 453 bp, Artificial Sequence
  Description of Artificial Sequence: Synthetic coding sequence
atgtctgagcagatgatgcagagcgtgggctgccgcatcagcctgagcgtcttccagttcctgggggaccagaggcaggagctggtggccttccaccggctggccaccgtgtactacagcctgcacatgtatgagatggccgaggactgctacctgaagaccctgagcctgtgccccccctggctgcagagccccaaggaggccctgtactatgccaaggtgtactaccgcctgggccgcctgaccttctgccagctgaaggatgcccatgatgccacagagtacttcctgctggccctggccgctgctgtgctgctgggagatgaggagctgcaggacaccatccgcagccggctggacaacatctgccagagccccctgtggcacagccggcccagcggctgcagcagcgagcgggcccgctggctgagcggcggcggcctggccctgtag

SEQ ID NO: 169555 - DNA, 3867 bp, Artificial Sequence
  Description of Artificial Sequence: Synthetic coding sequence
atgggcggctgcttctgcatcccccgggagaggagcctgacccggggccctgggaaggagacccccagcaaggaccccaccgtgtccagtgaatgtattgccagcagcgagtacaaggagaagtgcttcctgccccagaacatcaacccagacctgaccctgtccttctgtgtgaagagccgcagcagaagatgtgtgaatggccccctgcaggaggccgcccggcggcggctgtgggccctggagaatgaagaccaggaggtgaggatgctgttcaaggacctgagcgcccggctggtgtccatccagagccagagggcccagttcctgatcaccttcaagaccatggaggagatctggaagttcagcacctacctgaacctgggctacgtgtccatgtgcctggagcacctgctgtttgaccacaagtactggctgaactgcatcctggtggaggacacagagatccaggtgtctgtggatgacaagcacctggagaccatctacctgggcctgctgatccaggagggccacttcttctgccgggccctgtgcagcgtgaccccacctgctgagaaggagggggagtgcctgaccctgtgcaagaatgaactcatctctgtgaagatggccgaggccggcagcgagctggagggcgtgtccctggtgacaggccagaggggcctggtgctggtgtctgccctggagcccctgcccctgcccttccaccagtggttcctgaagaactacccaggcagctgtggcctgagcaggaagagggactggacaggcagctaccagatcggccggggccgctgcaaggccctgaccggctatgagcctggagagaaggatgagctgaacttctaccagggcgagagcattgagatcatcggcttcgtcatccctggcctgcagtggttcatcggcaagagcaccagcagcggccaggtgggctttgtgcccaccaggaacatcgaccctgacagctacagccccatgagcaggaacagcgccttcctgagtgatgaggagcgctgcagcctgctggccctgggcagtgacaagcagacagaatgtagcagcttcctgcacaccctggccaggacagacatcacctctgtgtaccgcctgagcggctttgagagcatccagaaccccccaaatgacctgagcgccagccagcctgagggcttcaaggaggtgcggcccggccgggcctgggaggagcaccaggccgtgggcagccggcagagcagcagcagcgaggacagcagcctggaggaggagctgctgagcgccaccagtgacagctaccgcctgcctgagccagatgacctggatgatcctgagctgctgatggacctgagcacaggccaggaggaggaggctgaaaattttgcccccatcctggccttcctggaccacgagggctacgccgaccacttcaagagcctgtatgacttctccttctccttcctgaccagcagcttctacagcttcagcgaggaggatgaatttgtggcctacctggaggccagcaggaagtgggccaagaagagccacatgacctgggcccacgcccggctgtgcttcctgctgggccgcctgagcatcaggaaggtgaagctgagccaggcccgggtgtactttgaggaggccatccacatcctgaatggagcctttgaggacctgagcctggtggccaccctgtacatcaacctggccgccatctacctgaagcagaggctgcggcacaagggcagcgccctgctggagaaggccggggccctgctggcctgcctgcctgaccgggagagcagcgccaagcatgagctggatgtggtggcctacgtgctgcggcagggcatcgtggtgggcagcagccccctggaggcccgggcctgcttcctggccatccggctgctgctgagcctgggcagacatgaggaggtgctgccctttgctgagcggctgcagctgctgagcggccaccccccagccagcgaggccgtggcctctgtgctgtccttcctgtatgacaagaagtacctgccccacctggccgtggcctctgtgcagcagcacggcatccagagcgcccagggcatgagcctgcccatctggcaggtgcacctggtgctgcagaacaccaccaagctgctgggcttccccagccctggctggggcgaggtgtctgccctggcctgccccatgctgcggcaggccctggccgcctgtgaggagctggccgacaggagcacccagagggccctgtgcctgatcctgagcaaggtgtacctggagcacaggagcccagatggagccatccactacctgagccaggccctggtgctgggccagctgctgggggagcaggagagctttgagagcagcctgtgcctggcctgggcctacctgctggccagccaggccaagaaggccctggatgtgctggagcccctgctgtgcagcctgaaggagacagagagcctgacccagaggggcgtcatctacaacctgctgggcctggccctgcagggcgagggccgggtgaacagagctgccaagagctacctgcgggccctgaacagagcccaggaggtgggagatgtgcacaaccaggccgtggccatggccaacctgggccacctgagcctgaagtcctgggcccagcacccagccaggaactacctgctgcaggccgtgcggctgtactgtgagctgcaggccagcaaggagacagacatggagctggtgcaggtgttcctgtggctggcccaggtgctggtgtctggccaccagctgacccacggcctgctgtgctatgagatggccctgctgtttggcctgcggcaccgccacctgaagagccagctgcaggccaccaagagcctgtgccacttctacagctctgtgagccccaaccctgaggcctgcatcacctaccacgagcactggctggccctggcccagcagctgcgggaccgggagatggagggccgcctgctggagagcctgggccagctgtacagaaacctgaacacagcccggagcctgcggcgcagcctgacctgcatcaaggagagcctgcgcatcttcatcgacctgggggagacagacaaggctgctgaggcctggctgggcgccggccgcctgcactacctgatgcaggaggatgagctggtggagctgtgcctgcaggccgccatccagacagccctgaagtctgaggagcccctgctggccctgaagctgtatgaggaggccggagatgtgttcttcaacggcaccaggcaccgccaccacgctgtggagtactaccgggccggggctgtgcccctggcccggcggctgaaggctgtgaggacagagctgcgcatcttcaacaagctgacagagctgcagatcagcctggagggctatgagaaggccctggagtttgccaccctggccgcccggctgagcacagtgactggagaccagaggcaggagctggtggccttccaccggctggccaccgtgtactacagcctgcacatgtatgagatggccgaggactgctacctgaagaccctgagcctgtgccccccctggctgcagagccccaaggaggccctgtactatgccaaggtgtactaccgcctgggccgcctgaccttctgccagctgaaggatgcccatgatgccacagagtacttcctgctggccctggccgctgctgtgctgctgggagatgaggagctgcaggacaccatccgcagccggctggacaacatctgccagagccccctgtggcacagccggcccagcggctgcagcagcgagcgggcccgctggctgagcggcggcggcctggccctgtag

SEQ ID NO: 169556 - DNA, 2181 bp, Artificial Sequence
  Description of Artificial Sequence: Synthetic coding sequence
atggacctgagcacaggccaggaggaggaggccgagaactttgcccccatcctggccttcctggaccacgagggctatgctgaccacttcaagagcctgtatgacttctccttctccttcctgaccagcagcttctacagcttctctgaagaagatgaatttgtggcctacctggaggccagcaggaagtgggccaagaagagccacatgacctgggcccacgcccggctgtgcttcctgctgggccgcctgagcatcaggaaggtgaagctgagccaggcccgggtgtactttgaggaggccatccacatcctgaatggagcctttgaggacctgagcctggtggccaccctgtacatcaacctggccgccatctacctgaagcagaggctgcggcacaagggcagcgccctgctggagaaggccggggccctgctggcctgcctgcctgaccgggagagcagcgccaagcatgagctggatgtggtggcctacgtgctgcggcagggcatcgtggtgggcagcagccccctggaggcccgggcctgcttcctggccatccggctgctgctgagcctgggcagacatgaggaggtgctgccctttgctgagcggctgcagctgctgagcggccaccccccagccagcgaggccgtggcctctgtgctgtccttcctgtatgacaagaagtacctgccccacctggccgtggcctctgtgcagcagcacggcatccagagcgcccagggcatgagcctgcccatctggcaggtgcacctggtgctgcagaacaccaccaagctgctgggcttccccagccctggctggggcgaggtgtctgccctggcctgccccatgctgcggcaggccctggccgcctgtgaggagctggccgacaggagcacccagagggccctgtgcctgatcctgagcaaggtgtacctggagcacaggagcccagatggagccatccactacctgagccaggccctggtgctgggccagctgctgggggagcaggagagctttgagagcagcctgtgcctggcctgggcctacctgctggccagccaggccaagaaggccctggatgtgctggagcccctgctgtgcagcctgaaggagacagagagcctgacccagaggggcgtcatctacaacctgctgggcctggccctgcagggcgagggccgggtgaacagagctgccaagagctacctgcgggccctgaacagagcccaggaggtgggagatgtgcacaaccaggccgtggccatggccaacctgggccacctgagcctgaagtcctgggcccagcacccagccaggaactacctgctgcaggccgtgcggctgtactgtgagctgcaggccagcaaggagacagacatggagctggtgcaggtgttcctgtggctggcccaggtgctggtgtctggccaccagctgacccacggcctgctgtgctatgagatggccctgctgtttggcctgcggcaccgccacctgaagagccagctgcaggccaccaagagcctgtgccacttctacagctctgtgagccccaaccctgaggcctgcatcacctaccacgagcactggctggccctggcccagcagctgcgggaccgggagatggagggccgcctgctggagagcctgggccagctgtacagaaacctgaacacagcccggagcctgcggcgcagcctgacctgcatcaaggagagcctgcgcatcttcatcgacctgggggagacagacaaggctgctgaggcctggctgggcgccggccgcctgcactacctgatgcaggaggatgagctggtggagctgtgcctgcaggccgccatccagacagccctgaagtctgaggagcccctgctggccctgaagctgtatgaggaggccggagatgtgttcttcaacggcaccaggcaccgccaccacgctgtggagtactacagagctggagctgtgcccctggcccggcggctgaaggctgtgaggacagagctgcgcatcttcaacaagctgacagagctgcagatcagcctggagggctatgagaaggccctggagtttgccaccctggccgcccggctgagcacagtgacagaggcccgggccggcggcctgagccccccaggctacagcgtgctgctgcctgcccacgtgtag

SEQ ID NO: 169557 - DNA, 720 bp, Artificial Sequence
  Description of Artificial Sequence: Synthetic coding sequence
atgcccctgctgctgctgggggagacagagcccctgaagctggagcgggactgccgcagccctgtggacccctgggccgccgccagcccagacctggccctggcctgcctgtgccactgccaggacctgagcagcggggccttcccagaccggggcgtgctgggcggcgtgctcttccccaccgtggagatggtgatcaaggtgtttgtggccaccagcagcggcagcatcgccatcaggaagaagcagcaggaggtggtgggcttcctggaggccaacaagattgacttcaaggagctggacattgctggagatgaggacaacagacgctggatgagagaaaatgtgcctggagagaagaagccccagaatggcatccccctgcccccccagatcttcaatgaggagcagtactgtggggactttgacagcttcttcagcgccaaggaggagaacatcatctacagcttcctgggcctggcccctcctccagacagcaaaggaagtgagaaggccgaggagggcggggagacagaggcccagaaggagggctctgaagatgtgggcaacctgcctgaggcccaggagaagaatgaggaggagggggagacagccacagaggagacagaggagatcgccatggagggcgctgagggggaggccgaggaggaggaggagacagctgagggggaggagcctggagaagatgaggacagctag

SEQ ID NO: 169558 - DNA, 387 bp, Artificial Sequence
  Description of Artificial Sequence: Synthetic coding sequence
atgagagaaaatgtgcctggagagaagaagccccagaatggcatccccctgcccccccagatcttcaatgaggagcagtactgtggggactttgacagcttcttcagcgccaaggaggagaacatcatctacagcttcctgggcctggcccctcctccagacagcaagggcagcgagaaggccgaggagggcggggagacagaggcccagaaggagggctctgaagatgtgggcaacctgcctgaggcccaggagaagaatgaggaggagggggagacagccacagaggagacagaggagatcgccatggagggcgctgagggggaggccgaggaggaggaggagacagctgagggggaggagcccggggaggatgaggacagctag

SEQ ID NO: 169559 - DNA, 387 bp, Artificial Sequence; identical to SEQ ID NO: 169558
  Description of Artificial Sequence: Synthetic coding sequence

SEQ ID NO: 169560 - DNA, 387 bp, Artificial Sequence; identical to SEQ ID NO: 169558
  Description of Artificial Sequence: Synthetic coding sequence

SEQ ID NO: 169561 - DNA, 321 bp, Artificial Sequence
  Description of Artificial Sequence: Synthetic coding sequence
atgagagaaaatgtgcctggagagaagaagccccagaatggcatccccctgcccccccagatcttcaatgaggagcagtactgtggggactttgacagcttcttcagcgccaaggaggagaacatcatctacagcttcctgggcctggcccctcctccagacagcaagggcagcgagaaggccgaggagggcggggagacagaggcccagaaggagggctctgaagatgtgggcaacctgcctgaggcccaggagaagaatgaggaggagggggagacagccacagaggagacagaggagatcgccatggagggcgcctag

SEQ ID NO: 169562 - DNA, 2373 bp, Artificial Sequence
  Description of Artificial Sequence: Synthetic coding sequence
atgaacatcatgaacacagagcagagccagaacagcatcgtgagccgcatcaaggtgtttgagggccagaccaacatcgagaccagcggcctgcccaagaagccagagatcacccccaggagcctgccccccaagcccaccgtgagcagcggcaagcccagcgtggcccccaagccagctgccaacagagccagcggggagtgggacagcggcacagaaaatcggctgaaggtgaccagcaaggagggcctgaccccctacccacccctgcaggaggccggcagcatccctgtgaccaagccagagctgcccaagaagcccaaccctggcctcatccgctctgtgaaccctgagatccctggccggggccccctggccgagagcagtgacagcggcaagaaggtgcccaccccagccccccggcccctgctgctgaagaagtctgtgtcctctgagaaccccacctaccccagcgcccccctgaagcctgtgacagtgcccccccggctggccggggccagccaggccaaggcctacaagagcctgggggagggccccccagccaacccccctgtgcctgtgctgcagagcaagcccctggtggacatcgacctgatcagctttgatgatgatgtgctgcccaccccatctggcaacctggccgaggagagcgtgggcagcgagatggtgctggaccccttccagctgcctgccaagacagagcccatcaaggagagagctgtgcagcctgcccccaccaggaagcccaccgtcatccgcatcccagccaagccaggcaagtgcctgcacgaggacccccagagccccccacccctgcctgctgagaagcccatcggcaacaccttcagcacagtgtctgggaagctgagcaatgtggagaggaccaggaacctggagagcaaccaccctggccagacaggaggctttgtgcgggtgcccccccggctgccccccaggcctgtgaatggcaagaccatccccacccagcagccccccaccaaggtgcccccagagaggcctcctccacccaagctgagcgccacccggcgcagcaacaagaagctgcccttcaacagaagcagcagtgacatggacctgcagaagaagcagagcaacctggccaccggcctgagcaaggccaagagccaggtgttcaagaaccaggaccctgtgctgcccccccggcccaagccaggccaccccctgtacagcaagtacatgctgtctgtgccccatggaattgccaatgaagacatcgtgtcccagaaccctggagagctgagctgcaagagaggagatgtgctggtgatgctgaagcagacagagaacaactacctggagtgccagaagggggaggacaccggccgggtgcacctgagccagatgaagatcatcacccccctggatgagcacctgcggagccggcccaatgaccccagccacgcccagaagcctgtggacagcggggcccctcatgctgtggtgctgcatgacttccctgctgagcaggtggatgacctgaacctgaccagcggggagatcgtgtacctgctggagaagattgacacagactggtaccggggcaactgcaggaaccagatcggcatcttccctgccaactacgtgaaggtgatcatcgacatccctgagggcggcaatggcaagcgggagtgtgtgagcagccactgtgtgaagggcagccgctgtgtggccaggtttgagtacatcggggagcagaaggatgagctgtccttcagcgagggggagatcatcatcctgaaggagtatgtgaatgaggagtgggcccggggggaggtgcggggccgcacaggcatcttccccctgaactttgtggagcctgtggaggactaccccaccagcggggccaacgtgctgagcaccaaggtgcccctgaagaccaagaaggaggacagcggcagcaacagccaggtgaacagcctgcctgctgagtggtgtgaggccctgcacagcttcaccgctgagaccagtgatgacctgtccttcaagagaggagaccgcatccagatcctggagcggctggacagcgactggtgccggggccgcctgcaggaccgggagggcatcttccctgctgtgtttgtgcggccctgcccagctgaggccaagtccatgctggccatcgtgcccaagggcaggaaggccaaggccctgtatgacttccggggggagaatgaagatgagctgtccttcaaggccggggacatcatcacagagctggagagcgtggatgatgactggatgtctggagagctgatgggcaagagcggcatcttccccaagaactacatccagttcctgcagatctcctag

SEQ ID NO: 169563 - DNA, 2373 bp, Artificial Sequence; identical to SEQ ID NO: 169562
  Description of Artificial Sequence: Synthetic coding sequence

SEQ ID NO: 169564 - DNA, 2304 bp, Artificial Sequence
  Description of Artificial Sequence: Synthetic coding sequence
atgaacatcatgaacacagagcagagccagaacagcatcgtgagccgcatcaaggtgtttgagggccagaccaacatcgagaccagcggcctgcccaagaagccagagatcacccccaggagcctgccccccaagcccaccgtgagcagcggcaagcccagcgtggcccccaagccagctgccaacagagccagcggggagtgggacagcggcacagaaaatcggctgaaggtgaccagcaaggagggcctgaccccctacccacccctgcaggaggccggcagcatccctgtgaccaagccagagctgcccaagaagcccaaccctggcctcatccgctctgtgaaccctgagatccctggccggggccccctggccgagagcagtgacagcggcaagaaggtgcccaccccagccccccggcccctgctgctgaagaagtctgtgtcctctgagaaccccacctaccccagcgcccccctgaagcctgtgacagtgcccccccggctggccggggccagccaggccaaggcctacaagagcctgggggagggccccccagccaacccccctgtgcctgtgctgcagagcaagcccctggtggacatcgacctgatcagctttgatgatgatgtgctgcccaccccatctggcaacctggccgaggagagcgtgggcagcgagatggtgctggaccccttccagctgcctgccaagacagagcccatcaaggagagagctgtgcagcctgcccccaccaggaagcccaccgtcatccgcatcccagccaagccaggcaagtgcctgcacgaggacccccagagccccccacccctgcctgctgagaagcccatcggcaacaccttcagcacagtgtctgggaagctgagcaatgtggagaggaccaggaacctggagagcaaccaccctggccagacaggaggctttgtgcgggtgcccccccggctgccccccaggcctgtgaatggcaagaccatccccacccagcagccccccaccaaggtgcccccagagaggcctcctccacccaagctgagcgccacccggcgcagcaacaagaagctgcccttcaacagaagcagcagtgacatggacctgcagaagaagcagagcaacctggccaccggcctgagcaaggccaagagccaggtgttcaagaaccaggaccctgtgctgcccccccggcccaagccaggccaccccctgtacagcaagtacatgagaggagatgtgctggtgatgctgaagcagacagagaacaactacctggagtgccagaagggggaggacaccggccgggtgcacctgagccagatgaagatcatcacccccctggatgagcacctgcggagccggcccaatgaccccagccacgcccagaagcctgtggacagcggggcccctcatgctgtggtgctgcatgacttccctgctgagcaggtggatgacctgaacctgaccagcggggagatcgtgtacctgctggagaagattgacacagactggtaccggggcaactgcaggaaccagatcggcatcttccctgccaactacgtgaaggtgatcatcgacatccctgagggcggcaatggcaagagagaatgtgtgagcagccactgtgtgaagggcagccgctgtgtggccaggtttgagtacatcggggagcagaaggatgagctgtccttcagcgagggggagatcatcatcctgaaggagtatgtgaatgaggagtgggcccggggggaggtgcggggccgcacaggcatcttccccctgaactttgtggagcctgtggaggactaccccaccagcggggccaacgtgctgagcaccaaggtgcccctgaagaccaagaaggaggacagcggcagcaacagccaggtgaacagcctgcctgctgagtggtgtgaggccctgcacagcttcaccgctgagaccagtgatgacctgtccttcaagagaggagaccgcatccagatcctggagcggctggacagcgactggtgccggggccgcctgcaggaccgggagggcatcttccctgctgtgtttgtgcggccctgcccagctgaggccaagtccatgctggccatcgtgcccaagggcaggaaggccaaggccctgtatgacttcagaggagaaaatgaagatgagctgtccttcaaggccggggacatcatcacagagctggagagcgtggatgatgactggatgtctggagagctgatgggcaagagcggcatcttccccaagaactacatccagttcctgcagatctcctag

SEQ ID NO: 169565 - DNA, 2196 bp, Artificial Sequence
  Description of Artificial Sequence: Synthetic coding sequence
atgaacatcatgaacacagagcagagccagaacagcatcgtgagccgcatcaaggtgtttgagggccagaccaacatcgagaccagcggcctgcccaagaagccagagatcacccccaggagcctgccccccaagcccaccgtgagcagcggcaagcccagcgtggcccccaagccagctgccaacagagccagcggggagtgggacagcggcacagaaaatcggctgaaggtgaccagcaaggagggcctgaccccctacccacccctgcaggaggccggcagcatccctgtgaccaagccagagctgcccaagaagcccaaccctggcctcatccgctctgtgaaccctgagatccctggccggggccccctggccgagagcagtgacagcggcaagaaggtgcccaccccagccccccggcccctgctgctgaagaagtctgtgtcctctgagaaccccacctaccccagcgcccccctgaagcctgtgacagtgcccccccggctggccggggccagccaggccaaggcctacaagagcctgggggagggccccccagccaacccccctgtgcctgtgctgcagagcaagcccctggtggacatcgacctgatcagctttgatgatgatgtgctgcccaccccatctggcaacctggccgaggagagcgtgggcagcgagatggtgctgggcctgcacgaggacccccagagccccccacccctgcctgctgagaagcccatcggcaacaccttcagcacagtgtctgggaagctgagcaatgtggagaggaccaggaacctggagagcaaccaccctggccagacaggaggctttgtgcgggtgcccccccggctgccccccaggcctgtgaatggcaagaccatccccacccagcagccccccaccaaggtgcccccagagaggcctcctccacccaagctgagcgccacccggcgcagcaacaagaagctgcccttcaacagaagcagcagtgacatggacctgcagaagaagcagagcaacctggccaccggcctgagcaaggccaagagccaggtgttcaagaaccaggaccctgtgctgcccccccggcccaagccaggccaccccctgtacagcaagtacatgagaggagatgtgctggtgatgctgaagcagacagagaacaactacctggagtgccagaagggggaggacaccggccgggtgcacctgagccagatgaagatcatcacccccctggatgagcacctgcggagccggcccaatgaccccagccacgcccagaagcctgtggacagcggggcccctcatgctgtggtgctgcatgacttccctgctgagcaggtggatgacctgaacctgaccagcggggagatcgtgtacctgctggagaagattgacacagactggtaccggggcaactgcaggaaccagatcggcatcttccctgccaactacgtgaaggtgatcatcgacatccctgagggcggcaatggcaagagagaatgtgtgagcagccactgtgtgaagggcagccgctgtgtggccaggtttgagtacatcggggagcagaaggatgagctgtccttcagcgagggggagatcatcatcctgaaggagtatgtgaatgaggagtgggcccggggggaggtgcggggccgcacaggcatcttccccctgaactttgtggagcctgtggaggactaccccaccagcggggccaacgtgctgagcaccaaggtgcccctgaagaccaagaaggaggacagcggcagcaacagccaggtgaacagcctgcctgctgagtggtgtgaggccctgcacagcttcaccgctgagaccagtgatgacctgtccttcaagagaggagaccgcatccagatcctggagcggctggacagcgactggtgccggggccgcctgcaggaccgggagggcatcttccctgctgtgtttgtgcggccctgcccagctgaggccaagtccatgctggccatcgtgcccaagggcaggaaggccaaggccctgtatgacttcagaggagaaaatgaagatgagctgtccttcaaggccggggacatcatcacagagctggagagcgtggatgatgactggatgtctggagagctgatgggcaagagcggcatcttccccaagaactacatccagttcctgcagatctcctag

SEQ ID NO: 169566 - DNA, 2196 bp, Artificial Sequence; identical to SEQ ID NO: 169565
  Description of Artificial Sequence: Synthetic coding sequence

SEQ ID NO: 169567 - DNA, 2304 bp, Artificial Sequence; identical to SEQ ID NO: 169564
  Description of Artificial Sequence: Synthetic coding sequence

SEQ ID NO: 169568 - DNA, 2304 bp, Artificial Sequence; identical to SEQ ID NO: 169564
  Description of Artificial Sequence: Synthetic coding sequence

SEQ ID NO: 169569 - DNA, 2190 bp, Artificial Sequence
  Description of Artificial Sequence: Synthetic coding sequence
atggatgacctgaccctgctggacctgctggagtgccctgtgtgctttgagaagctggatgtgacagccaaggtgctgccctgccagcacaccttctgcaagccctgcctgcagagggtcttcaaggcccacaaggagctgcgctgcccagaatgtaggacccctgtgttcagcaacatcgaggccctgcctgccaacctgctgctggtgcggctgctggatggagtgcgcagcggccagagcagcggccggggcggcagcttcagaagacctggcaccatgaccctgcaggacggcaggaagagcaggaccaacccccggcggctgcaggccagccccttccggctggtgcccaacgtgcgcatccacatggatggagtgccccgggccaaggccctgtgcaactaccggggccagaaccctggggacctgcgcttcaacaagggggacatcatcctgctgcggcggcagctggatgagaactggtaccagggcgagatcaatggcatcagcggcaacttccctgccagctctgtggaggtgatcaagcagctgccccagcccccacccctgtgccgggccctgtacaactttgacctgcggggcaaggacaagtctgagaaccaggactgcctgaccttcctgaaggatgacatcatcaccgtcatcagccgggtggatgagaactgggccgagggcaagctgggggacaaggtgggcatcttccccatcctgtttgtggagcccaacctgacagcccggcacctgctggagaagaacaagggccggcagagcagcaggaccaagaacctgagcctggtgagcagcagcagccggggcaacaccagcaccctgcggcggggccctggcagcaggaggaaggtgcccggccagttcagcatcaccacagccctgaacaccctgaacaggatggtgcacagccccagcggccgccacatggtggagatcagcacccctgtgctgatcagcagcagcaaccccagcgtcatcacccagcccatggagaaggcagatgtgcccagcagctgtgtgggccaggtgtccacctaccacccagcccctgtgtccccaggccacagcacagctgtggtgtccctgcccggcagccagcagcacctgagcgccaacatgtttgtggccctgcacagctacagcgcccacggcccagatgagctggacctgcagaagggggagggcgtgcgggtgctgggcaagtgccaggacggctggctgcggggcgtgtccctggtgacaggccgggtgggcatcttccccaacaactacgtgatccccatcttcaggaagaccagcagcttcccagacagccgcagccctggcctgtacaccacctggaccctgagcaccagctctgtgagcagccagggcagcatcagcgagggggacccccggcagagccggcccttcaagtctgtgtttgtgcccacagccatcgtgaaccctgtgcgcagcacagctggccctggcaccctgggccagggcagcctgaggaagggccgcagctccatgaggaagaatggcagcctgcagaggcccctgcagagcggcatccccaccctggtggtgggcagcctgcggcgcagccccaccatggtgctgcggccccagcagttccagttctaccagccccagggcatccccagcagccccagcgctgtggtggtggagatgggcagcaagccagccctgactggagagcccgccctgacctgcatcagccggggcagcgaggcctggatccacagcgctgccagcagcctcatcatggaggacaaggagatccccatcaagtctgagcccctgcccaagcccccagccagcgccccacccagcatcctggtgaagccagagaacagcagaaatggcatcgagaagcaggtgaagacagtgcgcttccagaactacagccccccacccaccaagcactacaccagccaccccaccagcggcaagccagagcagcctgccaccctgaaggccagccagcctgaggccgccagcctgggccctgagatgacagtgctgtttgcccacaggagcggctgccacagcggccagcagacagacctgcggaggaagagcgccctgggcaaggccaccaccctggtgtccacagccagcggcacccagaccgtcttccccagcaagtag

SEQ ID NO: 169570 - DNA, 2190 bp, Artificial Sequence; identical to SEQ ID NO: 169569
  Description of Artificial Sequence: Synthetic coding sequence

SEQ ID NO: 169571 - DNA, 387 bp, Artificial Sequence
  Description of Artificial Sequence: Synthetic coding sequence
atggaggacaaggagatccccatcaagtctgagcccctgcccaagcccccagccagcgcccctccttccatcctggtgaagccagagaacagcagaaatggaattgagaagcaggtgaagacagtgcgcttccagaactacagccccccacccaccaagcactacaccagccaccccaccagcggcaagccagagcagcctgccaccctgaaggccagccagcctgaggccgccagcctgggccctgagatgacagtgctgtttgcccacaggagcggctgccacagcggccagcagacagacctgcggaggaagagcgccctgggcaaggccaccaccctggtgtccacagccagcggcacccagacagtgttccccagcaagtag

SEQ ID NO: 169572 - DNA, 1686 bp, Artificial Sequence
  Description of Artificial Sequence: Synthetic coding sequence
atggctgctgaggagatgcactggcctgtgcccatgaaggccatcggggcccagaacctgctgaccatgcctgggggcgtggccaaggccggctacctgcacaagaagggcggcacccagctgcagctgctgaagtggcccctgcgcttcgtcatcatccacaagagatgtgtgtactacttcaagagcagcaccagcgccagcccccagggcgccttcagcctgagcggctacaacagagtgatgagagctgctgaggagaccaccagcaacaacgtgttccccttcaagatcatccacatcagcaagaagcacaggacctggttcttcagcgccagcagcgaggaggagaggaagtcctggatggccctgctgcggcgggagatcggccacttccacgagaagaaggacctgcccctggacaccagtgacagcagcagtgacacagacagcttctatggagctgtggagaggcctgtggacatcagcctgagcccctaccccacagacaatgaagattatgaacatgatgatgaagatgacagctacctggagccagacagccctgagcccggccgcctggaggatgccctgatgcaccccccagcctacccacctcctcctgtgcccacccccaggaagccagccttcagtgacatgccccgggcccacagcttcaccagcaaaggacctggccccctgctgcccccacctccacccaagcacggcctgcctgatgtgggcctggccgctgaggacagcaagagggaccccctgtgcccccggcgggcagagccctgcccccgggtgcctgccacccccaggaggatgtctgacccccccctgagcaccatgcccacagcccctggcctgaggaagccaccctgcttccgggagagcgccagccccagccctgagccctggaccccaggccacggggcctgcagcaccagcagcgctgccatcatggccacagccaccagcaggaactgtgacaagctgaagagcttccacctgagcccccggggcccccccaccagcgagcccccacctgtgcctgccaacaagcccaagttcctgaagattgctgaagaagatcctccccgggaggccgccatgcctggcctgtttgtgccccctgtggccccccggcccccagccctgaagctgcctgtgcctgaggccatggcccggcctgctgtgctgcccaggcctgagaagccccagctgccccacctgcagaggagccccccagatggccagagcttccgctccttctcctttgagaagccccggcagcccagccaggccgacacaggaggagatgacagtgatgaggactatgagaaggtgcccctgcccaacagcgtgtttgtgaacaccacagagagctgtgaggtggagcggctcttcaaggccaccagccccagaggagagccccaggacggcctgtactgcatccggaacagcagcaccaagagcggcaaggtgctggtggtgtgggatgagaccagcaacaaggtgaggaactaccgcatctttgagaaggacagcaagttctacctggagggggaggtgctgtttgtgtctgtgggctccatggtggagcactaccacacccacgtgctgcccagccaccagagcctgctgctgcggcacccctacggctacacaggccccaggtag

SEQ ID NO: 169573 - DNA, 294 bp, Artificial Sequence
  Description of Artificial Sequence: Synthetic coding sequence
atggctgctgaggagatgcactggcctgtgcccatgaaggccatcggggcccagaacctgctgaccatgcctgggggcgtggccaaggccggctacctgcacaagaagggcggcacccagctgcagctgctgaagtggcccctgcgcttcgtcatcatccacaagagatgtgtgtactacttcaagagcagcaccagcgccagcccccagggcgccttcagcctgagcggctacaaccggcagccccggccccagcctgcccaggccctgagccagacagaagctggcccctag

SEQ ID NO: 169574 - DNA, 1686 bp, Artificial Sequence; identical to SEQ ID NO: 169572
  Description of Artificial Sequence: Synthetic coding sequence

SEQ ID NO: 169575 - DNA, 1770 bp, Artificial Sequence
  Description of Artificial Sequence: Synthetic coding sequence
atggccagcctgggccccaggaccccagcccccagccgcagccggggcagaagagccatgtgctgggtgtccaccatctccttcatggctgctgaggagatgcactggcctgtgcccatgaaggccatcggggcccagaacctgctgaccatgcctgggggcgtggccaaggccggctacctgcacaagaagggcggcacccagctgcagctgctgaagtggcccctgcgcttcgtcatcatccacaagagatgtgtgtactacttcaagagcagcaccagcgccagcccccagggcgccttcagcctgagcggctacaacagagtgatgagagctgctgaggagaccaccagcaacaacgtgttccccttcaagatcatccacatcagcaagaagcacaggacctggttcttcagcgccagcagcgaggaggagaggaagtcctggatggccctgctgcggcgggagatcggccacttccacgagaagaaggacctgcccctggacaccagtgacagcagcagtgacacagacagcttctatggagctgtggagaggcctgtggacatcagcctgagcccctaccccacagacaatgaagattatgaacatgatgatgaagatgacagctacctggagccagacagccctgagcccggccgcctggaggatgccctgatgcaccccccagcctacccacctcctcctgtgcccacccccaggaagccagccttcagtgacatgccccgggcccacagcttcaccagcaaaggacctggccccctgctgcccccacctccacccaagcacggcctgcctgatgtgggcctggccgctgaggacagcaagagggaccccctgtgcccccggcgggcagagccctgcccccgggtgcctgccacccccaggaggatgtctgacccccccctgagcaccatgcccacagcccctggcctgaggaagccaccctgcttccgggagagcgccagccccagccctgagccctggaccccaggccacggggcctgcagcaccagcagcgctgccatcatggccacagccaccagcaggaactgtgacaagctgaagagcttccacctgagcccccggggcccccccaccagcgagcccccacctgtgcctgccaacaagcccaagttcctgaagattgctgaagaagatcctccccgggaggccgccatgcctggcctgtttgtgccccctgtggccccccggcccccagccctgaagctgcctgtgcctgaggccatggcccggcctgctgtgctgcccaggcctgagaagccccagctgccccacctgcagaggagccccccagatggccagagcttccgctccttctcctttgagaagccccggcagcccagccaggccgacacaggaggagatgacagtgatgaggactatgagaaggtgcccctgcccaacagcgtgtttgtgaacaccacagagagctgtgaggtggagcggctcttcaaggccaccagccccagaggagagccccaggacggcctgtactgcatccggaacagcagcaccaagagcggcaaggtgctggtggtgtgggatgagaccagcaacaaggtgaggaactaccgcatctttgagaaggacagcaagttctacctggagggggaggtgctgtttgtgtctgtgggctccatggtggagcactaccacacccacgtgctgcccagccaccagagcctgctgctgcggcacccctacggctacacaggccccaggtag

SEQ ID NO: 169576 - DNA, 1686 bp, Artificial Sequence; identical to SEQ ID NO: 169572
  Description of Artificial Sequence: Synthetic coding sequence

SEQ ID NO: 169577 - DNA, 429 bp, Artificial Sequence
  Description of Artificial Sequence: Synthetic coding sequence
atggctgctgaggagatgcactggcctgtgcccatgaaggccatcggggcccagaacctgctgaccatgcctgggggcgtggccaaggccggctacctgcacaagaagggcggcacccagctgcagctgctgaagtggcccctgcgcttcgtcatcatccacaagagatgtgtgtactacttcaagagcagcaccagcgccagcccccagggcgccttcagcctgagcggctacaacagagtgatgagagctgctgaggagaccaccagcaacaacgtgttccccttcaagatcatccacatcagcaagaagcacaggacctggttcttcagcgccagcagcgaggaggagaggaagtcctggatggccctgctgcggcgggagatcggccacttccacgagaagaaggacctgcccctggacacctag

SEQ ID NO: 169578 - DNA, 429 bp, Artificial Sequence; identical to SEQ ID NO: 169577
  Description of Artificial Sequence: Synthetic coding sequence

SEQ ID NO: 169579 - DNA, 1857 bp, Artificial Sequence
  Description of Artificial Sequence: Synthetic coding sequence
atggccggcagcggcccccggcccaggtcctggggcagaagagaggccggggccagagatgaggccgctgctgctgggggccggggccctggcccctgccgctgcagccagggcagaagagcctggatcgcccctgggaagccagccatgcctgctgcctggacccccttcatggctgctgaggagatgcactggcctgtgcccatgaaggccatcggggcccagaacctgctgaccatgcctggaggagtggccaaggccggctacctgcacaagaagggcggcacccagctgcagctgctgaagtggcccctgcgctttgtgatcatccacaagagatgtgtgtactacttcaagagcagcaccagcgccagcccccagggcgccttcagcctgagcggctacaacagagtgatgagagctgctgaggagaccaccagcaacaacgtgttccccttcaagatcatccacatcagcaagaagcacaggacctggttcttcagcgccagcagcgaggaggagaggaagtcctggatggccctgctgcggcgggagatcggccacttccacgagaagaaggacctgcccctggacaccagtgacagcagcagtgacacagacagcttctacggggctgtggagaggcctgtggacatcagcctgagcccctaccccacagacaatgaagattatgaacatgatgatgaagatgacagctacctggagccagacagccctgagcccggccgcctggaggatgccctgatgcaccccccagcctacccacctcctcctgtgcccacccccaggaagccagccttcagtgacatgccccgggcccacagcttcaccagcaagggccctggccccctgctgcccccacctccacccaagcacggcctgcctgatgtgggcctggccgctgaggacagcaagagggaccccctgtgccccaggagagctgagccctgcccccgggtgcctgccacccccaggaggatgtctgacccccccctgagcaccatgcccacagcccctggcctgaggaagccaccctgcttccgggagagcgccagccccagccctgagccctggaccccaggccatggagcctgcagcaccagcagcgctgccatcatggccacagccaccagcaggaactgtgacaagctgaagagcttccacctgagcccccggggcccccccaccagcgagcccccacctgtgcctgccaacaagcccaagttcctgaagattgctgaggaggaccccccccgggaggccgccatgcctggcctgtttgtgccccctgtggccccccggcccccagccctgaagctgcctgtgcctgaggccatggcccggcctgctgtgctgcccaggcctgagaagccccagctgccccacctgcagaggagccccccagatggccagagcttccgctccttctcctttgagaagccccggcagcccagccaggccgacacaggaggagatgacagtgatgaagattatgagaaggtgcccctgcccaacagcgtgtttgtgaacaccacagagagctgtgaggtggagcggctcttcaaggccaccagccccagaggagagccccaggacggcctgtactgcatccggaacagcagcaccaagagcggcaaggtgctggtggtgtgggatgagaccagcaacaaggtgaggaactaccgcatctttgagaaggacagcaagttctacctggagggggaggtgctgtttgtgtctgtgggctccatggtggagcactaccacacccacgtgctgcccagccaccagagcctgctgctgcggcacccctacggctacacaggccccaggtag

SEQ ID NO: 169580 - DNA, 519 bp, Artificial Sequence
  Description of Artificial Sequence: Synthetic coding sequence
atggctgctgaggagatgcactggcctgtgcccatgaaggccatcggggcccagaacctgctgaccatgcctgggggcgtggccaaggccggctacctgcacaagaagggcggcacccagctgcagctgctgaagtggcccctgcgcttcgtcatcatccacaagagatgtgtgtactacttcaagagcagcaccagcgccagcccccagggcgccttcagcctgagcggctacaacagagtgatgagagctgctgaggagaccaccagcaacaacgtgttccccttcaagatcatccacatcagcaagaagcacaggacctggttcttcagcgccagcagcgaggaggagaggaagtcctggatggccctgctgcggcgggagatcggccacttccacgagaagaaggacctgcccctggacaccagtgacagcagcagtgacacagacagcttctatggagctgtggagaggcctgtggacatcagcctgagcccctaccccacagacaatgaatag

SEQ ID NO: 169581 - DNA, 567 bp, Artificial Sequence
  Description of Artificial Sequence: Synthetic coding sequence
atggctgctgaggagatgcactggcctgtgcccatgaaggccatcggggcccagaacctgctgaccatgcctgggggcgtggccaaggccggctacctgcacaagaagggcggcacccagctgcagctgctgaagtggcccctgcgcttcgtcatcatccacaagagatgtgtgtactacttcaagagcagcaccagcgccagcccccagggcgccttcagcctgagcggctacaacagagtgatgagagctgctgaggagaccaccagcaacaacgtgttccccttcaagatcatccacatcagcaagaagcacaggacctggttcttcagcgccagcagcgaggaggagaggaagtcctggatggccctgctgcggcgggagatcggccacttccacgagaagaaggacctgcccctggacaccagtgacagcagcagtgacacagacagcttctatggagctgtggagaggcctgtggacatcagcctgagcccctaccccacagacaatgaagattatgaacatgatgatgaagatgacagctacctggagccagacagctag

SEQ ID NO: 169582 - DNA, 1686 bp, Artificial Sequence; identical to SEQ ID NO: 169572
  Description of Artificial Sequence: Synthetic coding sequence

SEQ ID NO: 169583 - DNA, 585 bp, Artificial Sequence
  Description of Artificial Sequence: Synthetic coding sequence
atggctgctgaggagatgcactggcctgtgcccatgaaggccatcggggcccagaacctgctgaccatgcctgggggcgtggccaaggccggctacctgcacaagaagggcggcacccagctgcagctgctgaagtggcccctgcgcttcgtcatcatccacaagagatgtgtgtactacttcaagagcagcaccagcgccagcccccagggcgccttcagcctgagcggctacaacagagtgatgagagctgctgaggagaccaccagcaacaacgtgttccccttcaagatcatccacatcagcaagaagcacaggacctggttcttcagcgccagcagcgaggaggagaggaagtcctggatggccctgctgcggcgggagatcggccacttccacgagaagaaggacctgcccctggacaccagtgacagcagcagtgacacagacagcttctatggagctgtggagaggcctgtggacatcagcctgagcccctaccccacagacaatgaagattatgaacatgatgatgaagatgacagctacctggagccagacagccctgagcccggccgcctgtag

SEQ ID NO: 169584 - DNA, 411 bp, Artificial Sequence
  Description of Artificial Sequence: Synthetic coding sequence
atggctgctgaggagatgcactggcctgtgcccatgaaggccatcggggcccagaacctgctgaccatgcctgggggcgtggccaaggccggctacctgcacaagaagggcggcacccagctgcagctgctgaagtggcccctgcgcttcgtcatcatccacaagagatgtgtgtactacttcaagagcagcaccagcgccagcccccagggcgccttcagcctgagcggctacaacagagtgatgagagctgctgaggagaccaccagcaacaacgtgttccccttcaagatcatccacatcagcaagaagcacaggacctggttcttcagcgccagcagcgaggaggagaggaagtcctggatggccctgctgcggcgggagatcggccacttccacgagaagaagtag

SEQ ID NO: 169585 - DNA, 2892 bp, Artificial Sequence
  Description of Artificial Sequence: Synthetic coding sequence
atggccgcccagaggatccgggccgccaacagcaatggcctgccccgctgcaagtctgagggcaccctgattgacctgtctgagggcttcagcgagaccagcttcaatgacatcaaggtgcccagccccagcgccctgctggtggacaaccccaccccatttggaaatgccaaggaggtgattgccatcaaggactactgccccaccaacttcaccaccctgaagttcagcaagggggaccacctgtatgtgctggacaccagcggcggggagtggtggtacgcccacaacaccacagagatgggctacatccccagcagctatgtgcagcccctgaactacagaaacagcaccctgagtgacagcggcatgattgacaacctgcctgacagcccagatgaggtggccaaggagctggagctgctgggcggctggacagatgacaagaaggtgcccggccgcatgtacagcaacaaccccttctggaatggagtgcagaccaaccccttcctgaatggaaatgtgcctgtgatgcccagcctggatgagctgaaccccaagagcacagtggacctgctgctgtttgatgctggcaccagcagcttcacagagagcagcagcgccaccaccaacagcactggaaacatctttgatgagctgcctgtgaccaacggcctgcacgccgagccccctgtgagaagagacaaccccttcttccgcagcaagaggagctacagcctgtctgagctgtctgtgctgcaggccaagagtgatgcccccaccagcagcagcttcttcaccggcctgaagagccctgcccctgagcagttccagagccgggaggacttcagaacagcctggctgaaccacaggaagctggcccggagctgccacgacctggacctgctgggccagagccctggctggggccagacccaggccgtggagaccaacatcgtgtgcaagctggacagcagcggcggcgctgtgcagctgcctgacaccagcatcagcatccacgtgcctgagggccacgtggcccctggagagacccagcagatctccatgaaggccctgctggacccccccctggagctgaacagcgacaggagctgcagcatcagccctgtgctggaggtgaagctgagcaacctggaggtgaagaccagcatcatcctggagatgaaggtgtctgctgagatcaagaatgacctcttcagcaagagcacagtgggcctgcagtgcctgcggagtgacagcaaggagggcccctacgtgtctgtgcccctgaactgcagctgtggggacacagtgcaggcccagctgcacaacctggagccctgcatgtatgtggccgtggtggcccacggccccagcatcctgtaccccagcacagtgtgggacttcatcaacaagaaggtgacagtgggcctgtatggccccaagcacatccaccccagcttcaagacagtggtgaccatctttggacatgactgtgcccccaagaccctgctggtgtctgaggtgacccggcaggcccccaacccagcccctgtggccctgcagctgtggggcaagcaccagtttgtgctgagccggccccaggacctgaaggtgtgcatgttcagcaacatgaccaactatgaggtgaaggccagcgagcaggccaaggtggtgcggggcttccagctgaagctgggcaaggtgtcccggctcatcttccccatcaccagccagaaccccaatgagctgagtgacttcaccctgcgggtgcaggtgaaggatgaccaggaggccatcctgacccagttctgtgtgcagaccccccagcccccacccaagagcgccatcaagcccagcggccagaggcgcttcctgaagaagaatgaggtgggcaagatcatcctgagcccctttgccaccaccaccaagtaccccaccttccaggacaggcctgtgagcagcctgaagtttgggaagctgctgaagacagtggtgcggcagaacaagaaccactacctgctggagtacaagaagggagatggcatcgccctgctgtctgaggagcgggtgcggctgcggggccagctgtggaccaaggagtggtacatcggctactaccagggccgggtgggcctggtgcacaccaagaatgtgctggtggtgggccgggcccggcccagcctgtgcagcggccctgagctgagcacctctgtgctgctggagcagatcctgcggccctgcaagttcctgacctacatctatgcctctgtgaggaccctgctgatggagaacatcagctcctggaggagctttgctgatgccctgggctacgtgaacctgcccctgaccttcttctgcagagctgagctggacagcgagcctgagcgggtggcctctgtgctggagaagctgaaggaggactgcaacaacacagagaacaaggagaggaagagcttccagaaggagctggtgatggccctgctgaagatggactgccagggcctggtggtgcggctcatccaggactttgtgctgctgaccacagctgtggaggtggcccagcgctggagggagctggccgagaagctggccaaggtgtccaagcagcagatggatgcctatgagagcccccaccgggacagaaatggagtggtggacagcgaggccatgtggaagccagcctatgacttcctgctgacctggagccaccagatcggggacagctacagagatgtgatccaggagctgcacctgggcctggacaagatgaagaaccccatcaccaagcgctggaagcacctgaccggcaccctcatcctggtgaacagcctggatgtgctgcgggctgctgccttctccccagctgaccaggatgactttgtgatctag

SEQ ID NO: 169586 - DNA, 2892 bp, Artificial Sequence; identical to SEQ ID NO: 169585
  Description of Artificial Sequence: Synthetic coding sequence

SEQ ID NO: 169587 - DNA, 2892 bp, Artificial Sequence; identical to SEQ ID NO: 169585
  Description of Artificial Sequence: Synthetic coding sequence

SEQ ID NO: 169588 - DNA, 369 bp, Artificial Sequence
  Description of Artificial Sequence: Synthetic coding sequence
atggccgcccagaggatccgggccgccaacagcaatggcctgccccgctgcaagtctgagggcaccctgattgacctgtctgagggcttcagcgagaccagcttcaatgacatcaaggtgcccagccccagcgccctgctggtggacaaccccaccccatttggaaatgccaaggaggtgattgccatcaaggactactgccccaccaacttcaccaccctgaagttcagcaagggggaccacctgtatgtgctggacaccagcggcggggagtggtggtacgcccacaacaccacagagatgggctacatccccagcagctatgtgcagcccctgaactacagaaacagcaccctgagtgacagctag

SEQ ID NO: 169589 - DNA, 1662 bp, Artificial Sequence
  Description of Artificial Sequence: Synthetic coding sequence
atggccgcccagaggatccgggccgccaacagcaatggcctgccccgctgcaagtctgagggcaccctgattgacctgtctgagggcttcagcgagaccagcttcaatgacatcaaggtgcccagccccagcgccctgctggtggacaaccccaccccatttggaaatgccaaggaggtgattgccatcaaggactactgccccaccaacttcaccaccctgaagttcagcaagggggaccacctgtatgtgctggacaccagcggcggggagtggtggtacgcccacaacaccacagagatgggctacatccccagcagctatgtgcagcccctgaactacagaaacagcaccctgagtgacagcggcatgattgacaacctgcctgacagcccagatgaggtggccaaggagctggagctgctgggcggctggacagatgacaagaaggtgcccggccgcatgtacagcaacaaccccttctggaatggagtgcagaccaaccccttcctgaatggaaatgtgcctgtgatgcccagcctggatgagctgaaccccaagagcacagtggacctgctgctgtttgatgctggcaccagcagcttcacagagagcagcagcgccaccaccaacagcactggaaacatctttgatgagctgcctgtgaccaacggcctgcacgccgagccccctgtgagaagagacaaccccttcttccgcagcaagaggagctacagcctgtctgagctgtctgtgctgcaggccaagagtgatgcccccaccagcagcagcttcttcaccggcctgaagagccctgcccctgagcagttccagagccgggaggacttcagaacagcctggctgaaccacaggaagctggcccggagctgccacgacctggacctgctgggccagagccctggctggggccagacccaggccgtggagaccaacatcgtgtgcaagctggacagcagcggcggcgctgtgcagctgcctgacaccagcatcagcatccacgtgcctgagggccacgtggcccctggagagacccagcagatctccatgaaggccctgctggacccccccctggagctgaacagcgacaggagctgcagcatcagccctgtgctggaggtgaagctgagcaacctggaggtgaagaccagcatcatcctggagatgaaggtgtctgctgagatcaagaatgacctcttcagcaagagcacagtgggcctgcagtgcctgcggagtgacagcaaggagggcccctacgtgtctgtgcccctgaactgcagctgtggggacacagtgcaggcccagctgcacaacctggagccctgcatgtatgtggccgtggtggcccacggccccagcatcctgtaccccagcacagtgtgggacttcatcaacaagaaggtgacagtgggcctgtatggccccaagcacatccaccccagcttcaagacagtggtgaccatctttggacatgactgtgcccccaagaccctgctggtgtctgaggtgacccggcaggcccccaacccccccatcaccaagcgctggaagcacctgaccggcaccctcatcctggtgaacagcctggatgtgctgcgggctgctgccttctccccagctgaccaggatgactttgtgatctag

SEQ ID NO: 169590 - DNA, 171 bp, Artificial Sequence
  Description of Artificial Sequence: Synthetic coding sequence
atggccgcccagaggatccgggccgccaacagcaatggcctgccccgctgcaagtctgagggcaccctgattgacctgtctgagggcttcagcgagaccagcttcaatgacatcaaggtgcccagccccagcgccctgctggtggacaaccccacccccttcggcaactag

SEQ ID NO: 169591 - DNA, 522 bp, Artificial Sequence
  Description of Artificial Sequence: Synthetic coding sequence
atggccgcccagaggatccgggccgccaacagcaatggcctgccccgctgcaagtctgagggcaccctgattgacctgtctgagggcttcagcgagaccagcttcaatgacatcaaggtgcccagccccagcgccctgctggtggacaaccccaccccatttggaaatgccaaggaggtgattgccatcaaggactactgccccaccaacttcaccaccctgaagttcagcaagggggaccacctgtatgtgctggacaccagcggcggggagtggtggtacgcccacaacaccacagagatgggctacatccccagcagctatgtgcagcccctgaactacagaaacagcaccctgagtgacagcggcatgattgacaacctgcctgacagcccagatgaggtggccaaggagctggagctgctgggcggctggacagatgacaagaaggtgcccggccgcatgtacagcaacaaccccttctggaatggagtgcagaccaaccccttcctgaatggatag

SEQ ID NO: 169592 - DNA, 174 bp, Artificial Sequence
  Description of Artificial Sequence: Synthetic coding sequence
atggccgcccagaggatccgggccgccaacagcaatggcctgccccgctgcaagtctgagggcaccctgattgacctgtctgagggcttcagcgagaccagcttcaatgacatcaaggtgcccagccccagcgccctgctggtggacaaccccaccccatttggaaatgcctag

SEQ ID NO: 169593 - DNA, 606 bp, Artificial Sequence
  Description of Artificial Sequence: Synthetic coding sequence
atggagaacatcagctcctggaggagctttgctgatgccctgggctacgtgaacctgcccctgaccttcttctgcagagctgagctggacagcgagcctgagcgggtggcctctgtgctggagaagctgaaggaggactgcaacaacacagagaacaaggagaggaagagcttccagaaggagctggtgatggccctgctgaagatggactgccagggcctggtggtgcggctcatccaggactttgtgctgctgaccacagctgtggaggtggcccagcgctggagggagctggccgagaagctggccaaggtgtccaagcagcagatggatgcctatgagagcccccaccgggacagaaatggagtggtggacagcgaggccatgtggaagccagcctatgacttcctgctgacctggagccaccagatcggggacagctacagagatgtgatccaggagctgcacctgggcctggacaagatgaagaaccccatcaccaagcgctggaagcacctgaccggcaccctcatcctggtgaacagcctggatgtgctgcgggctgctgccttctccccagctgaccaggatgactttgtgatctag

SEQ ID NO: 169594 - DNA, 897 bp, Artificial Sequence
  Description of Artificial Sequence: Synthetic coding sequence
atgctgaaccacgccacccagagggtgatggaggccgagcagaccaagaccaggtctgagctggtgcacaaggagacagctgcccgctacaatgctgccatgggccgcatgaggcagctggagaagaagctgaagagggccatcaacaagagcaagccctactttgagctgaaggccaagtactacgtgcagctggagcagctgaagaagacagtggatgacctgcaggccaagctgaccctggccaagggggagtacaagatggccctgaagaacctggagatgatcagtgatgagatccatgaaagaagaagaagcagcgccatgggcccccggggctgcggcgtgggcgctgagggcagcagcacctctgtggaggacctgcccggcagcaagccagagccagatgccatctctgtggccagcgaggcctttgaagatgacagctgcagcaactttgtgtctgaagatgattctgagacccagagcgtgagcagcttcagcagcggccccaccagccccagcgagatgccagaccagtttcctgctgtggtgcggcccggcagcctggacctgcccagccctgtgtccctgtctgaatttggcatgatgtttcctgtgctgggccccaggagtgaatgttctggggccagcagcccagaatgtgaggtggagcggggggacagagctgagggcgctgagaacaagaccagtgacaaggccaacaacaacagaggcctgagcagcagcagcggcagcggcggcagcagcaagagccagagcagcaccagccctgagggccaggccctggagaacaggatgaagcagctgagcctgcagtgcagcaagggcagagatggcatcatcgctgacatcaagatggtgcagattggatag

SEQ ID NO: 169595 - DNA, 387 bp, Artificial Sequence
  Description of Artificial Sequence: Synthetic coding sequence
atgctgaaccacgccacccagagggtgatggaggccgagcagaccaagaccaggtctgagctggtgcacaaggagacagctgcccgctacaatgctgccatgggccgcatgaggcagctggagaagaagctgaagagggccatcaacaagagcaagccctactttgagctgaaggccaagtactacgtgcagctggagcagctgaagaagacagtggatgacctgcaggccaagctgaccctggccaagggggagtacaagatggccctgaagaacctggagatgatcagtgatgagatccatgaaagaagaagaagcagcgccatgggcccccggggctgcggcgtgggcgctgagggcagcagcacctctgtggaggacctgtag

SEQ ID NO: 169596 - DNA, 1368 bp, Artificial Sequence
  Description of Artificial Sequence: Synthetic coding sequence
atggatgctgccctgaagaggagccgctctgaggagcctgctgagatcctgcccccagccagagatgaggaggaggaggaggaggagggcatggagcagggcctggaggaggaggaggaggtggacccccgcatccagggcgagctggagaagctgaaccagagcacagatgacatcaacagaagagaaacagagctggaggatgcccggcagaagttccgctctgtgctggtggaggccaccgtgaagctggatgagctggtgaagaagattggcaaggctgtggaggacagcaagccctactgggaggccaggagagtggcccggcaggcccagctggaggcccagaaggccacccaggacttccagagggccacagaggtgctgcgggccgccaaggagaccatcagcctggccgagcagaggctgctggaggatgacaagaggcagtttgattctgcctggcaggagatgctgaaccacgccacccagagggtgatggaggccgagcagaccaagaccaggtctgagctggtgcacaaggagacagctgcccgctacaatgctgccatgggccgcatgaggcagctggagaagaagctgaagagggccatcaacaagagcaagccctactttgagctgaaggccaagtactacgtgcagctggagcagctgaagaagacagtggatgacctgcaggccaagctgaccctggccaagggggagtacaagatggccctgaagaacctggagatgatcagtgatgagatccacgagaggagaagaagcagcgccatgggcccccggggctgcggcgtgggcgctgagggcagcagcacctctgtggaggacctgcccggcagcaagccagagccagatgccatctctgtggccagcgaggcctttgaagatgacagctgcagcaactttgtgtctgaagatgacagcgagacccagagcgtgtcctccttcagcagcggccccaccagccccagcgagatgccagaccagtttcctgctgtggtgcggcccggcagcctggacctgcccagccctgtgtccctgtctgaatttggcatgatgtttcctgtgctgggccccaggtctgagtgcagcggggccagcagcccagaatgtgaggtggagcggggggacagagctgagggcgctgagaacaagaccagtgacaaggccaacaacaacagaggcctgagcagcagcagcggcagcggcggcagcagcaagagccagagcagcaccagccctgagggccaggccctggagaacaggatgaagcagctgagcctgcagtgcagcaagggcagagatggcatcatcgctgacatcaagatggtgcagatcggctag

SEQ ID NO: 169597 - DNA, 897 bp, Artificial Sequence; identical to SEQ ID NO: 169594
  Description of Artificial Sequence: Synthetic coding sequence

SEQ ID NO: 169598 - DNA, 156 bp, Artificial Sequence
  Description of Artificial Sequence: Synthetic coding sequence
atgctgaaccacgccacccagagggtgatggaggccgagcagaccaagaccaggtctgagctggtgcacaaggagacagctgcccgctacaatgctgccatgggccgcatgaggcagctggagaagaagctgaagagggccatcaacaagagctag

SEQ ID NO: 169599 - DNA, 897 bp, Artificial Sequence; identical to SEQ ID NO: 169594
  Description of Artificial Sequence: Synthetic coding sequence

SEQ ID NO: 169600 - DNA, 2580 bp, Artificial Sequence
  Description of Artificial Sequence: Synthetic coding sequence
atgatggagggcctgaagaagaggaccaggaaggccttcggcatcaggaagaaggagaaggacacagacagcacaggcagcccagacagagatggcatccagggcaagaagaagacccagaagacccagctgctgctgaccagctgcttctggctgcgggccctgagcctgaccctgagccagaagaagagcaatggagccccaaatggcttctatgcagaaattgactgggagcgctacaacagccctgagctggatgaggagggctacagcatccggcctgaggagcccggcagcaccaagggcaagcacttctacagcagcagcgagagcgaggaggaggaggagagccacaagaagttcaacatcaagatcaagcccctgcagagcaaggacatcctgaagaatgctgccaccgtggatgagctgaaggccagcatcggcaacatcgccctgagccccagccctgtgaggaagagcccccggcgcagccctggggccatcaagaggaacctgagcagcgaggaggtggcccggcccaggaggagcacccccaccccagagctgatcagcaagaagcccccagatgacaccacagccctggcccccctgtttggaccacccctggagagcgcctttgatgagcagaagacagaggtgctgctggaccagcctgagatctggggcagcggccagcccatcaaccccagcatggagagccccaagctgacccggcccttccccaccggcaccccaccacccctgccccccaagaatgtgcctgccaccccacccaggacaggcagccccctgaccatcggccctggaaatgaccagagcgccacagaggtgaagattgagaagctgcccagcatcaatgacctggacagcatctttggacctgtgctgagccccaagtctgtggccgtgaatgctgaggagaagtgggtgcacttcagtgacaccagccctgagcacgtgaccccagagctgaccccccgggagaaggtggtgagccccccagccaccccagacaacccagctgacagccctgcccctggccccctgggccccccaggccccaccggccccccaggccccccaggccccccaagaaatgtgctgagccccctgaacctggaggaggtgcagaagaaggtggccgagcagaccttcatcaaggatgactacctggagaccatcagcagccccaaggactttggcctgggccagagggccaccccacctcctcctcctccacccacctacagaacagtggtgagcagccctggccctggcagcggccctggccctggcaccaccagtgatggcaagacagaggcccagcgctaccaggtgatctgccccagcctgcaggccggcggcaatgagctggacagctacagcggggccagcagccctgcccggcctgccacccccctggtgccctgccgcagcaccaccccacctcctcctccaccccggccccccagccggcccaagctgcccccaggcaagccaggagtgggagatgtgtcccggcccttcagcccccccatccacagcagcagccccccacccatcgcccccctggcccgggcagagagcaccagcagcatcagcagcaccaacagcctgtctgctgccaccacccccaccgtggagaatgagcagcccagcctggtgtggtttgaccggggcaagttctacctgacctttgagggcagcagccggggccccagccccctgaccatgggcgcccaggacaccctgcctgtggccgccgccttcacagagaccgtgaatgcctacttcaagggagctgaccccagcaagtgcatcgtgaagatcaccggggagatggtgctgtccttccctgctggcatcaccaggcactttgccaacaaccccagccctgctgccctgaccttccgggtcatcaacttcagccggctggagcacgtgctgcccaacccccagctgctgtgctgtgacaacacccagaatgatgccaacaccaaggagttctgggtgaacatgcccaacctgatgacccacctgaagaaggtgtctgagcagaagccccaggccacctactacaacgtggacatgctgaagtaccaggtgtctgcccagggcatccagagcacccccctgaacctggccgtgaactggaggtgtgagcccagcagcacagacctgagaattgactacaagtacaacacagatgccatgaccacagctgtggccctgaacaacgtgcagttcctggtgcccattgatggaggagtgaccaagctgcaggccgtgctgcccccagctgtgtggaatgctgagcagcagaggatcctgtggaagatcccagacatcagccagaagtcagaaaatggaggagtgggcagcctgctggcccgcttccagctgtctgagggccccagcaagcccagccccctggtggtgcagttcaccagcgagggcagcaccctgagcggctgtgacatcgagctggtgggcgccggctaccgcttcagcctcatcaagaagagatttgctgctgggaagtacctggccgacaactag

SEQ ID NO: 169601 - DNA, 1857 bp, Artificial Sequence
  Description of Artificial Sequence: Synthetic coding sequence
atgatggagggcctgaagaagaggaccaggaaggccttcggcatcaggaagaaggagaaggacacagacagcacaggcagcccagacagagatggcatcaacagccctgagctggatgaggagggctacagcatccggcctgaggagcccggcagcaccaagggcaagcacttctacagcagcagcgagagcgaggaggaggaggagagccacaagaagttcaacatcaagatcaagcccctgcagagcaaggacatcctgaagaatgctgccaccgtggatgagctgaaggccagcatcggcaacatcgccctgagccccagccctgtgaggaagagccccaggaggagccctggggccatcaagaggaacctgagcagcgaggaggtggcccggccccggcgcagcacccccaccccagagctgatcagcaagaagcccccagatgacaccacagccctggcccccctgtttggcccccccctggagagcgcctttgatgagcagaagacagaggtgctgctggaccagcctgagatctggggcagcggccagcccatcaaccccagcatggagagccccaagctgacccggcccttccccaccggcaccccaccacccctgccccccaagaatgtgcctgccaccccacccaggacaggcagccccctgaccatcggccctggggccagcagccctgcccggcctgccacccccctggtgccctgccgcagcaccaccccacctcctcctccacccaggcctcccagccggcccaagctgcccccaggcaagccaggagtgggagatgtgtcccggcccttcagcccccccatccacagcagcagccccccacccatcgcccccctggcccgggcagagagcaccagcagcatcagcagcaccaacagcctgtctgctgccaccacccccaccgtggagaatgagcagcccagcctggtgtggtttgaccggggcaagttctacctgacctttgagggcagcagccggggccccagccccctgaccatgggcgcccaggacaccctgcctgtggccgccgccttcacagaaacagtgaatgcctacttcaagggagctgaccccagcaaatgtattgtgaagatcactggagagatggtgctgtccttccctgctggcatcaccaggcactttgccaacaaccccagccctgctgccctgaccttccgggtcatcaacttcagccggctggagcacgtgctgcccaacccccagctgctgtgctgtgacaacacccagaatgatgccaacaccaaggagttctgggtgaacatgcccaacctgatgacccacctgaagaaggtgtctgagcagaagccccaggccacctactacaacgtggacatgctgaagtaccaggtgtctgcccagggcatccagagcacccccctgaacctggccgtgaactggaggtgtgagcccagcagcacagacctgagaattgactacaagtacaacacagatgccatgaccacagctgtggccctgaacaacgtgcagttcctggtgcccattgatggcggcgtgaccaagctgcaggccgtgctgcccccagctgtgtggaatgctgagcagcagaggatcctgtggaagatcccagacatcagccagaagtcagaaaatggaggagtgggcagcctgctggcccgcttccagctgtctgagggccccagcaagcccagccccctggtggtgcagttcaccagcgagggcagcaccctgagcggctgtgacatcgagctggtgggcgccggctaccgcttcagcctcatcaagaagagatttgctgctgggaagtacctggccgacaactag

SEQ ID NO: 169602 - DNA, 1893 bp, Artificial Sequence
  Description of Artificial Sequence: Synthetic coding sequence
atggagggcctgaagaagaggaccaggaaggccttcggcatcaggaagaaggagaaggacacagacagcacaggcagcccagacagagatggcatcaagaagagcaatggagcccccaacggcttctacgccgagattgactgggagcgctacaacagccctgagctggatgaggagggctacagcatccggcctgaggagcccggcagcaccaagggcaagcacttctacagcagcagcgagagcgaggaggaggaggagagccacaagaagttcaacatcaagatcaagcccctgcagagcaaggacatcctgaagaatgctgccaccgtggatgagctgaaggccagcatcggcaacatcgccctgagccccagccctgtgggcgccatcaagaggaacctgagcagcgaggaggtggcccggccccggcgcagcacccccaccccagagctgatcagcaagaagcccccagatgacaccacagccctggcccccctgtttggcccccccctggagagcgcctttgatgagcagaagacagaggtgctgctggaccagcctgagatctggggcagcggccagcccatcaaccccagcatggagagccccaagctgacccggcccttccccaccggcaccccaccacccctgccccccaagaatgtgcctgccaccccacccaggacaggcagccccctgaccatcggccctggggccagcagccctgcccggcctgccacccccctggtgccctgccgcagcaccaccccacctcctcctccacccaggcctcccagccggcccaagctgcccccaggcaagccaggagtgggagatgtgtcccggcccttcagcccccccatccacagcagcagccccccacccatcgcccccctggcccgggcagagagcaccagcagcatcagcagcaccaacagcctgtctgctgccaccacccccaccgtggtgtctgaagatgatgtgttctatgacaagctgcccagctttgaaagaagatgtgagaccccagctggcagcagccggggccccagccccctgaccatgggcgcccaggacaccctgcctgtggccgccgccttcacagaaacagtgaatgcctacttcaagggagctgaccccagcaaatgtattgtgaagatcactggagagatggtgctgtccttccctgctggcatcaccaggcactttgccaacaaccccagccctgctgccctgaccttccgggtcatcaacttcagccggctggagcacgtgctgcccaacccccagctgctgtgctgtgacaacacccagaatgatgccaacaccaaggagttctgggtgaacatgcccaacctgatgacccacctgaagaaggtgtctgagcagaagccccaggccacctactacaacgtggacatgctgaagtaccaggtgtctgcccagggcatccagagcacccccctgaacctggccgtgaactggaggtgtgagcccagcagcacagacctgagaattgactacaagtacaacacagatgccatgaccacagctgtggccctgaacaacgtgcagttcctggtgcccattgatggcggcgtgaccaagctgcaggccgtgctgcccccagctgtgtggaatgctgagcagcagaggatcctgtggaagatcccagacatcagccagaagtcagaaaatggaggagtgggcagcctgctggcccgcttccagctgtctgagggccccagcaagcccagccccctggtggtgcagttcaccagcgagggcagcaccctgagcggctgtgacatcgagctggtgggcgccggctaccgcttcagcctcatcaagaagagatttgctgctgggaagtacctggccgacaactag

SEQ ID NO: 169603 - DNA, 2487 bp, Artificial Sequence
  Description of Artificial Sequence: Synthetic coding sequence
atgatggagggcctgaagaagaggaccaggaaggccttcggcatcaggaagaaggagaaggacacagacagcacaggcagcccagacagagatggcatccagcccagcccccatgagcccccctacaacagcaaggcagaatgtgcccgggagggcggcaagaaggtgtccaagaagagcaatggagccccaaatggcttctatgcagaaattgactgggagcgctacaacagccctgagctggatgaggagggctacagcatccggcctgaggagcccggcagcaccaagggcaagcacttctacagcagcagcgagagcgaggaggaggaggagagccacaagaagttcaacatcaagatcaagcccctgcagagcaaggacatcctgaagaatgctgccaccgtggatgagctgaaggccagcatcggcaacatcgccctgagccccagccctgtgaggaagagcccccggcgcagccctggggccatcaagaggaacctgagcagcgaggaggtggcccggcccaggaggagcacccccaccccagagctgatcagcaagaagcccccagatgacaccacagccctggcccccctgtttggaccacccctggagagcgcctttgatgagcagaagacagaggtgctgctggaccagcctgagatctggggcagcggccagcccatcaaccccagcatggagagccccaagctgacccggcccttccccaccggcaccccaccacccctgccccccaagaatgtgcctgccaccccacccaggacaggcagccccctgaccatcggccctggaaatgaccagagcgccacagaggtgaagattgagaagctgcccagcatcaatgacctggacagcatctttggacctgtgctgagccccaagtctgtggccgtgaatgctgaggagaagtgggtgcacttcagtgacaccagccctgagcacgtgaccccagagctgaccccccgggagaaggtggtgagccccccagccaccccagacaacccagctgacagccctgcccctggccccctgggccccccaggccccaccggccccccaggccccccaggccccccaagaaatgtgctgagccccctgaacctggaggaggtgcagaagaaggtggccgagcagaccttcatcaaggatgactacctggagaccatcagcagccccaaggactttggcctgggccagagggccaccccacctcctcctcctccacccacctacagaacagtggtgagcagccctggccctggcagcggccctggccctggcaccaccagcggggccagcagccctgcccggcctgccacccccctggtgccctgccgcagcaccaccccacctcctcctccacccaggcctcccagccggcccaagctgcccccaggcaagccaggagtgggagatgtgtcccggcccttcagcccccccatccacagcagcagccccccacccatcgcccccctggcccgggcagagagcaccagcagcatcagcagcaccaacagcctgtctgctgccaccacccccaccgtggagaatgagcagcccagcctggtgtggtttgaccggggcaagttctacctgacctttgagggcagcagccggggccccagccccctgaccatgggcgcccaggacaccctgcctgtggccgccgccttcacagaaacagtgaatgcctacttcaagggagctgaccccagcaaatgtattgtgaagatcactggagagatggtgctgtccttccctgctggcatcaccaggcactttgccaacaaccccagccctgctgccctgaccttccgggtcatcaacttcagccggctggagcacgtgctgcccaacccccagctgctgtgctgtgacaacacccagaatgatgccaacaccaaggagttctgggtgaacatgcccaacctgatgacccacctgaagaaggtgtctgagcagaagccccaggccacctactacaacgtggacatgctgaagtaccaggtgtctgcccagggcatccagagcacccccctgaacctggccgtgaactggaggtgtgagcccagcagcacagacctgagaattgactacaagtacaacacagatgccatgaccacagctgtggccctgaacaacgtgcagttcctggtgcccattgatggcggcgtgaccaagctgcaggccgtgctgcccccagctgtgtggaatgctgagcagcagaggatcctgtggaagatcccagacatcagccagaagtcagaaaatggaggagtgggcagcctgctggcccgcttccagctgtctgagggccccagcaagcccagccccctggtggtgcagttcaccagcgagggcagcaccctgagcggctgtgacatcgagctggtgggcgccggctaccgcttcagcctcatcaagaagagatttgctgctgggaagtacctggccgacaactag

SEQ ID NO: 169604 - DNA, 2577 bp, Artificial Sequence
  Description of Artificial Sequence: Synthetic coding sequence
atggagggcctgaagaagaggaccaggaaggccttcggcatcaggaagaaggagaaggacacagacagcacaggcagcccagacagagatggcatccagggcaagaagaagacccagaagacccagctgctgctgaccagctgcttctggctgcgggccctgagcctgaccctgagccagaagaagagcaatggagcccccaacggcttctacgccgagattgactgggagcgctacaacagccctgagctggatgaggagggctacagcatccggcctgaggagcccggcagcaccaagggcaagcacttctacagcagcagcgagagcgaggaggaggaggagagccacaagaagttcaacatcaagatcaagcccctgcagagcaaggacatcctgaagaatgctgccaccgtggatgagctgaaggccagcatcggcaacatcgccctgagccccagccctgtgaggaagaaggagcggcgggagaagggggccatcaagaggaacctgagcagcgaggaggtggcccggccccggcgcagcacccccaccccagagctgatcagcaagaagcccccagatgacaccacagccctggcccccctgtttggcccccccctggagagcgcctttgatgagcagaagacagaggtgctgctggaccagcctgagatctggggcagcggccagcccatcaaccccagcatggagagccccaagctgacccggcccttccccaccggcaccccaccacccctgccccccaagaatgtgcctgccaccccacccaggacaggcagccccctgaccatcggccctggaaatgaccagagcgccacagaggtgaagattgagaagctgcccagcatcaatgacctggacagcatcttcggccctgtgctgagccccaagtctgtggccgtgaatgctgaggagaagtgggtgcacttcagtgacaccagccctgagcacgtgaccccagagctgaccccccgggagaaggtggtgtccccaccagccaccccagacaacccagctgacagccctgcccctggccccctgggccccccaggccccactggacctcctggccccccaggccccccaagaaatgtgctgagccccctgaacctggaggaggtgcagaagaaggtggccgagcagaccttcatcaaggatgactacctggagaccatcagcagccccaaggactttggcctgggccagagggccaccccacctcctcctcctccacccacctacagaacagtggtgagcagccctggccctggcagcggccctggccctggcaccaccagtgatggcaagacagaggcccagcgctaccaggtgatctgccccagcctgcaggccggcggcaatgagctggacagctacagcggggccagcagccctgcccggcctgccacccccctggtgccctgccgcagcaccaccccacctcctcctccacccaggcctcccagccggcccaagctgcccccaggcaagccaggagtgggagatgtgtcccggcccttcagcccccccatccacagcagcagccccccacccatcgcccccctggcccgggcagagagcaccagcagcatcagcagcaccaacagcctgtctgctgccaccacccccaccgtggagaatgagcagcccagcctggtgtggtttgaccggggcaagttctacctgacctttgagggcagcagccggggccccagccccctgaccatgggcgcccaggacaccctgcctgtggccgccgccttcacagaaacagtgaatgcctacttcaagggagctgaccccagcaaatgtattgtgaagatcactggagagatggtgctgtccttccctgctggcatcaccaggcactttgccaacaaccccagccctgctgccctgaccttccgggtcatcaacttcagccggctggagcacgtgctgcccaacccccagctgctgtgctgtgacaacacccagaatgatgccaacaccaaggagttctgggtgaacatgcccaacctgatgacccacctgaagaaggtgtctgagcagaagccccaggccacctactacaacgtggacatgctgaagtaccaggtgtctgcccagggcatccagagcacccccctgaacctggccgtgaactggaggtgtgagcccagcagcacagacctgagaattgactacaagtacaacacagatgccatgaccacagctgtggccctgaacaacgtgcagttcctggtgcccattgatggcggcgtgaccaagctgcaggccgtgctgcccccagctgtgtggaatgctgagcagcagaggatcctgtggaagatcccagacatcagccagaagtcagaaaatggaggagtgggcagcctgctggcccgcttccagctgtctgagggccccagcaagcccagccccctggtggtgcagttcaccagcgagggcagcaccctgagcggctgtgacatcgagctggtgggcgccggctaccgcttcagcctcatcaagaagagatttgctgctgggaagtacctggccgacaactag

SEQ ID NO: 169605 - DNA, 1896 bp, Artificial Sequence
  Description of Artificial Sequence: Synthetic coding sequence
atgatggagggcctgaagaagaggaccaggaaggccttcggcatcaggaagaaggagaaggacacagacagcacaggcagcccagacagagatggcatcaagaagagcaatggagccccaaatggcttctatgcagaaattgactgggagcgctacaacagccctgagctggatgaggagggctacagcatccggcctgaggagcccggcagcaccaagggcaagcacttctacagcagcagcgagagcgaggaggaggaggagagccacaagaagttcaacatcaagatcaagcccctgcagagcaaggacatcctgaagaatgctgccaccgtggatgagctgaaggccagcatcggcaacatcgccctgagccccagccctgtgggcgccatcaagaggaacctgagcagcgaggaggtggcccggcccaggaggagcacccccaccccagagctgatcagcaagaagcccccagatgacaccacagccctggcccccctgtttggaccacccctggagagcgcctttgatgagcagaagacagaggtgctgctggaccagcctgagatctggggcagcggccagcccatcaaccccagcatggagagccccaagctgacccggcccttccccaccggcaccccaccacccctgccccccaagaatgtgcctgccaccccacccaggacaggcagccccctgaccatcggccctggggccagcagccctgcccggcctgccacccccctggtgccctgccgcagcaccaccccacctcctcctccaccccggccccccagccggcccaagctgcccccaggcaagccaggagtgggagatgtgtcccggcccttcagcccccccatccacagcagcagccccccacccatcgcccccctggcccgggcagagagcaccagcagcatcagcagcaccaacagcctgtctgctgccaccacccccaccgtggtgtctgaagatgatgtgttctatgacaagctgcccagctttgagcggcgctgtgagaccccagctggcagcagccggggccccagccccctgaccatgggcgcccaggacaccctgcctgtggccgccgccttcacagagaccgtgaatgcctacttcaagggagctgaccccagcaagtgcatcgtgaagatcaccggggagatggtgctgtccttccctgctggcatcaccaggcactttgccaacaaccccagccctgctgccctgaccttccgggtcatcaacttcagccggctggagcacgtgctgcccaacccccagctgctgtgctgtgacaacacccagaatgatgccaacaccaaggagttctgggtgaacatgcccaacctgatgacccacctgaagaaggtgtctgagcagaagccccaggccacctactacaacgtggacatgctgaagtaccaggtgtctgcccagggcatccagagcacccccctgaacctggccgtgaactggaggtgtgagcccagcagcacagacctgagaattgactacaagtacaacacagatgccatgaccacagctgtggccctgaacaacgtgcagttcctggtgcccattgatggaggagtgaccaagctgcaggccgtgctgcccccagctgtgtggaatgctgagcagcagaggatcctgtggaagatcccagacatcagccagaagtcagaaaatggaggagtgggcagcctgctggcccgcttccagctgtctgagggccccagcaagcccagccccctggtggtgcagttcaccagcgagggcagcaccctgagcggctgtgacatcgagctggtgggcgccggctaccgcttcagcctcatcaagaagagatttgctgctgggaagtacctggccgacaactag

SEQ ID NO: 169606 - DNA, 2496 bp, Artificial Sequence
  Description of Artificial Sequence: Synthetic coding sequence
atggagggcctgaagaagaggaccaggaaggccttcggcatcaggaagaaggagaaggacacagacagcacaggcagcccagacagagatggcatccagggcaagaagaagacccagaagacccagctgctgctgaccagctgcttctggctgcgggccctgagcctgaccctgagccagaagaagagcaatggagcccccaacggcttctacgccgagattgactgggagcgctacaacagccctgagctggatgaggagggctacagcatccggcctgaggagcccggcagcaccaagggcaagcacttctacagcagcagcgagagcgaggaggaggaggagagccacaagaagttcaacatcaagatcaagcccctgcagagcaaggacatcctgaagaatgctgccaccgtggatgagctgaaggccagcatcggcaacatcgccctgagccccagccctgtgaggaagaaggagcggcgggagaagggggccatcaagaggaacctgagcagcgaggaggtggcccggccccggcgcagcacccccaccccagagctgatcagcaagaagcccccagatgacaccacagccctggcccccctgtttggcccccccctggagagcgcctttgatgagcagaagacagaggtgctgctggaccagcctgagatctggggcagcggccagcccatcaaccccagcatggagagccccaagctgacccggcccttccccaccggcaccccaccacccctgccccccaagaatgtgcctgccaccccacccaggacaggcagccccctgaccatcggccctggaaatgaccagagcgccacagaggtgaagattgagaagctgcccagcatcaatgacctggacagcatcttcggccctgtgctgagccccaagtctgtggccgtgaatgctgaggagaagtgggtgcacttcagtgacaccagccctgagcacgtgaccccagagctgaccccccgggagaaggtggtgtccccaccagccaccccagacaacccagctgacagccctgcccctggccccctgggccccccaggccccactggacctcctggccccccaggccccccaagaaatgtgctgagccccctgaacctggaggaggtgcagaagaaggtggccgagcagaccttcatcaaggatgactacctggagaccatcagcagccccaaggactttggcctgggccagagggccaccccacctcctcctcctccacccacctacagaacagtggtgagcagccctggccctggcagcggccctggccctggcaccaccagcggggccagcagccctgcccggcctgccacccccctggtgccctgccgcagcaccaccccacctcctcctccaccccggccccccagccggcccaagctgcccccaggcaagccaggagtgggagatgtgtcccggcccttcagcccccccatccacagcagcagccccccacccatcgcccccctggcccgggcagagagcaccagcagcatcagcagcaccaacagcctgtctgctgccaccacccccaccgtggagaatgagcagcccagcctggtgtggtttgaccggggcaagttctacctgacctttgagggcagcagccggggccccagccccctgaccatgggcgcccaggacaccctgcctgtggccgccgccttcacagagaccgtgaatgcctacttcaagggagctgaccccagcaagtgcatcgtgaagatcaccggggagatggtgctgtccttccctgctggcatcaccaggcactttgccaacaaccccagccctgctgccctgaccttccgggtcatcaacttcagccggctggagcacgtgctgcccaacccccagctgctgtgctgtgacaacacccagaatgatgccaacaccaaggagttctgggtgaacatgcccaacctgatgacccacctgaagaaggtgtctgagcagaagccccaggccacctactacaacgtggacatgctgaagtaccaggtgtctgcccagggcatccagagcacccccctgaacctggccgtgaactggaggtgtgagcccagcagcacagacctgagaattgactacaagtacaacacagatgccatgaccacagctgtggccctgaacaacgtgcagttcctggtgcccattgatggaggagtgaccaagctgcaggccgtgctgcccccagctgtgtggaatgctgagcagcagaggatcctgtggaagatcccagacatcagccagaagtcagaaaatggaggagtgggcagcctgctggcccgcttccagctgtctgagggccccagcaagcccagccccctggtggtgcagttcaccagcgagggcagcaccctgagcggctgtgacatcgagctggtgggcgccggctaccgcttcagcctcatcaagaagagatttgctgctgggaagtacctggccgacaactag

SEQ ID NO: 169607 - DNA, 783 bp, Artificial Sequence
  Description of Artificial Sequence: Synthetic coding sequence
atgatggagggcctgaagaagaggaccaggaaggccttcggcatcaggaagaaggagaaggacacagacagcacaggcagcccagacagagatggcatccagcccagcccccatgagcccccctacaacagcaaggcagaatgtgcccgggagggcggcaagaaggtgtccaagaagagcaatggagccccaaatggcttctatgcagaaattgactgggagcgctacaacagccctgagctggatgaggagggctacagcatccggcctgaggagcccggcagcaccaagggcaagcacttctacagcagcagcgagagcgaggaggaggaggagagccacaagaagttcaacatcaagatcaagcccctgcagagcaaggacatcctgaagaatgctgccaccgtggatgagctgaaggccagcatcggcaacatcgccctgagccccagccctgtgggcgccatcaagaggaacctgagcagcgaggaggtggcccggcccaggaggagcacccccaccccagagctgatcagcaagaagcccccagatgacaccacagccctggcccccctgtttggaccacccctggagagcgcctttgatgagcagaagacagaggtgctgctggaccagcctgagatctggggcagcggccagcccatcaaccccagcatggagagccccaagctgacccggcccttccccaccggcaccccaccacccctgccccccaagaatgtgcctgccaccccacccaggacaggcagccccctgacctag

SEQ ID NO: 169608 - DNA, 1002 bp, Artificial Sequence
  Description of Artificial Sequence: Synthetic coding sequence
atgacctgcagcgtgacccacatcgtgtccttcagcctgcccttcctgaaccccagccacccagccagcaccccaggccacacagaaaatgagcagcccagcctggtgtggtttgaccggggcaagttctacctgacctttgagggcagcagccggggccccagccccctgaccatgggcgcccaggacaccctgcctgtggccgccgccttcacagagaccgtgaatgcctacttcaagggagctgaccccagcaagtgcatcgtgaagatcaccggggagatggtgctgtccttccctgctggcatcaccaggcactttgccaacaaccccagccctgctgccctgaccttccgggtcatcaacttcagccggctggagcacgtgctgcccaacccccagctgctgtgctgtgacaacacccagaatgatgccaacaccaaggagttctgggtgaacatgcccaacctgatgacccacctgaagaaggtgtctgagcagaagccccaggccacctactacaacgtggacatgctgaagtaccaggtgtctgcccagggcatccagagcacccccctgaacctggccgtgaactggaggtgtgagcccagcagcacagacctgagaattgactacaagtacaacacagatgccatgaccacagctgtggccctgaacaacgtgcagttcctggtgcccattgatggaggagtgaccaagctgcaggccgtgctgcccccagctgtgtggaatgctgagcagcagaggatcctgtggaagatcccagacatcagccagaagtcagaaaatggaggagtgggcagcctgctggcccgcttccagctgtctgagggccccagcaagcccagccccctggtggtgcagttcaccagcgagggcagcaccctgagcggctgtgacatcgagctggtgggcgccggctaccgcttcagcctcatcaagaagagatttgctgctgggaagtacctggccgacaactag

SEQ ID NO: 169609 - DNA, 1107 bp, Artificial Sequence
  Description of Artificial Sequence: Synthetic coding sequence
atgtctgtggccggcctgaagaagcagttctacaaggccagccagctggtgtctgagaaggtgggcggcgctgagggcaccaagctggatgatgacttcaaggagatggagaagaaggtggatgtgaccagcaaggctgtgacagaggtgctggcccggaccatcgagtacctgcagcccaacccagccagccgggccaagctgaccatgctgaacacagtgtccaagatccggggccaggtgaagaaccctggctacccccagagcgagggcctgctgggggagtgcatgatccgccacggcaaggagctgggcggggagagcaactttggagatgccctgctggatgctggggagagcatgaagaggctggccgaggtgaaggacagcctggacatcgaggtgaagcagaacttcatcgaccccctgcagaacctgtgtgagaaggacctgaaggagatccagcaccacctgaagaagctggagggccggcggctggactttgactacaagaagaagaggcagggcaagatcccagatgaggagctgcggcaggccctggagaagtttgaggagagcaaggaggtggccgagacctccatgcacaacctgctggagacagacatcgagcaggtgtcccagctgagcgccctggtggatgcccagctggactaccaccggcaggccgtgcagatcctggatgagctggccgagaagctgaagaggaggatgagggaggccagcagccggcccaagcgggagtacaagcccaagccccgggagccctttgacctgggggagcctgagcagagcaatggaggcttcccctgcaccacagcccccaagattgctgccagcagcagcttccgcagcagtgacaagcccatccgcacccccagccgctccatgccacccctggaccagcccagctgcaaggccctgtatgactttgagccagaaaatgatggagagctgggcttccacgagggagatgtgatcaccctgaccaaccagattgatgagaactggtatgagggcatgctggatggccagagcggcttcttccccctgtcctatgtggaggtgctggtgcccctgccccagtag

SEQ ID NO: 169610 - DNA, 963 bp, Artificial Sequence
  Description of Artificial Sequence: Synthetic coding sequence
atgtctgtggccggcctgaagaagcagttctacaaggccagccagctggtgtctgagaaggtgggcggcgctgagggcaccaagctggatgatgacttcaaggagatggagaagaaggtggatgtgaccagcaaggctgtgacagaggtgctggcccggaccatcgagtacctgcagcccaaccctggagatgccctgctggatgctggggagagcatgaagaggctggccgaggtgaaggacagcctggacatcgaggtgaagcagaacttcatcgaccccctgcagaacctgtgtgagaaggacctgaaggagatccagcaccacctgaagaagctggagggccggcggctggactttgactacaagaagaagaggcagggcaagatcccagatgaggagctgcggcaggccctggagaagtttgaggagagcaaggaggtggccgagacctccatgcacaacctgctggagacagacatcgagcaggtgtcccagctgagcgccctggtggatgcccagctggactaccaccggcaggccgtgcagatcctggatgagctggccgagaagctgaagaggaggatgagggaggccagcagccggcccaagcgggagtacaagcccaagccccgggagccctttgacctgggggagcctgagcagagcaatggaggcttcccctgcaccacagcccccaagattgctgccagcagcagcttccgcagcagtgacaagcccatccgcacccccagccgctccatgccacccctggaccagcccagctgcaaggccctgtatgactttgagccagaaaatgatggagagctgggcttccacgagggagatgtgatcaccctgaccaaccagattgatgagaactggtatgagggcatgctggatggccagagcggcttcttccccctgtcctatgtggaggtgctggtgcccctgccccagtag

SEQ ID NO: 169611 - DNA, 915 bp, Artificial Sequence
  Description of Artificial Sequence: Synthetic coding sequence
atgtctgtggccggcctgaagaagcagttctacaaggccagccagctggtgtctgagaaggtgggcggcgctgagggcaccaagctggatgatgacttcaaggagatggagaagaaggtggatgtgaccagcaaggctgtgacagaggtgctggcccggaccatcgagtacctgcagcccaacccagccagccgggccaagctgaccatgctgaacacagtgtccaagatccggggccagaacctgtgtgagaaggacctgaaggagatccagcaccacctgaagaagctggagggccggcggctggactttgactacaagaagaagaggcagggcaagatcccagatgaggagctgcggcaggccctggagaagtttgaggagagcaaggaggtggccgagacctccatgcacaacctgctggagacagacatcgagcaggtgtcccagctgagcgccctggtggatgcccagctggactaccaccggcaggccgtgcagatcctggatgagctggccgagaagctgaagaggaggatgagggaggccagcagccggcccaagcgggagtacaagcccaagccccgggagccctttgacctgggggagcctgagcagagcaatggaggcttcccctgcaccacagcccccaagattgctgccagcagcagcttccgcagcagtgacaagcccatccgcacccccagccgctccatgccacccctggaccagcccagctgcaaggccctgtatgactttgagccagaaaatgatggagagctgggcttccacgagggagatgtgatcaccctgaccaaccagattgatgagaactggtatgagggcatgctggatggccagagcggcttcttccccctgtcctatgtggaggtgctggtgcccctgccccagtag

SEQ ID NO: 169612 - DNA, 1059 bp, Artificial Sequence
  Description of Artificial Sequence: Synthetic coding sequence
atgtctgtggccggcctgaagaagcagttccacaaggccacccagaaggtgtctgagaaggtgggcggcgctgagggcaccaagctggatgatgacttcaaggagatggagaggaaggtggatgtgaccagcagagctgtgatggagatcatgaccaagaccatcgagtacctgcagcccaacccagccagccgggccaagctgtccatgatcaacaccatgagcaagatccggggccaggagaagggccctggctacccccaggccgaggccctgctggccgaggccatgctgaagtttggccgggagctgggagatgactgcaactttggacctgccctgggggaggtgggggaggccatgagggagctgtctgaggtgaaggacagcctggacatcgaggtgaagcagaacttcatcgaccccctgcagaacctgcatgacaaggacctgcgggagatccagcaccacctgaagaagctggagggccggcggctggactttgactacaagaagaagaggcagggcaagatcccagatgaggagctgcggcaggccctggagaagtttgatgagagcaaggagattgctgagagctccatgttcaacctgctggagatggacatcgagcaggtgtcccagctgagcgccctggtgcaggcccagctggagtaccacaagcaggccgtgcagatcctgcagcaggtgacagtgcggctggaggagcgcatccggcaggccagcagccagccccggcgggagtaccagcccaagcccaggatgagcctggagttccccactggagacagcacccagcccaacggcggcctgagccacacaggcacccccaagcccagcggcgtgcagatggaccagccctgctgccgggccctgtatgactttgagccagaaaatgaaggagagctgggcttcaaggagggggacatcatcaccctgaccaaccagattgatgagaactggtatgagggcatgctgcacggccacagcggcttcttccccatcaactacgtggagatcctggtggccctgccccactag

SEQ ID NO: 169613 - DNA, 678 bp, Artificial Sequence
  Description of Artificial Sequence: Synthetic coding sequence
atgtctgtggccggcctgaagaagcagttccacaaggccacccagaaggtgtctgagaaggtgggcggcgctgagggcaccaagctggatgatgacttcaaggagatggagaggaaggtggatgtgaccagcagagctgtgatggagatcatgaccaagaccatcgagtacctgcagcccaaccctggcagcctggaggccgaggccctgctggccgaggccatgctgaagtttggccgggagctgggagatgactgcaactttggacctgccctgggggaggtgggggaggccatgagggagctgtctgaggtgaaggacagcctggacatcgaggtgaagcagaacttcatcgaccccctgcagaacctgcatgacaaggacctgcgggagatccagcaccacctgaagaagctggagggccggcggctggactttgactacaagaagaagaggcagggcaagatcccagatgaggagctgcggcaggccctggagaagtttgatgagagcaaggagattgctgagagctccatgttcaacctgctggagatggacatcgagcaggtgtcccagctgagcgccctggtgcaggcccagctggagtaccacaagcaggccgtgcagatcctgcagcaggtgacagtgcggctggaggagcgcatccggcaggcctag

SEQ ID NO: 169614 - DNA, 918 bp, Artificial Sequence
  Description of Artificial Sequence: Synthetic coding sequence
atggagatcatgaccaagaccatcgagtacctgcagcccaacccagccagccgggccaagctgtccatgatcaacaccatgagcaagatccggggccaggagaagggccctggctacccccaggccgaggccctgctggccgaggccatgctgaagtttggccgggagctgggagatgactgcaactttggacctgccctgggggaggtgggggaggccatgagggagctgtctgaggtgaaggacagcctggacatcgaggtgaagcagaacttcatcgaccccctgcagaacctgcatgacaaggacctgcgggagatccagcaccacctgaagaagctggagggccgccgcctggactttgactacaagaagaagaggcagggcaagatcccagatgaggagctgcggcaggccctggagaagtttgatgagagcaaggagattgctgagagctccatgttcaacctgctggagatggacatcgagcaggtgtcccagctgagcgccctggtgcaggcccagctggagtaccacaagcaggccgtgcagatcctgcagcaggtgacagtgcggctggaggagcgcatccggcaggccagcagccagccccggcgggagtaccagcccaagcccaggatgagcctggagttccccaccggggacagcacccagcccaatggaggcctgagccacacaggcacccccaagcccagcggcgtgcagatggaccagccctgctgccgggccctgtatgactttgagccagaaaatgaaggagagctgggcttcaaggagggggacatcatcaccctgaccaaccagattgatgagaactggtatgagggcatgctgcacggccacagcggcttcttccccatcaactacgtggagatcctggtggccctgccccactag

SEQ ID NO: 169615 - DNA, 546 bp, Artificial Sequence
  Description of Artificial Sequence: Synthetic coding sequence
atgtctgtggccggcctgaagaagcagttccacaaggccacccagaaggtgtctgagaaggtgggcggcgctgagggcaccaagctggatgatgacttcaaggagatggagattgagcaggtgtcccagctgagcgccctggtgcaggcccagctggagtaccacaagcaggccgtgcagatcctgcagcaggtgacagtgcggctggaggagcgcatccggcaggccagcagccagccccggcgggagtaccagcccaagcccaggatgagcctggagttccccaccggggacagcacccagcccaatggaggcctgagccacacaggcacccccaagcccagcggcgtgcagatggaccagccctgctgccgggccctgtatgactttgagccagaaaatgaaggagagctgggcttcaaggagggggacatcatcaccctgaccaaccagattgatgagaactggtatgagggcatgctgcacggccacagcggcttcttccccatcaactacgtggagatcctggtggccctgccccactag

SEQ ID NO: 169616 - DNA, 1068 bp, Artificial Sequence
  Description of Artificial Sequence: Synthetic coding sequence
atggatggcatctttgctggcatcatctgcaaccaggccaaccgctgcctgacctggaccagccagcagctgttcagcgagaagatcagcggggctgagggcaccaagctggatgatgagttcctggacatggagaggaagattgatgtgaccaacaaggtggtggccgagatcctgagcaagaccacagagtacctgcagcccaacccagcctaccgggccaagctgggcatgctgaacacagtgtccaagatccggggccaggtgaagaccaccggctacccccagacagagggcctgctgggggactgcatgctgaagtatggcaaggagctgggggaggacagcacctttggaaatgccctgattgaggtgggggagagcatgaagctgatggccgaggtgaaggacagcctggacatcaacgtgaagcagaccttcatcgaccccctgcagctgctgcaggacaaggacctgaaggagatcggccaccacctgaagaagctggagggccggcggctggactatgactacaagaagaagagggtgggcaagatcccagatgaggaggtgcggcaggccgtggagaagtttgaggagagcaaggagctggccgagaggtccatgttcaacttcctggagaatgatgtggagcaggtgtcccagctggccgtgttcattgaagctgccctggactaccaccggcagagcacagagatcctgcaggagctgcagagcaagctgcagatgaggatctctgctgccagctctgtgccccggcgggagtacaagcccaggcctgtgaagaggagcagcagcgagctgaatggagtgtccaccacctctgtggtgaagaccaccggcagcaacatccccatggaccagccctgctgccggggcctgtatgactttgagcctgagaaccagggcgagctgggcttcaaggagggggacatcatcaccctgaccaaccagattgatgagaactggtatgagggcatgatccacggggagagcggcttcttccccatcaactacgtggaggtgattgtgcccctgccccagtag

SEQ ID NO: 169617 - DNA, 1044 bp, Artificial Sequence
  Description of Artificial Sequence: Synthetic coding sequence
atgtctgtggccggcctgaagaagcagttccacaaggccagccagctgttcagcgagaagatcagcggggctgagggcaccaagctggatgatgagttcctggacatggagaggaagattgatgtgaccaacaaggtggtggccgagatcctgagcaagaccacagagtacctgcagcccaacccagcctaccgggccaagctgggcatgctgaacacagtgtccaagatccggggccaggtgaagaccaccggctacccccagacagagggcctgctgggggactgcatgctgaagtatggcaaggagctgggggaggacagcacctttggaaatgccctgattgaggtgggggagagcatgaagctgatggccgaggtgaaggacagcctggacatcaacgtgaagcagaccttcatcgaccccctgcagctgctgcaggacaaggacctgaaggagatcggccaccacctgaagaagctggagggccggcggctggactatgactacaagaagaagagggtgggcaagatcccagatgaggaggtgcggcaggccgtggagaagtttgaggagagcaaggagctggccgagaggtccatgttcaacttcctggagaatgatgtggagcaggtgtcccagctggccgtgttcattgaagctgccctggactaccaccggcagagcacagagatcctgcaggagctgcagagcaagctgcagatgaggatctctgctgccagctctgtgccccggcgggagtacaagcccaggcctgtgaagaggagcagcagcgagctgaatggagtgtccaccacctctgtggtgaagaccaccggcagcaacatccccatggaccagccctgctgccggggcctgtatgactttgagcctgagaaccagggcgagctgggcttcaaggagggggacatcatcaccctgaccaaccagattgatgagaactggtatgagggcatgatccacggggagagcggcttcttccccatcaactacgtggaggtgattgtgcccctgccccagtag

SEQ ID NO: 169618 - DNA, 1068 bp, Artificial Sequence; identical to SEQ ID NO: 169616
  Description of Artificial Sequence: Synthetic coding sequence

SEQ ID NO: 169619 - DNA, 867 bp, Artificial Sequence
  Description of Artificial Sequence: Synthetic coding sequence
atgtctgtggccggcctgaagaagcagttccacaaggccagccagctgttcagcgagaagatcagcggggctgagggcaccaagctggatgatgagttcctggacatggagaggaagattgatgtgaccaacaaggtggtggccgagatcctgagcaagaccacagagtacctgcagcccaacccagcctaccgggccaagctgggcatgctgaacacagtgtccaagatccggggccaggtgaagaccaccggctacccccagacagagggcctgctgggggactgcatgctgaagtatggcaaggagctgggggaggacagcacctttggaaatgccctgattgaggtgggggagagcatgaagctgatggccgaggtgaaggacagcctggacatcaacgtgaagcagaccttcatcgaccccctgcagctgctgcaggacaaggacctgaaggagatcggccaccacctgaagaagctggagggccggcggctggactatgactacaagaagaagagggtgggcaagatcccagatgaggaggtgcggcaggccgtggagaagtttgaggagagcaaggagctggccgagaggtccatgttcaacttcctggagaatgatgtggagcaggtgtcccagctggccgtgttcattgaagctgccctggactaccaccggcagagcacagagatcctgcaggagctgcagagcaagctgcagatgaggatctctgctgccagctctgtgccccggcgggagtacaagcccaggcctgtgaagaggagcagcagcgagctgaatggagtgtccaccacctctgtggtgaagaccacagcctacagccggctggagcctgctgactag

SEQ ID NO: 169620 - DNA, 1662 bp, Artificial Sequence
  Description of Artificial Sequence: Synthetic coding sequence
atggtggaggccatcgtggagtttgactaccaggcccagcatgatgatgagctgaccatctctgtgggggagatcatcaccaacatcaggaaggaggatggcggctggtgggagggccagatcaatggccggcggggcctcttcccagacaactttgtgcgggagatcaagaaggagatgaagaaggaccccctgaccaacaaggcccctgagaagcccctgcacgaggtgcccagcggcaacagcctgctgagcagcgagaccatcctgcggaccaacaagagaggagagaggagaagaagacgctgccaggtggccttctcctacctgccccagaatgatgatgagctggagctgaaggtgggggacatcatcgaggtggtgggggaggtggaggagggctggtgggagggcgtgctgaatggcaagacaggcatgttccccagcaacttcatcaaggagctgagcggggagagtgatgagctgggcatcagccaggatgagcagctgagcaagagcaggcctgagggcctgcccccagccagcctgctgcccttccctgcccatggagccaagggcaagaccacctttgagggcaccatcctgtacagagctgcccctgggaagacagagggccaccggcgctactacagcctgcgggagaccactggaagtgaaagtgatggaggagacagcagcagcaccaagtctgagggcgccaatggaacagtggccacagctgccatccagcccaagaaggtgaagggcgtgggctttggagacatcttcaaggacaagcccatcaagctgcggcccaggagcattgaggtggagaatgacttcctgcctgtggagaagaccatcggcaagaagctgcctgccaccacagccaccccagacagcagcaagacagagatggacagcaggaccaagagcaaggactactgcaaggtgatcttcccctatgaggcccagaatgatgatgagctgaccatcaaggagggggacatcgtgaccctcatcaacaaggactgcattgatgtgggctggtgggagggggagctgaatggccggcggggcgtcttcccagacaactttgtgaagctgctgcccccagactttgagaaggagggcaaccggcccaagaagcccccaccacccagcgcccctgtgatcaagcagggcgccggcaccacagagaggaagcatgagatcaagaagatccccccagagaggcctgagatgctgcccaacagaacagaggagaaggagaggcctgagcgggagcccaagctggacctgcagaagcccagcgtgcctgccatcccccccaagaagcccaggcctcccaagaccaacagcctgagcaggcctggggccctgcccccccggcggcctgagaggcctgtgggccccctgacccacacccgctactgctgtgccctgaccagcggggccggcgtgggctggctgtggaaggagcaccggcggggcacagactgccaccggccctgggaggagggccgcggggagggcggggcccaggccagcctgctgcaccccccagccaagctgtctgaggacaccggccacttctgcccctgcagctgcacccaggccggcgtgtctgtgcggctgcggggagctgtgtgggtgtcctag

SEQ ID NO: 169621 - DNA, 1887 bp, Artificial Sequence
  Description of Artificial Sequence: Synthetic coding sequence
atggaggtgtctgctgccaaggcccccagcgctgctgacctgtctgaaattgagatcaagaaggagatgaagaaggaccccctgaccaacaaggcccctgagaagcccctgcacgaggtgcccagcggcaacagcctgctgagcagcgagaccatcctgcggaccaacaagagaggagagaggagaagaagacgctgccaggtggccttctcctacctgccccagaatgatgatgagctggagctgaaggtgggggacatcatcgaggtggtgggggaggtggaggagggctggtgggagggcgtgctgaatggcaagacaggcatgttccccagcaacttcatcaaggagctgtctggagagagtgatgagctgggcatcagccaggatgagcagctgagcaagagcagcctgcgggagaccaccggcagcgagagtgatggaggagacagcagcagcaccaagtctgagggcgccaacggcaccgtggccacagctgccatccagcccaagaaggtgaagggcgtgggctttggagacatcttcaaggacaagcccatcaagctgcggcccaggagcattgaggtggagaatgacttcctgcctgtggagaagaccatcggcaagaagctgcctgccaccacagccaccccagacagcagcaagacagagatggacagcaggaccaagagcaaggactactgcaaggtgatcttcccctatgaggcccagaatgatgatgagctgaccatcaaggagggggacatcgtgaccctcatcaacaaggactgcattgatgtgggctggtgggagggggagctgaatggaagaagaggagtcttcccagacaactttgtgaagctgctgcccccagactttgagaaggagggcaaccggcccaagaagcccccacctccttctgcccctgtgatcaagcagggcgccggcaccacagagaggaagcatgagatcaagaagatccccccagagaggcctgagatgctgcccaacagaacagaggagaaggagaggcctgagcgggagcccaagctggacctgcagaagcccagcgtgcctgccatcccccccaagaagccccggccccccaagaccaacagcctgagcaggcctggggccctgcccccaagaagacctgagaggcctgtgggccccctgacccacaccaggggggacagccccaagattgacctggccggcagcagcctgagcggcatcctggacaaggacctgagtgacaggagcaatgacatcgacctggagggctttgattctgtggtgagcagcacagagaagctgagccaccccaccaccagccggcccaaggccaccggccggcggccccccagccagagcctgaccagcagcagcctgagcagcccagacatctttgacagccccagccctgaggaggacaaggaggagcacatcagcctggcccacagaggagtggatgccagcaagaagaccagcaagacagtgaccatcagccaggtgtctgacaacaaggccagcctgccccccaagccaggcaccatggctgctgggggcggcggccctgcccccctgagcagcgctgcccccagccccctgagcagcagcctgggcacagctggccaccgggccaacagccccagcctgtttggaacagagggcaagcccaagatggagcctgctgccagcagccaggccgctgtggaggagctgcggacccaggtgcgggagctgcggagcatcatcgagaccatgaaggaccagcagaagcgggagatcaagcagctgctgtctgagctggatgaggagaagaagatccggctgcggctgcagatggaggtgaatgacatcaagaaggccctgcagagcaagtag

SEQ ID NO: 169622 - DNA, 1953 bp, Artificial Sequence
  Description of Artificial Sequence: Synthetic coding sequence
atgaagaaggaccccctgaccaacaaggcccctgagaagcccctgcacgaggtgcccagcggcaacagcctgctgagcagcgagaccatcctgcggaccaacaagagaggagagaggagaagaagacgctgccaggtggccttctcctacctgccccagaatgatgatgagctggagctgaaggtgggggacatcatcgaggtggtgggggaggtggaggagggctggtgggagggcgtgctgaatggcaagacaggcatgttccccagcaacttcatcaaggagctgtctggagagagtgatgagctgggcatcagccaggatgagcagctgagcaagagcaggcctgagggcctgcccccagccagcctgctgcccttccctgcccacggggccaagggcaagaccacctttgagggcaccatcctgtaccgggccgcccctgggaagacagagggccaccggcgctactacagcctgcgggagaccaccggcagcgagagtgatggaggagacagcagcagcaccaagtctgagggcgccaacggcaccgtggccacagctgccatccagcccaagaaggtgaagggcgtgggctttggagacatcttcaaggacaagcccatcaagctgcggcccaggagcattgaggtggagaatgacttcctgcctgtggagaagaccatcggcaagaagctgcctgccaccacagccaccccagacagcagcaagacagagatggacagcaggaccaagagcaaggactactgcaaggtgatcttcccctatgaggcccagaatgatgatgagctgaccatcaaggagggggacatcgtgaccctcatcaacaaggactgcattgatgtgggctggtgggagggggagctgaatggaagaagaggagtcttcccagacaactttgtgaagctgctgcccccagactttgagaaggagggcaaccggcccaagaagcccccacctccttctgcccctgtgatcaagcagggcgccggcaccacagagaggaagcatgagatcaagaagatccccccagagaggcctgagatgctgcccaacagaacagaggagaaggagaggcctgagcgggagcccaagctggacctgcagaagcccagcgtgcctgccatcccccccaagaagccccggccccccaagaccaacagcctgagcaggcctggggccctgcccccaagaagacctgagaggcctgtgggccccctgacccacaccaggggggacagccccaagattgacctggccggcagcagcctgagcggcatcctggacaaggacctgagtgacaggagcaatgacatcgacctggagggctttgattctgtggtgagcagcacagagaagctgagccaccccaccaccagccggcccaaggccaccggccggcggccccccagccagagcctgaccagcagcagcctgagcagcccagacatctttgacagccccagccctgaggaggacaaggaggagcacatcagcctggcccacagaggagtggatgccagcaagaagaccagcaagacagtgaccatcagccaggtgtctgacaacaaggccagcctgccccccaagccaggcaccatggctgctgggggcggcggccctgcccccctgagcagcgctgcccccagccccctgagcagcagcctgggcacagctggccaccgggccaacagccccagcctgtttggaacagagggcaagcccaagatggagcctgctgccagcagccaggccgctgtggaggagctgcggacccaggtgcgggagctgcggagcatcatcgagaccatgaaggaccagcagaagcgggagatcaagcagctgctgtctgagctggatgaggagaagaagatccggctgcggctgcagatggaggtgaatgacatcaagaaggccctgcagagcaagtag

SEQ ID NO: 169623 - DNA, 1284 bp, Artificial Sequence
  Description of Artificial Sequence: Synthetic coding sequence
atgggagaggagaccatcggcaagaagctgcctgccaccacagccaccccagacagcagcaagacagagatggacagcaggaccaagagcaaggactactgcaaggtgatcttcccctatgaggcccagaatgatgatgagctgaccatcaaggagggggacatcgtgaccctcatcaacaaggactgcattgatgtgggctggtgggagggggagctgaatggccggcggggcgtcttcccagacaactttgtgaagctgctgcccccagactttgagaaggagggcaaccggcccaagaagcccccaccacccagcgcccctgtgatcaagcagggcgccggcaccacagagaggaagcatgagatcaagaagatccccccagagaggcctgagatgctgcccaacagaacagaggagaaggagaggcctgagcgggagcccaagctggacctgcagaagcccagcgtgcctgccatcccccccaagaagcccaggcctcccaagaccaacagcctgagcaggcctggggccctgcccccccggcggcctgagaggcctgtgggccccctgacccacaccaggggggacagccccaagattgacctggccggcagcagcctgagcggcatcctggacaaggacctgagtgacaggagcaatgacatcgacctggagggctttgacagcgtggtgagcagcacagagaagctgagccaccccaccaccagccggcccaaggccactggaagaagaccacccagccagagcctgaccagcagcagcctgagcagcccagacatctttgacagccccagccctgaggaggacaaggaggagcacatcagcctggcccaccggggcgtggatgccagcaagaagaccagcaagacagtgaccatcagccaggtgtctgacaacaaggccagcctgccccccaagccaggcaccatggccgccggcggcggcggccctgcccccctgagcagcgctgcccccagccccctgagcagcagcctgggcacagctggccaccgggccaacagccccagcctgtttggaacagagggcaagcccaagatggagcctgctgccagcagccaggccgctgtggaggagctgcggacccaggtgcgggagctgcggagcatcatcgagaccatgaaggaccagcagaagcgggagatcaagcagctgctgtctgagctggatgaggagaagaagatccggctgcggctgcagatggaggtgaatgacatcaagaaggccctgcagagcaagtag

SEQ ID NO: 169624 - DNA, 1938 bp, Artificial Sequence
  Description of Artificial Sequence: Synthetic coding sequence
ctgaccaacaaggcccctgagaagcccctgcacgaggtgcccagcggcaacagcctgctgagcagcgagaccatcctgcggaccaacaagagaggagagaggagaagaagacgctgccaggtggccttctcctacctgccccagaatgatgatgagctggagctgaaggtgggggacatcatcgaggtggtgggggaggtggaggagggctggtgggagggcgtgctgaatggcaagacaggcatgttccccagcaacttcatcaaggagctgagcggggagagtgatgagctgggcatcagccaggatgagcagctgagcaagagcaggcctgagggcctgcccccagccagcctgctgcccttccctgcccatggagccaagggcaagaccacctttgagggcaccatcctgtacagagctgcccctgggaagacagagggccaccggcgctactacagcctgcgggagaccactggaagtgaaagtgatggaggagacagcagcagcaccaagtctgagggcgccaatggaacagtggccacagctgccatccagcccaagaaggtgaagggcgtgggctttggagacatcttcaaggacaagcccatcaagctgcggcccaggagcattgaggtggagaatgacttcctgcctgtggagaagaccatcggcaagaagctgcctgccaccacagccaccccagacagcagcaagacagagatggacagcaggaccaagagcaaggactactgcaaggtgatcttcccctatgaggcccagaatgatgatgagctgaccatcaaggagggggacatcgtgaccctcatcaacaaggactgcattgatgtgggctggtgggagggggagctgaatggccggcggggcgtcttcccagacaactttgtgaagctgctgcccccagactttgagaaggagggcaaccggcccaagaagcccccaccacccagcgcccctgtgatcaagcagggcgccggcaccacagagaggaagcatgagatcaagaagatccccccagagaggcctgagatgctgcccaacagaacagaggagaaggagaggcctgagcgggagcccaagctggacctgcagaagcccagcgtgcctgccatcccccccaagaagcccaggcctcccaagaccaacagcctgagcaggcctggggccctgcccccccggcggcctgagaggcctgtgggccccctgacccacaccaggggggacagccccaagattgacctggccggcagcagcctgagcggcatcctggacaaggacctgagtgacaggagcaatgacatcgacctggagggctttgacagcgtggtgagcagcacagagaagctgagccaccccaccaccagccggcccaaggccactggaagaagaccacccagccagagcctgaccagcagcagcctgagcagcccagacatctttgacagccccagccctgaggaggacaaggaggagcacatcagcctggcccaccggggcgtggatgccagcaagaagaccagcaagacagtgaccatcagccaggtgtctgacaacaaggccagcctgccccccaagccaggcaccatggccgccggcggcggcggccctgcccccctgagcagcgctgcccccagccccctgagcagcagcctgggcacagctggccaccgggccaacagccccagcctgtttggaacagagggcaagcccaagatggagcctgctgccagcagccaggccgctgtggaggagctgcggacccaggtgcgggagctgcggagcatcatcgagaccatgaaggaccagcagaagcgggagatcaagcagctgctgtctgagctggatgaggagaagaagatccggctgcggctgcagatggaggtgaatgacatcaagaaggccctgcagagcaagtag

SEQ ID NO: 169625 - DNA, 450 bp, Artificial Sequence
  Description of Artificial Sequence: Synthetic coding sequence
tttgagaccagcgagaggagaagaagacgctgccaggtggccttctcctacctgccccagaatgatgatgagctggagctgaaggtgggggacatcatcgaggtggtgggggaggtggaggagggctggtgggagggcgtgctgaatggcaagacaggcatgttccccagcaacttcatcaaggagctgagcggggagagtgatgagctgggcatcagccaggatgagcagctgagcaagagcagcctgcgggagaccactggaagtgaaagtgatggaggagacagcagcagcaccaagtctgagggcgccaatggaacagtggccacagctgccatccagcccaagaaggtgaagggcgtgggctttggagacatcttcaaggacaagcccatcaagctgcggcccaggagcattgaggtggagaatgacttcctgcctgtggagtag

SEQ ID NO: 169626 - DNA, 1998 bp, Artificial Sequence
  Description of Artificial Sequence: Synthetic coding sequence
atggtggaggccatcgtggagtttgactaccaggcccagcatgatgatgagctgaccatctctgtgggggagatcatcaccaacatcaggaaggaggatggcggctggtgggagggccagatcaatggccggcggggcctcttcccagacaactttgtgcgggagatcaagaaggagatgaagaaggaccccctgaccaacaaggcccctgagaagcccctgcacgaggtgcccagcggcaacagcctgctgagcagcgagaccatcctgcggaccaacaagagaggagagaggagaagaagacgctgccaggtggccttctcctacctgccccagaatgatgatgagctggagctgaaggtgggggacatcatcgaggtggtgggggaggtggaggagggctggtgggagggcgtgctgaatggcaagacaggcatgttccccagcaacttcatcaaggagctgagcggggagagtgatgagctgggcatcagccaggatgagcagctgagcaagagcagcctgcgggagaccactggaagtgaaagtgatggaggagacagcagcagcaccaagtctgagggcgccaatggaacagtggccacagctgccatccagcccaagaaggtgaagggcgtgggctttggagacatcttcaaggacaagcccatcaagctgcggcccaggagcattgaggtggagaatgacttcctgcctgtggagaagaccatcggcaagaagctgcctgccaccacagccaccccagacagcagcaagacagagatggacagcaggaccaagagcaaggactactgcaaggtgatcttcccctatgaggcccagaatgatgatgagctgaccatcaaggagggggacatcgtgaccctcatcaacaaggactgcattgatgtgggctggtgggagggggagctgaatggccggcggggcgtcttcccagacaactttgtgaagctgctgcccccagactttgagaaggagggcaaccggcccaagaagcccccaccacccagcgcccctgtgatcaagcagggcgccggcaccacagagaggaagcatgagatcaagaagatccccccagagaggcctgagatgctgcccaacagaacagaggagaaggagaggcctgagcgggagcccaagctggacctgcagaagcccagcgtgcctgccatcccccccaagaagcccaggcctcccaagaccaacagcctgagcaggcctggggccctgcccccccggcggcctgagaggcctgtgggccccctgacccacaccaggggggacagccccaagattgacctggccggcagcagcctgagcggcatcctggacaaggacctgagtgacaggagcaatgacatcgacctggagggctttgacagcgtggtgagcagcacagagaagctgagccaccccaccaccagccggcccaaggccactggaagaagaccacccagccagagcctgaccagcagcagcctgagcagcccagacatctttgacagccccagccctgaggaggacaaggaggagcacatcagcctggcccaccggggcgtggatgccagcaagaagaccagcaagacagtgaccatcagccaggtgtctgacaacaaggccagcctgccccccaagccaggcaccatggccgccggcggcggcggccctgcccccctgagcagcgctgcccccagccccctgagcagcagcctgggcacagctggccaccgggccaacagccccagcctgtttggaacagagggcaagcccaagatggagcctgctgccagcagccaggccgctgtggaggagctgcggacccaggtgcgggagctgcggagcatcatcgagaccatgaaggaccagcagaagcgggagatcaagcagctgctgtctgagctggatgaggagaagaagatccggctgcggctgcagatggaggtgaatgacatcaagaaggccctgcagagcaagtag

SEQ ID NO: 169627 - DNA, 450 bp, Artificial Sequence
  Description of Artificial Sequence: Synthetic coding sequence
atggagaggtctgagaggagaagaagacgctgccaggtggccttctcctacctgccccagaatgatgatgagctggagctgaaggtgggggacatcatcgaggtggtgggggaggtggaggagggctggtgggagggcgtgctgaatggcaagacaggcatgttccccagcaacttcatcaaggagctgagcggggagagtgatgagctgggcatcagccaggatgagcagctgagcaagagcagcctgcgggagaccactggaagtgaaagtgatggaggagacagcagcagcaccaagtctgagggcgccaatggaacagtggccacagctgccatccagcccaagaaggtgaagggcgtgggctttggagacatcttcaaggacaagcccatcaagctgcggcccaggagcattgaggtggagaatgacttcctgcctgtggagtag

SEQ ID NO: 169628 - DNA, 627 bp, Artificial Sequence
  Description of Artificial Sequence: Synthetic coding sequence
atggagatcaagaaggagatgaagaaggaccccctgaccaacaaggcccctgagaagcccctgcacgaggtgcccagcggcaacagcctgctgagcagcgagaccatcctgcggaccaacaagagaggagagaggagaagaagacgctgccaggtggccttctcctacctgccccagaatgatgatgagctggagctgaaggtgggggacatcatcgaggtggtgggggaggtggaggagggctggtgggagggcgtgctgaatggcaagacaggcatgttccccagcaacttcatcaaggagctgtctggagagagtgatgagctgggcatcagccaggatgagcagctgagcaagagcagcctgcgggagaccaccggcagcgagagtgatggaggagacagcagcagcaccaagtctgagggcgccaacggcaccgtggccacagctgccatccagcccaagaaggtgaagggcgtgggctttggagacatcttcaaggacaagcccatcaagctgcggcccaggagcattgaggtggagaatgacttcctgcctgtggagaagaccatcggcaagaagctgcctgccaccacagccaccccagacagcagcaagacagaatag

SEQ ID NO: 169629 - DNA, 1215 bp, Artificial Sequence
  Description of Artificial Sequence: Synthetic coding sequence
atggacagcaggaccaagagcaaggactactgcaaggtgatcttcccctatgaggcccagaatgatgatgagctgaccatcaaggagggggacatcgtgaccctcatcaacaaggactgcattgatgtgggctggtgggagggggagctgaatggaagaagaggagtcttcccagacaactttgtgaagctgctgcccccagactttgagaaggagggcaaccggcccaagaagcccccacctccttctgcccctgtgatcaagcagggcgccggcaccacagagaggaagcatgagatcaagaagatccccccagagaggcctgagatgctgcccaacagaacagaggagaaggagaggcctgagcgggagcccaagctggacctgcagaagcccagcgtgcctgccatcccccccaagaagccccggccccccaagaccaacagcctgagcaggcctggggccctgcccccaagaagacctgagaggcctgtgggccccctgacccacaccaggggggacagccccaagattgacctggccggcagcagcctgagcggcatcctggacaaggacctgagtgacaggagcaatgacatcgacctggagggctttgattctgtggtgagcagcacagagaagctgagccaccccaccaccagccggcccaaggccaccggccggcggccccccagccagagcctgaccagcagcagcctgagcagcccagacatctttgacagccccagccctgaggaggacaaggaggagcacatcagcctggcccacagaggagtggatgccagcaagaagaccagcaagacagtgaccatcagccaggtgtctgacaacaaggccagcctgccccccaagccaggcaccatggctgctgggggcggcggccctgcccccctgagcagcgctgcccccagccccctgagcagcagcctgggcacagctggccaccgggccaacagccccagcctgtttggaacagagggcaagcccaagatggagcctgctgccagcagccaggccgctgtggaggagctgcggacccaggtgcgggagctgcggagcatcatcgagaccatgaaggaccagcagaagcgggagatcaagcagctgctgtctgagctggatgaggagaagaagatccggctgcggctgcagatggaggtgaatgacatcaagaaggccctgcagagcaagtag

SEQ ID NO: 169630 - DNA, 456 bp, Artificial Sequence
  Description of Artificial Sequence: Synthetic coding sequence
atgaactgggccccagccacctgctgggccctgctgctggccgccgccttcctgtgtgacagcggggccgccaagggcggccggggcggggcccggggcagcgcccggggcggcgtgcggggcggggcccggggggccagccgggtgcgggtgcggcctgcccagagatatggagcccctggcagcagcctgcgggtggccgctgctggagctgctgctggagctgctgctggagctgctgctggcctggccgccggcagcggctggaggagagctgctggccctggagagcggggcctggaggatgaggaggatggagtgcctggaggaaatggaactggacctggcatctacagctaccgggcctggaccagcggggccggccccacccggggcccccggctgtgcctggtgctgggcggggccctgggcgccctgggcctgctgcggccctag

SEQ ID NO: 169631 - DNA, 456 bp, Artificial Sequence; identical to SEQ ID NO: 169630
  Description of Artificial Sequence: Synthetic coding sequence

SEQ ID NO: 169632 - DNA, 981 bp, Artificial Sequence
  Description of Artificial Sequence: Synthetic coding sequence
atggcccctcctgctggaggagctgctgctgctgccagtgacctgggcagcgctgctgtgctgctggccgtgcacgccgctgtgcggcccctgggcgccggcccagatgctgaggcccagctgcggcggctgcagctgtctgctgaccctgagaggcctggccgcttccggctggagctgctgggcgccggccctggagctgtgaacctggagtggcccctggagagcgtgtcctacaccatccggggccccacccagcacgagctgcagcccccacctgggggccctggcaccctgagcctgcacttcctgaacccccaggaggcccagcgctgggccgtgctggtgcggggggccaccgtggagggccagaatggcagcaagagcaacagccccccagccctgggccctgaggcctgccctgtgtccctgcccagccccccagaggccagcaccctgaagggccccccacctgaggccgacctgcccaggagccctggcaacctgacagagcgggaggagctggccggcagcctggcccgggccatcgctggaggagatgagaagggagctgcccaggtggccgctgtgctggcccagcaccgggtggccctgtctgtgcagctgcaggaggcctgcttccccccaggccccatccggctgcaggtgaccctggaggatgctgccagcgctgccagcgctgccagcagcgcccacgtggccctgcaggtgcacccccactgcaccgtggccgccctgcaggagcaggtgttttctgagctgggcttccccccagctgtgcagcgctgggtgattggccgctgcctgtgtgtgcctgagaggagcctggccagctatggagtgcggcaggatggagaccctgccttcctgtacctgctgagcgccccccgggaggccccagcccagctggtgctgtccttcctgcacctgcaccagtgccccaggcctccctggctgtag

SEQ ID NO: 169633 - DNA, 1164 bp, Artificial Sequence
  Description of Artificial Sequence: Synthetic coding sequence
atggcccctcctgctggaggagctgctgctgctgccagtgacctgggcagcgctgctgtgctgctggccgtgcacgccgctgtgcggcccctgggcgccggcccagatgctgaggcccagctgcggcggctgcagctgtctgctgaccctgagaggcctggccgcttccggctggagctgctgggcgccggccctggagctgtgaacctggagtggcccctggagagcgtgtcctacaccatccggggccccacccagcacgagctgcagcccccacctgggggccctggcaccctgagcctgcacttcctgaacccccaggaggcccagcgctgggccgtgctggtgcggggggccaccgtggagggccagaatggcagcaagagcaacagccccccagccctgggccctgaggcctgccctgtgtccctgcccagccccccagaggccagcaccctgaagggccccccacctgaggccgacctgcccaggagccctggcaacctgacagagcgggaggagctggccggcagcctggcccgggccatcgctggaggagatgagaagggagctgcccaggtggccgctgtgctggcccagcaccgggtggccctgtctgtgcagctgcaggaggcctgcttccccccaggccccatccggctgcaggtgaccctggaggatgctgccagcgctgccagcgctgccagcagcgcccacgtggccctgcaggtgcacccccactgcaccgtggccgccctgcaggagcaggtgttttctgagctgggcttccccccagctgtgcagcgctgggtgattggccgctgcctgtgtgtgcctgagaggagcctggccagctatggagtgcggcaggatggagaccctgccttcctgtacctgctgagcgccccccgggaggccccagccaccggccccagcccccagcacccccagaagatggatggagagctgggccgcctcttcccccccagcctgggcctgcccccaggcccccagcctgctgccagcagcctgcccagccccctgcagcccagctggagctgccccagctgcaccttcatcaatgccccagaccggcccggctgtgagatgtgcagcacccagaggccctgcacctgggaccccctggccgccgccagcacctag

SEQ ID NO: 169634 - DNA, 2019 bp, Artificial Sequence
  Description of Artificial Sequence: Synthetic coding sequence
atggctgatggcagcctgactggaggcggcctggaggccgccgccatggcccctgagaggatgggctgggccgtggagcaggagctggccagcctggagaagggcctcttccaggatgaggacagctgcagcgactgcagctacagagacaagccaggcagcagcctgcagagcttcatgcctgagggcaagaccttcttccctgagatcttccagaccaaccagctgctcttctatgagcgcttccgggcctaccaggactacatcctggccgactgcaaggccagcgaggtgcaggagttcaccgctgagttcctggagaaggtgctggagcccagcggctggagggctgtgtggcacaccaacgtgttcaaggtgctggtggagatcacagatgtggactttgctgccctgaaggctgtggtgcggctggccgagccctacctgtgtgacagccaggtgtccaccttcaccatggagtgcatgaaggagctgctggacctgaaggagcaccggctgcccctgcaggagctgtgggtggtgtttgatgattctggagtgtttgaccagacagccctggccattgaacatgtgcgcttcttctaccagaacatctggaggtcctgggatgaggaggaggaggatgaatatgactactttgtgcgctgtgtggagccccggctgcggctgcactatgacatcctggaggacagagtgcccagcggcctcatcgtggactaccacaacctgctgagccagtgtgaggagagctacaggaagttcctgaacctgcggagcagcctgagcaactgcaacagcgacagcgagcaggagaacatctccatggtggagggcctgaagctgtacagcgagatggagcagctgaagcagaagctgaagctgattgagaaccccctgctgcgctacgtgtttggctaccagaagaacagcaacatccaggccaagggcgtgcgcagcagcggccagaagatcacccacgtggtgagcagcaccatgatggccggcctgctgcggagcctgctgacagaccggctgtgccaggagcccggggaggaggagcgggagatccagttccacagcgaccccctgagcgccatcaatgcctgctttgaaggagacacagtgattgtgtgccccggccactacgtggtgcacggcaccttcagcattgctgacagcattgagctggagggctacggcctgcctgatgacatcgtcatcgagaagagaggaaaaggagacacctttgtggactgcacaggagctgacatcaagatcagcggcatcaagtttgtgcagcatgatgctgtggagggcatcctgattgtgcaccggggcaagaccaccctggagaactgtgtgctgcagtgtgagaccactggagtgacagtgaggaccagcgctgagttcctgatgaagaacagcgacctgtatggagccaagggggccggcatcgagatctacccaggcagccagtgcaccctgagtgacaatggcatccaccactgcaaggagggcatcctgatcaaggacttcctggatgagcactatgacatccccaagatctccatggtgaacaacatcatccacaacaatgaaggctacggcgtggtgctggtgaagcccaccatcttcagtgacctgcaggagaatgcagaagatggaacagaggagaacaaggccctgaagatccagaccagcggggagccagatgtggccgagcgggtggacctggaggagctgattgaatgtgccaccgggaagatggagctgtgtgccaggacagaccccagcgagcaggtggagggcaactgtgagatcgtgaatgagctgattgctgccagcacccagaagggccagatcaagaagaagaggctgtctgagctgggcatcacccaggctgatgacaacctgatgagccaggagatgtttgtgggcatcgtgggcaaccagttcaagtggaatggcaagggcagctttggcaccttcctgttctag

SEQ ID NO: 169635 - DNA, 723 bp, Artificial Sequence
  Description of Artificial Sequence: Synthetic coding sequence
atgacagcccctgtgcctgccccccgcatcctgctgcccctgctgctgctgctgctgctgaccccacctcctggggcccggggggaggtgtgcatggccagccggggcctgagcctcttccctgagagctgcccagacttctgctgcggcacctgtgatgaccagtactgctgcagtgatgtgctgaagaagtttgtgtggagcgaggagcgctgtgctgtgcctgaggcctctgtgcctgcctctgtggagcctgtggagcagctgggcagcgccctgcgcttccggcccggctacaatgaccccatgagcggctttggagccaccctggccgtgggcctgaccatctttgtgctgtctgtggtgaccatcatcatctgcttcacctgcagctgctgctgcctgtacaagacctgccggcggcccaggcctgtggtgaccaccaccaccagcaccaccgtggtgcacgccccctacccccagccccccagcgtgccccccagctacccaggccccagctaccagggctaccacaccatgccaccccagcccggcatgcctgctgccccctaccccatgcagtaccccccaccctacccagcccagcccatgggccccccagcctaccacgagaccctggccggcggggccgccgccccctacccagccagccagcccccctacaacccagcctacatggatgcccccaaggccgccctgtag

SEQ ID NO: 169636 - DNA, 339 bp, Artificial Sequence
  Description of Artificial Sequence: Synthetic coding sequence
atggccagccggggcctgagcctcttccctgagagctgcccagacttctgctgcggcacctgtgatgaccagtactgctgcagtgatgtgctgaagaagtttgtgtggagcgaggagcgctgtgctgtgcctgaggcctctgtgcctgcctctgtggagcctgtggagcagctgggcagcgccctgcgcttccggcccggctacaatgaccccatgagcggctttggagccaccctggccgtgggcctgaccatctttgtgctgtctgtggtgaccatcatcatctgcttcacctgcagctgctgctgcctgtacaagacctgcagaagacccaggtag

SEQ ID NO: 169637 - DNA, 414 bp, Artificial Sequence
  Description of Artificial Sequence: Synthetic coding sequence
atgggctttggagccaccctggccgtgggcctgaccatctttgtgctgtctgtggtgaccatcatcatctgcttcacctgcagctgctgctgcctgtacaagacctgcagaagacccaggcctgtggtgaccaccaccaccagcaccaccgtggtgcacgccccctacccccagcccccatctgtgcccccatcctacccaggccccagctaccagggctaccacaccatgccaccccagcccggcatgcctgctgccccctaccccatgcagtaccccccaccctacccagcccagcccatgggccccccagcctaccacgagaccctggccggcggcgctgctgccccctacccagccagccagcccccctacaacccagcctacatggatgcccccaaggccgccctgtag

SEQ ID NO: 169638 - DNA, 630 bp, Artificial Sequence
  Description of Artificial Sequence: Synthetic coding sequence
atggccagccggggcctgagcctcttccctgagagctgcccagacttctgctgcggcacctgtgatgaccagtactgctgcagtgatgtgctgaagaagtttgtgtggagcgaggagcgctgtgctgtgcctgaggcctctgtgcctgcctctgtggagcctgtggagcagctgggcagcgccctgcgcttccggcccggctacaatgaccccatgagcggctttggagccaccctggccgtgggcctgaccatctttgtgctgtctgtggtgaccatcatcatctgcttcacctgcagctgctgctgcctgtacaagacctgcagaagacccaggcctgtggtgaccaccaccaccagcaccaccgtggtgcacgccccctacccccagcccccatctgtgcccccatcctacccaggccccagctaccagggctaccacaccatgccaccccagcccggcatgcctgctgccccctaccccatgcagtaccccccaccctacccagcccagcccatgggccccccagcctaccacgagaccctggccggcggcgctgctgccccctacccagccagccagcccccctacaacccagcctacatggatgcccccaaggccgccctgtag

SEQ ID NO: 169639 - DNA, 630 bp, Artificial Sequence; identical to SEQ ID NO: 169638
  Description of Artificial Sequence: Synthetic coding sequence

SEQ ID NO: 169640 - DNA, 513 bp, Artificial Sequence
  Description of Artificial Sequence: Synthetic coding sequence
atgccaccccagcccggctgccagcagcaccccacccagtgcagcacccaccacctgacccagcccagcccctgggcccaccggcccaccacccggccctggctggaggagcagccccggcccaccccaccagccagcctgctgaccacccggcccacctggatgccccggggcggccccctgagcatcccctggcccctgtggctgcccctgggctacgtggtgtgtgtgcgggagtggtgtgccggggctgtgccctatgccccctgtgtgctgtgtgtgtcctgcctgtacatgtggctgcccctgatgctgacccgctggggcaccatcctggcccgggtgggctgggaccagaccctcttcagcagcagccctgagatcatgctgcccaagatcagcagccagacccagaggatgggctggtggggcgccccctgtgaggtggcccctgagcgctggggccccctgcagggcaccagcggcgtgctgctgcagctgaccctgggctag

SEQ ID NO: 169641 - DNA, 666 bp, Artificial Sequence
  Description of Artificial Sequence: Synthetic coding sequence
atgagaagagtgctgcggctgctgctgggctgcttcctgacagagctgtgtgcccgggtgtgccgggcccaggagagagctggccacggccagctggcccagctgggcggcgtgctgctgctggccggcggcaacagaagtggagctgccagcggggaggccagcgagggcgctgaggccagtgatgccccacccacccgggcccccaccccagacttctgccggggctactttgatgtgatgggccagtgggacccccccttcaactgcagcagcggggacttcatcttctgctgcggcacctgtggcttccgcttctgctgcaccttcaagaagaggcggctgaaccagagcacctgcaccaactatgacacccccctgtggctgaacacaggcaagcccccagccaggaaggatgaccccctgcatgaccccaccaaggacaagaccaacctgattgtgtacatcatctgtggggtggtggccgtgatggtgctggtgggcatcttcaccaagctgggcctggagaaggcccaccggccccagcgggagcacatgagccggctgtatgacaacctgctcttcatggaggcccagatctccttccaggaggatgagcccgcccctggagagtggagcgtgggcctgcagacctggacagtgtag

SEQ ID NO: 169642 - DNA, 1275 bp, Artificial Sequence
  Description of Artificial Sequence: Synthetic coding sequence
atgagaagagtgctgcggctgctgctgggctgcttcctgacagagctgtgtgcccgggtgtgccgggcccaggagagagctggccacggccagctggcccagctgggcggcgtgctgctgctggccggcggcaacagaagtggagctgccagcggggaggccagcgagggcgctgaggccagtgatgccccacccacccgggcccccaccccagacttctgccggggctactttgatgtgatgggccagtgggacccccccttcaactgcagcagcggggacttcatcttctgctgcggcacctgtggcttccgcttctgctgcaccttcaagaagaggcggctgaaccagagcacctgcaccaactatgacacccccctgtggctgaacacaggcaagcccccagccaggaaggatgaccccctgcatgaccccaccaaggacaagaccaacctgattgtgtacatcatctgtggggtggtggccgtgatggtgctggtgggcatcttcaccaagctgggcctggagaaggcccaccggccccagcgggagcacatgagccgggccctggctgatgtgatgaggccccagggccactgcaacacagaccacatggagcgggacctgaacatcgtggtgcacgtgcagcactatgagaacatggacaccaggacccccatcaacaacctgcacgccacccagatgaacaatgctgtgcccaccagccccctgctgcagcagatgggccacccccacagctaccccaacctgggccagatcagcaacccctatgagcagcagcccccaggcaaggagctgaacaagtatgccagcctgaaggctgtgggcagcagtgatggagactgggccgtgtccaccctgaagagccccaaggctgacaaggtgaatgatgacttctacaccaagaggaggcacctggccgagctggccgccaagggcaacctgcccctgcaccctgtgcgggtggaggatgagccccgggccttcagccctgagcacggccctgccaagcagaatggccagaagagcaggaccaacaagatgccaccccaccccctggcctacaccagcaccaccaacttcaagggctgggaccccaatgagcagagcctgcggcggcaggcctacagcaacaagggcaagctgggcacagctgagaccggcagcagtgaccccctgggcacccggccccagcactaccccccaccccagccctacttcatcaccaacagcaagacagaggtgacagtgtag

SEQ ID NO: 169643 - DNA, 789 bp, Artificial Sequence
  Description of Artificial Sequence: Synthetic coding sequence
atgtgtggcccccggcggctggccgcccctggcagcagcctgggcagctttggccgggccagcagaggaggaagaagaggcagcagcggcggccgggctgctgagcccggcctgggggacaccatgagaagagtgctgcggctgctgctgggctgcttcctgacagagctgtgtgcccgggtgtgccgggcccaggagcgggccggccacggccagctggcccagctgggcggcgtgctgctgctggccggcggcaacagaagtggggccgccagcggggaggccagcgagggcgctgaggccagtgatgccccacccacccgggcccccaccccagacttctgccggggctactttgatgtgatgggccagtgggacccccccttcaactgcagcagcggggacttcatcttctgctgcggcacctgtggcttccgcttctgctgcaccttcaagaagaggcggctgaaccagagcacctgcaccaactatgacacccccctgtggctgaacacaggcaagcccccagccaggaaggatgaccccctgcatgaccccaccaaggacaagaccaacctgattgtgtacatcatctgtggggtggtggccgtgatggtgctggtgggcatcttcaccaagctgggcctggagaaggcccaccggccccagcgggagcacatgagccggctgtatgacaacctgctcttcatggaggcccagatctccttccaggaggatgagcccgcccctggagagtggagcgtgggcctgcagacctggacagtgtag

SEQ ID NO: 169644 - DNA, 1398 bp, Artificial Sequence
  Description of Artificial Sequence: Synthetic coding sequence
atgtgtggcccccggcggctggccgcccctggcagcagcctgggcagctttggccgggccagcagaggaggaagaagaggcagcagcggcggccgggctgctgagcccggcctgggggacaccatgagaagagtgctgcggctgctgctgggctgcttcctgacagagctgtgtgcccgggtgtgccgggcccaggagcgggccggccacggccagctggcccagctgggcggcgtgctgctgctggccggcggcaacagaagtggggccgccagcggggaggccagcgagggcgctgaggccagtgatgccccacccacccgggcccccaccccagacttctgccggggctactttgatgtgatgggccagtgggacccccccttcaactgcagcagcggggacttcatcttctgctgcggcacctgtggcttccgcttctgctgcaccttcaagaagaggcggctgaaccagagcacctgcaccaactatgacacccccctgtggctgaacacaggcaagcccccagccaggaaggatgaccccctgcatgaccccaccaaggacaagaccaacctgattgtgtacatcatctgtggggtggtggccgtgatggtgctggtgggcatcttcaccaagctgggcctggagaaggcccaccggccccagcgggagcacatgagccgggccctggctgatgtgatgaggccccagggccactgcaacacagaccacatggagcgggacctgaacatcgtggtgcacgtgcagcactatgagaacatggacaccaggacccccatcaacaacctgcacgccacccagatgaacaatgctgtgcccaccagccccctgctgcagcagatgggccacccccacagctaccccaacctgggccagatcagcaacccctatgagcagcagcccccaggcaaggagctgaacaagtatgccagcctgaaggctgtgggcagcagtgatggagactgggccgtgtccaccctgaagagccccaaggctgacaaggtgaatgatgacttctacaccaagagaagacacctggccgagctggccgccaagggcaacctgcccctgcaccctgtgcgggtggaggatgagccccgggccttcagccctgagcacggccctgccaagcagaatggccagaagagcaggaccaacaagatgccaccccaccccctggcctacaccagcaccaccaacttcaagggctgggaccccaatgagcagagcctgcggcggcaggcctacagcaacaagggcaagctgggcacagctgagaccggcagcagtgaccccctgggcacccggccccagcactaccccccaccccagccctacttcatcaccaacagcaagacagaggtgacagtgtag

SEQ ID NO: 169645 - DNA, 678 bp, Artificial Sequence
  Description of Artificial Sequence: Synthetic coding sequence
atggaggagctgacagcctttgtgtccaagagctttgaccagaagagcaaggatggaaatggaggcggcggcggcggcggcggcaagaaggacagcatcacctaccgggaggtgctggagagcggcctggcccggagccgggagctgggcaccagtgacagcagcctgcaggacatcacagagggcggcggccactgccctgtgcacctgttcaaggaccacgtggacaatgacaaggagaagctgaaggagtttggaacagcccgggtggccgagggcatctatgagtgcaaggagaagcgggaggatgtgaagtcagaagatgaagatggccagaccaagctgaagcagaggaggagcaggaccaacttcaccctggagcagctgaatgagctggagcggctgtttgatgagacccactacccagatgccttcatgagggaggagctgagccagaggctgggcctgtctgaggcccgggtgcaggtgtggttccagaacagaagagccaagtgcaggaagcaggagaaccagatgcacaagggcgtcatcctgggcacagccaaccacctggatgcctgccgggtggccccctacgtgaacatgggcgccctgaggatgcccttccagcagatggagttctgcagctgcaggcctggctggagcatcatggcctag

SEQ ID NO: 169646 - DNA, 678 bp, Artificial Sequence; identical to SEQ ID NO: 169645
  Description of Artificial Sequence: Synthetic coding sequence

SEQ ID NO: 169647 - DNA, 879 bp, Artificial Sequence
  Description of Artificial Sequence: Synthetic coding sequence
atggaggagctgacagcctttgtgtccaagagctttgaccagaagagcaaggatggaaatggaggcggcggcggcggcggcggcaagaaggacagcatcacctaccgggaggtgctggagagcggcctggcccggagccgggagctgggcaccagtgacagcagcctgcaggacatcacagagggcggcggccactgccctgtgcacctgttcaaggaccacgtggacaatgacaaggagaagctgaaggagtttggaacagcccgggtggccgagggcatctatgagtgcaaggagaagcgggaggatgtgaagtcagaagatgaagatggccagaccaagctgaagcagaggaggagcaggaccaacttcaccctggagcagctgaatgagctggagcggctgtttgatgagacccactacccagatgccttcatgagggaggagctgagccagaggctgggcctgtctgaggcccgggtgcaggtgtggttccagaacagaagagccaagtgcaggaagcaggagaaccagatgcacaagggcgtcatcctgggcacagccaaccacctggatgcctgccgggtggccccctacgtgaacatgggcgccctgaggatgcccttccagcaggtgcaggcccagctgcagctggagggcgtggcccacgcccacccccacctgcacccccacctggccgcccacgccccctacctgatgttccccccaccacccttcggcctgcccatcgccagcctggccgagagcgccagcgctgctgctgtggtggccgccgccgccaagagcaacagcaagaacagcagcattgctgacctgcggctgaaggccaggaagcatgctgaggccctgggcctgtag

SEQ ID NO: 169648 - DNA, 879 bp, Artificial Sequence; identical to SEQ ID NO: 169647
  Description of Artificial Sequence: Synthetic coding sequence

SEQ ID NO: 169649 - DNA, 573 bp, Artificial Sequence
  Description of Artificial Sequence: Synthetic coding sequence
atggaggatgagggccagaccaagatcaagcagaggaggagcaggaccaacttcaccctggagcagctgaatgagctggagcggctgtttgatgagacccactacccagatgccttcatgagggaggagctgagccagaggctgggcctgtctgaggcccgggtgcaggtgtggttccagaacagaagagccaagtgcaggaagcaggagaaccagctgcacaagggcgtgctgattggagctgccagccagtttgaggcctgccgggtggccccctacgtgaatgtgggcgccctgaggatgcccttccagcaggtgcaggcccagctgcagctggacagcgctgtggcccacgcccaccaccacctgcacccccacctggccgcccacgccccctacatgatgtttcctgcccccccatttggcctgcccctggccaccctggccgctgacagcgccagcgctgcctctgtggtggccgctgctgctgctgccaagaccaccagcaagaacagcagcattgctgacctgcggctgaaggccaagaagcatgctgctgccctgggcctgtag

SEQ ID NO: 169650 - DNA, 996 bp, Artificial Sequence
  Description of Artificial Sequence: Synthetic coding sequence
atggaggagctgacagcctttgtgtccaagagctttgaccagaaggtgaaggagaagaaggaggccatcacctaccgggaggtgctggagagcggccccctgcggggggccaaggagcccaccggctgcacagaggccggcagagatgacaggagcagccctgctgtgcgggctgctgggggcggcggcggcggcggcggcggcggcggcggcggcggcggcggcggcggcgtgggcggcggcggggccggcggcggggccggcggcggccgcagccctgtgcgggagctggacatgggcgctgctgagaggagccgggagcccggcagcccccggctgacagaggtgtccccagagctgaaggacagaaaagaagatgccaagggcatggaggatgagggccagaccaagatcaagcagaggaggagcaggaccaacttcaccctggagcagctgaatgagctggagcggctgtttgatgagacccactacccagatgccttcatgagggaggagctgagccagaggctgggcctgtctgaggcccgggtgcaggtgtggttccagaacagaagagccaagtgcaggaagcaggagaaccagctgcacaagggcgtgctgattggagctgccagccagtttgaggcctgccgggtggccccctacgtgaatgtgggcgccctgaggatgcccttccagcaggacagccactgcaatgtgacccccctgtccttccaggtgcaggcccagctgcagctggacagcgctgtggcccacgcccaccaccacctgcacccccacctggccgcccacgccccctacatgatgtttcctgccccacccttcggcctgcccctggccaccctggccgctgacagcgccagcgctgcctctgtggtggccgctgctgctgctgccaagaccaccagcaagaacagcagcattgctgacctgcggctgaaggccaagaagcacgccgccgccctgggcctgtag

SEQ ID NO: 169651 - DNA, 1068 bp, Artificial Sequence
  Description of Artificial Sequence: Synthetic coding sequence
atggaggagctgacagcctttgtgtccaagagctttgaccagaaggtgaaggagaagaaggaggccatcacctaccgggaggtgctggagagcggccccctgcggggggccaaggagcccaccggctgcacagaggccggcagagatgacaggagcagccctgctgtgcgggctgctgggggcggcggcggcggcggcggcggcggcggcggcggcggcggcggcggcggcgtgggcggcggcggggccggcggcggggccggcggcggccgcagccctgtgcgggagctggacatgggcgctgctgagaggagccgggagcccggcagcccccggctgacagagggccgcaggaagcccaccaaggccgaggtgcaggccaccctgctgctgcccggggaggccttccgcttcctggtgtccccagagctgaaggacagaaaagaagatgccaagggcatggaggatgagggccagaccaagatcaagcagaggaggagcaggaccaacttcaccctggagcagctgaatgagctggagcggctgtttgatgagacccactacccagatgccttcatgagggaggagctgagccagaggctgggcctgtctgaggcccgggtgcaggtgtggttccagaacagaagagccaagtgcaggaagcaggagaaccagctgcacaagggcgtgctgattggagctgccagccagtttgaggcctgccgggtggccccctacgtgaatgtgggcgccctgaggatgcccttccagcaggacagccactgcaatgtgacccccctgtccttccaggtgcaggcccagctgcagctggacagcgctgtggcccacgcccaccaccacctgcacccccacctggccgcccacgccccctacatgatgtttcctgccccacccttcggcctgcccctggccaccctggccgctgacagcgccagcgctgcctctgtggtggccgctgctgctgctgccaagaccaccagcaagaacagcagcattgctgacctgcggctgaaggccaagaagcacgccgccgccctgggcctgtag

SEQ ID NO: 169652 - DNA, 573 bp, Artificial Sequence; identical to SEQ ID NO: 169649
  Description of Artificial Sequence: Synthetic coding sequence

SEQ ID NO: 169653 - DNA, 573 bp, Artificial Sequence; identical to SEQ ID NO: 169649
  Description of Artificial Sequence: Synthetic coding sequence

SEQ ID NO: 169654 - DNA, 1734 bp, Artificial Sequence
  Description of Artificial Sequence: Synthetic coding sequence
atgctgaccccagcctttgacctgagccaggaccctgacttcctgaccatcgccatccgggtgccctatgcccgggtgtctgaatttgatgtgtactttgagggcagtgacttcaagttctacgccaagccctacttcctgcggctgaccctgcccggcagaattgtggagaatggcagcgagcagggcagctatgatgctgacaagggcatcttcaccatccggctgcccaaggagaccccaggccagcactttgagggcctgaacatgctgacagccctgctggcccccaggaagagcaggacagccaagcccctggtggaggagatcggggccagcgagatccctgaggaggtggtggatgatgaggagtttgactgggagattgagcagaccccctgtgaggaggtgtctgagagcgccctgaacccccagtgccactacggcttcggcaacctgcggtctggagtgctgcagaggctgcaggatgagctgagtgatgtgattgacatcaaggaccctgacttcaccccagctgctgagcggcggcagaagaggctggccgctgagctggccaagtttgatcctgaccactacctggccgacttctttgaagatgaggccatcgagcagatcctgaagtacaacccctggtggacagacaagtacagcaagatgatggccttcctggagaagagccaggagcaggagaaccacgccaccctggtgtccttcagcgaggaggagaagtaccagctgaggaagtttgtgaacaagagctacctgctggacaagagggcctgccggcaggtgtgctacagcctgattgacatcctgctggcctactgctatgagaccagggtgacagaaggagagaagaatgtggagagcgcctggaacatcaggaagctgagccccaccctgtgctggtttgagacctggaccaacgtgcatgacatcatggtgtcctttggccggcgggtgctgtgctaccccctgtaccgccacttcaagctggtgatgaaggcctacagagacaccatcaagatcctgcagctgggcaagtctgctgtgctgaagtgcctgctggacatccacaagatcttccaggagaatgaccctgcctacatcctgaatgacctgtacatcagtgactactgtgtgtggatccagaaggtgaagagcaagaagctggccgccctggccgaggccctgaaggaggtgtccctgaccaaggcccagctgggcctggagctggaggagctggaggccgccgccctgctggtgcaggaggaggagacagccctgaaggccgcccacagcgtgtctggccagcagaccctgtgcagcagcagcgaggccagtgacagcgaggacagcgacagctctgtgtcctctggaaatgaagattctggcagtgacagcgagcaggatgagctgaaggacagccccagcgagaccgtgagcagcctgcagggccccttcctggaggagagcagcgccttcctgattgtggatggcggcgtgagaagaaacacagccatccaggagagtgatgccagccagggcaagcccctggccagctcctggcccctgggcgtgtctggccccctgattgaggagctgggggagcagctgaagaccaccgtgcaggtgtctgagcccaagggcaccacagctgtgaacagaagcaacatccaggagagagatggctgccagacccccaacaactag

SEQ ID NO: 169655 - DNA, 4851 bp, Artificial Sequence
  Description of Artificial Sequence: Synthetic coding sequence
atggagggcgctgagccccgggcccggcctgagcggctggccgaggccgagaccagggctgctgatggcggccgcctggtggaggtgcagctgagcggcggggccccctggggcttcaccctgaagggcggccgggagcacggggagcccctggtgatcaccaagattgaggagggcagcaaggctgctgctgtggacaagctgctggccggagatgagatcgtgggcatcaatgacatcggcctgagcggcttccggcaggaggccatctgcctggtgaagggcagccacaagaccctgaagctggtggtgaagagaagaagtgagctgggctggaggccccacagctggcacgccaccaagttcagtgacagccaccctgagctggccgccagccccttcaccagcaccagcggctgccccagctggagcggccgccaccacgccagcagcagcagccatgacctgagcagctcctgggagcagaccaacctgcagaggaccctggaccacttcagcagcctgggctctgtggacagcctggaccaccccagcagccggctgtctgtggccaagagcaacagcagcattgaccacctgggcagccacagcaagagggacagcgcctacggcagcttcagcaccagcagcagcaccccagaccacaccctgagcaaggctgacaccagcagcgctgagaacatcctgtacacagtgggcctgtgggaggccccccggcagggcggccggcaggcccaggccgccggggacccccagggcagcgaggagaagctgagctgcttccccccccgggtgcctggggacagcggcaagggccccaggcctgagtacaatgctgagcccaagctggccgcccctggccgcagcaactttggacctgtgtggtacgtgcctgacaagaagaaggcccccagcagccccccacctcctcctccacccctgcggagtgacagctttgctgccaccaagagccatgagaaggcccagggccctgtgttttctgaggccgctgctgcccagcacttcaccgccctggcccaggcccagcccaggggggacagaagacctgagctgacagaccggccctggaggtctgcccaccctggcagcctgggcaagggcagcggcggccctggctgcccccaggaggcccatgctgatggctcctggccacccagcaaggatggagccagcagccggctgcaggccagcctgagcagcagtgatgtgcgcttcccccagagcccccacagcggccgccacccccccctgtacagcgaccacagccccctgtgtgccgacagcctgggccaggagcctggagctgccagcttccagaatgacagccccccccaggtgcggggcctgagcagctgtgaccagaagctgggcagcggctggcagggcccccggccctgtgtgcagggcgacctgcaggccgcccagctgtgggccggctgctggcccagcgacacagccctgggcgccctggagagcctgcccccacccaccgtgggccagagccccaggcaccacctgccccagcctgagggccccccagatgcccgggagaccggccgctgctaccccctggacaagggagctgagggctgcagcgctggggcccaggagcccccccgggccagcagagctgagaaggccagccagaggctggccgccagcatcacctgggcagatggagagagcagccgcatctgcccccaggagacccccctgctgcacagcctgacccaggagggcaagaggaggcctgagagcagcccagaagattctgccacccggcccccaccatttgatgcccacgtgggcaagcccaccaggagaagtgacagatttgccaccaccctgagaaatgagatccagatgcaccgggccaagctgcagaagagccgcagcacagtggccctgacagctgctggggaggctgaagatggcaccggccgctggagggctggcctgggcggcggcacccaggagggccccctggccggcacctacaaggaccacctgaaggaggcccaggcccgggtgctgcgggccaccagcttcaagagaagagacctggaccccaaccctggggacctgtacccagagagcctggagcacaggatgggagaccctgacacagtgccccacttctgggaggccggcctggcccagccccccagcagcaccagcggcggcccccaccccccacgcatcggcggcagaagacgcttcaccgctgagcagaagctgaagagctacagcgagcctgagaagatgaatgaggtgggcctgacccggggctacagcccccaccagcaccccaggaccagcgaggacacagtgggcacctttgctgaccgctggaagttctttgaggagaccagcaagcctgtgccccagaggcctgcccagaagcaggccctgcacggcatcccccgggacaagccagagcggcccaggacagctggccgcacctgtgagggcacagagccctggagcaggaccaccagcctgggggacagcctgaatgcccacagcgctgctgagaaggccggcaccagtgacctgccccggcggctgggcacctttgctgagtaccaggcctcctggaaggagcagaggaagcccctggaggcccggagcagcggccgctgccacagcgcagatgacatcctggatgtgtccctggacccccaggagcggccccagcacgtgcacggccgcagccgcagcagccccagcacagaccactacaagcaggaggcctctgtggagctgcggcggcaggccggggaccctggagagccccgggaggagctgcccagcgctgtgcgggcagaggagggccagagcaccccccggcaggctgatgcccagtgccgggagggcagccctggcagccagcagcacccccccagccagaaggcccccaacccccccaccttcagcgagctgagccactgccgcggggcccctgagctgccccgggagggccggggccgggccggcaccctgccccgggactaccgctacagcgaggagagcaccccagctgacctgggcccccgggcccagagccctggcagccccctgcacgcccggggccaggacagctggcctgtgtcctctgccctgctgagcaagaggcctgccccccagaggcctcctccacccaagcgggagccccggcgctaccgggccacagatggagccccagcagatgcccctgtgggcgtgctgggccggcccttccccacccccagccctgccagcctggatgtgtatgtggcccggctgagcctgagccacagccccagcgtcttcagcagcgcccagccccaggacacccccaaggccaccgtgtgtgagcggggcagccagcacgtgtctggagatgccagccggcccctgcctgaggccctgctgccccccaagcagcagcacctgcggctgcagacagccaccatggagaccagccgcagccccagcccccagtttgccccccagaagctgacagacaagccacccctgctgatccaggatgaggacagcaccagaattgagcgggtgatggacaacaacaccaccgtgaagatggtgcccatcaagatcgtgcacagcgagagccagcctgagaaggagagccggcagagcctggcctgcccagctgagcccccagccctgccccacggcctggagaaggaccagatcaagaccctgagcaccagcgagcagttctacagccgcttctgcctgtacacccggcagggcgctgagcctgaggccccccaccgggcccagcctgctgagccccagcccctgggcacccaggtgcccccagagaaggaccgctgcaccagccccccaggcctgagctacatgaaggccaaggagaagacagtggaggacctgaagtctgaggagctggcccgggagatcgtgggcaaggacaagagcctggccgacatcctggaccccagcgtgaagatcaagaccaccatggacctgatggagggcatcttccccaaggatgagcacctgctggaggaggcccagcagaggaggaagctgctgcccaagatccccagccccaggagcacagaggagaggaaggaggagcccagcgtgcctgctgctgtgtccctggccaccaacagcacctactacagcaccagcgcccccaaggccgagctgctgatcaagatgaaggacctgcaggagcagcaggagcatgaagaagattctggcagtgacctggaccatgacctgtctgtgaagaagcaggagctgattgagagcatcagcaggaagctgcaggtgctgcgggaggcccgggagagcctgctggaggatgtgcaggccaacacagtgctgggcgctgaggtggaggccatcgtgaagggcgtgtgcaagcccagcgagtttgacaagttcaggatgttcatcggggacctggacaaggtggtgaacctgctgctgagcctgagcggccgcctggcccgggtggagaatgccctgaacaacctggatgatggagccagccctggggaccggcagagcctgctggagaagcagagggtgctgatccagcagcatgaagatgccaaggagctgaaggagaacctggaccggcgggagcgcatcgtgtttgacatcctggccaactacctgtctgaggagagcctggccgactatgagcactttgtgaagatgaagagcgccctgatcatcgagcagcgggagctggaggacaagatccacctgggggaggagcagctgaagtgcctgctggacagcctgcagcctgagcggggcaagtag

SEQ ID NO: 169656 - DNA, 1356 bp, Artificial Sequence
  Description of Artificial Sequence: Synthetic coding sequence
atggagaccagccgcagccccagcccccagtttgccccccagaagctgacagacaagccacccctgctgatccaggatgaggacagcacccgcatcgagcgggtgatggacaacaacaccaccgtgaagatggtgcccatcaagatcgtgcacagcgagagccagcctgagaaggagagccggcagagcctggcctgcccagctgagcccccagccctgccccacggcctggagaaggaccagatcaagaccctgagcaccagcgagcagttctacagccgcttctgcctgtacacccggcagggcgctgagcctgaggccccccaccgggcccagcctgctgagccccagcccctgggcacccaggtgcccccagagaaggaccgctgcaccagccccccaggcctgagctacatgaaggccaaggagaagacagtggaggacctgaagtctgaggagctggcccgggagatcgtgggcaaggacaagagcctggccgacatcctggaccccagcgtgaagatcaagaccaccatggacctgatggagggcatcttccccaaggatgagcacctgctggaggaggcccagcagaggaggaagctgctgcccaagatccccagccccaggagcacagaggagaggaaggaggagcccagcgtgcctgctgctgtgtccctggccaccaacagcacctactacagcaccagcgcccccaaggccgagctgctgatcaagatgaaggacctgcaggagcagcaggagcacgaggaggacagcggcagtgacctggaccatgacctgtctgtgaagaagcaggagctgattgagagcatcagcaggaagctgcaggtgctgcgggaggcccgggagagcctgctggaggatgtgcaggccaacacagtgctgggcgctgaggtggaggccatcgtgaagggcgtgtgcaagcccagcgagtttgacaagttcaggatgtttattggagacctggacaaggtggtgaacctgctgctgagcctgagcggccgcctggcccgggtggagaatgccctgaacaacctggatgatggagccagccctggggaccggcagagcctgctggagaagcagagggtgctgatccagcagcatgaagatgccaaggagctgaaggagaacctggacagaagagaaagaattgtgtttgacatcctggccaactacctgtctgaggagagcctggccgactatgagcactttgtgaagatgaagagcgccctgatcatcgagcagcgggagctggaggacaagatccacctgggggaggagcagctgaagtgcctgctggacagcctgcagcctgagcggggcaagtag

SEQ ID NO: 169657 - DNA, 1128 bp, Artificial Sequence
  Description of Artificial Sequence: Synthetic coding sequence
atggagaccagccgcagccccagcccccagtttgccccccagaagctgacagacaagccacccctgctgatccaggatgaggacagcacccgcatcgagcgggtgatggacaacaacaccaccgtgaagatggtgcccatcaagatcgtgcacagcgagagccagcctgagaaggagagccggcagagcctggcctgcccagctgagcccccagccctgccccacggcctggagaaggaccagatcaagaccctgagcaccagcgagcagttctacagccgcttctgcctgtacacccggcagggcgctgagcctgaggccccccaccgggcccagcctgctgagccccagcccctgggcacccaggtgcccccagagaaggaccgctgcaccagccccccaggcctgagctacatgaaggccaaggagaagacagtggaggacctgaagtctgaggagctggcccgggagatcgtgggcaaggacaagagcctggccgacatcctggaccccagcgtgaagatcaagaccaccatggacctgatggagggcatcttccccaaggatgagcacctgctggaggaggcccagcagaggaggaagctgctgcccaagatccccagccccaggagcacagaggagaggaaggaggagcccagcgtgcctgctgctgtgtccctggccaccaacagcacctactacagcaccagcgcccccaaggccgagctgctgatcaagatgaaggacctgcaggagcagcaggagcacgaggaggacagcggcagtgacctggaccatgacctgtctgtgaagaagcaggagctgattgagagcatcagcaggaagctgcaggtgctgcgggaggcccgggagagcctgctggaggatgtgcaggccaacacagtgctgggcgctgaggtggaggccatcgtgaagggcgtgtgcaagcccagcgagtttgacaagttcaggatgtttattggagacctggacaaggtggtgaacctgctgctgagcctgagcggccgcctggcccgggtggagaatgccctgaacaacctggatgatggagccagccctggggaccggcagagcctgctggagaagcagagggtgctgatccagtag

SEQ ID NO: 169658 - DNA, 1203 bp, Artificial Sequence
  Description of Artificial Sequence: Synthetic coding sequence
atggagaccagccgcagccccagcccccagtttgccccccagaagctgacagacaagccacccctgctgatccaggatgaggacagcacccgcatcgagcgggtgatggacaacaacaccaccgtgaagatggtgcccatcaagatcgtgcacagcgagagccagcctgagaaggagagccggcagagcctggcctgcccagctgagcccccagccctgccccacggcctggagaaggaccagatcaagaccctgagcaccagcgagcagttctacagccgcttctgcctgtacacccggcagggcgctgagcctgaggccccccaccgggcccagcctgctgagccccagcccctgggcacccaggtgcccccagagaaggaccgctgcaccagccccccaggcctgagctacatgaaggccaaggagaagacagtggaggacctgaagtctgaggagctggcccgggagatcgtgggcaaggacaagagcctggccgacatcctggaccccagcgtgaagatcaagaccaccatggacctgatggagggcatcttccccaaggatgagcacctgctggaggaggcccagcagaggaggaagctgctgcccaagatccccagccccaggagcacagaggagaggaaggaggagcccagcgtgcctgctgctgtgtccctggccaccaacagcacctactacagcaccagcgcccccaaggccgagctgctgatcaagatgaaggacctgcaggagcagcaggagcacgaggaggacagcggcagtgacctggaccatgacctgtctgtgaagaagcaggagctgattgagagcatcagcaggaagctgcaggtgctgcgggaggcccgggagagcctgctggaggatgtgcaggccaacacagtgctgggcgctgaggtggaggccatcgtgaagggcgtgtgcaagcccagcgagtttgacaagttcaggatgtttattggagacctggacaaggtggtgaacctgctgctgagcctgagcggccgcctggcccgggtggagaatgccctgaacaacctggatgatggagccagccctggggaccggcagagcctgctggagaagcagagggtgctgatccagcagatgtgtgtggacttcatgctggacacctaccacagccccatcaacagaagcagctgcctgactgtgaccaagtag

SEQ ID NO: 169659 - DNA, 777 bp, Artificial Sequence
  Description of Artificial Sequence: Synthetic coding sequence
atgagggagcgggcccctcctcctcctccacccagccaggagacccctgtgtacagcatggatgacttccccccacctccaccccacacagtgtgtgaggcccagctggacagtgaagatcctgagggcccccggcccagcttcaacaagctgagcaaggtgaccatcgcccgggagcggcacatgcctggagctgcccacgtggtgggcagccagaccctggccagccggctgcagaccagcatcaagggcagcgaggccgagagcaccccacccagcttcatgtctgtgcacgcccagctggccggcagcctgggcggccagcctgcccccatccagacccagagcctgagccatgaccctgtgtctggcacccagggcctggagaagaaggtgtccccagacccccagaagagcagcgaggacatcagaacagaggccctggccaaggagatcgtgcaccaggacaagagcctggccgacatcctggaccctgacagccggctgaagaccaccatggacctgatggagggcctcttccccagagatgtgaacctgctgaaggaaaattctgtgaagaggaaggccatccagaggacagtgagcagcagcggctgtgagggcaagagaaatgaagacaaggaggccgtgtccatgctggtgaactgcccccagatctccttcccccggctgggcccctggctgtgcccccagaccagccgggtgagccccttcctgctgggcgctgtgctgtctgtggtgttcagccagcactag

SEQ ID NO: 169660 - DNA, 5991 bp, Artificial Sequence
  Description of Artificial Sequence: Synthetic coding sequence
atgatgaggaccacagaggacttccacaagcccagcgccaccctgaacagcaacacagccaccaagggccgctacatctacctggaggccttcctggagggcggggccccctggggcttcaccctgaagggcggcctggagcacggggagcccctcatcatcagcaaggtggaggagggcggcaaggctgacaccctgagcagcaagctgcaggccggagatgaggtggtgcacatcaatgaggtgaccctgagcagcagcaggaaggaggccgtgtccctggtgaagggcagctacaagaccctgcggctggtggtgagaagagatgtgtgcacagaccccggccatgctgacacaggagccagcaactttgtgtccccagagcacctgaccagcggcccccagcacaggaaggccgcctggagcggcggcgtgaagctgcggctgaagcaccggcgctctgagcctgctggccggccccacagctggcacaccaccaagagcggggagaagcagccagatgcctccatgatgcagatcagccagggcatgattggccccccctggcaccagagctaccacagcagcagcagcaccagtgacctgagcaactatgaccacgcctacctgcggcgcagcccagaccagtgcagcagccagggctccatggagagcctggagcccagcggggcctacccaccctgccacctgagccctgccaagagcacaggcagcattgaccagctgagccacttccacaacaagagggacagcgcctacagcagcttcagcaccagcagcagcatcctggagtacccccaccctggcatcagcggccgggagaggagcggctccatggacaacaccagcgcccggggcggcctgctggagggcatgaggcaggccgacatccgctacgtgaagacagtgtatgacacccggcggggcgtgtctgcagaatatgaggtgaacagcagcgccctgctgctgcagggccgggaggcccgggccagcgccaacggccagggctatgacaagtggagcaacatcccccggggcaagggcgtgcccccacccagctggagccagcagtgccccagcagcctggagacagccacagacaacctgccccccaaggtgggcgcccccctgcccccagcccggagtgacagctatgctgccttccgccaccgggagcggcccagctcctggagcagcctggaccagaagaggctgtgccggccccaggccaacagcctgggcagcctgaagagccccttcatcgaggagcagctgcacacagtgctggagaagagccctgagaacagcccccctgtgaagcccaagcacaactacacccagaaggcccagcccggccagcccctgctgcccaccagcatctaccctgtgcccagcctggagccccactttgcccaggtgccccagcccagcgtgagcagcaatggcatgctgtacccagccctggccaaggagagcggctacatcgccccccagggcgcctgcaacaagatggccaccattgatgaaaatggaaaccagaatggaagtggccggcccggctttgccttctgccagcccctggagcatgacctgctgagccctgtggagaagaagccagaggccacagccaagtatgtgcccagcaaggtgcacttctgcagcgtgcctgaaaatgaagaagatgccagcctgaagaggcacctgaccccaccccagggcaacagcccccacagcaatgaaaggaagagcacccacagcaacaagcccagcagccacccccacagcctgaagtgcccccaggcccaggcctggcaggccggggaggacaagaggagcagccggctgtctgagccctgggagggggacttccaggaggaccacaatgccaacctgtggaggcggctggagcgggagggcctgggccagagcctgagcggcaactttgggaagaccaagagcgccttcagcagcctgcagaacatccctgagagcctgcggcggcacagcagcctggagctgggccggggcacccaggagggctacccaggcggccggcccacctgtgctgtgaacaccaaggccgaggaccccggcaggaaggccgccccagacctgggcagccacctggaccggcaggtgtcctaccccaggcctgagggccgcactggagccagcgccagcttcaacagcacagaccccagccctgaggagcccccagcccccagccacccccacaccagcagcctgggccggcggggccctggccctggcagcgccagcgccctgcagggcttccagtatggcaagccccactgcagcgtgctggagaaggtgtccaagtttgagcagcgggagcagggcagccagaggccttctgtgggcggcagcggcttcggccacaactaccggccccacaggacagtgtccaccagcagcaccagcggaaatgactttgaggagaccaaggcccacatccgcttcagcgagagcgctgagcccctgggcaatggagagcagcacttcaagaatggagagctgaagctggaggaggccagccggcagccctgtggccagcagctgagcggcggggccagtgacagcggccggggcccccagaggccagatgcccggctgctgcggagccagagcaccttccagctgagcagcgagcctgagcgggagcctgagtggagggaccggcccggcagccctgagagccccctgctggatgcccccttcagccgggcctacagaaattccatcaaggatgcccagagccgggtgctgggcgccaccagcttcagaagaagagacctggagctgggcgcccctgtggccagccgctcctggaggccccggcccagcagcgcccacgtgggcctgcggagccctgaggccagcgccagcgccagcccccacaccccccgggagcggcacagcgtgaccccagctgagggggacctggcccggcctgtgcccccagctgcccggcggggggcccggcggcggctgaccccagagcagaagaagaggagctacagcgagcctgagaagatgaatgaggtgggcatcgtggaggaggccgagcccgcccccctgggcccccagagaaatggcatgagatttcctgagagctctgtggccgacagaagaaggctgtttgaaagagatggcaaggcctgcagcaccctgagcctgagcggccctgagctgaagcagttccagcagagcgccctggccgactacatccagaggaagacaggcaagaggcccaccagcgctgctggctgcagcctgcaggagcccggccccctgcgggagcgggcccagagcgcctacctgcagcccggccctgctgccctggagggcagcggcctggccagcgccagcagcctgagcagcctgcgggagcccagcctgcagccccggcgggaggccaccctgctgcctgccaccgtggccgagacccagcaggccccccgggacaggagcagcagctttgctgggggccggcggctgggggagcggcggcggggggacctgctgagcggggccaatggaggcacccggggcacccagagaggagatgagaccccccgggagcccagctcctggggcgcccgggccggcaagtccatgtctgctgaggacctgctggagaggagtgatgtgctggccggccctgtgcacgtgcgcagccgcagcagccctgccacagctgacaagaggcaggatgtgctgctgggccaggacagcggcttcggcctggtgaaggacccctgctacctggccggccctggcagccgcagcctgagctgcagcgagcggggccaggaggagatgctgcccctcttccaccacctgaccccccgctggggcggcagcggctgcaaggccatcggggacagctctgtgcccagtgaatgtcctggcaccctggaccaccagaggcaggccagcaggaccccctgcccccggccccccctggccggcacccagggcctggtgacagacacccgggccgcccccctgacccccatcggcacccccctgcccagcgccatccccagcggctactgcagccaggacggccagacaggccggcagcccctgcccccctacaccccagccatgatgcacaggagcaatggccacaccctgacccagcccccaggcccccggggctgtgaaggagatggccctgagcacggcgtggaggagggcaccaggaagagggtgtccctgccccagtggcccccacccagccgggccaagtgggcccacgccgcccgggaggacagcctgcctgaggagagcagcgccccagactttgccaacctgaagcactaccagaagcagcagagcctgcccagcctgtgcagcaccagtgaccctgacacccccctgggcgcccccagcaccccaggccgcatcagcctgcgcatcagcgagagcgtgctgcgggacagccccccacctcatgaggactatgaagatgaggtgtttgtgcgggacccccaccccaaggccaccagcagccccacctttgagcccctgcccccacctcctcctcctccacccagccaggagacccctgtgtacagcatggatgacttccccccacctccaccccacacagtgtgtgaggcccagctggacagcgaggaccctgagggcccccggcccagcttcaacaagctgagcaaggtgaccatcgcccgggagcggcacatgcctggggccgcccacgtggtgggcagccagaccctggccagccggctgcagaccagcatcaagggcagcgaggccgagagcaccccacccagcttcatgtctgtgcacgcccagctggccggcagcctgggcggccagcctgcccccatccagacccagagcctgagccatgaccctgtgtctggcacccagggcctggagaagaaggtgtccccagacccccagaagagcagcgaggacatcagaacagaggccctggccaaggagatcgtgcaccaggacaagagcctggccgacatcctggaccctgacagccggctgaagaccaccatggacctgatggagggcctcttccccagagatgtgaacctgctgaaggagaacagcgtgaagaggaaggccatccagaggacagtgagcagcagcggctgtgagggcaagagaaatgaagacaaggaggccgtgtccatgctggtgaactgcccagcctactacagcgtgtctgcccccaaggccgagctgctgaacaagatcaaggagatgcctgctgaggtgaatgaggaggaggagcaggctgatgtgaatgagaagaaggccgagctgattggcagcctgacccacaagctggagaccctgcaggaggccaagggcagcctgctgacagacatcaagctgaacaatgccctgggggaggaggtggaggccctgatcagcgagctgtgcaagcccaatgaatttgacaagtacaggatgttcatcggggacctggacaaggtggtgaacctgctgctgagcctgagcggccgcctggcccgggtggagaatgtgctgagcggcctgggagaagatgccagcaatgaggagaggagcagcctgtatgagaagaggaagatcctggccggccagcatgaagatgcccgggagctgaaggagaacctggaccggcgggagcgggtggtgctgggcatcctggccaactacctgtctgaggagcagctgcaggactaccagcactttgtgaagatgaagagcaccctgctgattgagcagaggaagctggatgacaagatcaagctgggccaggagcaggtgaagtgcctgctggagagcctgcccagcgacttcatccccaaggccggggccctggccctgccccccaacctgaccagcgagcccatcccagctgggggctgcaccttcagcggcatcttccccaccctgaccagccccctgtag

SEQ ID NO: 169661 - DNA, 561 bp, Artificial Sequence
  Description of Artificial Sequence: Synthetic coding sequence
atggccttctacagcaccacagaatatgacatccagctggcccggggcctgctgagcggcatgttcctgtttgccaccaggagaagtgagcccgccggccggccccacagctggcacaccaccaagtctggagagaagcagccagatgcctccatgatgcagatcagccagggcatgattggccccccctggcaccagagctaccacagcagcagcagcaccagtgacctgagcaactatgaccacgcctacctgcggcgcagcccagaccagtgcagcagccagggctccatggagagcctggagcccagcggggcctacccaccctgccacctgagccctgccaagagcacaggcagcattgaccagctgagccacttccacaacaagagggacagcgcctacagcagcttcagcaccagcagcagcatcctggagtacccccaccctgggaagagggtgaagacccgggacctgcccggcagccagagccctggccgggccatcagcaggaagaccaccatgcccaccagcggcggcggctggagggagaaggcctag

SEQ ID NO: 169662 - DNA, 4482 bp, Artificial Sequence
  Description of Artificial Sequence: Synthetic coding sequence
atggagaacagacctggcagcttccagtatgtgcctgtgcagctgcagggcggggccccctggggcttcaccctgaagggcggcctggagcactgtgagcccctgactgtgtccaagattgaagatggcggcaaggccgccctgagccagaagatgaggactggagatgagctggtgaacatcaatggcacccccctgtatggcagccggcaggaggccctgatcctgatcaagggcagcttccgcatcctgaagctgattgtgagaagaagaaatgcccctgtgtcccggccccacagctggcacgtggccaagctgctggagggctgcccagaggccgccaccaccatgcacttccccagcgaggccttcagcctgtcctggcacagcggctgcaacaccagtgatgtgtgtgtgcagtggtgccccctgagccgccactgcagcacagagaagagcagcagcatcggctccatggagagcctggagcagcccggccaggccacctatgagagccacctgctgcccatcgaccagaacatgtaccccaaccagagggacagcgcctacagcagcttcagcgccagcagcaatgccagtgactgtgccctgagcctgcggcctgaggagcccgccagcacagactgcatcatgcagggccctggccccaccaaggcccccagcggccggcccaacgtggccgagaccagcggcggcagcaggaggaccaacggcggccacctgacccccagcagccagatgagcagccggccccaggagggctaccagagcggccctgccaaggctgtgcggggccccccccagccccctgtgagaagagacagcctgcaggccagccgggcccagctgctgaatggagagcagaggcgggccagcgagcctgtggtgcccctgccccagaaggagaagctgagcctggagcctgtgctgcctgccaggaaccccaaccgcttctgctgcctgagcggccatgaccaggtgaccagcgagggccaccagaactgtgagttcagccagcccccagagagcagccagcagggcagcgagcacctgctgatgcaggccagcaccaaggctgtgggcagccccaaggcctgtgaccgggccagctctgtggacagcaaccccctgaatgaggccagcgctgagctggccaaggccagctttggccggcccccccacctgattggccccaccggccaccgccacagcgcccctgagcagctgctggccagccacctgcagcacgtgcacctggacacccggggcagcaagggcatggagctgccccctgtgcaggacggccaccagtggaccctgagccccctgcacagcagccacaagggcaagaagagcccctgcccccccaccggcggcacccatgaccagagcagcaaggagaggaagacccggcaggtggatgacaggagcctggtgctgggccaccagagccagagcagcccccctcatggagaggctgatggccaccccagcgagaagggcttcctggaccccaacagaaccagccgggccgccagcgagctggccaaccagcagcccagcgccagcggcagcctggtgcagcaggccacagactgcagcagcaccaccaaggccgccagcggcacagaggccggggaggagggggacagcgagcccaaggagtgcagcaggatgggcggcagaagaagtggcggcacccggggccgcagcatccagaacagaaggaagtcagaaagatttgccaccaacctgagaaatgagatccagaggaggaaggcccagctgcagaagagcaagggccccctgagccagctgtgtgacaccaaggagcctgtggaggagacccaggagcccccagagagcccccccctgacagccagcaacaccagcctgctgagcagctgcaagaagccacccagcccccgggacaagctgttcaacaagtccatgatgctgcgggcccggagcagcgagtgcctgagccaggcccctgagagccatgagagcaggacaggcctggagggccgcatcagccctggccagaggcctggccagagcagcctgggcctgaacacctggtggaaggccccagaccccagcagcagtgaccctgagaaggcccacgcccactgcggcgtgcggggcggccactggcgctggagccctgagcacaacagccagcccctggtggccgccgccatggagggccccagcaaccctggggacaacaaggagctgaaggccagcacagcccaggccggagaagatgccatcctgctgccctttgctgacaggaggaagttctttgaggagagcagcaagagcctgagcaccagccacctgcccggcctgaccacccacagcaacaagaccttcacccagaggcccaagcccatcgaccagaacttccagcccatgagcagcagctgccgggagctgcggcggcaccccatggaccagagctaccacagcgctgaccagccctaccacgccacagaccagagctaccacagcatgagccccctgcagagcgagacccccacctacagtgaatgttttgccagcaagggcctggagaacagcatgtgctgcaagcccctgcactgtggggactttgactaccacaggacctgcagctacagctgcagcgtgcagggcgccctggtgcatgacccctgcatctactgcagcggggagatctgcccagccctgctgaagaggaacatgatgcccaactgctacaactgccgctgccaccaccaccagtgcatccgctgcagcgtgtgctaccacaacccccagcacagcgccctggaggacagcagcctggcccctggcaacacctggaagcccaggaagctgactgtgcaggagttccctggggacaagtggaaccccatcaccggcaacaggaagaccagccagagcggccgggagatggcccacagcaagaccagcttctcctgggccacccccttccacccctgcctggagaacccagccctggacctgagcagctaccgggccatcagcagcctggacctgctgggggacttcaagcacgccctgaagaagtctgaggagacctctgtgtatgaggagggcagcagcctggcctccatgccccaccccctgcggagccgggccttcagcgagagccacatcagcctggccccccagagcacccgggcctggggccagcacagaagagagctgttcagcaaaggagatgagacccagagcgacctgctgggcgccaggaagaaggccttccccccaccccggcccccaccacccaactgggagaagtaccgcctcttccgggccgcccagcagcagaagcagcagcagcagcagcagaagcagcaggaggaggaggaggaggaggaggaggaggaggaggaggaggaggaggaggaggaggaggaggccgaggaggaggaggaggagctgcccccccagtacttcagcagcgagaccagcggcagctgtgccctgaaccctgaggaggtgctggagcagccccagcccctgagctttggccacctggagggcagccggcagggcagccagagcgtgcctgctgagcaggagagctttgccctgcacagcagtgacttcctgccccccatccggggccacctgggcagccagcctgagcaggcccagcccccctgctactacggcatcggcggcctgtggaggaccagcggccaggaggccacagagagcgccaagcaggagttccagcacttcagcccccccagcggggcccctggcatccccaccagctacagcgcctactacaacatctctgtggccaaggccgagctgctgaacaagctgaaggaccagcctgagatggccgagatcggcctgggggaggaggaggtggaccacgagctggcccagaagaagatccagctgattgagagcatcagcaggaagctgtctgtgctgcgggaggcccagaggggcctgctggaggacatcaatgccaacagcgccctgggggaggaggtggaggccaacctgaaggctgtgtgcaagagcaatgaatttgagaagtaccacctgtttgtgggggacctggacaaggtggtgaacctgctgctgagcctgagcggccgcctggcccgggtggagaatgccctgaacagcattgacagcgaggccaaccaggagaagctggtgctgattgagaagaagcagcagctgaccggccagctggctgatgccaaggagctgaaggagcacgtggaccggcgggagaagctggtgtttggcatggtgagccgctacctgccccaggaccagctgcaggactaccagcactttgtgaagatgaagagcgccctgatcatcgagcagcgggagctggaggagaagatcaagctgggggaggagcagctgaagtgcctgcgggagagcctgctgctgggccccagcaacttctag

SEQ ID NO: 169663 - DNA, 4482 bp, Artificial Sequence; identical to SEQ ID NO: 169662
  Description of Artificial Sequence: Synthetic coding sequence

SEQ ID NO: 169664 - DNA, 4134 bp, Artificial Sequence
  Description of Artificial Sequence: Synthetic coding sequence
atgcacttccccagcgaggccttcagcctgtcctggcacagcggctgcaacaccagtgatgtgtgtgtgcagtggtgccccctgagccgccactgcagcacagagaagagcagcagcatcggctccatggagagcctggagcagcccggccaggccacctatgagagccacctgctgcccatcgaccagaacatgtaccccaaccagagggacagcgcctacagcagcttcagcgccagcagcaatgccagtgactgtgccctgagcctgcggcctgaggagcccgccagcacagactgcatcatgcagggccctggccccaccaaggcccccagcggccggcccaacgtggccgagaccagcggcggcagcaggaggaccaacggcggccacctgacccccagcagccagatgagcagccggccccaggagggctaccagagcggccctgccaaggctgtgcggggccccccccagccccctgtgagaagagacagcctgcaggccagccgggcccagctgctgaatggagagcagaggcgggccagcgagcctgtggtgcccctgccccagaaggagaagctgagcctggagcctgtgctgcctgccaggaaccccaaccgcttctgctgcctgagcggccatgaccaggtgaccagcgagggccaccagaactgtgagttcagccagcccccagagagcagccagcagggcagcgagcacctgctgatgcaggccagcaccaaggctgtgggcagccccaaggcctgtgaccgggccagctctgtggacagcaaccccctgaatgaggccagcgctgagctggccaaggccagctttggccggcccccccacctgattggccccaccggccaccgccacagcgcccctgagcagctgctggccagccacctgcagcacgtgcacctggacacccggggcagcaagggcatggagctgccccctgtgcaggacggccaccagtggaccctgagccccctgcacagcagccacaagggcaagaagagcccctgcccccccaccggcggcacccatgaccagagcagcaaggagaggaagacccggcaggtggatgacaggagcctggtgctgggccaccagagccagagcagcccccctcatggagaggctgatggccaccccagcgagaagggcttcctggaccccaacagaaccagccgggccgccagcgagctggccaaccagcagcccagcgccagcggcagcctggtgcagcaggccacagactgcagcagcaccaccaaggccgccagcggcacagaggccggggaggagggggacagcgagcccaaggagtgcagcaggatgggcggcagaagaagtggcggcacccggggccgcagcatccagaacagaaggaagtcagaaagatttgccaccaacctgagaaatgagatccagaggaggaaggcccagctgcagaagagcaagggccccctgagccagctgtgtgacaccaaggagcctgtggaggagacccaggagcccccagagagcccccccctgacagccagcaacaccagcctgctgagcagctgcaagaagccacccagcccccgggacaagctgttcaacaagtccatgatgctgcgggcccggagcagcgagtgcctgagccaggcccctgagagccatgagagcaggacaggcctggagggccgcatcagccctggccagaggcctggccagagcagcctgggcctgaacacctggtggaaggccccagaccccagcagcagtgaccctgagaaggcccacgcccactgcggcgtgcggggcggccactggcgctggagccctgagcacaacagccagcccctggtggccgccgccatggagggccccagcaaccctggggacaacaaggagctgaaggccagcacagcccaggccggagaagatgccatcctgctgccctttgctgacaggaggaagttctttgaggagagcagcaagagcctgagcaccagccacctgcccggcctgaccacccacagcaacaagaccttcacccagaggcccaagcccatcgaccagaacttccagcccatgagcagcagctgccgggagctgcggcggcaccccatggaccagagctaccacagcgctgaccagccctaccacgccacagaccagagctaccacagcatgagccccctgcagagcgagacccccacctacagtgaatgttttgccagcaagggcctggagaacagcatgtgctgcaagcccctgcactgtggggactttgactaccacaggacctgcagctacagctgcagcgtgcagggcgccctggtgcatgacccctgcatctactgcagcggggagatctgcccagccctgctgaagaggaacatgatgcccaactgctacaactgccgctgccaccaccaccagtgcatccgctgcagcgtgtgctaccacaacccccagcacagcgccctggaggacagcagcctggcccctggcaacacctggaagcccaggaagctgactgtgcaggagttccctggggacaagtggaaccccatcaccggcaacaggaagaccagccagagcggccgggagatggcccacagcaagaccagcttctcctgggccacccccttccacccctgcctggagaacccagccctggacctgagcagctaccgggccatcagcagcctggacctgctgggggacttcaagcacgccctgaagaagtctgaggagacctctgtgtatgaggagggcagcagcctggcctccatgccccaccccctgcggagccgggccttcagcgagagccacatcagcctggccccccagagcacccgggcctggggccagcacagaagagagctgttcagcaaaggagatgagacccagagcgacctgctgggcgccaggaagaaggccttccccccaccccggcccccaccacccaactgggagaagtaccgcctcttccgggccgcccagcagcagaagcagcagcagcagcagcagaagcagcaggaggaggaggaggaggaggaggaggaggaggaggaggaggaggaggaggaggaggaggaggccgaggaggaggaggaggagctgcccccccagtacttcagcagcgagaccagcggcagctgtgccctgaaccctgaggaggtgctggagcagccccagcccctgagctttggccacctggagggcagccggcagggcagccagagcgtgcctgctgagcaggagagctttgccctgcacagcagtgacttcctgccccccatccggggccacctgggcagccagcctgagcaggcccagcccccctgctactacggcatcggcggcctgtggaggaccagcggccaggaggccacagagagcgccaagcaggagttccagcacttcagcccccccagcggggcccctggcatccccaccagctacagcgcctactacaacatctctgtggccaaggccgagctgctgaacaagctgaaggaccagcctgagatggccgagatcggcctgggggaggaggaggtggaccacgagctggcccagaagaagatccagctgattgagagcatcagcaggaagctgtctgtgctgcgggaggcccagaggggcctgctggaggacatcaatgccaacagcgccctgggggaggaggtggaggccaacctgaaggctgtgtgcaagagcaatgaatttgagaagtaccacctgtttgtgggggacctggacaaggtggtgaacctgctgctgagcctgagcggccgcctggcccgggtggagaatgccctgaacagcattgacagcgaggccaaccaggagaagctggtgctgattgagaagaagcagcagctgaccggccagctggctgatgccaaggagctgaaggagcacgtggaccggcgggagaagctggtgtttggcatggtgagccgctacctgccccaggaccagctgcaggactaccagcactttgtgaagatgaagagcgccctgatcatcgagcagcgggagctggaggagaagatcaagctgggggaggagcagctgaagtgcctgcgggagagcctgctgctgggccccagcaacttctag

SEQ ID NO: 169665 - DNA, 1686 bp, Artificial Sequence
  Description of Artificial Sequence: Synthetic coding sequence
atggccaaggagcgctgcctgaagaagagcttccaggacagcctggaggacatcaagaagaggatgaaggagaagaggaacaagaacctggccgagatcggcaagaggaggagcttcatcgccgccccctgccagatcatcaccaacaccagcaccctgctgaagaactaccaggacaacaacaagatgctggtgctggccctggagaatgagaagagcaaggtgaaggaggcccaggacatcatcctgcagctgaggaaggagtgctactacctgacctgccagctgtatgccctgaagggcaagctgaccagccagcagacagtggagcccgcccagaaccaggagatctgcagcagcggcatggaccccaacagtgatgacagcagcaggaacctgtttgtgaaggacctgccccagatccccctggaggagacagagctgcccggccagggcgagagcttccagatcgaggaccagatccccaccatcccccaggacaccctgggcgtggactttgattctggagaggccaagagcacagacaacgtgctgcccaggacagtgtctgtgcgcagcagcctgaagaagcactgcaacagcatctgccagtttgacagcctggatgactttgagaccagccacctggccggcaagagctttgaatttgagcgggtgggcttcctggaccccctggtgaacatgcacatcccagaaaatgtgcagcacaatgcctgccagtggagcaaggaccaggtgaacctgagccccaagctgatccagcccggcaccttcaccaagaccaaggaggacatcctggagagcaagtctgagcagaccaagagcaagcagagggacacccaggagaggaagcgggaggagaagaggaaggccaacagaaggaagagcaagaggatgagcaagtacaaggagaacaagtctgagaacaagaagacagtgccccagaagaagatgcacaagtctgtgagcagcaatgatgcctacaacttcaacctggaggagggcgtgcacctgacccccttccggcagaaggtgtccaatgacagcaaccgggaggagaacaatgaaagtgaggtgtccctgtgtgagagcagcggcagcggagatgacagtgatgacctgtacctgcccacctgcaagtacatccagaaccccaccagcaacagcgacaggcctgtgacccggcccctggccaagagggccctgaagtacacagatgagaaggagacagagggcagcaagcccaccaagacccccaccaccaccccacctgagacccagcagagcccccacctgagcctgaaggacatcaccaacgtgtccctgtaccctgtggtgaagatccggcggctgagcctgagccccaagaagaacaaggccagccctgctgtggccctgcccaagaggcgctgcacagcctctgtgaactacaaggagcccaccctggccagcaagctgcggcggggggaccccttcacagacctgtgcttcctgaacagccccatcttcaagcagaagaaggacctgcggcgcagcaagaagagggccctggaggtgtccccagccaaggaggccatcttcatcctgtactacgtgcgggagtttgtgagccgcttcccagactgcaggaagtgcaagctggagacccacatctgcctgaggtag

SEQ ID NO: 169666 - DNA, 879 bp, Artificial Sequence
  Description of Artificial Sequence: Synthetic coding sequence
atggccaaggagcgctgcctgaagaagagcttccaggacagcctggaggacatcaagaagaggatgaaggagaagaggaacaagaacctggccgagatcggcaagaggaggagcttcatcgccgccccctgccagatcatcaccaacaccagcaccctgctgaagaactaccaggacaacaacaagatgctggtgctggccctggagaatgagaagagcaaggtgaaggaggcccaggacatcatcctgcagctgaggaaggagtgctactacctgacctgccagctgtatgccctgaagggcaagctgaccagccagcagacagtggagcccgcccagaaccaggagatctgcagcagcggcatggaccccaacagtgatgacagcagcaggaacctgtttgtgaaggacctgccccagatccccctggaggagacagagctgcccggccagggcgagagcttccagatcgaggccaccccacctgagacccagcagagcccccacctgagcctgaaggacatcaccaacgtgtccctgtaccctgtggtgaagatccggcggctgagcctgagccccaagaagaacaaggccagccctgctgtggccctgcccaagaggcgctgcacagcctctgtgaactacaaggagcccaccctggccagcaagctgcggcggggggaccccttcacagacctgtgcttcctgaacagccccatcttcaagcagaagaaggacctgcggcgcagcaagaagagggccctggaggtgtccccagccaaggaggccatcttcatcctgtactacgtgcgggagtttgtgagccgcttcccagactgcaggaagtgcaagctggagacccacatctgcctgaggtag

SEQ ID NO: 169667 - DNA, 648 bp, Artificial Sequence
  Description of Artificial Sequence: Synthetic coding sequence
atggccaaggagcgctgcctgaagaagagcttccaggacagcctggaggacatcaagaagaggatgaaggagaagaggaacaagaacctggccgagatcggcaagaggaggagcttcatcgccgccccctgccagatcatcaccaacaccagcaccctgctgaagaactaccaggacaacaacaagatgctggtgctggccctggagaatgagaagagcaaggtgaaggaggcccaggacatcatcctgcagctgaggaaggagtgctactacctgacctgccagctgtatgccctgaagggcaagctgaccagccagcagacagtggagcccgcccagaaccaggagatctgcagcagcggcatggaccccaacagtgatgacagcagcaggaacctgtttgtgaaggacctgccccagatccccctggaggagacagagctgcccggccagggcgagagcttccagatcgaggaccagatccccaccatcccccaggacaccctgggcgtggactttgattctggggccctggaggtgtccccagccaaggaggccatcttcatcctgtactacgtgcgggagtttgtgagccgcttcccagactgcaggaagtgcaagctggagacccacatctgcctgaggtag

SEQ ID NO: 169668 - DNA, 1584 bp, Artificial Sequence
  Description of Artificial Sequence: Synthetic coding sequence
atggccaaggagcgctgcctgaagaagagcttccaggacagcctggaggacatcaagaagaggatgaaggagaagaggaacaagaacctggccgagatcggcaagaggaggagcttcatcgccgccccctgccagatcatcaccaacaccagcaccctgctgaagaactaccaggacaacaacaagatgctggtgctggccctggagaatgagaagagcaaggtgaaggaggcccaggacatcatcctgcagctgaggaaggagtgctactacctgacctgccagctgtatgccctgaagggcaagctgaccagccagcagacagtggagcccgcccagaaccaggagatctgcagcagcggcatggaccccaacagtgatgacagcagcaggaacctgtttgtgaaggacctgccccagatccccctggaggagacagagctgcccggccagggcgagagcttccagatcgaggaccagatccccaccatcccccaggacaccctgggcgtggactttgattctggagaggccaagagcacagacaacgtgctgcccaggacagtgtctgtgcgcagcagcctgaagaagcactgcaacagcatctgccagtttgacagcctggatgactttgagaccagccacctggccggcaagagctttgaatttgagcgggtgggcttcctggaccccctggtgaacatgcacatcccagaaaatgtgcagcacaatgcctgccagtggagcaaggaccaggtgaacctgagccccaagctgatccagcccggcaccttcaccaagaccaaggaggacatcctggagagcaagtctgagcagaccaagagcaagcagagggacacccaggagaggaagcgggaggagaagaggaaggccaacagaaggaagagcaagaggatgagcaagtacaaggagaacaagtctgagaacaagaagacagtgccccagaagaagatgcacaagtctgtgagcagcaatgatgcctacaacttcaacctggaggagggcgtgcacctgacccccttccggcagaaggtgtccaatgacagcaaccgggaggagaacaatgaaagtgaggtgtccctgtgtgagagcagcggcagcggagatgacagtgatgacctgtacctgcccacctgcaagtacatccagaaccccaccagcaacagcgacaggcctgtgacccggcccctggccaagagggccctgaagtacacagatgagaaggagacagagggcagcaagcccaccaagacccccaccaccaccccacctgagacccagcagagcccccacctgagcctgaaggacatcaccaacgtgtccctgtaccctgtggtgaagatccggcggctgagcctgagccccaagaagaacaaggccagccctgctgtggccctgcccaagaggcgctgcacagcctctgtgaactacaaggagcccaccctggccagcaagctgcggcggggggaccccttcacagacctgtgcttcctgaacagccccatcttcaagcagaagaaggacctgcggcgcagcaagaagtccatgaagcagatccagtag

SEQ ID NO: 169669 - DNA, 1584 bp, Artificial Sequence; identical to SEQ ID NO: 169668
  Description of Artificial Sequence: Synthetic coding sequence

SEQ ID NO: 169670 - DNA, 828 bp, Artificial Sequence
  Description of Artificial Sequence: Synthetic coding sequence
atggccaaggagcgctgcctgaagaagagcttccaggacagcctggaggacatcaagaagaggatgaaggagaagaggaacaagaacctggccgagatcggcaagaggaggagcttcatcgccgccccctgccagatcatcaccaacaccagcaccctgctgaagaactaccaggacaacaacaagatgctggtgctggccctggagaatgagaagagcaaggtgaaggaggcccaggacatcatcctgcagctgaggaaggagtgctactacctgacctgccagctgtatgccctgaagggcaagctgaccagccagcagacagtggagcccgcccagaaccaggagatctgcagcagcggcatggaccccaacagtgatgacagcagcaggaacctgtttgtgaaggacctgccccagatccccctggaggagacagagctgcccggccagggcgagagcttccagatcgaggaccagatccccaccatcccccaggacaccctgggcgtggactttgattctgccaccccacctgagacccagcagagcccccacctgagcctgaaggacatcaccaacgtgtccctgtaccctgtggtgaagatccggcggctgagcctgagccccaagaagaacaaggccagccctgctgtggccctgcccaagaggcgctgcacagcctctgtgaactacaaggagcccaccctggccagcaagctgcggcggggggaccccttcacagacctgtgcttcctgaacagccccatcttcaagcagaagaaggacctgcggcgcagcaagaagtccatgaagcagatccagtag

SEQ ID NO: 169671 - DNA, 930 bp, Artificial Sequence
  Description of Artificial Sequence: Synthetic coding sequence
atggccaaggagcgctgcctgaagaagagcttccaggacagcctggaggacatcaagaagaggatgaaggagaagaggaacaagaacctggccgagatcggcaagaggaggagcttcatcgccgccccctgccagatcatcaccaacaccagcaccctgctgaagaactaccaggacaacaacaagatgctggtgctggccctggagaatgagaagagcaaggtgaaggaggcccaggacatcatcctgcagctgaggaaggagtgctactacctgacctgccagctgtatgccctgaagggcaagctgaccagccagcagacagtggagcccgcccagaaccaggagatctgcagcagcggcatggaccccaacagtgatgacagcagcaggaacctgtttgtgaaggacctgccccagatccccctggaggagacagagctgcccggccagggcgagagcttccagatcgaggaccagatccccaccatcccccaggacaccctgggcgtggactttgattctgccaccccacctgagacccagcagagcccccacctgagcctgaaggacatcaccaacgtgtccctgtaccctgtggtgaagatccggcggctgagcctgagccccaagaagaacaaggccagccctgctgtggccctgcccaagaggcgctgcacagcctctgtgaactacaaggagcccaccctggccagcaagctgcggcggggggaccccttcacagacctgtgcttcctgaacagccccatcttcaagcagaagaaggacctgcggcgcagcaagaagagggccctggaggtgtccccagccaaggaggccatcttcatcctgtactacgtgcgggagtttgtgagccgcttcccagactgcaggaagtgcaagctggagacccacatctgcctgaggtag

SEQ ID NO: 169672 - DNA, 1686 bp, Artificial Sequence; identical to SEQ ID NO: 169665
  Description of Artificial Sequence: Synthetic coding sequence

SEQ ID NO: 169673 - DNA, 930 bp, Artificial Sequence; identical to SEQ ID NO: 169671
  Description of Artificial Sequence: Synthetic coding sequence

SEQ ID NO: 169674 - DNA, 777 bp, Artificial Sequence
  Description of Artificial Sequence: Synthetic coding sequence
atggccaaggagcgctgcctgaagaagagcttccaggacagcctggaggacatcaagaagaggatgaaggagaagaggaacaagaacctggccgagatcggcaagaggaggagcttcatcgccgccccctgccagatcatcaccaacaccagcaccctgctgaagaactaccaggacaacaacaagatgctggtgctggccctggagaatgagaagagcaaggtgaaggaggcccaggacatcatcctgcagctgaggaaggagtgctactacctgacctgccagctgtatgccctgaagggcaagctgaccagccagcagacagtggagcccgcccagaaccaggagatctgcagcagcggcatggaccccaacagtgatgacagcagcaggaacctgtttgtgaaggacctgccccagatccccctggaggagacagagctgcccggccagggcgagagcttccagatcgaggccaccccacctgagacccagcagagcccccacctgagcctgaaggacatcaccaacgtgtccctgtaccctgtggtgaagatccggcggctgagcctgagccccaagaagaacaaggccagccctgctgtggccctgcccaagaggcgctgcacagcctctgtgaactacaaggagcccaccctggccagcaagctgcggcggggggaccccttcacagacctgtgcttcctgaacagccccatcttcaagcagaagaaggacctgcggcgcagcaagaagtccatgaagcagatccagtag

SEQ ID NO: 169675 - DNA, 828 bp, Artificial Sequence; identical to SEQ ID NO: 169670
  Description of Artificial Sequence: Synthetic coding sequence

SEQ ID NO: 169676 - DNA, 777 bp, Artificial Sequence; identical to SEQ ID NO: 169674
  Description of Artificial Sequence: Synthetic coding sequence

SEQ ID NO: 169677 - DNA, 879 bp, Artificial Sequence; identical to SEQ ID NO: 169666
  Description of Artificial Sequence: Synthetic coding sequence

SEQ ID NO: 169678 - DNA, 3798 bp, Artificial Sequence
  Description of Artificial Sequence: Synthetic coding sequence
atggagtgccctgtgatggagaccggcagcctcttcaccagcggcatcaagaggcacctgaaggacaagaggatcagcaagaccaccaagctgaatgtgtccctggccagcaagatcaagaccaagatcctgaacaacagcagcatcttcaagatcagcctgaagcacaacaacagagccctggcccaggccctgagccgggagaaggagaacagccgccgcatcaccacagagaagatgctgctgcagaaggaggtggagaagctgaactttgagaacaccttcctgcggctgaagctgaacaacctgaacaagaagctgattgacatcgaggccctgatgaacaacaacctgatcacagccatcgagatgagcagcctgtctgagttccaccagagcagcttcctgctgagcgccagcaagaagaagaggatcagcaagcagtgcaagctgatgaggctgccctttgcccgggtgcccctgaccagcaatgatgatgaagatgaggacaaggagaagatgcagtgtgacaacaacatcaagagcaagaccctgcctgacatccccagcagcggcagcaccacccagcccctgagcacccaggacaacagcgaggtgctcttcctgaaggagaacaaccagaatgtgtatggcctggatgacagcgagcacatcagcagcatcgtggatgtgcccccccgggagagccacagccacagcgaccagagcagcaagaccagcctgatgtctgagatgagaaatgcccagagcatcggccgccgctgggagaagcccagccccagcaatgtgacagagaggaagaagaggggcagctcctgggagagcaacaacctgtctgctgacaccccctgtgccaccgtgctggacaagcagcacatcagcagccctgagctgaactgcaacaatgagatcaatggccacaccaatgagaccaacacagagatgcagaggaacaagcaggacctgcccggcctgagcagcgagagcgcccgggagcccaatgctgagtgcatgaaccagattgaagataatgatgacttccagctgcagaagacagtgtatgatgctgacatggacctgacagccagcgaggtgtccaagatcgtgacagtgtccacaggcatcaagaagaagagcaacaagaagaccaatgaacatggcatgaagaccttcaggaaggtgaaggacagcagcagcgagaagaagcgggagaggagcaagaggcagttcaagaacagcagtgatgtggacattggagagaagattgagaacagaacagagaggagtgatgtgctggatggcaagagaggagctgaggaccccggcttcatcttcaacaatgagcagctggcccagatgaatgagcagctggcccaggtgaatgagctgaagaagatgaccctgcagacaggctttgagcagggcgacagagaaaatgtgctgtgcaacaagaaggagaagaggatcaccaatgagcaggaggagacctacagcctgagccagagcagcggcaagttccaccaggagagcaagtttgataaaggccagaacagcctgacctgcaacaagagcaaggccagccggcagaccttcgtcatccacaagctggagaaggacaacctgctgcccaaccagaaggacaaggtgaccatctatgagaacctggatgtgaccaatgagttccacacagccaacctgagcaccaaggacaatggaaacctgtgtgactatggcacccacaacatcctggacctgaagaagtatgtgacagacatccagcccagcgagcagaatgaaagcaacatcaacaagctgaggaagaaggtgaacaggaagacagagatcatcagcggcatgaaccacatgtatgaagataatgacaaggatgtggtgcacggcctgaagaagggcaacttcttcttcaagacccaggaggacaaggagcccatcagtgaaaatattgaggtgtccaaggagctgcagatcccagccctgagcacccgggacaatgaaaaccagtgtgactaccgcacccagaatgtgctgggcctgcagaagcagatcaccaacatgtaccctgtgcagcagaatgaaagcaaggtgaacaagaagctgcggcagaaggtgaacaggaagacagagatcatcagcgaggtgaaccacctggacaatgacaagagcattgagtacacagtgaagagccacagcctcttcctgacccagaaggacaaggagatcatccctggcaacctggaggaccccagcgagtttgagaccccagccctgagcaccaaggacagcggcaacctgtatgacagcgagatccagaatgtgctgggcgtgaagcacggccatgacatgcagcctgcctgccagaatgacagcaagattggcaagaagccccggctgaatgtgtgccagaagtctgagatcatccctgagaccaaccagatctatgaaaatgacaacaagggcgtgcatgacctggagaaggacaacttcttcagcctgacccccaaggacaaggagaccatcagcgagaacctgcaggtgaccaatgagttccagacagtggacctgctgatcaaggacaatggaaacctgtgtgactatgacacccagaacatcctggagctgaagaagtatgtgacagacaggaagtctgctgagcagaatgaaagcaagatcaacaagctgaggaacaaggtgaactggaagacagagatcatcagcgagatgaaccagatctatgaagataatgacaaggatgcccacgtgcaggagagctacaccaaggacctggacttcaaggtgaacaagagcaagcagaagctggagtgccaggacatcatcaacaagcactacatggaggtgaacagcaatgagaaggagagctgtgaccagatcctggacagctacaaggtggtgaagaagaggaagaaggagagcagctgcaaggccaagaacatcctgaccaaggccaagaacaagctggccagccagctgacagagagcagccagaccagcatcagcctggagagtgacctgaagcacatcaccagcgaggccgacagcgaccccggcaaccctgtggagctgtgcaagacccagaagcagagcaccaccaccctgaacaagaaggacctgccctttgtggaggagatcaaggagggggagtgccaggtgaagaaggtgaacaagatgaccagcaagagcaagaagaggaagaccagcattgaccccagccctgagagccatgaggtgatggagcgcatcctggacagcgtgcagggcaagagcacagtgtctgagcaggccgacaaggagaacaacctggagaatgagaagatggtgaagaacaagccagacttctacaccaaggccttccgcagcctgtctgagatccacagccccaacatccaggacagcagctttgacagcgtgcgggagggcctggtgcccctgtctgtgagcagcggcaagaatgtcatcatcaaggagaactttgccctggagtgcagccctgccttccaggtgtctgatgatgaacatgagaagatgaacaagatgaagttcaaggtgaacagaaggacccagaagagcggcatcggggaccggcccctgcaggacctgagcaacaccagctttgtgagcaacaacacagctgagagcgagaacaagtctgaggacctgagcagcgagaggaccagcagaagaagacgctgcacccccttctacttcaaggagcccagcctgcgggacaagatgagaagatag

SEQ ID NO: 169679 - DNA, 744 bp, Artificial Sequence
  Description of Artificial Sequence: Synthetic coding sequence
atggagtgccctgtgatggagaccggcagcctcttcaccagcggcatcaagaggcacctgaaggacaagaggatcagcaagaccaccaagctgaatgtgtccctggccagcaagatcaagaccaagatcctgaacaacagcagcatcttcaagatcagcctgaagcacaacaacagagccctggcccaggccctgagccgggagaaggagaacagccgccgcatcaccacagagaagatgctgctgcagaaggaggtggagaagctgaactttgagaacaccttcctgcggctgaagctgaacaacctgaacaagaagctgattgacatcgaggccctgatgaacaacaacctgatcacagccatcgagatgagcagcctgtctgagttccaccagagcagcttcctgctgagcgccagcaagaagaagaggatcagcaagcagtgcaagctgatgaggctgccctttgcccgggtgcccctgaccagcaatgatgatgaagatgaggacaaggagaagatgcagtgtgacaacaacatcaagagcaagaccctgcctgacatccccagcagcggcagcaccacccagcccctgagcacccaggacaacagcgaggtgctcttcctgaaggagaacaaccagaatgtgtatggcctggatgacagcgagcacatcagcagcatcgtggatgtgcccccaagaggagaaattgtgctgaagatccactttgagtacctgtactag

SEQ ID NO: 169680 - DNA, 264 bp, Artificial Sequence
  Description of Artificial Sequence: Synthetic coding sequence
atggagtgccctgtgatggagaccggcagcctcttcaccagcggcatcaagaggcacctgaaggacaagaggatcagcaagaccaccaagctgaatgtgtccctggccagcaagatcaagaccaagatcctgaacaacagcagcatcttcaagatcagcctgaagcacaacaacagagccctggcccaggccctgagccgggagaaggagaacagccgccgcatcaccacagagaagatgctgctgcagaaggaggtggagtag

SEQ ID NO: 169681 - DNA, 753 bp, Artificial Sequence
  Description of Artificial Sequence: Synthetic coding sequence
atgagcatcttcacccccaccaaccagatccggctgaccaacgtggccgtggtgaggatgaagagagctgggaagagatttgaaattgcctgctacaagaacaaggtggtgggctggaggtctggagtggagaaggacctggatgaggtgctgcagacccacagcgtgtttgtgaatgtgtccaagggccaggtggccaagaaggaggacctgatcagcgcctttggaacagatgaccagacagagatctgcaagcagatcctgaccaagggggaggtgcaggtgtctgacaaggagcggcacacccagctggagcagatgttccgggacatcgccaccatcgtggccgacaagtgtgtgaaccctgagaccaagaggccctacaccgtcatcctgattgagcgggccatgaaggacatccactacagcgtgaagaccaacaagagcaccaagcagcaggccctggaggtgatcaagcagctgaaggagaagatgaagattgagcgggcccacatgaggctgcgcttcatcctgcctgtgaatgaaggcaagaagctgaaggagaagctgaagcccctcatcaaggtgattgaaagtgaggactatggccagcagctggagatcgtgtgcctgattgaccccggctgcttccgggagattgatgagctgatcaagaaggagaccaagggcaagggcagcctggaggtgctgaacctgaaggatgtggaggagggagatgagaagtttgaatag

SEQ ID NO: 169682 - DNA, 1572 bp, Artificial Sequence
  Description of Artificial Sequence: Synthetic coding sequence
atggtggcccctggcctggtgctgggcctggtgctgcccctcatcctgtgggccgacagatctgctggcatcggcttccgctttgccagctacatcaacaatgacatggtgctgcagaaggagcctgctggagctgtgatctggggcttcggcacccctggggccaccgtgacagtgaccctgcggcagggccaggagaccatcatgaagaaggtgacctctgtgaaggcccacagcgacacctggatggtggtgctggaccccatgaagccaggcggcccctttgaggtgatggcccagcagaccctggagaagatcaacttcaccctgcgggtgcatgatgtgctgtttggagatgtgtggctgtgcagcggccagagcaacatgcagatgacagtgctgcagatcttcaatgccacccgggagctgagcaacacagctgcctaccagagcgtgcgcatcctgtctgtgagccccatccaggccgagcaggagctggaggacctggtggccgtggacctgcagtggagcaagcccaccagcgagaacctgggccacggctacttcaagtacatgtctgctgtgtgctggctgtttggccgccacctgtatgacaccctgcagtaccccatcggcctcatcgccagctcctggggcggcacccccatcgaggcctggagcagcggccgcagcctgaaggcctgtggggtgcccaagcagggcagcatcccctatgattctgtgacaggccccagcaagcacagcgtgctgtggaatgccatgatccaccccctgtgcaacatgaccctgaagggcgtggtgtggtaccagggcgagagcaacatcaactacaacacagacctgtacaactgcaccttccctgccctgattgaggactggagggagaccttccaccggggcagccagggccagacagagcgcttcttccccttcggcctggtgcagctgagcagtgacctgagcaagaagagcagtgatgatggcttcccccagatccgctggcaccagacagctgactttggctacgtgcccaaccccaagatgcccaacaccttcatggctgtggccatggacctgtgtgaccgggacagccccttcggcagcatccacccccgggacaagcagacagtggcctaccgcctgcacctgggcgcccgggccctggcctatggagagaagaacctgacctttgagggccccctgcctgagaagattgagctgctggcccacaagggcctgctgaacctgacctactaccagcagatccaggtgcagaagaaggacaacaagatctttgagatcagctgctgcagcgaccaccgctgcaagtggctgcctgcctccatgaacacagtgtccacccagagcctgaccctggccatcgacagctgccacggcaccgtggtggccctgcgctatgcctggaccacctggccctgtgagtacaagcagtgccccctgtaccaccccagcagcgccctgcctgccccacccttcatcgccttcatcacagaccagggccctggccaccagagcaatgtggccaagtag

SEQ ID NO: 169683 - DNA, 1467 bp, Artificial Sequence
  Description of Artificial Sequence: Synthetic coding sequence
atggtgctgcagaaggagcctgctggggccgtcatctggggcttcggcacccctggggccaccgtgacagtgaccctgcggcagggccaggagaccatcatgaagaaggtgacctctgtgaaggcccacagcgacacctggatggtggtgctggaccccatgaagccaggcggcccctttgaggtgatggcccagcagaccctggagaagatcaacttcaccctgcgggtgcatgatgtgctgtttggagatgtgtggctgtgcagcggccagagcaacatgcagatgacagtgctgcagatcttcaatgccacccgggagctgagcaacacagctgcctaccagagcgtgcgcatcctgtctgtgagccccatccaggccgagcaggagctggaggacctggtggccgtggacctgcagtggagcaagcccaccagcgagaacctgggccacggctacttcaagtacatgtctgctgtgtgctggctgtttggccgccacctgtatgacaccctgcagtaccccatcggcctgattgccagctcctggggcggcacccccatcgaggcctggagcagcggccgcagcctgaaggcctgtggggtgcccaagcagggcagcatcccctatgacagcgtgacaggccccagcaagcacagcgtgctgtggaatgccatgatccaccccctgtgcaacatgaccctgaagggcgtggtgtggtaccagggcgagagcaacatcaactacaacacagacctgtacaactgcaccttccctgccctgattgaggactggagggagaccttccaccggggcagccagggccagacagagcgcttcttccccttcggcctggtgcagctgagcagtgacctgagcaagaagagcagtgatgatggcttcccccagatccgctggcaccagacagctgactttggctacgtgcccaaccccaagatgcccaacaccttcatggctgtggccatggacctgtgtgaccgggacagccccttcggcagcatccacccccgggacaagcagacagtggcctaccgcctgcacctgggcgcccgggccctggcctacggggagaagaacctgacctttgagggccccctgcctgagaagattgagctgctggcccacaagggcctgctgaacctgacctactaccagcagatccaggtgcagaagaaggacaacaagatctttgagatcagctgctgcagcgaccaccgctgcaagtggctgcctgcctccatgaacacagtgtccacccagagcctgaccctggccatcgacagctgccacggcaccgtggtggccctgcgctatgcctggaccacctggccctgtgagtacaagcagtgccccctgtaccaccccagcagcgccctgcctgccccacccttcatcgccttcatcacagaccagggccctggccaccagagcaatgtggccaagtag

SEQ ID NO: 169684 - DNA, 2094 bp, Artificial Sequence
  Description of Artificial Sequence: Synthetic coding sequence
atgctgctgcccctgctgctgagcagcctgctgggcggcagccaggccatggatggccgcttctggatccgggtgcaggagagcgtgatggtgcctgagggcctgtgcatctctgtgccctgcagcttctcctacccccggcaggactggacaggcagcaccccagcctacggctactggttcaaggctgtgacagagaccaccaagggggcccctgtggccaccaaccaccagagccgggaggtggagatgagcacccggggccgcttccagctgactggagaccctgccaagggcaactgcagcctggtgatcagagatgcccagatgcaggatgagagccagtacttcttccgggtggagcggggcagctatgtgcgctacaacttcatgaatgatggcttcttcctgaaggtgacagccctgacccagaagccagatgtgtacatccctgagaccctggagcccggccagcctgtgaccgtcatctgtgtgttcaactgggcctttgaggagtgccccccacccagcttctcctggacaggagctgccctgagcagccagggcaccaagcccaccaccagccacttctctgtgctgtccttcaccccccggccccaggaccacaacacagacctgacctgccacgtggacttcagcaggaagggcgtgtctgcccagaggacagtgcggctgcgggtggcctatgccccccgggacctggtgatcagcatcagccgggacaacaccccagccctggagccccagccccagggcaatgtgccctacctggaggcccagaagggccagttcctgcggctgctgtgtgccgctgacagccagcccccagccaccctgtcctgggtgctgcagaacagagtgctgagcagcagccacccctggggcccccggcccctgggcctggagctgcccggggtgaaggccggggacagcggccgctacacctgcagagctgagaaccggctgggcagccagcagagggccctggacctgtctgtgcagtaccccccagagaacctgcgggtgatggtgtcccaggccaacagaacagtgctggagaacctgggcaatggcaccagcctgcctgtgctggagggccagagcctgtgcctggtgtgtgtgacccacagcagccccccagcccggctgtcctggacccagaggggccaggtgctgagccccagccagcccagcgaccccggggtgctggagctgccccgggtgcaggtggagcatgaaggagagttcacctgccacgcccggcaccccctgggcagccagcacgtgtccctgagcctgtctgtgcactacagccccaagctgctgggccccagctgctcctgggaggccgagggcctgcactgcagctgcagcagccaggccagccctgcccccagcctgcgctggtggctgggggaggagctgctggagggcaacagcagccaggacagctttgaggtgacccccagcagcgctggcccctgggccaacagcagcctgagcctgcacggcggcctgagcagcggcctgcggctgcgctgtgaggcctggaatgtgcatggagcccagagcggcagcatcctgcagctgcctgacaagaagggcctcatcagcacagccttcagcaatggagccttcctgggcatcggcatcacagccctgctcttcctgtgcctggccctgatcatcatgaagatcctgcccaagaggaggacccagacagagaccccccggccccgcttcagccgccacagcaccatcctggactacatcaacgtggtgcccacagctggccccctggcccagaagaggaaccagaaggccacccccaacagccccaggacccccctgcccccaggggcccccagccctgagagcaagaagaaccagaagaagcagtaccagctgcccagcttccctgagcccaagagcagcacccaggcccctgagagccaggagagccaggaggagctgcactacgccaccctgaacttccctggggtgcggcccaggcctgaggccaggatgcccaagggcacccaggccgactatgcagaggtgaagttccagtag

SEQ ID NO: 169685 - DNA, 1809 bp, Artificial Sequence
  Description of Artificial Sequence: Synthetic coding sequence
atgctgctgcccctgctgctgagcagcctgctgggcggcagccaggccatggatggccgcttctggatccgggtgcaggagagcgtgatggtgcctgagggcctgtgcatctctgtgccctgcagcttctcctacccccggcaggactggacaggcagcaccccagcctacggctactggttcaaggctgtgacagagaccaccaagggggcccctgtggccaccaaccaccagagccgggaggtggagatgagcacccggggccgcttccagctgactggagaccctgccaagggcaactgcagcctggtgatcagagatgcccagatgcaggatgagagccagtacttcttccgggtggagcggggcagctatgtgcgctacaacttcatgaatgatggcttcttcctgaaggtgacagccctgacccagaagccagatgtgtacatccctgagaccctggagcccggccagcctgtgaccgtcatctgtgtgttcaactgggcctttgaggagtgccccccacccagcttctcctggacaggagctgccctgagcagccagggcaccaagcccaccaccagccacttctctgtgctgtccttcaccccccggccccaggaccacaacacagacctgacctgccacgtggacttcagcaggaagggcgtgtctgcccagaggacagtgcggctgcgggtggcctatgccccccgggacctggtgatcagcatcagccgggacaacaccccagccctggagccccagccccagggcaatgtgccctacctggaggcccagaagggccagttcctgcggctgctgtgtgccgctgacagccagcccccagccaccctgtcctgggtgctgcagaacagagtgctgagcagcagccacccctggggcccccggcccctgggcctggagctgcccggggtgaaggccggggacagcggccgctacacctgcagagctgagaaccggctgggcagccagcagagggccctggacctgtctgtgcagtaccccccagagaacctgcgggtgatggtgtcccaggccaacagaacagtgctggagaacctgggcaatggcaccagcctgcctgtgctggagggccagagcctgtgcctggtgtgtgtgacccacagcagccccccagcccggctgtcctggacccagaggggccaggtgctgagccccagccagcccagcgaccccggggtgctggagctgccccgggtgcaggtggagcatgaaggagagttcacctgccacgcccggcaccccctgggcagccagcacgtgtccctgagcctgtctgtgcactacaagaagggcctcatcagcacagccttcagcaatggagccttcctgggcatcggcatcacagccctgctcttcctgtgcctggccctgatcatcatgaagatcctgcccaagaggaggacccagacagagaccccccggccccgcttcagccgccacagcaccatcctggactacatcaacgtggtgcccacagctggccccctggcccagaagaggaaccagaaggccacccccaacagccccaggacccccctgcccccaggggcccccagccctgagagcaagaagaaccagaagaagcagtaccagctgcccagcttccctgagcccaagagcagcacccaggcccctgagagccaggagagccaggaggagctgcactacgccaccctgaacttccctggggtgcggcccaggcctgaggccaggatgcccaagggcacccaggccgactatgcagaggtgaagttccagtag

SEQ ID NO: 169686 - DNA, 2094 bp, Artificial Sequence; identical to SEQ ID NO: 169684
  Description of Artificial Sequence: Synthetic coding sequence

SEQ ID NO: 169687 - DNA, 1560 bp, Artificial Sequence
  Description of Artificial Sequence: Synthetic coding sequence
atgctgctgcccctgctgctgagcagcctgctgggcggcagccaggccatggatggccgcttctggatccgggtgcaggagagcgtgatggtgcctgagggcctgtgcatctctgtgccctgcagcttctcctacccccggcaggactggacaggcagcaccccagcctacggctactggttcaaggctgtgacagagaccaccaagggggcccctgtggccaccaaccaccagagccgggaggtggagatgagcacccggggccgcttccagctgactggagaccctgccaagggcaactgcagcctggtgatcagagatgcccagatgcaggatgagagccagtacttcttccgggtggagcggggcagctatgtgcgctacaacttcatgaatgatggcttcttcctgaaggtgacagccctgacccagaagacagtgcggctgcgggtggcctatgccccccgggacctggtgatcagcatcagccgggacaacaccccagccctggagccccagccccagggcaatgtgccctacctggaggcccagaagggccagttcctgcggctgctgtgtgccgctgacagccagcccccagccaccctgtcctgggtgctgcagaacagagtgctgagcagcagccacccctggggcccccggcccctgggcctggagctgcccggggtgaaggccggggacagcggccgctacacctgcagagcagaaaatcggctgggcagccagcagagggccctggacctgtctgtgcagtacccacctgagaacctgcgggtgatggtgtcccaggccaacagaacagtgctggagaacctgggcaatggcaccagcctgcctgtgctggagggccagagcctgtgcctggtgtgtgtgacccacagcagccccccagcccggctgtcctggacccagaggggccaggtgctgagccccagccagcccagcgaccccggggtgctggagctgccccgggtgcaggtggagcacgagggggagttcacctgccacgcccggcaccccctgggcagccagcacgtgtccctgagcctgtctgtgcactacaagaagggcctcatcagcacagccttcagcaatggagccttcctgggcatcggcatcacagccctgctcttcctgtgcctggccctgatcatcatgaagatcctgcccaagaggaggacccagacagagaccccccggccccgcttcagccgccacagcaccatcctggactacatcaacgtggtgcccacagctggccccctggcccagaagaggaaccagaaggccacccccaacagccccaggacccccctgcccccaggggcccccagccctgagagcaagaagaaccagaagaagcagtaccagctgcccagcttccctgagcccaagagcagcacccaggcccctgagagccaggagagccaggaggagctgcactacgccaccctgaacttccctggggtgcggcccaggcctgaggccaggatgcccaagggcacccaggccgactatgcagaggtgaagttccagtag

SEQ ID NO: 169688 - DNA, 1920 bp, Artificial Sequence
  Description of Artificial Sequence: Synthetic coding sequence
atgctgctgcccctgctgctgagcagcctgctgggcggcagccaggccatggatggccgcttctggatccgggtgcaggagagcgtgatggtgcctgagggcctgtgcatctctgtgccctgcagcttctcctacccccggcaggactggacaggcagcaccccagcctacggctactggttcaaggctgtgacagagaccaccaagggggcccctgtggccaccaaccaccagagccgggaggtggagatgagcacccggggccgcttccagctgactggagaccctgccaagggcaactgcagcctggtgatcagagatgcccagatgcaggatgagagccagtacttcttccgggtggagcggggcagctatgtgcgctacaacttcatgaatgatggcttcttcctgaaggtgacagtgctgtccttcaccccccggccccaggaccacaacacagacctgacctgccacgtggacttcagcaggaagggcgtgtctgcccagaggacagtgcggctgcgggtggcctatgccccccgggacctggtgatcagcatcagccgggacaacaccccagccctggagccccagccccagggcaatgtgccctacctggaggcccagaagggccagttcctgcggctgctgtgtgccgctgacagccagcccccagccaccctgtcctgggtgctgcagaacagagtgctgagcagcagccacccctggggcccccggcccctgggcctggagctgcccggggtgaaggccggggacagcggccgctacacctgcagagctgagaaccggctgggcagccagcagagggccctggacctgtctgtgcagtaccccccagagaacctgcgggtgatggtgtcccaggccaacagaacagtgctggagaacctgggcaatggcaccagcctgcctgtgctggagggccagagcctgtgcctggtgtgtgtgacccacagcagccccccagcccggctgtcctggacccagaggggccaggtgctgagccccagccagcccagcgaccccggggtgctggagctgccccgggtgcaggtggagcatgaaggagagttcacctgccacgcccggcaccccctgggcagccagcacgtgtccctgagcctgtctgtgcactacagccccaagctgctgggccccagctgctcctgggaggccgagggcctgcactgcagctgcagcagccaggccagccctgcccccagcctgcgctggtggctgggggaggagctgctggagggcaacagcagccaggacagctttgaggtgacccccagcagcgctggcccctgggccaacagcagcctgagcctgcacggcggcctgagcagcggcctgcggctgcgctgtgaggcctggaatgtgcatggagcccagagcggcagcatcctgcagctgcctgacaagaagggcctcatcagcacagccttcagcaatggagccttcctgggcatcggcatcacagccctgctcttcctgtgcctggccctgatcatcatgaagatcctgcccaagaggaggacccagacagagaccccccggccccgcttcagccgccacagcaccatcctggactacatcaacgtggtgcccacagctggccccctggcccagaagaggaaccagaaggccacccccaacagccccaggacccccctgcccccaggggcccccagccctgagagcaagaagaaccagaagaagcagtaccagctgcccagcttccctgagcccaagagcagcacccaggcccctgagagccaggagagccaggaggagctgcactacgccaccctgaacttccctggggtgcggcccaggcctgaggccaggatgcccaagggcacccaggccgactatgcagaggtgaagttccagtag

SEQ ID NO: 169689 - DNA, 1635 bp, Artificial Sequence
  Description of Artificial Sequence: Synthetic coding sequence
atgctgctgcccctgctgctgagcagcctgctgggcggcagccaggccatggatggccgcttctggatccgggtgcaggagagcgtgatggtgcctgagggcctgtgcatctctgtgccctgcagcttctcctacccccggcaggactggacaggcagcaccccagcctacggctactggttcaaggctgtgacagagaccaccaagggggcccctgtggccaccaaccaccagagccgggaggtggagatgagcacccggggccgcttccagctgactggagaccctgccaagggcaactgcagcctggtgatcagagatgcccagatgcaggatgagagccagtacttcttccgggtggagcggggcagctatgtgcgctacaacttcatgaatgatggcttcttcctgaaggtgacagtgctgtccttcaccccccggccccaggaccacaacacagacctgacctgccacgtggacttcagcaggaagggcgtgtctgcccagaggacagtgcggctgcgggtggcctatgccccccgggacctggtgatcagcatcagccgggacaacaccccagccctggagccccagccccagggcaatgtgccctacctggaggcccagaagggccagttcctgcggctgctgtgtgccgctgacagccagcccccagccaccctgtcctgggtgctgcagaacagagtgctgagcagcagccacccctggggcccccggcccctgggcctggagctgcccggggtgaaggccggggacagcggccgctacacctgcagagctgagaaccggctgggcagccagcagagggccctggacctgtctgtgcagtaccccccagagaacctgcgggtgatggtgtcccaggccaacagaacagtgctggagaacctgggcaatggcaccagcctgcctgtgctggagggccagagcctgtgcctggtgtgtgtgacccacagcagccccccagcccggctgtcctggacccagaggggccaggtgctgagccccagccagcccagcgaccccggggtgctggagctgccccgggtgcaggtggagcatgaaggagagttcacctgccacgcccggcaccccctgggcagccagcacgtgtccctgagcctgtctgtgcactacaagaagggcctcatcagcacagccttcagcaatggagccttcctgggcatcggcatcacagccctgctcttcctgtgcctggccctgatcatcatgaagatcctgcccaagaggaggacccagacagagaccccccggccccgcttcagccgccacagcaccatcctggactacatcaacgtggtgcccacagctggccccctggcccagaagaggaaccagaaggccacccccaacagccccaggacccccctgcccccaggggcccccagccctgagagcaagaagaaccagaagaagcagtaccagctgcccagcttccctgagcccaagagcagcacccaggcccctgagagccaggagagccaggaggagctgcactacgccaccctgaacttccctggggtgcggcccaggcctgaggccaggatgcccaagggcacccaggccgactatgcagaggtgaagttccagtag

SEQ ID NO: 169690 - DNA, 1365 bp, Artificial Sequence
  Description of Artificial Sequence: Synthetic coding sequence
atgctgctgcccctgctgctgagcagcctgctgggcggcagccaggccatggatggccgcttctggatccgggtgcaggagagcgtgatggtgcctgagggcctgtgcatctctgtgccctgcagcttctcctacccccggcaggactggacaggcagcaccccagcctacggctactggttcaaggctgtgacagagaccaccaagggggcccctgtggccaccaaccaccagagccgggaggtggagatgagcacccggggccgcttccagctgactggagaccctgccaagggcaactgcagcctggtgatcagagatgcccagatgcaggatgagagccagtacttcttccgggtggagcggggcagctatgtgcgctacaacttcatgaatgatggcttcttcctgaaggtgacagtgctgtccttcaccccccggccccaggaccacaacacagacctgacctgccacgtggacttcagcaggaagggcgtgtctgcccagaggacagtgcggctgcgggtggcctatgccccccgggacctggtgatcagcatcagccgggacaacaccccagaccccccagagaacctgcgggtgatggtgtcccaggccaacagaacagtgctggagaacctgggcaatggcaccagcctgcctgtgctggagggccagagcctgtgcctggtgtgtgtgacccacagcagccccccagcccggctgtcctggacccagaggggccaggtgctgagccccagccagcccagcgaccccggggtgctggagctgccccgggtgcaggtggagcatgaaggagagttcacctgccacgcccggcaccccctgggcagccagcacgtgtccctgagcctgtctgtgcactacaagaagggcctcatcagcacagccttcagcaatggagccttcctgggcatcggcatcacagccctgctcttcctgtgcctggccctgatcatcatgaagatcctgcccaagaggaggacccagacagagaccccccggccccgcttcagccgccacagcaccatcctggactacatcaacgtggtgcccacagctggccccctggcccagaagaggaaccagaaggccacccccaacagccccaggacccccctgcccccaggggcccccagccctgagagcaagaagaaccagaagaagcagtaccagctgcccagcttccctgagcccaagagcagcacccaggcccctgagagccaggagagccaggaggagctgcactacgccaccctgaacttccctggggtgcggcccaggcctgaggccaggatgcccaagggcacccaggccgactatgcagaggtgaagttccagtag

SEQ ID NO: 169691 - DNA, 1665 bp, Artificial Sequence
  Description of Artificial Sequence: Synthetic coding sequence
atgctgctgcccctgctgctgagcagcctgctgggcggcagccaggccatggatggccgcttctggatccgggtgcaggagagcgtgatggtgcctgagggcctgtgcatctctgtgccctgcagcttctcctacccccggcaggactggacaggcagcaccccagcctacggctactggttcaaggctgtgacagagaccaccaagggggcccctgtggccaccaaccaccagagccgggaggtggagatgagcacccggggccgcttccagctgactggagaccctgccaagggcaactgcagcctggtgatcagagatgcccagatgcaggatgagagccagtacttcttccgggtggagcggggcagctatgtgcgctacaacttcatgaatgatggcttcttcctgaaggtgacaggcaccaagcccaccaccagccacttctctgtgctgtccttcaccccccggccccaggaccacaacacagacctgacctgccacgtggacttcagcaggaagggcgtgtctgcccagaggacagtgcggctgcgggtggcctatgccccccgggacctggtgatcagcatcagccgggacaacaccccagccctggagccccagccccagggcaatgtgccctacctggaggcccagaagggccagttcctgcggctgctgtgtgccgctgacagccagcccccagccaccctgtcctgggtgctgcagaacagagtgctgagcagcagccacccctggggcccccggcccctgggcctggagctgcccggggtgaaggccggggacagcggccgctacacctgcagagctgagaaccggctgggcagccagcagagggccctggacctgtctgtgcagtaccccccagagaacctgcgggtgatggtgtcccaggccaacagaacagtgctggagaacctgggcaatggcaccagcctgcctgtgctggagggccagagcctgtgcctggtgtgtgtgacccacagcagccccccagcccggctgtcctggacccagaggggccaggtgctgagccccagccagcccagcgaccccggggtgctggagctgccccgggtgcaggtggagcatgaaggagagttcacctgccacgcccggcaccccctgggcagccagcacgtgtccctgagcctgtctgtgcactacaagaagggcctcatcagcacagccttcagcaatggagccttcctgggcatcggcatcacagccctgctcttcctgtgcctggccctgatcatcatgaagatcctgcccaagaggaggacccagacagagaccccccggccccgcttcagccgccacagcaccatcctggactacatcaacgtggtgcccacagctggccccctggcccagaagaggaaccagaaggccacccccaacagccccaggacccccctgcccccaggggcccccagccctgagagcaagaagaaccagaagaagcagtaccagctgcccagcttccctgagcccaagagcagcacccaggcccctgagagccaggagagccaggaggagctgcactacgccaccctgaacttccctggggtgcggcccaggcctgaggccaggatgcccaagggcacccaggccgactatgcagaggtgaagttccagtag

SEQ ID NO: 169692 - DNA, 2097 bp, Artificial Sequence
  Description of Artificial Sequence: Synthetic coding sequence
atggtgcccggccaggcccagccccagagccctgagatgctgctgctgcccctgctgctgcctgtgctgggcgccggcagcctgaacaaggaccccagctacagcctgcaggtgcagaggcaggtgcctgtgcctgagggcctgtgtgtgattgtgtcctgcaacctgagctaccccagagatggctgggatgagagcacagctgcctacggctactggttcaagggccgcaccagccccaagacaggagcccctgtggccaccaacaaccagagccgggaggtggagatgagcacccgggaccgcttccagctgaccggggaccccgggaagggcagctgcagcctggtgatcagagatgcccagcgggaggatgaggcctggtacttcttccgggtggagcggggcagccgggtgcgccacagcttcctgagcaatgccttcttcctgaaggtgacagccctgaccaagaagccagatgtgtacatccctgagaccctggagcccggccagcctgtgaccgtcatctgtgtgttcaactgggccttcaagaagtgcccagcccccagcttctcctggacaggagctgccctgagccccaggaggacccggcccagcaccagccacttctctgtgctgtccttcacccccagcccccaggaccatgacacagacctgacctgccacgtggacttcagcaggaaaggagtgtctgcccagaggacagtgcggctgcgggtggcctatgcccccaaggacctgatcatcagcatcagccatgacaacaccagcgccctggagctgcagggcaatgtcatctacctggaggtgcagaagggccagttcctgcggctgctgtgtgccgctgacagccagcccccagccaccctgtcctgggtgctgcaggacagagtgctgagcagcagccacccctggggccccaggaccctgggcctggagctgcggggcgtgcgggccggggacagcggccgctacacctgcagagcagaaaatcggctgggcagccagcagcaggccctggacctgtctgtgcagtacccacctgagaacctgcgggtgatggtgtcccaggccaacagaacagtgctggagaacctgggcaatggcaccagcctgcctgtgctggagggccagagcctgcggctggtgtgtgtgacccacagcagccccccagcccggctgtcctggacccgctggggccagacagtgggccccagccagcccagcgaccccggggtgctggagctgccccccatccagatggagcacgagggggagttcacctgccacgcccagcaccccctgggcagccagcacgtgtccctgagcctgtctgtgcactacccaccccagctgctgggccccagctgctcctgggaggccgagggcctgcactgcagctgcagcagccaggccagccctgcccccagcctgcgctggtggctgggggaggagctgctggagggcaacagcagccagggcagctttgaggtgacccccagcagcgctggcccctgggccaacagcagcctgagcctgcatggaggcctgagcagcggcctgcggctgcgctgcaaggcctggaatgtgcacggggcccagagcggcagcgtcttccagctgctgcccgggaagctggagcacggcggcggcctgggcctgggcgccgccctgggcgccggcgtggccgccctgctggccttctgcagctgcctggtggtgttccgggtgaagatctgcaggaaggaggccaggaagagagctgctgctgagcaggatgtgcccagcaccctgggccccatcagccagggccaccagcatgaatgttctgctggcagcagccaggaccaccccccacctggagctgccacctacacccctgggaagggggaggagcaggagctgcactacgccagcctgtccttccagggcctgcggctgtgggagcctgctgaccaggaggcccccagcaccacagagtacagcgagatcaagatccacacaggccagcccctgcggggccctggcttcggcctgcagctggagcgggagatgagcggcatggtgcccaagtag

SEQ ID NO: 169693 - DNA, 1809 bp, Artificial Sequence
  Description of Artificial Sequence: Synthetic coding sequence
atggtgcccggccaggcccagccccagagccctgagatgctgctgctgcccctgctgctgcctgtgctgggcgccggcagcctgaacaaggaccccagctacagcctgcaggtgcagaggcaggtgcctgtgcctgagggcctgtgtgtgattgtgtcctgcaacctgagctaccccagagatggctgggatgagagcacagctgcctacggctactggttcaagggccgcaccagccccaagacaggagcccctgtggccaccaacaaccagagccgggaggtggagatgagcacccgggaccgcttccagctgaccggggaccccgggaagggcagctgcagcctggtgatcagagatgcccagcgggaggatgaggcctggtacttcttccgggtggagcggggcagccgggtgcgccacagcttcctgagcaatgccttcttcctgaaggtgacagccctgaccaagaagccagatgtgtacatccctgagaccctggagcccggccagcctgtgaccgtcatctgtgtgttcaactgggccttcaagaagtgcccagcccccagcttctcctggacaggagctgccctgagccccaggaggacccggcccagcaccagccacttctctgtgctgtccttcacccccagcccccaggaccatgacacagacctgacctgccacgtggacttcagcaggaaaggagtgtctgcccagaggacagtgcggctgcgggtggcctatgcccccaaggacctgatcatcagcatcagccatgacaacaccagcgccctggagctgcagggcaatgtcatctacctggaggtgcagaagggccagttcctgcggctgctgtgtgccgctgacagccagcccccagccaccctgtcctgggtgctgcaggacagagtgctgagcagcagccacccctggggccccaggaccctgggcctggagctgcggggcgtgcgggccggggacagcggccgctacacctgcagagcagaaaatcggctgggcagccagcagcaggccctggacctgtctgtgcagtacccacctgagaacctgcgggtgatggtgtcccaggccaacagaacagtgctggagaacctgggcaatggcaccagcctgcctgtgctggagggccagagcctgcggctggtgtgtgtgacccacagcagccccccagcccggctgtcctggacccgctggggccagacagtgggccccagccagcccagcgaccccggggtgctggagctgccccccatccagatggagcacgagggggagttcacctgccacgcccagcaccccctgggcagccagcacgtgtccctgagcctgtctgtgcactggaagctggagcacggcggcggcctgggcctgggcgccgccctgggcgccggcgtggccgccctgctggccttctgcagctgcctggtggtgttccgggtgaagatctgcaggaaggaggccaggaagagagctgctgctgagcaggatgtgcccagcaccctgggccccatcagccagggccaccagcatgaatgttctgctggcagcagccaggaccaccccccacctggagctgccacctacacccctgggaagggggaggagcaggagctgcactacgccagcctgtccttccagggcctgcggctgtgggagcctgctgaccaggaggcccccagcaccacagagtacagcgagatcaagatccacacaggccagcccctgcggggccctggcttcggcctgcagctggagcgggagatgagcggcatggtgcccaagtag

SEQ ID NO: 169694 - DNA, 1809 bp, Artificial Sequence; identical to SEQ ID NO: 169693
  Description of Artificial Sequence: Synthetic coding sequence

SEQ ID NO: 169695 - DNA, 1788 bp, Artificial Sequence
  Description of Artificial Sequence: Synthetic coding sequence
atgctgctgctgctgctgctgctgccccccctgctgtgtggccgggtgggcgccaaggagcagaaggactacctgctgaccatgcagaagtctgtgacagtgcaggagggcctgtgtgtgtctgtgctgtgcagcttctcctacccccagaatggctggacagccagtgaccctgtgcacggctactggttccgggccggggaccacgtgtccaggaacatccctgtggccaccaacaacccagcccgggctgtgcaggaggagacccgggaccgcttccacctgctgggggacccccagaacaaggactgcaccctgagcatccgggacacccgggagagtgatgctggcacctacgtgttctgtgtggagcggggcaacatgaagtggaactacaagtatgaccagctgtctgtgaatgtgacagccagccaggacctgctgagccgctaccgcctggaggtgcctgagagcgtgacagtgcaggagggcctgtgtgtgtctgtgccctgcagcgtgctgtacccccactacaactggacagccagcagccctgtgtatggctcctggttcaaggagggcgctgacatcccctgggacatccctgtggccaccaacaccccatctgggaaggtgcaggaggacacccacggccgcttcctgctgctgggggacccccagaccaacaactgcagcctgagcatcagagatgccaggaagggggacagcggcaagtactacttccaggtggagcggggcagcaggaagtggaactacatctatgacaagctgtctgtgcacgtgacagccctgacccacatgcccaccttcagcatccctggcaccctggagagcggccaccccaggaacctgacctgcagcgtgccctgggcctgtgagcagggcaccccacccaccatcacctggatgggcgcctctgtgagcagcctggaccccaccatcaccaggagctccatgctgagcctcatcccccagccccaggaccacggcaccagcctgacctgccaggtgaccctgcctggagctggggtgaccatgaccagggctgtgcggctgaacatctcctacccaccccagaacctgaccatgacagtgttccagggagatggaacagccagcaccaccctgagaaatggaagtgccctgtctgtgctggagggccagagcctgcacctggtgtgtgctgtggacagcaaccccccagcccggctgtcctggacctggggcagcctgaccctgagccccagccagagcagcaacctgggcgtgctggagctgccccgggtgcacgtgaaggatgaaggagagttcacctgccgggcccagaaccccctgggcagccagcacatcagcctgagcctgagcctgcagaatgagtacaccgggaagatgaggcccatctctggagtgaccctgggcgccttcggcggggccggggccacagccctggtgttcctgtacttctgcatcatctttgtggtggtgcgcagctgcaggaagaagagcgcccggcctgctgtgggcgtgggggacaccggcatggaggatgccaatgctgtgcggggcagcgccagccagggccccctgattgagagccctgcagatgacagccccccccaccacgcccccccagccctggccacccccagccctgaggagggggagatccagtatgccagcctgtccttccacaaggcccggccccagtacccccaggagcaggaggccatcggctatgagtacagcgagatcaacatccccaagtag

SEQ ID NO: 169696 - DNA, 1290 bp, Artificial Sequence
  Description of Artificial Sequence: Synthetic coding sequence
atgcccctgtgcaggcctgagcacctgatgccccgggccagccgggtgcctgtggccgccagcctgcccctgagccatgctgtgatccccacccagctgcccagcaggcctggccacaggcctcctggccggccccggcgctgccccaaggccagctgcctgcccccacctgtgggccccagcagcacccagacagccaagagggtgaccatgggctggccccggcccggccgggccctggtggccgtgaaggccctgctggtgctgagcctgctgcaggtgcctgcccaggccgtggtgcgggctgtgctggaggacaacagcagctctgtggactttgctgacctgcctgccctgtttggagtgcccctggcccctgagggcatccggggctacctgatggaggtgaagccagccaatgcctgccaccccatcgaggccccccggctgggcaacagaagcctgggcgccatcgtgctgatccgccgctatgactgcacctttgacctgaaggtgctgaatgcccagagagctggctttgaggccgccatcgtgcacaacgtgcacagtgatgacctggtgtccatgacccacgtgtatgaggacctgcggggccagatcgccatccccagcgtgtttgtgtctgaggccgccagccaggacctgcgggtcatcctgggctgcaacaagagcgcccacgccctgctgctgcctgatgatcctccctgccacgacctgggctgccaccctgtgctgactgtgtcctgggtgctgggctgcaccctggccctggtggtgtctgccttctttgtgctgaaccacctgtggctgtgggcccaggcctgctgcagccaccggcggcctgtgaagaccagcacctgccagaaggcccaggtgaggaccttcacctggcacaatgacctgtgtgccatctgcctggatgaatatgaggagggggaccagctgaagatcctgccctgcagccacacctaccactgcaagtgcatcgacccctggttcagccaggcccccaggaggagctgccctgtgtgcaagcagagcgtggccgccacagaagattcttttgacagcaccacctacagcttcagagatgaggaccccagcctgcccggccacaggcctcccatctgggccatccaggtgcagctgcggagccggcggctggagctgctgggccgggccagcccccactgccactgcagcaccaccagcctggaggccgagtacaccaccgtgtcctctgcccctcctgaggcccctggccagtag

SEQ ID NO: 169697 - DNA, 1656 bp, Artificial Sequence; identical to SEQ ID NO: 155651
  Description of Artificial Sequence: Synthetic coding sequence

SEQ ID NO: 169698 - DNA, 1062 bp, Artificial Sequence
  Description of Artificial Sequence: Synthetic coding sequence
atgcagggcgcccaggaggccagcgccagcgagatgctgcccctgctgctgcccctgctgtgggccggggccctggcccaggagcggcgcttccagctggagggccctgagagcctgactgtgcaggagggcctgtgtgtgctggtgccctgccgcctgcccaccaccctgcctgccagctactacggctacggctactggttcctggagggcgcagatgtgcctgtggccaccaatgaccctgatgaggaggtgcaggaggagacccggggccgcttccacctgctgtgggaccccaggaggaagaactgcagcctgagcatcagagatgccaggagaagagacaatgctgcctacttcttccggctgaagagcaagtggatgaagtatggctacaccagcagcaagctgtctgtgcgggtgatggccctgacccaccggcccaacatcagcatccctggcaccctggagagcggccaccccagcaacctgacctgcagcgtgccctgggtgtgtgagcagggcaccccacccatcttctcctggatgtctgctgcccccaccagcctgggccccaggaccacccagagctctgtgctgaccatcaccccccggccccaggaccacagcaccaacctgacctgccaggtgaccttccctggggccggcgtgaccatggagaggaccatccagctgaatgtgtcctatgccccccagaaggtggccatcagcatcttccagggcaacagcgctgccttcaagatcctgcagaacaccagcagcctgcctgtgctggagggccaggccctgcggctgctgtgtgatgctgatggcaaccccccagcccacctgtcctggttccagggcttccctgccctgaatgccacccccatcagcaacacaggagtgctggagctgccccaggtgggcagcgctgaggagggggacttcacctgccgggcccagcaccccctgggcagcctgcagatcagcctgagcctgtttgtgcactggagcagcgcccctgtgcctgacagacacagcttccggcccccctgctag

SEQ ID NO: 169699 - DNA, 1281 bp, Artificial Sequence
  Description of Artificial Sequence: Synthetic coding sequence
atgctgcccctgctgctgcccctgctgtgggccggggccctggcccaggagcggcgcttccagctggagggccctgagagcctgactgtgcaggagggcctgtgtgtgctggtgccctgccgcctgcccaccaccctgcctgccagctactacggctacggctactggttcctggagggcgcagatgtgcctgtggccaccaatgaccctgatgaggaggtgcaggaggagacccggggccgcttccacctgctgtgggaccccaggaggaagaactgcagcctgagcatcagagatgcccggcggcgggacaatgctgcctacttcttccggctgaagagcaagtggatgaagtatggctacaccagcagcaagctgtctgtgcgggtgatggccctgacccaccggcccaacatcagcatccctggcaccctggagagcggccaccccagcaacctgacctgcagcgtgccctgggtgtgtgagcagggcaccccacccatcttctcctggatgtctgctgcccccaccagcctgggccccaggaccacccagagctctgtgctgaccatcaccccccggccccaggaccacagcaccaacctgacctgccaggtgaccttccctggagctggggtgaccatggagaggaccatccagctgaatgtgtcctccttcaagatcctgcagaacaccagcagcctgcctgtgctggagggccaggccctgcggctgctgtgtgatgctgatggcaaccccccagcccacctgtcctggttccagggcttccctgccctgaatgccacccccatcagcaacacaggagtgctggagctgccccaggtgggcagcgctgaggagggggacttcacctgccgggcccagcaccccctgggcagcctgcagatcagcctgagcctgtttgtgcactggaagccagagggccgggccggcggcgtgctgggcgctgtgtggggcgccagcatcaccaccctggtgttcctgtgtgtgtgcttcatcttccgggtgaagaccaggaggaagaaggccgcccagcctgtgcagaacacagatgatgtgaaccctgtgatggtgtctggcagccggggccaccagcaccagttccagacaggaattgtgtctgaccaccctgctgaggccggccccatcagtgaagatgagcaggagctgcactatgctgtgctgcacttccacaaggtgcagccccaggagcccaaggtgacagacacagagtacagcgagatcaagatccacaagtag

SEQ ID NO: 169700 - DNA, 1314 bp, Artificial Sequence
  Description of Artificial Sequence: Synthetic coding sequence
atgcagggcgcccaggaggccagcgccagcgagatgctgcccctgctgctgcccctgctgtgggccggggccctggcccaggagcggcgcttccagctggagggccctgagagcctgactgtgcaggagggcctgtgtgtgctggtgccctgccgcctgcccaccaccctgcctgccagctactacggctacggctactggttcctggagggcgcagatgtgcctgtggccaccaatgaccctgatgaggaggtgcaggaggagacccggggccgcttccacctgctgtgggaccccaggaggaagaactgcagcctgagcatcagagatgccaggagaagagacaatgctgcctacttcttccggctgaagagcaagtggatgaagtatggctacaccagcagcaagctgtctgtgcgggtgatggccctgacccaccggcccaacatcagcatccctggcaccctggagagcggccaccccagcaacctgacctgcagcgtgccctgggtgtgtgagcagggcaccccacccatcttctcctggatgtctgctgcccccaccagcctgggccccaggaccacccagagctctgtgctgaccatcaccccccggccccaggaccacagcaccaacctgacctgccaggtgaccttccctggggccggcgtgaccatggagaggaccatccagctgaatgtgagcagcttcaagatcctgcagaacaccagcagcctgcctgtgctggagggccaggccctgcggctgctgtgtgatgctgatggcaaccccccagcccacctgtcctggttccagggcttccctgccctgaatgccacccccatcagcaacacaggagtgctggagctgccccaggtgggcagcgctgaggagggggacttcacctgccgggcccagcaccccctgggcagcctgcagatcagcctgagcctgtttgtgcactggaagccagagggccgggccggcggcgtgctgggcgctgtgtggggcgccagcatcaccaccctggtgttcctgtgtgtgtgcttcatcttccgggtgaagaccaggaggaagaaggccgcccagcctgtgcagaacacagatgatgtgaaccctgtgatggtgtctggcagccggggccaccagcaccagttccagacaggcatcgtgtctgaccaccctgctgaggccggccccatcagtgaagatgagcaggagctgcactatgctgtgctgcacttccacaaggtgcagccccaggagcccaaggtgacagacacagagtacagcgagatcaagatccacaagtag

SEQ ID NO: 169701 - DNA, 1362 bp, Artificial Sequence
  Description of Artificial Sequence: Synthetic coding sequence
atgcagggcgcccaggaggccagcgccagcgagatgctgcccctgctgctgcccctgctgtgggccggggccctggcccaggagcggcgcttccagctggagggccctgagagcctgactgtgcaggagggcctgtgtgtgctggtgccctgccgcctgcccaccaccctgcctgccagctactacggctacggctactggttcctggagggcgcagatgtgcctgtggccaccaatgaccctgatgaggaggtgcaggaggagacccggggccgcttccacctgctgtgggaccccaggaggaagaactgcagcctgagcatcagagatgccaggagaagagacaatgctgcctacttcttccggctgaagagcaagtggatgaagtatggctacaccagcagcaagctgtctgtgcgggtgatggccctgacccaccggcccaacatcagcatccctggcaccctggagagcggccaccccagcaacctgacctgcagcgtgccctgggtgtgtgagcagggcaccccacccatcttctcctggatgtctgctgcccccaccagcctgggccccaggaccacccagagctctgtgctgaccatcaccccccggccccaggaccacagcaccaacctgacctgccaggtgaccttccctggggccggcgtgaccatggagaggaccatccagctgaatgtgtcctatgccccccagaaggtggccatcagcatcttccagggcaacagcgctgccttcaagatcctgcagaacaccagcagcctgcctgtgctggagggccaggccctgcggctgctgtgtgatgctgatggcaaccccccagcccacctgtcctggttccagggcttccctgccctgaatgccacccccatcagcaacacaggagtgctggagctgccccaggtgggcagcgctgaggagggggacttcacctgccgggcccagcaccccctgggcagcctgcagatcagcctgagcctgtttgtgcactggaagccagagggccgggccggcggcgtgctgggcgctgtgtggggcgccagcatcaccaccctggtgttcctgtgtgtgtgcttcatcttccgggtgaagaccaggaggaagaaggccgcccagcctgtgcagaacacagatgatgtgaaccctgtgatggtgtctggcagccggggccaccagcaccagttccagacaggcatcgtgtctgaccaccctgctgaggccggccccatcagtgaagatgagcaggagctgcactatgctgtgctgcacttccacaaggtgcagccccaggagcccaaggtgacagacacagagtacagcgagatcaagatccacaagtag

SEQ ID NO: 169702 - DNA, 1170 bp, Artificial Sequence
  Description of Artificial Sequence: Synthetic coding sequence
atgcagggcgcccaggaggccagcgccagcgagatgctgcccctgctgctgcccctgctgtgggccggggccctggcccaggagcggcgcttccagctggagggccctgagagcctgactgtgcaggagggcctgtgtgtgctggtgccctgccgcctgcccaccaccctgcctgccagctactacggctacggctactggttcctggagggcgcagatgtgcctgtggccaccaatgaccctgatgaggaggtgcaggaggagacccggggccgcttccacctgctgtgggaccccaggaggaagaactgcagcctgagcatcagagatgccaggagaagagacaatgctgcctacttcttccggctgaagagcaagtggatgaagtatggctacaccagcagcaagctgtctgtgcgggtgatggccctgacccaccggcccaacatcagcatccctggcaccctggagagcggccaccccagcaacctgacctgcagcgtgccctgggtgtgtgagcagggcaccccacccatcttctcctggatgtctgctgcccccaccagcctgggccccaggaccacccagagctctgtgctgaccatcaccccccggccccaggaccacagcaccaacctgacctgccaggtgaccttccctggggccggcgtgaccatggagaggaccatccagctgaatgtgtcctggatgctgcggcggccccccctgagcaccccagatgccccccagaaggtggccatcagcatcttccagggcaacagcgctgccttcaagatcctgcagaacaccagcagcctgcctgtgctggagggccaggccctgcggctgctgtgtgatgctgatggcaaccccccagcccacctgtcctggttccagggcttccctgccctgaatgccacccccatcagcaacacaggagtgctggagctgccccaggtgggcagcgctgaggagggggacttcacctgccgggcccagcaccccctgggcagcctgcagatcagcctgagcctgtttgtgcactggaagccagagggccgggccggcggcgtgctgggcgctgtgtggggcgccagcatcaccaccctggtgttcctgtgtgtgtgcttcatcttccgggtcatcagcaccagcagccggcaggcctag

SEQ ID NO: 169703 - DNA, 1206 bp, Artificial Sequence
  Description of Artificial Sequence: Synthetic coding sequence
atgcagggcgcccaggaggccagcgccagcgagatgctgcccctgctgctgcccctgctgtgggccgccagctactacggctacggctactggttcctggagggcgcagatgtgcctgtggccaccaatgaccctgatgaggaggtgcaggaggagacccggggccgcttccacctgctgtgggaccccaggaggaagaactgcagcctgagcatcagagatgccaggagaagagacaatgctgcctacttcttccggctgaagagcaagtggatgaagtatggctacaccagcagcaagctgtctgtgcgggtgatggccctgacccaccggcccaacatcagcatccctggcaccctggagagcggccaccccagcaacctgacctgcagcgtgccctgggtgtgtgagcagggcaccccacccatcttctcctggatgtctgctgcccccaccagcctgggccccaggaccacccagagctctgtgctgaccatcaccccccggccccaggaccacagcaccaacctgacctgccaggtgaccttccctggggccggcgtgaccatggagaggaccatccagctgaatgtgagcagcttcaagatcctgcagaacaccagcagcctgcctgtgctggagggccaggccctgcggctgctgtgtgatgctgatggcaaccccccagcccacctgtcctggttccagggcttccctgccctgaatgccacccccatcagcaacacaggagtgctggagctgccccaggtgggcagcgctgaggagggggacttcacctgccgggcccagcaccccctgggcagcctgcagatcagcctgagcctgtttgtgcactggaagccagagggccgggccggcggcgtgctgggcgctgtgtggggcgccagcatcaccaccctggtgttcctgtgtgtgtgcttcatcttccgggtgaagaccaggaggaagaaggccgcccagcctgtgcagaacacagatgatgtgaaccctgtgatggtgtctggcagccggggccaccagcaccagttccagacaggcatcgtgtctgaccaccctgctgaggccggccccatcagtgaagatgagcaggagctgcactatgctgtgctgcacttccacaaggtgcagccccaggagcccaaggtgacagacacagagtacagcgagatcaagatccacaagtag

SEQ ID NO: 169704 - DNA, 1125 bp, Artificial Sequence
  Description of Artificial Sequence: Synthetic coding sequence
atgctgctgctgctgctgctgcccctgctgtggggccgggagcgggtggagggccagaagagcaacaggaaggactacagcctgaccatgcagagctctgtgacagtgcaggagggcatgtgtgtgcacgtgcgctgcagcttctcctaccctgtggacagccagacagacagcgaccctgtgcacggctactggttccgggctggaaatgacatctcctggaaggcccctgtggccaccaacaacccagcctgggccgtgcaggaggagacccgggaccgcttccacctgctgggggacccccagaccaagaactgcaccctgagcatcagagatgccaggatgtctgatgctggccgctacttcttcaggatggagaagggcaacatcaagtggaactacaagtatgaccagctgtctgtgaatgtgacagaccccccccagaacctgactgtgacagtgttccagggcgagggcacagccagcacagccctgggcaacagcagcagcctgtctgtgctggagggccagagcctgcggctggtgtgtgctgtggacagcaaccccccagcccggctgtcctggacctggaggagcctgaccctgtaccccagccagcccagcaaccccctggtgctggagctgcaggtgcacctgggagatgaaggagagttcacctgccgggcccagaacagcctgggcagccagcacgtgtccctgaacctgagcctgcagcaggagtacacaggcaagatgaggcctgtgtctggagtgctgctgggcgctgtgggcggggccggggccacagccctggtgttcctgtccttctgtgtgatcttcatcgtggtgcgcagctgcaggaagaagagcgcccggcctgctgctgatgtgggggacatcggcatgaaggatgccaacaccatccggggcagcgccagccagggcaacctgacagagagctgggcagatgacaaccccaggcaccacggcctggccgcccacagcagcggggaggagcgggagatccagtatgcccccctgtccttccacaagggggagccccaggacctgagcggccaggaggccaccaacaatgagtacagcgagatcaagatccccaagtag

SEQ ID NO: 169705 - DNA, 1404 bp, Artificial Sequence
  Description of Artificial Sequence: Synthetic coding sequence
atgctgctgctgctgctgctgcccctgctgtggggccgggagcgggtggagggccagaagagcaacaggaaggactacagcctgaccatgcagagctctgtgacagtgcaggagggcatgtgtgtgcacgtgcgctgcagcttctcctaccctgtggacagccagacagacagcgaccctgtgcacggctactggttccgggctggaaatgacatctcctggaaggcccctgtggccaccaacaacccagcctgggccgtgcaggaggagacccgggaccgcttccacctgctgggggacccccagaccaagaactgcaccctgagcatcagagatgccaggatgtctgatgctggccgctacttcttcaggatggagaagggcaacatcaagtggaactacaagtatgaccagctgtctgtgaatgtgacagccctgacccaccggcccaacatcctgatccctggcaccctggagagcggctgcttccagaacctgacctgcagcgtgccctgggcctgtgagcagggcaccccacccatgatctcctggatgggcacctctgtgagccccctgcaccccagcaccaccaggagctctgtgctgaccctcatcccccagccccagcaccacggcaccagcctgacctgccaggtgaccctgcccggggccggcgtgaccaccaacagaaccatccagctgaatgtgtcctacccaccccagaacctgactgtgaccgtcttccagggcgagggcacagccagcacagccctgggcaacagcagcagcctgtctgtgctggagggccagagcctgcggctggtgtgtgctgtggacagcaaccccccagcccggctgtcctggacctggaggagcctgaccctgtaccccagccagcccagcaaccccctggtgctggagctgcaggtgcacctgggagatgaaggagagttcacctgccgggcccagaacagcctgggcagccagcacgtgtccctgaacctgagcctgcagcaggagtacaccgggaagatgaggcctgtgtctggagtgctgctgggcgctgtgggcggggccggggccacagccctggtgttcctgtccttctgtgtgatcttcatcgtggtgcgcagctgcaggaagaagagcgcccggcctgctgctgatgtgggggacatcggcatgaaggatgccaacaccatccggggcagcgccagccagggcaacctgacagagagctgggcagatgacaaccccaggcaccacggcctggccgcccacagcagtggagaggagcgggagatccagtatgcccccctgtccttccacaagggggagccccaggacctgagcggccaggaggccaccaacaatgagtacagcgagatcaagatccccaagtag

SEQ ID NO: 169706 - DNA, 438 bp, Artificial Sequence
  Description of Artificial Sequence: Synthetic coding sequence
atgctgctgctgctgctgctgcccctgctgtggggccgggagcgggtggagggccagaagagcaacaggaaggactacagcctgaccatgcagagctctgtgacagtgcaggagggcatgtgtgtgcacgtgcgctgcagcttctcctaccctgtggacagccagacagacagcgaccctgtgcacggctactggttccgggctggaaatgacatctcctggaaggcccctgtggccaccaacaacccagcctgggccgtgcaggaggagacccgggaccgcttccacctgctgggggacccccagaccaagaactgcaccctgagcatcagagatgccaggatgtctgatgctggccgctacttcttcaggatggagaagggcaacatcaagtggaactacaagtatgaccagctgtctgtgaatgtgacagaatag

SEQ ID NO: 169707 - DNA, 1500 bp, Artificial Sequence
  Description of Artificial Sequence: Synthetic coding sequence
atgctgctgctgctgctgctgctgcccctgctgtggggcaccaagggcatggagggggaccggcagtatggagatggctacctgctgcaggtgcaggagctggtgacagtgcaggagggcctgtgtgtgcacgtgccctgcagcttctcctacccccaggacggctggacagacagcgaccctgtgcacggctactggttccgggccggggaccggccctaccaggatgcccctgtggccaccaacaacccagaccgggaggtgcaggccgagacccagggccgcttccagctgctgggggacatctggagcaatgactgcagcctgagcatcagagatgccaggaagagggacaagggcagctacttcttccggctggagcggggctccatgaagtggagctacaagagccagctgaactacaagaccaagcagctgtctgtgtttgtgacagccctgacccacaggccagacatcctgatcctgggcaccctggagagcggccacagcaggaacctgacctgcagcgtgccctgggcctgcaagcagggcaccccacccatgatctcctggattggagcctctgtgagcagccctggccccaccacagcccggagctctgtgctgaccctgacccccaagccccaggaccacggcaccagcctgacctgccaggtgaccctgcccggcactggagtgaccaccaccagcacagtgcggctggatgtgtcctacccaccctggaacctgaccatgacagtgttccagggagatgccacagccagcacagccctgggcaatggcagcagcctgtctgtgctggagggccagagcctgcggctggtgtgtgctgtgaacagcaaccccccagcccggctgtcctggacccggggcagcctgaccctgtgccccagccgcagcagcaaccctggcctgctggagctgccccgggtgcacgtgagagatgaaggagagttcacctgccgggcccagaatgcccagggcagccagcacatcagcctgagcctgagcctgcagaatgaaggcaccggcaccagcaggcctgtgtcccaggtgaccctggccgctgtgggcggggccggggccacagccctggccttcctgtccttctgcatcatcttcatcatcgtgcgcagctgcaggaagaagagcgcccggcctgctgctggggtgggggacaccggcatggaggatgccaaggccatccggggcagcgccagccagggccccctgacagagagctggaaggatggcaaccccctgaagaagcccccacctgctgtggcccccagcagtggagaggagggggagctgcactacgccaccctgtccttccacaaggtgaagccccaggacccccagggccaggaggccacagacagcgagtacagcgagatcaagatccacaagcgggagacagctgagacccaggcctgcctgaggaaccacaaccccagcagcaaggaggtgcggggctag

SEQ ID NO: 169708 - DNA, 1221 bp, Artificial Sequence
  Description of Artificial Sequence: Synthetic coding sequence
atgctgctgctgctgctgctgctgcccctgctgtggggcaccaagggcatggagggggaccggcagtatggagatggctacctgctgcaggtgcaggagctggtgacagtgcaggagggcctgtgtgtgcacgtgccctgcagcttctcctacccccaggacggctggacagacagcgaccctgtgcacggctactggttccgggccggggaccggccctaccaggatgcccctgtggccaccaacaacccagaccgggaggtgcaggccgagacccagggccgcttccagctgctgggggacatctggagcaatgactgcagcctgagcatcagagatgccaggaagagggacaagggcagctacttcttccggctggagcggggctccatgaagtggagctacaagagccagctgaactacaagaccaagcagctgtctgtgtttgtgacagatcctccctggaacctgaccatgaccgtcttccagggagatgccacagccagcacagccctgggcaatggcagcagcctgtctgtgctggagggccagagcctgcggctggtgtgtgctgtgaacagcaaccccccagcccggctgtcctggacccggggcagcctgaccctgtgccccagccgcagcagcaaccctggcctgctggagctgccccgggtgcacgtgagagatgaaggagagttcacctgccgggcccagaatgcccagggcagccagcacatcagcctgagcctgagcctgcagaatgaaggaacaggcaccagcaggcctgtgtcccaggtgaccctggccgctgtgggcggggccggggccacagccctggccttcctgtccttctgcatcatcttcatcatcgtgcgcagctgcaggaagaagagcgcccggcctgctgctggggtgggggacaccggcatggaggatgccaaggccatccggggcagcgccagccagggccccctgacagagagctggaaggatggcaaccccctgaagaagcccccacctgctgtggcccccagcagcggggaggagggggagctgcactacgccaccctgtccttccacaaggtgaagccccaggacccccagggccaggaggccacagattctgagtacagcgagatcaagatccacaagcgggagacagctgagacccaggcctgcctgaggaaccacaaccccagcagcaaggaggtgcggggctag

SEQ ID NO: 169709 - DNA, 1173 bp, Artificial Sequence
  Description of Artificial Sequence: Synthetic coding sequence
atgctgctgctgctgctgctgctgcccctgctgtggggcaccaagggcatggagggggaccggcagtatggagatggctacctgctgcaggtgcaggagctggtgacagtgcaggagggcctgtgtgtgcacgtgccctgcagcttctcctacccccaggacggctggacagacagcgaccctgtgcacggctactggttccgggccggggaccggccctaccaggatgcccctgtggccaccaacaacccagaccgggaggtgcaggccgagacccagggccgcttccagctgctgggggacatctggagcaatgactgcagcctgagcatcagagatgccaggaagagggacaagggcagctacttcttccggctggagcggggctccatgaagtggagctacaagagccagctgaactacaagaccaagcagctgtctgtgtttgtgacagccagcacagccctgggcaatggcagcagcctgtctgtgctggagggccagagcctgcggctggtgtgtgctgtgaacagcaaccccccagcccggctgtcctggacccggggcagcctgaccctgtgccccagccgcagcagcaaccctggcctgctggagctgccccgggtgcacgtgagagatgaaggagagttcacctgccgggcccagaatgcccagggcagccagcacatcagcctgagcctgagcctgcagaatgaaggaacaggcaccagcaggcctgtgtcccaggtgaccctggccgctgtgggcggggccggggccacagccctggccttcctgtccttctgcatcatcttcatcatcgtgcgcagctgcaggaagaagagcgcccggcctgctgctggggtgggggacaccggcatggaggatgccaaggccatccggggcagcgccagccagggccccctgacagagagctggaaggatggcaaccccctgaagaagcccccacctgctgtggcccccagcagcggggaggagggggagctgcactacgccaccctgtccttccacaaggtgaagccccaggacccccagggccaggaggccacagattctgagtacagcgagatcaagatccacaagcgggagacagctgagacccaggcctgcctgaggaaccacaaccccagcagcaaggaggtgcggggctag

SEQ ID NO: 169710 - DNA, 1392 bp, Artificial Sequence
  Description of Artificial Sequence: Synthetic coding sequence
atgctgctgctgctgctgcccctgctgtggggccgggagagagctgagggccagaccagcaagctgctgaccatgcagagctctgtgacagtgcaggagggcctgtgtgtgcacgtgccctgcagcttctcctaccccagccacggctggatctacccaggccctgtggtgcacggctactggttccgggagggcgccaacacagaccaggatgcccctgtggccaccaacaacccagcccgggctgtgtgggaggagacccgggaccgcttccacctgctgggggacccccacaccaagaactgcaccctgagcatcagagatgcccggcggagtgatgctggccgctacttcttcaggatggagaagggcagcatcaagtggaactacaagcaccaccggctgtctgtgaatgtgacagccctgacccaccggcccaacatcctgatccctggcaccctggagagcggctgcccccagaacctgacctgcagcgtgccctgggcctgtgagcagggcaccccacccatgatctcctggattggcacctctgtgagccccctggaccccagcaccaccaggagctctgtgctgaccctcatcccccagccccaggaccacggcaccagcctgacctgccaggtgaccttccctggggcctctgtgaccaccaacaagacagtgcacctgaatgtgtcctacccaccccagaacctgaccatgaccgtcttccagggagatggcaccgtgtccacagtgctgggcaatggcagcagcctgagcctgcctgagggccagagcctgcggctggtgtgtgctgtggatgctgtggacagcaaccccccagcccggctgagcctgtcctggaggggcctgaccctgtgccccagccagcccagcaaccctggggtgctggagctgccctgggtgcacctgagagatgctgctgagttcacctgccgggcccagaaccccctgggcagccagcaggtgtacctgaatgtgtccctgcagagcaaggccaccagcggcgtgacccagggcgtggtgggcggggccggggccacagccctggtgttcctgtccttctgtgtgatctttgtggtggtgcgcagctgcaggaagaagagcgcccggcctgctgctggggtgggggacacaggaattgaagatgccaatgctgtgcggggcagcgccagccagggccccctgacagagccctgggccgaggacagccccccagaccagcccccaccagccagcgcccggagctctgtgggggagggggagctgcagtatgccagcctgtccttccagatggtgaagccctgggacagccggggccaggaggccacagacacagagtacagcgagatcaagatccacaggtag

SEQ ID NO: 169711 - DNA, 1440 bp, Artificial Sequence
  Description of Artificial Sequence: Synthetic coding sequence
atgctgctgctgctgctgcccctgctgtggggccgggagagagctgagggccagaccagcaagctgctgaccatgcagagctctgtgacagtgcaggagggcctgtgtgtgcacgtgccctgcagcttctcctaccccagccacggctggatctacccaggccctgtggtgcacggctactggttccgggagggcgccaacacagaccaggatgcccctgtggccaccaacaacccagcccgggctgtgtgggaggagacccgggaccgcttccacctgctgggggacccccacaccaagaactgcaccctgagcatcagagatgcccggcggagtgatgctggccgctacttcttcaggatggagaagggcagcatcaagtggaactacaagcaccaccggctgtctgtgaatgtgacagccctgacccaccggcccaacatcctgatccctggcaccctggagagcggctgcccccagaacctgacctgcagcgtgccctgggcctgtgagcagggcaccccacccatgatctcctggattggcacctctgtgagccccctggaccccagcaccaccaggagctctgtgctgaccctcatcccccagccccaggaccacggcaccagcctgacctgccaggtgaccttccctggggcctctgtgaccaccaacaagacagtgcacctgaatgtgtcctacccaccccagaacctgaccatgaccgtcttccagggagatggcaccgtgtccacagtgctgggcaatggcagcagcctgagcctgcctgagggccagagcctgcggctggtgtgtgctgtggatgctgtggacagcaaccccccagcccggctgagcctgtcctggaggggcctgaccctgtgccccagccagcccagcaaccctggggtgctggagctgccctgggtgcacctgagagatgctgctgagttcacctgccgggcccagaaccccctgggcagccagcaggtgtacctgaatgtgtccctgcagagcaaggccaccagcggcgtgacccagggcgtggtgggcggggccggggccacagccctggtgttcctgtccttctgtgtgatctttgtggtggtgcgcagctgcaggaagaagagcgcccggcctgctgctggggtgggggacacaggaattgaagatgccaatgctgtgcggggcagcgccagccagatcctgaaccacttcatcggcttccccaccttcctgggcctgggctttgagttcctgctgaacctgcgggacctgtgctgccacccagacagcgagttctacgtgtaccacttcagccacttccgcctcatcaagaacattgctggggagatcgtgtggagcctggagggcaagatcctgtggctgctggatgtgtctgacttcttccactggttcttcctgatctgtgtgggctag

SEQ ID NO: 169712 - DNA, 735 bp, Artificial Sequence
  Description of Artificial Sequence: Synthetic coding sequence
atggctgctgctgccagccctgccttcctgctgtgcctgcccctgctgcacctgctgagcggctggagcagagctggctgggtggacacccactgcctgtgctatgacttcatcatcacccccaagagcaggcctgagccccagtggtgtgaggtgcagggcctggtggatgagcggcccttcctgcactatgactgtgtgaaccacaaggccaaggcctttgccagcctgggcaagaaggtgaatgtgaccaagacctgggaggagcagacagagaccctgagagatgtggtggacttcctgaagggccagctgctggacatccaggtggagaacctgatccccatcgagcccctgaccctgcaggccaggatgagctgtgaacatgaggcccacggccacggccggggctcctggcagttcctgttcaacggccagaagttcctgctgtttgacagcaacaacaggaagtggacagccctgcaccctggggccaagaagatgacagagaagtgggagaagaacagagatgtgaccatgttcttccagaagatcagcctgggggactgcaagatgtggctggaggagttcctgatgtactgggagcagatgctggaccccaccaagccacccagcctggcccctggcaccacccagcccaaggccatggccaccaccctgagcccctggagcctgctgatcatcttcctgtgcttcatcctggccggccgctag

SEQ ID NO: 169713 - DNA, 1248 bp, Artificial Sequence
  Description of Artificial Sequence: Synthetic coding sequence
atgaccggggagcggcccagcacagccctgcctgaccggcgctggggcccccgcatcctgggcttctggggcggctgccgggtgtgggtgtttgctgccatcttcctgctgctgagcctggccgcctcctggagcaaggccgagaatgactttggcctggtgcagcccctggtgaccatggagcagctgctgtgggtgtctggccggcagatcggctctgtggacaccttccgcatccccctcatcacagccaccccccggggcaccctgctggcctttgctgaggccaggaagatgagcagcagtgatgaaggagccaagttcatcgccctgcggcgctccatggaccagggcagcacctggagccccacagccttcatcgtgaatgatggagatgtgcctgatggcctgaacctgggcgctgtggtgtctgatgtggagaccggggtggtgttcctgttctacagcctgtgtgcccacaaggccggctgccaggtggccagcaccatgctggtgtggagcaaggatgatggagtgtcctggagcaccccaagaaacctgagcctggacattggaacagaggtgtttgcccctggccctggcagcggcatccagaagcagcgggagcccaggaagggccgcctcatcgtgtgtggccacggcaccctggagagagatggagtcttctgcctgctgagtgatgaccacggggcctcctggaggtatggcagcggcgtgtctggcatcccctacggccagcccaagcaggagaatgacttcaacccagatgagtgccagccctatgagctgcctgatggctctgtggtgatcaatgccaggaaccagaacaactaccactgccactgcagaattgtgctgcggagctatgatgcctgtgacaccctgcggcccagagatgtgacctttgatcctgagctggtggaccctgtggtggccgccggggctgtggtgaccagcagcggcatcgtgttcttcagcaacccagcccaccctgagttccgggtgaacctgaccctgcgctggagcttcagcaatggcacctcctggaggaaggagaccgtgcagctgtggccaggccccagcggctacagcagcctggccaccctggagggctccatggatggagaggagcaggccccccagctgtatgtgctgtatgaaaaaggaagaaaccactacacagagagcatctctgtggccaagatctctgtgtatggcaccctgtag

SEQ ID NO: 169714 - DNA, 1248 bp, Artificial Sequence; identical to SEQ ID NO: 169713
  Description of Artificial Sequence: Synthetic coding sequence

SEQ ID NO: 169715 - DNA, 1248 bp, Artificial Sequence; identical to SEQ ID NO: 169713
  Description of Artificial Sequence: Synthetic coding sequence

SEQ ID NO: 169716 - DNA, 1248 bp, Artificial Sequence; identical to SEQ ID NO: 169713
  Description of Artificial Sequence: Synthetic coding sequence

SEQ ID NO: 169717 - DNA, 1248 bp, Artificial Sequence; identical to SEQ ID NO: 169713
  Description of Artificial Sequence: Synthetic coding sequence

SEQ ID NO: 169718 - DNA, 1248 bp, Artificial Sequence; identical to SEQ ID NO: 169713
  Description of Artificial Sequence: Synthetic coding sequence

SEQ ID NO: 169719 - DNA, 1248 bp, Artificial Sequence; identical to SEQ ID NO: 169713
  Description of Artificial Sequence: Synthetic coding sequence

SEQ ID NO: 169720 - DNA, 2277 bp, Artificial Sequence
  Description of Artificial Sequence: Synthetic coding sequence
atggctgtgtctgctggcagcgcccggaccagccccagcagtgacaaggtgcagaaggacaaggccgagctgatcagcggcccccggcaggacagccgcatcggcaagctgctgggctttgagtggacagacctgagctcctggaggcggctggtgaccctgctgaaccggcccacagatcctgccagcctggccgtgttccgcttcctgtttggcttcctgatggtgctggacatcccccaggagcggggcctgagcagcctggacaggaagtacctggatggcctggatgtgtgccgcttccccctgctggatgccctgcggcccctgcccctggactggatgtacctggtgtacaccatcatgttcctgggcgccctgggcatgatgctgggcctgtgctaccgcatcagctgtgtgctcttcctgctgccctactggtacgtgttcctgctggacaagacctcctggaacaaccacagctacctgtatggcctgctggccttccagctgaccttcatggatgccaaccactactggagcgtggatggcctgctgaatgcccacagaagaaatgcccacgtgcccctgtggaactatgctgtgctgcggggccagatcttcatcgtgtacttcatcgccggcgtgaagaagctggatgctgactgggtggagggctacagcatggagtacctgagccgccactggctgttcagccccttcaagctgctgctgtctgaggagctgaccagcctgctggtggtgcactggggcggcctgctgctggacctgtctgctggcttcctgctcttctttgatgtgagccgcagcatcggcctcttctttgtgtcctacttccactgcatgaacagccagctgttcagcatcggcatgttctcctatgtgatgctggccagcagccccctcttctgcagccctgagtggcccaggaagctggtgtcctactgcccccggcggctgcagcagctgctgcccctgaaggccgccccccagcccagcgtgtcctgtgtgtacaagaggagccggggcaagagcggccagaagccaggcctgcggcaccagctgggcgccgccttcaccctgctgtacctgctggagcagctgttcctgccctacagccacttcctgacccagggctacaacaactggaccaacggcctgtatggctacagctgggacatgatggtgcacagccgcagccaccagcacgtgaagatcacctacagagatggccgcactggagagctgggctacctgaaccctggggtcttcacccagagccgccgctggaaggaccatgctgacatgctgaagcagtatgccacctgcctgagccggctgctgcccaagtacaacgtgacagagccccagatctactttgacatctgggtgtccatcaatgaccgcttccagcagaggatctttgacccccgggtggacatcgtgcaggccgcctggagccccttccagaggacctcctgggtgcagcccctgctgatggacctgagcccctggagggccaagctgcaggagatcaagagcagcctggacaaccacacagaggtggtgttcatcgctgacttccctggcctgcacctggagaactttgtgtctgaggacctgggcaacaccagcatccagctgctgcagggcgaggtgacagtggagctggtggccgagcagaagaaccagaccctgcgggagggggagaagatgcagctgcctgctggggagtaccacaaggtgtacaccaccagccccagccccagctgctacatgtatgtgtatgtgaacaccacagagctggccctggagcaggacctggcctacctgcaggagctgaaggagaaggtggagaatggaagtgaaacaggccccctgcccccagagctgcagcccctgctggagggggaggtgaagggcggccctgagcccacccccctggtgcagaccttcctgcggcggcagcagaggctgcaggagattgaaagaagaagaaacacccccttccacgagcgcttcttccgcttcctgctgaggaagctgtatgtgttcagaagaagcttcctgatgacctgcatcagcctgaggaacctgatcctgggccggcccagcctggagcagctggcccaggaggtgacctacgccaacctgcggccctttgaggccgtgggggagctgaaccccagcaacacagacagcagccacagcaaccccccagagagcaacccagaccctgtgcacagcgagttctag

SEQ ID NO: 169721 - DNA, 1386 bp, Artificial Sequence
  Description of Artificial Sequence: Synthetic coding sequence
atgaggcctgctgacctgcccccccggcccatggaggagagccctgccagcagcagcgcccccacagaaacagaggagcccggcagcagcgctgaggtgatggaggaggtgaccacctgcagcttcaacagccccctcttccggcaggaggatgaccggggcatcacctaccgcatcccagccctgctgtacatcccccccacccacaccttcctggcctttgctgagaagaggagcaccaggagagatgaagatgccctgcacctggtgctgcggcggggcctgagaattggccagctggtgcagtggggccccctgaagcccctgatggaggccaccctgcccggccacaggaccatgaacccctgccctgtgtgggagcagaagagcggctgtgtgttcctgttcttcatctgtgtgcggggccacgtgacagagcggcagcagatcgtgtctggaagaaatgctgcccggctgtgcttcatctacagccaggatgctggctgctcctggagcgaggtgcgggacctgacagaggaggtgattggcagcgagctgaagcactgggccacctttgctgtgggccctggccacggcatccagctgcagagcggccgcctggtgatcccagcctacacctactacatccccagctggttcttctgcttccagctgccctgcaagacccggccccacagcctgatgatctacagtgatgacctgggcgtgacctggcaccacggccgcctcatccggcccatggtgacagtggagtgtgaggtggccgaggtgacaggccgggccggccaccctgtgctgtactgcagcgcccggacccccaaccgctgcagagctgaggccctgagcacagaccacggggagggcttccagaggctggccctgagccggcagctgtgtgagcccccccacggctgccagggctctgtggtgtccttccggcccctggagatcccccaccgctgccaggacagcagcagcaaggatgcccccaccatccagcagagcagccctggcagcagcctgcggctggaggaggaggccggcacccccagcgagagctggctgctgtacagccaccccaccagcaggaagcagagggtggacctgggcatctacctgaaccagacccccctggaggccgcctgctggagccggccctggatcctgcactgcggcccctgtggctacagcgacctggccgccctggaggaggagggcctgtttggctgcctgtttgaatgtggcaccaagcaggagtgtgagcagatcgccttccgcctcttcacccaccgggagatcctgagccacctgcagggcgactgcaccagccctggaagaaaccccagccagttcaagagcaactag

SEQ ID NO: 169722 - DNA, 1386 bp, Artificial Sequence; identical to SEQ ID NO: 169721
  Description of Artificial Sequence: Synthetic coding sequence

SEQ ID NO: 169723 - DNA, 1287 bp, Artificial Sequence
  Description of Artificial Sequence: Synthetic coding sequence
atggaggaggtgaccacctgcagcttcaacagccccctcttccggcaggaggatgaccggggcatcacctaccgcatcccagccctgctgtacatcccccccacccacaccttcctggcctttgctgagaagaggagcaccaggagagatgaagatgccctgcacctggtgctgcggcggggcctgcgcatcggccagctggtgcagtggggccccctgaagcccctgatggaggccaccctgcccggccacaggaccatgaacccctgccctgtgtgggagcagaagagcggctgtgtgttcctgttcttcatctgtgtgcggggccacgtgacagagcggcagcagatcgtgtctggaagaaatgctgcccggctgtgcttcatctacagccaggatgctggctgctcctggagcgaggtgcgggacctgacagaggaggtgattggcagcgagctgaagcactgggccacctttgctgtgggccctggccacggcatccagctgcagagcggccgcctggtgatcccagcctacacctactacatccccagctggttcttctgcttccagctgccctgcaagacccggccccacagcctgatgatctacagtgatgacctgggcgtgacctggcaccacggccgcctcatccggcccatggtgacagtggagtgtgaggtggccgaggtgacaggccgggccggccaccctgtgctgtactgcagcgcccggacccccaaccgctgcagagctgaggccctgagcacagaccatggagagggcttccagaggctggccctgagccggcagctgtgtgagccccctcatggctgccagggctctgtggtgtccttccggcccctggagatcccccaccgctgccaggacagcagcagcaaggatgcccccaccatccagcagagcagccctggcagcagcctgcggctggaggaggaggccggcaccccatctgagagctggctgctgtacagccaccccaccagcaggaagcagagggtggacctgggcatctacctgaaccagacccccctggaggccgcctgctggagccggccctggatcctgcactgcggcccctgtggctacagcgacctggccgccctggaggaggagggcctgtttggctgcctgtttgaatgtggcaccaagcaggagtgtgagcagatcgccttccgcctcttcacccaccgggagatcctgagccacctgcagggcgactgcaccagccctggcaggaaccccagccagttcaagagcaactag

SEQ ID NO: 169724 - DNA, 1059 bp, Artificial Sequence
  Description of Artificial Sequence: Synthetic coding sequence
atggaggccaccctgcccggccacaggaccatgaacccctgccctgtgtgggagcagaagagcggctgtgtgttcctgttcttcatctgtgtgcggggccacgtgacagagcggcagcagatcgtgtctggaagaaatgctgcccggctgtgcttcatctacagccaggatgctggctgctcctggagcgaggtgcgggacctgacagaggaggtgattggcagcgagctgaagcactgggccacctttgctgtgggccctggccacggcatccagctgcagagcggccgcctggtgatcccagcctacacctactacatccccagctggttcttctgcttccagctgccctgcaagacccggccccacagcctgatgatctacagtgatgacctgggcgtgacctggcaccacggccgcctcatccggcccatggtgacagtggagtgtgaggtggccgaggtgacaggccgggccggccaccctgtgctgtactgcagcgcccggacccccaaccgctgcagagctgaggccctgagcacagaccatggagagggcttccagaggctggccctgagccggcagctgtgtgagccccctcatggctgccagggctctgtggtgtccttccggcccctggagatcccccaccgctgccaggacagcagcagcaaggatgcccccaccatccagcagagcagccctggcagcagcctgcggctggaggaggaggccggcaccccatctgagagctggctgctgtacagccaccccaccagcaggaagcagagggtggacctgggcatctacctgaaccagacccccctggaggccgcctgctggagccggccctggatcctgcactgcggcccctgtggctacagcgacctggccgccctggaggaggagggcctgtttggctgcctgtttgaatgtggcaccaagcaggagtgtgagcagatcgccttccgcctcttcacccaccgggagatcctgagccacctgcagggcgactgcaccagccctggcaggaaccccagccagttcaagagcaactag

SEQ ID NO: 169725 - DNA, 1203 bp, Artificial Sequence
  Description of Artificial Sequence: Synthetic coding sequence
atggccaccctgctgctgctgctgggcgtgctggtggtgtccccagatgccctgggcagcaccacagctgtgcagacccccaccagcggggagcccctggtgtccaccagcgagcccctgagcagcaagatgtacaccaccagcatcaccagtgaccccaaggctgacagcactggagaccagaccagcgccctgccccccagcaccagcatcaatgaaggcagccccctgtggaccagcattggagccagcacaggcagccccctgcctgagcccaccacctaccaggaggtgtccatcaagatgagctctgtgccccaggagacccctcatgccaccagccaccctgctgtgcccatcacagccaacagcctgggcagccacacagtgactggaggcaccatcaccaccaacagccctgagaccagcagcaggaccagcggggcccctgtgaccacagctgccagcagcctggagaccagccggggcaccagcggcccccccctgaccatggccaccgtgtccctggagaccagcaagggcaccagcggcccccctgtgaccatggccacagacagcctggagaccagcacaggcaccactggacctcctgtgaccatgaccaccggcagcctggagcccagcagcggggccagcggcccccaggtgtcctctgtgaagctgagcaccatgatgagccccaccaccagcaccaatgccagcacagtgcccttcaggaacccagatgagaacagccggggcatgctgcctgtggccgtgctggtggccctgctggccgtcatcgtgctggtggccctgctgctgctgtggaggcggcggcagaagagaagaactggagccctggtgctgagcagaggaggcaagagaaatggagtggtggatgcctgggccggccctgcccaggtgcctgaggagggcgctgtgacagtgacagtgggcggcagcggcggggacaagggcagcggcttcccagatggagagggcagcagccggcggcccaccctgaccaccttcttcggccgcaggaagagccggcagggcagcctggccatggaggagctgaagagcggcagcggccccagcctgaagggggaggaggagcccctggtggcctctgaagatggagctgtggatgccccagccccagatgagcctgagggcggagatggagctgccccctag

SEQ ID NO: 169726 - DNA, 1203 bp, Artificial Sequence; identical to SEQ ID NO: 169725
  Description of Artificial Sequence: Synthetic coding sequence

SEQ ID NO: 169727 - DNA, 1068 bp, Artificial Sequence
  Description of Artificial Sequence: Synthetic coding sequence
atggccaccctgctgctgctgctgggcgtgctggtggtgtccccagatgccctgggcagcaccacagctgtgcagacccccaccagcggggagcccctggtgtccaccagcgagcccctgagcagcaagatgtacaccaccagcatcaccagtgaccccaaggctgacagcactggagaccagaccagcgccctgccccccagcaccagcatcaatgaaggcagccccctgtggaccagcattggagccagcacaggcagccccctgcctgagcccaccacctaccaggaggtgtccatcaagatgagctctgtgccccaggagacccctcatgccaccagccaccctgctgtgcccatcacagccaacagcctgggcagccacacagtgactggaggcaccatcaccaccaacagccctgagaccagcagcaggaccagcggggcccctgtgaccacagctgccagcagcctggagaccagccggggcaccagcggcccccccctgaccatggccaccgtgtccctggagaccagcaagggcaccagcggcccccctgtgaccatggccacagacagcctggagaccagcacaggcaccactggacctcctgtgaccatgaccaccggcagcctggagcccagcagcggggccagcggcccccaggtgtcctctgtgaagctgagcaccatgatgagccccaccaccagcaccaatgccagcacagtgcccttcaggaacccagatgagaacagccggggcatgctgcctgtggccgtgctggtggccctgctggccgtcatcgtgctggtggccctgctgctgctgtggaggcggcggcagaagagaagaactggagccctggtgctgagcagaggaggcaagagaaatggagtggtggatgcctgggccggccctgcccaggtgcctgaggagggcgctgtgacagtgacagtgggcggcagcggcggggacaagggcagcggcttcccagatggagagggcagcagccggcggcccaccctgaccaccttcttcggccgcaggaagagccggcagggcagctag

SEQ ID NO: 169728 - DNA, 672 bp, Artificial Sequence
  Description of Artificial Sequence: Synthetic coding sequence
atgcagtgggccgtgggccgccgctgggcctgggccgccctgctgctggccgtggccgctgtgctgacccaggtggtgtggctgtggctgggcacccagagctttgtgttccagcgggaggagatcgcccagctggcccggcagtatgccggcctggaccacgagctggccttcagccgcctcatcgtggagctgcggcggctgcaccctggccacgtgctgcctgatgaggagctgcagtgggtgtttgtgaatgctgggggctggatgggcgccatgtgcctgctgcacgccagcctgtctgaatatgtgctgctgtttggaacagccctgggcagccggggccacagcggccgctactgggccgagatcagtgacaccatcatcagcggcaccttccaccagtggagggagggcaccaccaagtctgaggtgttctacccaggagaaacagtggtgcacggccctggagaggccacagctgtggagtggggccccaacacctggatggtggagtatggccggggcgtcatccccagcaccctggcctttgccctggccgacacagtgttcagcacccaggacttcctgaccctcttctacaccctgcggagctatgcccggggcctgcggctggagctgaccacctacctgtttggccaggacccctag

SEQ ID NO: 169729 - DNA, 570 bp, Artificial Sequence
  Description of Artificial Sequence: Synthetic coding sequence
atgcagtgggccgtgggccgccgctgggcctgggccgccctgctgctggccgtggccgctgtgctgacccaggtggtgtggctgtggctgggcctggaccacgagctggccttcagccgcctcatcgaggagctgcagtgggtgtttgtgaatgctgggggctggatgggcgccatgtgcctgctgcacgccagcctgtctgaatatgtgctgctgtttggaacagccctgggcagccggggccacagcggccgctactgggccgagatcagtgacaccatcatcagcggcaccttccaccagtggagggagggcaccaccaagtctgaggtgttctacccaggagaaacagtggtgcacggccctggagaggccacagctgtggagtggggccccaacacctggatggtggagtatggccggggcgtcatccccagcaccctggcctttgccctggccgacacagtgttcagcacccaggacttcctgaccctcttctacaccctgcggagctatgcccggggcctgcggctggagctgaccacctacctgtttggccaggacccctag

SEQ ID NO: 169730 - DNA, 405 bp, Artificial Sequence
  Description of Artificial Sequence: Synthetic coding sequence
atgggcgccatgtgcctgctgcacgccagcctgtctgaatatgtgctgctgtttggaacagccctgggcagccggggccacagcggccgctactgggccgagatcagtgacaccatcatcagcggcaccttccaccagtggagggagggcaccaccaagtctgaggtgttctacccaggagagaccgtggtgcacggccctggagaggccacagctgtggagtggggccccaacacctggatggtggagtatggccggggcgtcatccccagcaccctggcctttgccctggccgacaccgtcttcagcacccaggacttcctgaccctcttctacaccctgcggagctatgcccggggcctgcggctggagctgaccacctacctgtttggccaggacccctag

SEQ ID NO: 169731 - DNA, 579 bp, Artificial Sequence
  Description of Artificial Sequence: Synthetic coding sequence
atgcagtgggccgtgggccgccgctgggcctgggccgccctgctgctggccgtggccgctgtgctgacccaggtggtgtggctgtggctgggcacccagagctttgtgttccagcgggaggagatcgcccagctggcccggcagtatgccggcctggaccacgagctggccttcagccgcctcatcgtggagctgcggcggctgcaccctggccacgtgctgcctgatgaggagctgcagtgggtgtttgtgaatgctgggggctggatgggcgccatgtgcctgctgcacgccagcctgtctgaatatgtgctgctgtttggaacagccctgggcagccggggccacagcggggagaccgtggtgcacggccctggagaggccacagctgtggagtggggccccaacacctggatggtggagtatggccggggcgtcatccccagcaccctggcctttgccctggccgacaccgtcttcagcacccaggacttcctgaccctcttctacaccctgcggagctatgcccggggcctgcggctggagctgaccacctacctgtttggccaggacccctag

SEQ ID NO: 169732 - DNA, 2916 bp, Artificial Sequence
  Description of Artificial Sequence: Synthetic coding sequence
atgggcgtggccggcaggaacagacctggagctgcctgggccgtgctgctgctgctgctgctgctgccccccctgctgctgctggccggggctgtgcccccaggccggggccgggccgccggcccccaggaggatgtggatgaatgtgcccagggcctggatgactgccacgcagatgccctgtgccagaacacccccaccagctacaagtgcagctgcaagccaggctaccagggcgagggccggcagtgtgaagatattgatgaatgtggaaatgagctgaatggaggctgtgtgcatgactgcctgaacatccctggcaactaccgctgcacctgctttgatggcttcatgctggcccatgatggccacaactgcctggatgtggatgaatgtctggagaacaacggcggctgccagcacacctgtgtgaatgtgatgggcagctatgagtgctgctgcaaggagggcttcttcctgagtgacaaccagcacacctgcatccacaggtctgaggagggcctgagctgcatgaacaaggaccacggctgcagccacatctgcaaggaggccccccggggctctgtggcctgtgaatgtcggcccggctttgagctggccaagaaccagagggactgcatcctgacctgcaaccacggcaatggaggctgccagcacagctgtgatgacacagcagatggccctgagtgcagctgccacccccagtacaagatgcacacagatggccgcagctgcctggagcgggaggacacagtgctggaggtgacagagagcaacaccacctctgtggtggatggagacaagagggtgaagaggcggctgctgatggagacctgtgctgtgaacaacggcggctgtgacaggacctgcaaggacaccagcactggagtgcactgcagctgccctgtgggcttcaccctgcagctggatggcaagacctgcaaggacattgatgagtgccagaccagaaatggaggctgtgaccacttctgcaagaacatcgtgggcagctttgactgtggctgcaagaagggcttcaagctgctgacagatgagaagagctgccaggatgtggatgaatgttccctggacaggacctgtgaccacagctgcatcaaccaccctggcacctttgcctgtgcctgcaacagaggctacaccctgtatggcttcacccactgtggggacaccaatgaatgttccatcaacaatggaggctgccagcaggtgtgtgtgaacacagtgggcagctatgagtgccagtgccaccctggctacaagctgcactggaacaagaaggactgtgtggaggtgaagggcctgctgcccacctctgtgagcccccgggtgtccctgcactgcggcaagagcggcggcggagatggctgcttcctgcgctgccacagcggcatccacctgagcagcggcctgcagggcgcctacagcgtgacctgtggcagcagcagccccctgaggaacaagcagcagaagagcaatgacagcgcctttggagatgtgaccaccatccgcacctctgtgaccttcaagctgaatgaaggcaagtgcagcctgaagaatgctgagctgtttcctgagggcctgcggcctgccctgcctgagaagcacagctctgtgaaggagagcttccgctacgtgaacctgacctgcagcagcggcaagcaggtgcctggggcccctggccggcccagcacccccaaggagatgttcatcaccgtggagtttgagctggagaccaaccagaaggaggtgacagccagctgtgacctgagctgcatcgtgaagaggacagagaagaggctgaggaaggccatccgcaccctgaggaaggctgtgcaccgggagcagttccacctgcagctgagcggcatgaacctggatgtggccaagaagccacccaggaccagcgagcggcaggccgagagctgtggggtgggccagggccatgctgagaaccagtgtggcctgtgccagcccggggagtacagcgcagatggctttgccccctgccacctgtgtgccctgggcaccttccagcctgaggccggccgcaccagctgcttcccctgtggcggcggcctggccaccaagcaccagggcgccaccagcttccaggactgtgagaccagggtgcagtgcagccctggccacttctacaacaccaccacccaccgctgcatccgctgccctgtgggcacctaccagcctgagtttgggaagaacaactgtgtgtcctgccccggcaacaccaccacagactttgatggcagcaccaacatcacccagtgcaagaacagaagatgtggcggggagctgggggacttcaccggctacatcgagagccccaactacccaggcaactacccagccaacacagagtgcacctggaccatcaaccccccacccaagaggcgcatcctgattgtggtgcctgagatcttcctgcccattgaagatgactgtggggactacctggtgatgaggaagaccagcagcagcaacagcgtgaccacctatgagacctgccagacctatgaaagacccatcgccttcaccagccgcagcaagaagctgtggatccagttcaagagcaatgaaggcaacagcgcccggggcttccaggtgccctacgtgacctatgatgaggactaccaggagctgattgaggacatcgtgagagatggccgcctgtatgccagcgagaaccaccaggagatcctgaaggacaagaagctgatcaaggccctgtttgatgtgctggcccacccccagaactacttcaagtacacagcccaggagagccgggagatgttccccaggagcttcatccggctgctgcggagcaaggtgagccgcttcctgcggccctacaagtag

SEQ ID NO: 169733 - DNA, 1044 bp, Artificial Sequence
  Description of Artificial Sequence: Synthetic coding sequence
atgggcgctgctgctgtgcgctggcacctgtgtgtgctgctggccctgggcacccggggccgcctggccggcggcagcggcctgcccggctctgtggatgtggatgagtgcagcgagggcacagatgactgccacattgatgccatctgccagaacacccccaagagctacaagtgcctgtgcaagccaggctacaagggggagggcaagcagtgtgaagatattgatgaatgtgaaaatgactactacaacggcggctgtgtgcatgagtgcatcaacatccctggcaactaccgctgcacctgctttgatggcttcatgctggcccatgatggccacaactgcctggatgtggatgagtgccaggacaacaatggaggctgccagcagatctgtgtgaatgccatgggcagctatgagtgccagtgccacagcggcttcttcctgagtgacaaccagcacacctgcatccacaggagcaatgaaggcatgaactgcatgaacaaggaccacggctgtgcccacatctgccgggagacccccaagggcggcgtggcctgtgactgcaggcctggctttgacctggcccagaaccagaaggactgcaccctgacctgcaactatggaaatggaggctgccagcacagctgtgaggacacagacaccggccccacctgtggctgccaccagaagtatgccctgcacagtgatggccgcacctgcatcgagaaggatgaagctgccatcgagaggagccagttcaatgccacctctgtggctgatgtggacaagagggtgaagaggcggctgctgatggagacctgtgctgtgaacaatggaggctgtgacaggacctgcaaggacacagccactggagtgcgctgcagctgccctgtgggcttcaccctgcagccagatggcaagacctgcaagggccagcacgtggagctgtgtggctgcccctgcctgtactggccaggccaggagcccccctgtgcctgcatcgccggcccccgggccggcctgaatggaggccacgtgtag

SEQ ID NO: 169734 - DNA, 2967 bp, Artificial Sequence
  Description of Artificial Sequence: Synthetic coding sequence
atgggcgctgctgctgtgcgctggcacctgtgtgtgctgctggccctgggcacccggggccgcctggccggcggcagcggcctgcccggctctgtggatgtggatgagtgcagcgagggcacagatgactgccacattgatgccatctgccagaacacccccaagagctacaagtgcctgtgcaagccaggctacaagggggagggcaagcagtgtgaagatattgatgaatgtgaaaatgactactacaacggcggctgtgtgcatgagtgcatcaacatccctggcaactaccgctgcacctgctttgatggcttcatgctggcccatgatggccacaactgcctggatgtggatgagtgccaggacaacaatggaggctgccagcagatctgtgtgaatgccatgggcagctatgagtgccagtgccacagcggcttcttcctgagtgacaaccagcacacctgcatccacaggagcaatgaaggcatgaactgcatgaacaaggaccacggctgtgcccacatctgccgggagacccccaagggcggcgtggcctgtgactgcaggcctggctttgacctggcccagaaccagaaggactgcaccctgacctgcaactatggaaatggaggctgccagcacagctgtgaggacacagacaccggccccacctgtggctgccaccagaagtatgccctgcacagtgatggccgcacctgcatcgagacctgtgctgtgaacaatggaggctgtgacaggacctgcaaggacacagccactggagtgcgctgcagctgccctgtgggcttcaccctgcagccagatggcaagacctgcaaggacatcaatgaatgtctggtgaacaacggcggctgtgaccacttctgcaggaacacagtgggcagctttgaatgtggctgcaggaagggctacaagctgctgacagatgagaggacctgccaggacattgatgagtgcagctttgagaggacctgtgaccacatctgcatcaacagccctggcagcttccagtgcctgtgccaccggggctacatcctgtatggcaccacccactgtggagatgtggatgaatgttccatgagcaatggcagctgtgaccagggctgtgtgaacaccaagggcagctatgaatgtgtgtgccccccaggccggcggctgcactggaatggcaaggactgtgtggagaccgggaagtgcctgagccgggccaagaccagcccccgggcccagctgagctgcagcaaggccggcggcgtggagagctgcttcctgagctgcccagcccacaccctgtttgtgcctgacagtgaaaattcctatgtgctgagctgtggggtgcccggcccccagggcaaggccctgcagaagagaaatggcaccagcagcggcctgggccccagctgcagtgatgcccccaccacccccatcaagcagaaggcccgcttcaagatcagagatgccaagtgccacctgcggccccacagccaggcccgggccaaggagacagcccggcagcccctgctggaccactgccacgtgacctttgtgaccctgaagtgtgacagcagcaagaagagaagaagaggaaggaagagccccagcaaggaggtgagccacatcacagctgagtttgaaattgagaccaagatggaggaggccagtgacacctgtgaggccgactgcctgaggaagagagctgagcagagcctgcaggccgccatcaagaccctgaggaagagcatcggccggcagcagttctacgtgcaggtgtctggaacagaatatgaggtggcccagaggcctgccaaggccctggagggccagggcgcctgtggggccggccaggtgctgcaggacagcaaatgtgtggcctgtggccctggcacccactttggaggagagctgggccagtgtgtgtcctgcatgcctggcacctaccaggacatggagggccagctgagctgcaccccctgccccagcagtgatggcctgggcctgcccggggccagaaatgtgtctgaatgtggcggccagtgcagccctggcttcttcagcgcagatggcttcaagccctgccaggcctgccctgtgggcacctaccagcctgagcccggccgcacaggctgcttcccctgtggcggcggcctgctgaccaagcatgagggcaccaccagcttccaggactgtgaggccaaggtgcactgcagccctggccaccactacaacaccaccacccaccgctgcatccgctgccctgtgggcacctaccagcctgagtttggccagaaccactgcatcacctgccccggcaacaccagcacagactttgatggcagcaccaacgtgacccactgcaagaaccagcactgcggcggggagctgggggactacacaggctacatcgagagccccaactacccaggggactacccagccaatgcagaatgtgtgtggcacatcgcccccccacccaagaggcgcatcctgattgtggtgcctgagatcttcctgcccattgaagatgaatgtggagatgtgctggtgatgaggaagagcgccagccccaccagcatcaccacctatgagacctgccagacctatgagcggcccatcgccttcaccagccgcagcaggaagctgtggatccagttcaagagcaatgaaggcaacagcggcaagggcttccaggtgccctacgtgacctatgatgaggactaccagcagctgattgaagatattgtgagagatggccgcctgtatgccagcgagaaccaccaggagatcctgaaggacaagaagctgatcaaggccctgtttgatgtgctggcccacccccagaactacttcaagtacacagcccaggagagcaaggagatgttccccaggagcttcatcaagctgctgcggagcaaggtgagccgcttcctgcggccctacaagtag

SEQ ID NO: 169735 - DNA, 1857 bp, Artificial Sequence
  Description of Artificial Sequence: Synthetic coding sequence
atggagacagaagctgccagcacagctgtgaggacccagacccaggccccccgggtggtggccaccaggagcacccccagcacccagacagtggcccgggccagccggcgggcccagagcatcacagaggccgccaccggccacgcccggacccagcccctggcctgtgatgctgctgcccccctggacagccactgcagcaggactggaagacatgccaagaccagcaccagcgcctggagcaccacagaagctgccaccaccagcgctgccaccccctgggccgccagcagcgctgctgctggccgggccaccagctgcagccccaccagcgccccagcccggaccagcaccagcgcccccagcagcggccctgtgaccaccagcgccagcaccccccaggcccgggccaaggagacagcccggcagcccctgctggaccactgccacgtgacctttgtgaccctgaagtgtgacagcagcaagaagagaagaagaggaaggaagagccccagcaaggaggtgagccacatcacagctgagtttgaaattgagaccaagatggaggaggccagtgacacctgtgaggccgactgcctgaggaagagagctgagcagagcctgcaggccgccatcaagaccctgaggaagagcatcggccggcagcagttctacgtgcaggtgtctggaacagaatatgaggtggcccagaggcctgccaaggccctggagggccagggcgcctgtggggccggccaggtgctgcaggacagcaaatgtgtggcctgtggccctggcacccactttggaggagagctgggccagtgtgtgtcctgcatgcctggcacctaccaggacatggagggccagctgagctgcaccccctgccccagcagtgatggcctgggcctgcccggggccagaaatgtgtctgaatgtggcggccagtgcagccctggcttcttcagcgcagatggcttcaagccctgccaggcctgccctgtgggcacctaccagcctgagcccggccgcacaggctgcttcccctgtggcggcggcctgctgaccaagcatgagggcaccaccagcttccaggactgtgaggccaaggtgcactgcagccctggccaccactacaacaccaccacccaccgctgcatccgctgccctgtgggcacctaccagcctgagtttggccagaaccactgcatcacctgccccggcaacaccagcacagactttgatggcagcaccaacgtgacccactgcaagaaccagcactgcggcggggagctgggggactacacaggctacatcgagagccccaactacccaggggactacccagccaatgcagaatgtgtgtggcacatcgcccccccacccaagaggcgcatcctgattgtggtgcctgagatcttcctgcccattgaagatgaatgtggagatgtgctggtgatgaggaagagcgccagccccaccagcatcaccacctatgagacctgccagacctatgagcggcccatcgccttcaccagccgcagcaggaagctgtggatccagttcaagagcaatgaaggcaacagcggcaagggcttccaggtgccctacgtgacctatgatgaggactaccagcagctgattgaagatattgtgagagatggccgcctgtatgccagcgagaaccaccaggagatcctgaaggacaagaagctgatcaaggccctgtttgatgtgctggcccacccccagaactacttcaagtacacagcccaggagagcaaggagatgttccccaggagcttcatcaagctgctgcggagcaaggtgagccgcttcctgcggccctacaagtag

SEQ ID NO: 169736 - DNA, 1092 bp, Artificial Sequence
  Description of Artificial Sequence: Synthetic coding sequence
atgggcgctgctgctgtgcgctggcacctgtgtgtgctgctggccctgggcacccggggccgcctggccggcggcagcggcctgcccggctctgtggatgtggatgagtgcagcgagggcacagatgactgccacattgatgccatctgccagaacacccccaagagctacaagtgcctgtgcaagccaggctacaagggggagggcaagcagtgtgaagatattgatgaatgtgaaaatgactactacaacggcggctgtgtgcatgagtgcatcaacatccctggcaactaccgctgcacctgctttgatggcttcatgctggcccatgatggccacaactgcctggatgtggatgagtgccaggacaacaatggaggctgccagcagatctgtgtgaatgccatgggcagctatgagtgccagtgccacagcggcttcttcctgagtgacaaccagcacacctgcatccacaggagcaatgaaggcatgaactgcatgaacaaggaccacggctgtgcccacatctgccgggagacccccaagggcggcgtggcctgtgactgcaggcctggctttgacctggcccagaaccagaaggactgcaccctgacctgcaactatggaaatggaggctgccagcacagctgtgaggacacagacaccggccccacctgtggctgccaccagaagtatgccctgcacagtgatggccgcacctgcatcgagacctgtgctgtgaacaatggaggctgtgacaggacctgcaaggacacagccactggagtgcgctgcagctgccctgtgggcttcaccctgcagccagatggcaagacctgcaaggacatcaatgaatgtctggtgaacaacggcggctgtgaccacttctgcaggaacacagtgggcagctttgaatgtggctgcaggaagggctacaagctgctgacagatgagaggacctgccaggacattgatgagtgcagctttgagaggacctgtgaccacatctgcatcaacagccctggcagcttccagtgcctgatcaagctgctgcggagcaaggtgagccgcttcctgcggccctacaagtag

SEQ ID NO: 169737 - DNA, 528 bp, Artificial Sequence
  Description of Artificial Sequence: Synthetic coding sequence
tgaagagagacccccaagggcggcgtggcctgtgactgcaggcctggctttgacctggcccagaaccagaaggactgcaccctgacctgcaactatggaaatggaggctgccagcacagctgtgaggacacagacaccggccccacctgtggctgccaccagaagtatgccctgcacagtgatggccgcacctgcatcgagaaggatgaagctgccatcgagaggagccagttcaatgccacctctgtggctgatgtggacaagagggtgaagaggcggctgctgatggagacctgtgctgtgaacaatggaggctgtgacaggacctgcaaggacacagccactggagtgcgctgcagctgccctgtgggcttcaccctgcagccagatggcaagacctgcaaggacatcaatgaatgtctggtgaacaacggcggctgtgaccacttctgcaggaacacagtgggcagctttgaatgtggctgcaggaagggctacaagctgctgacagatgagaggacctgctag

SEQ ID NO: 169738 - DNA, 3000 bp, Artificial Sequence
  Description of Artificial Sequence: Synthetic coding sequence
atgggcgtggccggcaggaacagacctggagctgcctgggccgtgctgctgctgctgctgctgctgccccccctgctgctgctggccggggctgtgcccccaggccggggccgggccgccggcccccaggaggatgtggatgaatgtgcccagggcctggatgactgccacgcagatgccctgtgccagaacacccccaccagctacaagtgcagctgcaagccaggctaccagggcgagggccggcagtgtgaagatattgatgaatgtggaaatgagctgaatggaggctgtgtgcatgactgcctgaacatccctggcaactaccgctgcacctgctttgatggcttcatgctggcccatgatggccacaactgcctggatgtggatgaatgtctggagaacaacggcggctgccagcacacctgtgtgaatgtgatgggcagctatgagtgctgctgcaaggagggcttcttcctgagtgacaaccagcacacctgcatccacaggtctgaggagggcctgagctgcatgaacaaggaccacggctgcagccacatctgcaaggaggccccccggggctctgtggcctgtgaatgtcggcccggctttgagctggccaagaaccagagggactgcatcctgacctgcaaccacggcaatggaggctgccagcacagctgtgatgacacagcagatggccctgagtgcagctgccacccccagtacaagatgcacacagatggccgcagctgcctggagcgggaggacacagtgctggaggtgacagagagcaacaccacctctgtggtggatggagacaagagggtgaagaggcggctgctgatggagacctgtgctgtgaacaacggcggctgtgacaggacctgcaaggacaccagcactggagtgcactgcagctgccctgtgggcttcaccctgcagctggatggcaagacctgcaaggacattgatgagtgccagaccagaaatggaggctgtgaccacttctgcaagaacatcgtgggcagctttgactgtggctgcaagaagggcttcaagctgctgacagatgagaagagctgccaggatgtggatgaatgttccctggacaggacctgtgaccacagctgcatcaaccaccctggcacctttgcctgtgcctgcaacagaggctacaccctgtatggcttcacccactgtggggacaccaatgaatgttccatcaacaatggaggctgccagcaggtgtgtgtgaacacagtgggcagctatgagtgccagtgccaccctggctacaagctgcactggaacaagaaggactgtgtggaggtgaagggcctgctgcccacctctgtgagcccccgggtgtccctgcactgcggcaagagcggcggcggagatggctgcttcctgcgctgccacagcggcatccacctgagcagtgatgtgaccaccatccgcacctctgtgaccttcaagctgaatgaaggcaagtgcagcctgaagaatgctgagctgtttcctgagggcctgcggcctgccctgcctgagaagcacagctctgtgaaggagagcttccgctacgtgaacctgacctgcagcagcggcaagcaggtgcctggggcccctggccggcccagcacccccaaggagatgttcatcaccgtggagtttgagctggagaccaaccagaaggaggtgacagccagctgtgacctgagctgcatcgtgaagaggacagagaagaggctgaggaaggccatccgcaccctgaggaaggctgtgcaccgggagcagttccacctgcagctgagcggcatgaacctggatgtggccaagaagccacccaggaccagcgagcggcaggccgagagctgtggggtgggccagggccacgccgagaaccagtgtgtgtcctgcagagctggcacctactatgatggagcccgggagcgctgcatcctgtgccccaacggcaccttccagaatgaggagggccagatgacctgtgagccctgccccaggcctggcaacagcggggccctgaagaccccagaggcctggaacatgtctgaatgtggcggcctgtgccagcccggggagtacagcgcagatggctttgccccctgccacctgtgtgccctgggcaccttccagcctgaggccggccgcaccagctgcttcccctgtggcggcggcctggccaccaagcaccagggcgccaccagcttccaggactgtgagaccagggtgcagtgcagccctggccacttctacaacaccaccacccaccgctgcatccgctgccctgtgggcacctaccagcctgagtttgggaagaacaactgtgtgtcctgccccggcaacaccaccacagactttgatggcagcaccaacatcacccagtgcaagaacagaagatgtggcggggagctgggggacttcaccggctacatcgagagccccaactacccaggcaactacccagccaacacagagtgcacctggaccatcaaccccccacccaagaggcgcatcctgattgtggtgcctgagatcttcctgcccattgaagatgactgtggggactacctggtgatgaggaagaccagcagcagcaacagcgtgaccacctatgagacctgccagacctatgaaagacccatcgccttcaccagccgcagcaagaagctgtggatccagttcaagagcaatgaaggcaacagcgcccggggcttccaggtgccctacgtgacctatgatgaggactaccaggagctgattgaggacatcgtgagagatggccgcctgtatgccagcgagaaccaccaggagatcctgaaggacaagaagctgatcaaggccctgtttgatgtgctggcccacccccagaactacttcaagtacacagcccaggagagccgggagatgttccccaggagcttcatccggctgctgcggagcaaggtgagccgcttcctgcggccctacaagtag

SEQ ID NO: 169739 - DNA, 2424 bp, Artificial Sequence
  Description of Artificial Sequence: Synthetic coding sequence
atgggcgtggccggcaggaacagacctggagctgcctgggccgtgctgctgctgctgctgctgctgccccccctgctgctgctggccggggctgtgcccccaggccggggccgggccgccggcccccaggaggatgtggatgaatgtgcccagggcctggatgactgccacgcagatgccctgtgccagaacacccccaccagctacaagtgcagctgcaagccaggctaccagggcgagggccggcagtgtgaagatattgatgaatgtggaaatgagctgaatggaggctgtgtgcatgactgcctgaacatccctggcaactaccgctgcacctgctttgatggcttcatgctggcccatgatggccacaactgcctggatgtggatgaatgtctggagaacaacggcggctgccagcacacctgtgtgaatgtgatgggcagctatgagtgctgctgcaaggagggcttcttcctgagtgacaaccagcacacctgcatccacaggtctgaggagggcctgagctgcatgaacaaggaccacggctgcagccacatctgcaaggaggccccccggggctctgtggcctgtgaatgtcggcccggctttgagctggccaagaaccagagggactgcatcctgacctgcaaccacggcaatggaggctgccagcacagctgtgatgacacagcagatggccctgagtgcagctgccacccccagtacaagatgcacacagatggccgcagctgcctggagcgggaggacacagtgctggaggtgacagagagcaacaccacctctgtggtggatggagacaagagggtgaagaggcggctgctgatggagacctgtgctgtgaacaacggcggctgtgacaggacctgcaaggacaccagcactggagtgcactgcagctgccctgtgggcttcaccctgcagctggatggcaagacctgcaaggacattgatgagtgccagaccagaaatggaggctgtgaccacttctgcaagaacatcgtgggcagctttgactgtggctgcaagaagggcttcaagctgctgacagatgagaagagctgccaggatgtggatgaatgttccctggacaggacctgtgaccacagctgcatcaaccaccctggcacctttgcctgtgcctgcaacagaggctacaccctgtatggcttcacccactgtggggacaccaatgaatgttccatcaacaatggaggctgccagcaggtgtgtgtgaacacagtgggcagctatgagtgccagtgccaccctggctacaagctgcactggaacaagaaggactgtgtggccagctgtgacctgagctgcatcgtgaagaggacagagaagaggctgaggaaggccatccgcaccctgaggaaggctgtgcaccgggagcagttccacctgcagctgagcggcatgaacctggatgtggccaagaagccacccaggaccagcgagcggcaggccgagagctgtggggtgggccagggccacgccgagaaccagtgtgtgtcctgcagagctggcacctactatgatggagcccgggagcgctgcatcctgtgccccaacggcaccttccagaatgaggagggccagatgacctgtgagccctgccccaggcctggcaacagcggggccctgaagaccccagaggcctggaacatgtctgaatgtggcggcctgtgccagcccggggagtacagcgcagatggctttgccccctgccacctgtgtgccctgggcaccttccagcctgaggccggccgcaccagctgcttcccctgtggcggcggcctggccaccaagcaccagggcgccaccagcttccaggactgtgagaccagggtgcagtgcagccctggccacttctacaacaccaccacccaccgctgcatccgctgccctgtgggcacctaccagcctgagtttgggaagaacaactgtgtgtcctgccccggcaacaccaccacagactttgatggcagcaccaacatcacccagtgcaagaccagcagcaacagcgtgaccacctatgagacctgccagacctatgaaagacccatcgccttcaccagccgcagcaagaagctgtggatccagttcaagagcaatgaaggcaacagcgcccggggcttccaggtgccctacgtgacctatgatgaggactaccaggagctgattgaggacatcgtgagagatggccgcctgtatgccagcgagaaccaccaggagatcctgaaggacaagaagctgatcaaggccctgtttgatgtgctggcccacccccagaactacttcaagtacacagcccaggagagccgggagatgttccccaggagcttcatccggctgctgcggagcaaggtgagccgcttcctgcggccctacaagtag

SEQ ID NO: 169740 - DNA, 3087 bp, Artificial Sequence
  Description of Artificial Sequence: Synthetic coding sequence
atgggcgtggccggcaggaacagacctggagctgcctgggccgtgctgctgctgctgctgctgctgccccccctgctgctgctggccggggctgtgcccccaggccggggccgggccgccggcccccaggaggatgtggatgaatgtgcccagggcctggatgactgccacgcagatgccctgtgccagaacacccccaccagctacaagtgcagctgcaagccaggctaccagggcgagggccggcagtgtgaagatattgatgaatgtggaaatgagctgaatggaggctgtgtgcatgactgcctgaacatccctggcaactaccgctgcacctgctttgatggcttcatgctggcccatgatggccacaactgcctggatgtggatgaatgtctggagaacaacggcggctgccagcacacctgtgtgaatgtgatgggcagctatgagtgctgctgcaaggagggcttcttcctgagtgacaaccagcacacctgcatccacaggtctgaggagggcctgagctgcatgaacaaggaccacggctgcagccacatctgcaaggaggccccccggggctctgtggcctgtgaatgtcggcccggctttgagctggccaagaaccagagggactgcatcctgacctgcaaccacggcaatggaggctgccagcacagctgtgatgacacagcagatggccctgagtgcagctgccacccccagtacaagatgcacacagatggccgcagctgcctggagcgggaggacacagtgctggaggtgacagagagcaacaccacctctgtggtggatggagacaagagggtgaagaggcggctgctgatggagacctgtgctgtgaacaacggcggctgtgacaggacctgcaaggacaccagcactggagtgcactgcagctgccctgtgggcttcaccctgcagctggatggcaagacctgcaaggacattgatgagtgccagaccagaaatggaggctgtgaccacttctgcaagaacatcgtgggcagctttgactgtggctgcaagaagggcttcaagctgctgacagatgagaagagctgccaggatgtggatgaatgttccctggacaggacctgtgaccacagctgcatcaaccaccctggcacctttgcctgtgcctgcaacagaggctacaccctgtatggcttcacccactgtggggacaccaatgaatgttccatcaacaatggaggctgccagcaggtgtgtgtgaacacagtgggcagctatgagtgccagtgccaccctggctacaagctgcactggaacaagaaggactgtgtggaggtgaagggcctgctgcccacctctgtgagcccccgggtgtccctgcactgcggcaagagcggcggcggagatggctgcttcctgcgctgccacagcggcatccacctgagcagcggcctgcagggcgcctacagcgtgacctgtggcagcagcagccccctgaggaacaagcagcagaagagcaatgacagcgcctttggagatgtgaccaccatccgcacctctgtgaccttcaagctgaatgaaggcaagtgcagcctgaagaatgctgagctgtttcctgagggcctgcggcctgccctgcctgagaagcacagctctgtgaaggagagcttccgctacgtgaacctgacctgcagcagcggcaagcaggtgcctggggcccctggccggcccagcacccccaaggagatgttcatcaccgtggagtttgagctggagaccaaccagaaggaggtgacagccagctgtgacctgagctgcatcgtgaagaggacagagaagaggctgaggaaggccatccgcaccctgaggaaggctgtgcaccgggagcagttccacctgcagctgagcggcatgaacctggatgtggccaagaagccacccaggaccagcgagcggcaggccgagagctgtggggtgggccagggccatgctgagaaccagtgtgtgtcctgccgggccggcacctactatgatggagcccgggagcgctgcatcctgtgccccaacggcaccttccagaatgaggagggccagatgacctgtgagccctgcccccggcccggcaacagcggggccctgaagaccccagaggcctggaacatgtctgaatgtggcggcctgtgccagcctggagagtacagcgcagatggctttgccccctgccacctgtgtgccctgggcaccttccagcctgaggccggccgcaccagctgcttcccctgtggcggcggcctggccaccaagcaccagggcgccaccagcttccaggactgtgagaccagggtgcagtgcagccctggccacttctacaacaccaccacccaccgctgcatccgctgccctgtgggcacctaccagcctgagtttgggaagaacaactgtgtgtcctgccccggcaacaccaccacagactttgatggcagcaccaacatcacccagtgcaagaacagaagatgtggcggggagctgggggacttcaccggctacatcgagagccccaactacccaggcaactacccagccaacacagaatgtacctggaccatcaaccccccacccaagaggcgcatcctgattgtggtgcctgagatcttcctgcccattgaagatgactgtggggactacctggtgatgaggaagaccagcagcagcaacagcgtgaccacctatgagacctgccagacctatgagcggcccatcgccttcaccagccgcagcaagaagctgtggatccagttcaagagcaatgaaggcaacagcgcccggggcttccaggtgccctacgtgacctatgatgaggactaccaggagctgattgaagatattgtgagagatggccgcctgtatgccagcgagaaccaccaggagatcctgaaggacaagaagctgatcaaggccctgtttgatgtgctggcccacccccagaactacttcaagtacacagcccaggagagccgggagatgttccccaggagcttcatccggctgctgcggagcaaggtgagccgcttcctgcggccctacaagtag

SEQ ID NO: 169741 - DNA, 411 bp, Artificial Sequence
  Description of Artificial Sequence: Synthetic coding sequence
atggtgctgctggagagcgagcagttcctgacagagctgaccaggctcttccagaagtgcaggaccagcggctctgtgtacatcaccctgaagaagtatgatggccgcaccaagcccatccccaagaagggcaccgtggagggctttgagcctgctgacaacaagtgcctgctgcgggccacagatggcaagaagaagatcagcacagtggtgagcagcaaggaggtgaacaagttccagatggcctacagcaacctgctgcgggccaacatggatggcctgaagaagagggacaagaagaacaagaccaagaagaccaaggctgctgctgctgctgctgctgctgccccagctgctgctgccacagcccccaccacagctgccaccacagctgccacagctgcccagtag

SEQ ID NO: 169742 - DNA, 333 bp, Artificial Sequence
  Description of Artificial Sequence: Synthetic coding sequence
atggcctgtgccgccgcccggagccctgctgaccaggaccgcttcatctgcatctacccagcctacctgaacaacaagaagaccatcgccgagggccgccgcatccccatcagcaaggctgtggagaaccccacagccacagagatccaggatgtgtgcagcgctgtgggcctgaatgtgttcctggagaagaacaagatgtacagccgggagtggaacagagatgtgcagtaccggggccgggtgcgggtgcagctgaagcaggaggatggcagcctgtgcctggtgcagttccccagccactacaccctgagcctgaccagcggcagctag

SEQ ID NO: 169743 - DNA, 435 bp, Artificial Sequence
  Description of Artificial Sequence: Synthetic coding sequence
atggcctgtgccgccgcccggagccctgctgaccaggaccgcttcatctgcatctacccagcctacctgaacaacaagaagaccatcgccgagggccgccgcatccccatcagcaaggctgtggagaaccccacagccacagagatccaggatgtgtgcagcgctgtgggcctgaatgtgttcctggagaagaacaagatgtacagccgggagtggaacagagatgtgcagtaccggggccgggtgcgggtgcagctgaagcaggaggatggcagcctgtgcctggtgcagttccccagcaggaagtctgtgatgctgtatgctgctgagatgatccccaagctgaagaccaggacccagaagacaggaggagctgaccagagcctgcagcagggcgagggcagcaagaagggcaagggcaagaagaagaagtag

SEQ ID NO: 169744 - DNA, 237 bp, Artificial Sequence
  Description of Artificial Sequence: Synthetic coding sequence
atggcctgtgccgccgcccggagccctgctgaccaggaccggctgctgaagatcctgcagctgcagcgcttcaagatgtatgtgcagcagctggacctgacctacttcctgaggaagatcaagtgcaccctggagaatggcatcgtgatgagcaacacagaagctgagagcggcagcagcagcaacaggaagatgggcgccagcgccctgtacagcagccaccacgtgtcccagtag

SEQ ID NO: 169745 - DNA, 639 bp, Artificial Sequence; identical to SEQ ID NO: 148856
  Description of Artificial Sequence: Synthetic coding sequence

SEQ ID NO: 169746 - DNA, 1368 bp, Artificial Sequence
  Description of Artificial Sequence: Synthetic coding sequence
atgccacccctgtccatgaagaggtctgccatcgacctggaggagatggccagcggcctgaacaagaggaagatgatccagcacgctgtgttcaaggagctggtgaagctggtggaccccggggtgaaggcctggacccccaccaagggcaagcagaatgtcatcatgtttgtgggcctgcagggcagcggcaagaccaccacctgcagcaagctggcctactactaccagaggaagggctggaagacctgcctgatctgtgccgacaccttccgggccggggcctttgaccagctgaagcagaatgccaccaaggcccgcatccccttctacggcagctacacagagatggaccctgtgatcatcgccagcgagggcgtggagaagttcaagaatgaaaattttgagatcatcatcgtggacaccagcggccgccacaagcaggaggacagcctgtttgaggagatgctgcaggtggccaatgccatccagcctgacaacatcgtgtatgtgatggatgccagcatcggccaggcctgtgaggcccaggccaaggccttcaaggacaaggtggatgtggcctctgtgattgtgaccaagctggatggccacgccaagggcggcggggccctgtctgctgtggccgccaccaagagccccatcatcttcatcggcaccggggagcacattgatgactttgagcccttcaagacccagcccttcatcagcaagctgctgggcatgggagacatcgagggcctgattgacaaggtgaatgagctgaagctggatgacaatgaggccctgattgagaagctgaagcacggccagttcaccctgcgggacatgtatgagcagttccagaacatcatgaagatgggccccttcagccagatcctgggcatgatccctggcttcggcacagacttcatgagcaaaggaaatgagcaggagagcatggcccggctgaagaagctgatgaccatcatggacagcatgaatgaccaggagctggacagcacagatggagccaaggtgttcagcaagcagcccggccgcatccagagggtggcccggggcagcggcgtgtccaccagagatgtgcaggagctgctgacccagtacaccaagtttgcccagatggtgaagaagatgggcggcatcaagggcctcttcaagggcggggacatgagcaagaatgtgtcccagagccagatggccaagctgaaccagcagatggccaagatgatggacccccgggtgctgcaccacatgggcggcatggccggcctgcagagcatgatgaggcagttccagcagggcgctgctggcaacatgaagggcatgatgggcttcaacaacatgtag

SEQ ID NO: 169747 - DNA, 135 bp, Artificial Sequence
  Description of Artificial Sequence: Synthetic coding sequence
atggtgctggccgacctgggcaggaagatcaccagcgccctgcggagcctgagcaatgccaccatcatcaatgaggaggtgctgaatgccatgctgaaggaggtgtgcacagccctgctggaggctgatgtgtag

SEQ ID NO: 169748 - DNA, 225 bp, Artificial Sequence
  Description of Artificial Sequence: Synthetic coding sequence
atggtgctggccgacctgggcaggaagatcaccagcgccctgcggagcctgagcaatgccaccatcatcaatgaggaggtgctgaatgccatgctgaaggaggtgtgcacagccctgctggaggctgatgtgaacatcaagctggtgaagcagctgcgggagaatgtgaagagcgccatcgacctggaggagatggccagcggcctgaacaagaggaagatgtag

SEQ ID NO: 169749 - DNA, 1515 bp, Artificial Sequence; identical to SEQ ID NO: 148424
  Description of Artificial Sequence: Synthetic coding sequence

SEQ ID NO: 169750 - DNA, 1791 bp, Artificial Sequence
  Description of Artificial Sequence: Synthetic coding sequence
atggctgctgagaagcaggtgcctgggggcggcggcggcggcggcagcggcggcggcggcggcagcggcggcggcggcagcggcggcggcagaggagctggaggagaggagaacaaggaaaatgaaagaccttctgctggcagcaaggccaacaaggagtttggagacagcctgagcctggagatcctgcagatcatcaaggagagccagcagcagcacggcctgcggcatggagacttccagcgctaccggggctactgcagccggcggcagaggcggctgaggaagaccctgaacttcaagatgggcaacagacacaagttcaccgggaagaaggtgacagaggagctgctgacagacaaccgctacctgctgctggtgctgatggatgctgagcgggcctggagctatgccatgcagctgaagcaggaggccaacacagagcccaggaagcgcttccacctgctgagccggctgaggaaggctgtgaagcacgccgaggagctggagcggctgtgtgagagcaacagagtggatgccaagaccaagctggaggcccaggcctacacagcctacctgagcggcatgctgcgctttgagcaccaggagtggaaggccgccatcgaggccttcaacaagtgcaagaccatctatgagaagctggccagcgccttcacagaggagcaggccgtgctgtacaaccagagggtggaggagatcagccccaacatccgctactgtgcctacaacattggagagacccgggccaagcaggccgccaccatgtctgaggtggagtggaggggccgcacagtgcctgtgaagattgacaaggtgcgcatcttcctgctgggcctggccgacaatgaagctgccatcgtgcaggccgagagcgaggagaccaaggagcggctgtttgagagcatgctgtctgagtgcagagatgccatccaggtggtgcgggaggagctgaagccagaccagaagcagagggactacatcctggagggggagcccgggaaggtgagcaacctgcagtacctgcacagctacctgacctacatcaagctgagcacagccatcaagagaaatgaaaacatggccaagggcctgcagagggccctgctgcagcagcagccagaagatgacagcaagaggagcccccggccccaggacctgatccggctgtatgacatcatcctgcagaacctggtggagctgctgcagctgcccggcctggaggaggacaaggccttccagaaggagatcggcctgaagaccctggtgttcaaggcctaccgctgcttcttcatcgcccagagctatgtgctggtgaagaagtggagcgaggccctggtgctgtatgacagagtgctgaagtatgccaatgaggtgaacagtgatgctggggccttcaagaacagcctgaaggacctgcctgatgtgcaggagctgatcacccaggtgcgctctgagaagtgcagcctgcaggccgccgccatcctggatgccaatgatgcccaccagacagagaccagcagcagccaggtgaaggacaacaagcccctggtggagagatttgagaccttctgcctggaccccagcctggtgaccaagcaggccaacctggtgcacttccccccaggcttccagcccatcccctgcaagcccctcttctttgacctggccctgaaccacgtggccttcccccccctggaggacaagctggagcagaagaccaagagcggcctgaccggctacatcaagggcatcttcggcttccgctcctag

SEQ ID NO: 169751 - DNA, 1884 bp, Artificial Sequence
  Description of Artificial Sequence: Synthetic coding sequence
atggctgctgagaagcaggtgcctgggggcggcggcggcggcggcagcggcggcggcggcggcagcggcggcggcggcagcggcggcggcagaggagctggaggagaggagaacaaggaaaatgaaagaccttctgctggcagcaaggccaacaaggagtttggagacagcctgagcctggagatcctgcagatcatcaaggagagccagcagcagcacggcctgcggcatggagacttccagcgctaccggggctactgcagccggcggcagaggcggctgaggaagaccctgaacttcaagatgggcaacagacacaagttcaccgggaagaaggtgacagaggagctgctgacagacaaccgctacctgctgctggtgctgatggatgctgagcgggcctggagctatgccatgcagctgaagcaggaggccaacacagagcccaggaagcgcttccacctgctgagccggctgaggaaggctgtgaagcacgccgaggagctggagcggctgtgtgagagcaacagagtggatgccaagaccaagctggaggcccaggcctacacagcctacctgagcggcatgctgcgctttgagcaccaggagtggaaggccgccatcgaggccttcaacaagtgcaagaccatctatgagaagctggccagcgccttcacagaggagcaggccgtgctgtacaaccagagggtggaggagatcagccccaacatccgctactgtgcctacaacattggagaccagagcgccatcaatgagctgatgcagatgaggctgcggagcggcggcacagagggcctgctggccgagaagctggaggccctgatcacccagacccgggccaagcaggccgccaccatgtctgaggtggagtggaggggccgcacagtgcctgtgaagattgacaaggtgcgcatcttcctgctgggcctggccgacaatgaggccgccatcgtgcaggccgagagcgaggagaccaaggagcggctgtttgagagcatgctgtctgaatgtagagatgccatccaggtggtgcgggaggagctgaagccagaccagaagcagagggactacatcctggagggggagcccgggaaggtgagcaacctgcagtacctgcacagctacctgacctacatcaagctgagcacagccatcaagagaaatgaaaacatggccaagggcctgcagagggccctgctgcagcagcagccagaagatgacagcaagaggagcccccggccccaggacctgatccggctgtatgacatcatcctgcagaacctggtggagctgctgcagctgcccggcctggaggaggacaaggccttccagaaggagatcggcctgaagaccctggtgttcaaggcctaccgctgcttcttcatcgcccagagctatgtgctggtgaagaagtggagcgaggccctggtgctgtatgacagagtgctgaagtatgccaatgaggtgaacagtgatgctggggccttcaagaacagcctgaaggacctgcctgatgtgcaggagctgatcacccaggtgcgctctgagaagtgcagcctgcaggccgccgccatcctggatgccaatgatgcccaccagacagagaccagcagcagccaggtgaaggacaacaagcccctggtggagagatttgagaccttctgcctggaccccagcctggtgaccaagcaggccaacctggtgcacttccccccaggcttccagcccatcccctgcaagcccctcttctttgacctggccctgaaccacgtggccttcccccccctggaggacaagctggagcagaagaccaagagcggcctgaccggctacatcaagggcatcttcggcttccgctcctag

SEQ ID NO: 169752 - DNA, 1581 bp, Artificial Sequence
  Description of Artificial Sequence: Synthetic coding sequence
atgggcaacagacacaagttcaccgggaagaaggtgacagaggagctgctgacagacaaccgctacctgctgctggtgctgatggatgctgagcgggcctggagctatgccatgcagctgaagcaggaggccaacacagagcccaggaagcgcttccacctgctgagccggctgaggaaggctgtgaagcatgctgaggagctggagcggctgtgtgagagcaacagagtggatgccaagaccaagctggaggcccaggcctacacagcctacctgagcggcatgctgcgctttgagcaccaggagtggaaggccgccatcgaggccttcaacaagtgcaagaccatctatgagaagctggccagcgccttcacagaggagcaggccgtgctgtacaaccagagggtggaggagatcagccccaacatccgctactgtgcctacaacatcggggaccagagcgccatcaatgagctgatgcagatgaggctgcggagcggcggcacagagggcctgctggccgagaagctggaggccctgatcacccagacccgggccaagcaggccgccaccatgtctgaggtggagtggaggggccgcacagtgcctgtgaagattgacaaggtgcgcatcttcctgctgggcctggccgacaatgaagctgccatcgtgcaggccgagagcgaggagaccaaggagcggctgtttgagagcatgctgtctgagtgcagagatgccatccaggtggtgcgggaggagctgaagccagaccagaagcagagggactacatcctggagggggagcccgggaaggtgagcaacctgcagtacctgcacagctacctgacctacatcaagctgagcacagccatcaagagaaatgaaaacatggccaagggcctgcagagggccctgctgcagcagcagccagaagatgacagcaagaggagcccccggccccaggacctgatccggctgtatgacatcatcctgcagaacctggtggagctgctgcagctgcccggcctggaggaggacaaggccttccagaaggagatcggcctgaagaccctggtgttcaaggcctaccgctgcttcttcatcgcccagagctatgtgctggtgaagaagtggagcgaggccctggtgctgtatgacagagtgctgaagtatgccaatgaggtgaacagtgatgctggggccttcaagaacagcctgaaggacctgcctgatgtgcaggagctgatcacccaggtgcgctctgagaagtgcagcctgcaggccgccgccatcctggatgccaatgatgcccaccagacagagaccagcagcagccaggtgaaggacaacaagcccctggtggagagatttgagaccttctgcctggaccccagcctggtgaccaagcaggccaacctggtgcacttccccccaggcttccagcccatcccctgcaagcccctcttctttgacctggccctgaaccacgtggccttcccccccctggaggacaagctggagcagaagaccaagagcggcctgaccggctacatcaagggcatcttcggcttccgctcctag

SEQ ID NO: 169753 - DNA, 984 bp, Artificial Sequence
  Description of Artificial Sequence: Synthetic coding sequence
atgcagatgaggctgcggagcggcggcacagagggcctgctggccgagaagctggaggccctgatcacccagacccgggccaagcaggccgccaccatgtctgaggtggagtggaggggccgcacagtgcctgtgaagattgacaaggtgcgcatcttcctgctgggcctggccgacaatgaggccgccatcgtgcaggccgagagcgaggagaccaaggagcggctgtttgagagcatgctgtctgaatgtagagatgccatccaggtggtgcgggaggagctgaagccagaccagaagcagagggactacatcctggagggggagcccgggaaggtgagcaacctgcagtacctgcacagctacctgacctacatcaagctgagcacagccatcaagagaaatgaaaacatggccaagggcctgcagagggccctgctgcagcagcagccagaagatgacagcaagaggagcccccggccccaggacctgatccggctgtatgacatcatcctgcagaacctggtggagctgctgcagctgcccggcctggaggaggacaaggccttccagaaggagatcggcctgaagaccctggtgttcaaggcctaccgctgcttcttcatcgcccagagctatgtgctggtgaagaagtggagcgaggccctggtgctgtatgacagagtgctgaagtatgccaatgaggtgaacagtgatgctggggccttcaagaacagcctgaaggacctgcctgatgtgcaggagctgatcacccaggtgcgctctgagaagtgcagcctgcaggccgccgccatcctggatgccaatgatgcccaccagacagagaccagcagcagccaggtgaaggacaacaagcccctggtggagagatttgagagcaccccaggcacagatggagccctgaagagatttgtgatgctgctgcagtaccacggctttgagatgaacagcagcctgctgtag

SEQ ID NO: 169754 - DNA, 1770 bp, Artificial Sequence
  Description of Artificial Sequence: Synthetic coding sequence
atggctgctgagaagcaggtgcctgggggcggcggcggcggcggcagcggcggcggcggcggcagcggcggcggcggcagcggcggcggcagaggagctggaggagaggagaacaaggaaaatgaaagaccttctgctggcagcaaggccaacaaggagtttggagacagcctgagcctggagatcctgcagatcatcaaggagagccagcagcagcacggcctgcggcatggagacttccagcgctaccgctacctgctgctggtgctgatggatgctgagcgggcctggagctatgccatgcagctgaagcaggaggccaacacagagcccaggaagcgcttccacctgctgagccggctgaggaaggctgtgaagcacgccgaggagctggagcggctgtgtgagagcaacagagtggatgccaagaccaagctggaggcccaggcctacacagcctacctgagcggcatgctgcgctttgagcaccaggagtggaaggccgccatcgaggccttcaacaagtgcaagaccatctatgagaagctggccagcgccttcacagaggagcaggccgtgctgtacaaccagagggtggaggagatcagccccaacatccgctactgtgcctacaacattggagaccagagcgccatcaatgagctgatgcagatgaggctgcggagcggcggcacagagggcctgctggccgagaagctggaggccctgatcacccagacccgggccaagcaggccgccaccatgtctgaggtggagtggaggggccgcacagtgcctgtgaagattgacaaggtgcgcatcttcctgctgggcctggccgacaatgaggccgccatcgtgcaggccgagagcgaggagaccaaggagcggctgtttgagagcatgctgtctgaatgtagagatgccatccaggtggtgcgggaggagctgaagccagaccagaagcagagggactacatcctggagggggagcccgggaaggtgagcaacctgcagtacctgcacagctacctgacctacatcaagctgagcacagccatcaagagaaatgaaaacatggccaagggcctgcagagggccctgctgcagcagcagccagaagatgacagcaagaggagcccccggccccaggacctgatccggctgtatgacatcatcctgcagaacctggtggagctgctgcagctgcccggcctggaggaggacaaggccttccagaaggagatcggcctgaagaccctggtgttcaaggcctaccgctgcttcttcatcgcccagagctatgtgctggtgaagaagtggagcgaggccctggtgctgtatgacagagtgctgaagtatgccaatgaggtgaacagtgatgctggggccttcaagaacagcctgaaggacctgcctgatgtgcaggagctgatcacccaggtgcgctctgagaagtgcagcctgcaggccgccgccatcctggatgccaatgatgcccaccagacagagaccagcagcagccaggtgaaggacaacaagcccctggtggagagatttgagaccttctgcctggaccccagcctggtgaccaagcaggccaacctggtgcacttccccccaggcttccagcccatcccctgcaagcccctcttctttgacctggccctgaaccacgtggccttcccccccctggaggacaagctggagcagaagaccaagagcggcctgaccggctacatcaagggcatcttcggcttccgctcctag

SEQ ID NO: 169755 - DNA, 1110 bp, Artificial Sequence
  Description of Artificial Sequence: Synthetic coding sequence
atggctgctgagaagcaggtgcctgggggcggcggcggcggcggcagcggcggcggcggcggcagcggcggcggcggcagcggcggcggcagaggagctggaggagaggagaacaaggaaaatgaaagaccttctgctggcagcaaggccaacaaggagtttggagacagcctgagcctggagatcctgcagatcatcaaggagagccagcagcagcacggcctgcggcatggagacttccagcgctaccggggctactgcagccggcggcagaggcggctgaggaagaccctgaacttcaagatgggcaacagacacaagttcaccgggaagaaggtgacagaggagctgctgacagacaaccgctacctgctgctggtgctgatggatgctgagcgggcctggagctatgccatgcagctgaagcaggaggccaacacagagcccaggaagcgcttccacctgctgagccggctgaggaaggctgtgaagcacgccgaggagctggagcggctgtgtgagagcaacagagtggatgccaagaccaagctggaggcccaggcctacacagcctacctgagcggcatgctgcgctttgagcaccaggagtggaaggccgccatcgaggccttcaacaagtgcaagaccatctatgagaagctggccagcgccttcacagaggagcaggccgtgctgtacaaccagagggtggaggagatcagccccaacatccgctactgtgcctacaacattggagaccagagcgccatcaatgagctgatgcagatgaggctgcggagcggcggcacagagggcctgctggccgagaagctggaggccctgatcacccagacccgggccaagcaggccgccaccatgtctgaggtggagtggaggggccgcacagtgcctgtgaagattgacaaggtgcgcatcttcctgctgggcctggccgacaatgaggccgccatcgtgcaggccgagagcgaggagaccaaggagcggctgtttgagagcatgctgtctgaatgtagagatgccatccaggtggtgcgggaggagctgaagccagaccagagggacctgctgctgcccagccagggccagtag

SEQ ID NO: 169756 - DNA, 867 bp, Artificial Sequence
  Description of Artificial Sequence: Synthetic coding sequence
atgctgtctgagtgcagagatgccatccaggtggtgcgggaggagctgaagccagaccagaagcagagggactacatcctggagggggagcccgggaaggtgagcaacctgcagtacctgcacagctacctgacctacatcaagctgagcacagccatcaagagaaatgaaaacatggccaagggcctgcagagggccctgctgcagcagcagccagaagatgacagcaagaggagcccccggccccaggacctgatccggctgtatgacatcatcctgcagaacctggtggagctgctgcagctgcccggcctggaggaggacaaggccttccagaaggagatcggcctgaagaccctggtgttcaaggcctaccgctgcttcttcatcgcccagagctatgtgctggtgaagaagtggagcgaggccctggtgctgtatgacagagtgctgaagtatgccaatgaggtgaacagtgatgctggggccttcaagaacagcctgaaggacctgcctgatgtgcaggagctgatcacccaggtgcgctctgagaagtgcagcctgcaggccgccgccatcctggatgccaatgatgcccaccagacagagaccagcagcagccaggtgaaggacaacaagcccctggtggagagatttgagaccttctgcctggaccccagcctggtgaccaagcaggccaacctggtgcacttccccccaggcttccagcccatcccctgcaagcccctcttctttgacctggccctgaaccacgtggccttcccccccctggaggacaagctggagcagaagaccaagagcggcctgaccggctacatcaagggcatcttcggcttccgctcctag

SEQ ID NO: 169757 - DNA, 2016 bp, Artificial Sequence
  Description of Artificial Sequence: Synthetic coding sequence
atggccagcggcggcagcggcggcgtgtctgtgcctgccctgtggagcgaggtgaacagatatggccagaatggagacttcacccgggccctgaagacagtgaacaagatcctgcagatcaacaaggatgatgtgacagccctgcactgcaaggtggtgtgcctgatccagaatggcagcttcaaggaggccctgaatgtcatcaacacccacaccaaggtgctggccaacaacagcctgagctttgagaaggcctactgtgagtaccgcctgaacagaattgaaaatgccctgaagaccattgaaagtgccaaccagcagacagacaagctgaaggagctgtatggccaggtgctgtaccgcctggagagatatgatgaatgtctggccgtgtacagagacctggtgaggaacagccaggatgattatgatgaggagaggaagaccaacctgtctgctgtggtggccgcccagagcaactgggagaaggtggtgcctgagaacctgggcctgcaggagggcacccatgagctgtgctacaacacagcctgtgccctgattggccagggccagctgaaccaggccatgaagatcctgcagaaggccgaggacctgtgcagaagaagcctgtctgaggacacagatggaacagaggaggacccccaggccgagctggccatcatccacggccagatggcctacatcctgcagctgcagggccgcacagaggaggccctgcagctgtacaaccagatcatcaagctgaagcccacagatgtgggcctgctggccgtcatcgccaacaacatcatcaccatcaacaaggaccagaatgtgtttgacagcaagaagaaggtgaagctgaccaatgctgagggcgtggagttcaagctgagcaagaagcagctgcaggccatcgagttcaacaaggccctgctggccatgtacaccaaccaggccgagcagtgcaggaagatcagcgccagcctgcagagccagagccctgagcacctgctgcctgtgctgatccaggccgcccagctgtgccgggagaagcagcacaccaaggccatcgagctgctgcaggagttcagtgaccagcacccagaaaatgctgctgagatcaagctgaccatggcccagctgaagatcagccagggcaacatcagcaaggcctgcctgatcctgcggagcattgaggagctgaagcacaagccaggcatggtgtctgccctggtgaccatgtacagccatgaggaggacatcgacagcgccatcgaggtgttcacccaggccatccagtggtaccagaaccaccagcccaagagccctgcccacctgagcctcatccgggaggccgccaacttcaagctgaagtatggcaggaagaaggaggccatcagtgacctgcagcagctgtggaagcagaaccccaaggacatccacaccctggcccagctgatcagcgcctacagcctggtggaccctgagaaggccaaggccctgagcaagcacctgcccagcagtgacagcatgagcctgaaggtggatgtggaggccctggagaacagcgctggggccacctacatcaggaagaagggcggcaaggtgactggagacagccagcccaaggagcagggccagggcgacctgaagaagaagaagaagaagaagaagggcaagctgcccaagaactatgaccccaaggtgaccccagaccctgagcgctggctgcccatgagggagaggagctactaccggggcaggaagaagggcaagaagaaggaccagatcggcaagggcacccagggcgccacagctggggccagcagcgagctggatgccagcaagacagtgagcagcccccccaccagcccccggcccggcagcgctgccaccgtgtctgccagcaccagcaacatcatccccccaagacaccagaagccagctggggccccagccaccaagaagaagcagcagcagaagaagaagaagggcggcaagggcggctggtag

SEQ ID NO: 169758 - DNA, 1878 bp, Artificial Sequence
  Description of Artificial Sequence: Synthetic coding sequence
cccctggtgagcagcaagatggccagcggcggcagcggcggcgtgtctgtgcctgccctgtggagcgaggtgaacagatatggccagaatggagacttcacccgggccctgaagacagtgaacaagatcctgcagatcaacaaggatgatgtgacagccctgcactgcaaggtggtgtgcctgatccagaatggcagcttcaaggaggccctgaatgtcatcaacacccacaccaaggtgctggccaacaacagcctgagctttgagaaggcctactgtgagtaccgcctgaacagaattgaaaatgccctgaagaccattgaaagtgccaaccagcagacagacaagctgaaggagctgtatggccaggtgctgtaccgcctggagagatatgatgaatgtctggccgtgtacagagacctggtgaggaacagccaggatgattatgatgaggagaggaagaccaacctgtctgctgtggtggccgcccagagcaactgggagaaggtggtgcctgagaacctgggcctgcaggagggcacccatgagctgtgctacaacacagcctgtgccctgattggccagggccagctgaaccaggccatgaagatcctgcagaaggccgaggacctgtgcagaagaagcctgtctgaggacacagaccagaatgtgtttgacagcaagaagaaggtgaagctgaccaatgctgagggcgtggagttcaagctgagcaagaagcagctgcaggccatcgagttcaacaaggccctgctggccatgtacaccaaccaggccgagcagtgcaggaagatcagcgccagcctgcagagccagagccctgagcacctgctgcctgtgctgatccaggccgcccagctgtgccgggagaagcagcacaccaaggccatcgagctgctgcaggagttcagtgaccagcacccagaaaatgctgctgagatcaagctgaccatggcccagctgaagatcagccagggcaacatcagcaaggcctgcctgatcctgcggagcattgaggagctgaagcacaagccaggcatggtgtctgccctggtgaccatgtacagccatgaagaagatattgattctgccatcgaggtgttcacccaggccatccagtggtaccagaaccaccagcccaagagccctgcccacctgagcctcatccgggaggccgccaacttcaagctgaagtatggcaggaagaaggaggccatcagtgacctgcagcagctgtggaagcagaaccccaaggacatccacaccctggcccagctgatcagcgcctacagcctggtggaccctgagaaggccaaggccctgagcaagcacctgcccagcagtgacagcatgagcctgaaggtggatgtggaggccctggagaacagcgctggggccacctacatcaggaagaagggcggcaaggtgactggagacagccagcccaaggagcagggccagggcgacctgaagaagaagaagaagaagaagaagggcaagctgcccaagaactatgaccccaaggtgaccccagaccctgagcgctggctgcccatgagggagaggagctactaccggggcaggaagaagggcaagaagaaggaccagatcggcaagggcacccagggcgccacagctggggccagcagcgagctggatgccagcaagacagtgagcagcccccccacccaggacctggccgtgctgcagcagtacctgcccctgcaggtgaccagctacccccaggacaccaggaacctgcagggcctgcagcagcagaagaggaacagcaacaggaagaggaggaaggtggagaaggtggccggagatgagaacatcctggtggccggctgcttctag

SEQ ID NO: 169759 - DNA, 1833 bp, Artificial Sequence
  Description of Artificial Sequence: Synthetic coding sequence
atggccagcggcggcagcggcggcgtgtctgtgcctgccctgtggagcgaggtgaacagatatggccagaatggagacttcacccgggccctgaagacagtgaacaagatcctgcagatcaacaaggatgatgtgacagccctgcactgcaaggtggtgtgcctgatccagaatggcagcttcaaggaggccctgaatgtcatcaacacccacaccaaggtgctggccaacaacagcctgagctttgagaaggcctactgtgagtaccgcctgaacagaattgaaaatgccctgaagaccattgaaagtgccaaccagcagacagacaagctgaaggagctgtatggccaggtgctgtaccgcctggagagatatgatgaatgtctggccgtgtacagagacctggtgaggaacagccaggatgattatgatgaggagaggaagaccaacctgtctgctgtggtggccgcccagagcaactgggagaaggtggtgcctgagaacctgggcctgcaggagggcacccatgagctgtgctacaacacagcctgtgccctgattggccagggccagctgaaccaggccatgaagatcctgcagaaggccgaggacctgtgcagaagaagcctgtctgaggacacagaccagaatgtgtttgacagcaagaagaaggtgaagctgaccaatgctgagggcgtggagttcaagctgagcaagaagcagctgcaggccatcgagttcaacaaggccctgctggccatgtacaccaaccaggccgagcagtgcaggaagatcagcgccagcctgcagagccagagccctgagcacctgctgcctgtgctgatccaggccgcccagctgtgccgggagaagcagcacaccaaggccatcgagctgctgcaggagttcagtgaccagcacccagaaaatgctgctgagatcaagctgaccatggcccagctgaagatcagccagggcaacatcagcaaggcctgcctgatcctgcggagcattgaggagctgaagcacaagccaggcatggtgtctgccctggtgaccatgtacagccatgaagaagatattgattctgccatcgaggtgttcacccaggccatccagtggtaccagaaccaccagcccaagagccctgcccacctgagcctcatccgggaggccgccaacttcaagctgaagtatggcaggaagaaggaggccatcagtgacctgcagcagctgtggaagcagaaccccaaggacatccacaccctggcccagctgatcagcgcctacagcctggtggaccctgagaaggccaaggccctgagcaagcacctgcccagcagtgacagcatgagcctgaaggtggatgtggaggccctggagaacagcgctggggccacctacatcaggaagaagggcggcaaggtgactggagacagccagcccaaggagcagggccagggcgacctgaagaagaagaagaagaagaagaagggcaagctgcccaagaactatgaccccaaggtgaccccagaccctgagcgctggctgcccatgagggagaggagctactaccggggcaggaagaagggcaagaagaaggaccagatcggcaagggcacccagggcgccacagctggggccagcagcgagctggatgccagcaagacagtgagcagcccccccaccagccccaggcctggcagcgctgccaccgtgtctgccagcaccagcaacatcatcccccccaggcaccagaagccagctggggccccagccaccaagaagaagcagcagcagaagaagaagaagggcggcaaaggaggctggtag

SEQ ID NO: 169760 - DNA, 1917 bp, Artificial Sequence
  Description of Artificial Sequence: Synthetic coding sequence
atgctggacttcttcaccatcttcagcaagggcggcctggtgctgtggtgcttccagggcgtgtctgacagctgcaccggccctgtgaatgccctgatccgctctgtgctgctgcaggagcggggcggcaacaacagcttcacccatgaggccctgaccctgaagtacaagctggacaaccagtttgagctggtgtttgtggtgggcttccagaagatcctgaccctgacctacgtggacaagctgattgatgatgtgcacaggctcttccgggacaagtacagaacagagatccagcagcagagcgccctgagcctgctgaatggcacctttgacttccagaatgacttcctgcggctgctgcgggaggccgaggagagcagcaagatccgggcccccaccaccatgaagaagtttgaggacagcgagaaggccaagaagcctgtgcgctccatgattgagaccagaggagagaagcccaaggagaaggccaagaacagcaagaagaagggggccaagaaggagggcagtgatggccccctggccaccagcaagcctgtgcctgctgagaagagcggcctgcctgtgggcccagaaaatggagtggagctgagcaaggaggagctgatccggaggaagcgggaggagttcatccagaagcacggccggggcatggagaagagcaacaagagcaccaagagtgatgcccccaaggagaagggcaagaaggccccccgggtgtgggagctgggcggctgtgccaacaaggaggtgctggactacagcacccccaccaccaacggcaccccagaggccgccctgtctgaggacatcaacctgatccggggcaccggcagcggcggccagctgcaggacctggactgcagcagcagtgatgatgagggcgccgcccagaacagcaccaagcccagcgccaccaagggcaccctgggcggcatgtttggcatgctgaagggcctggtgggcagcaagagcctgagccgggaggacatggagagcgtgctggacaagatgagggaccacctgattgccaagaatgtggccgctgacattgctgtgcagctgtgtgagagcgtggccaacaagctggagggcaaggtgatgggcaccttcagcacagtgaccagcacagtgaagcaggccctgcaggagagcctggtgcagatcctgcagccccagaggagagtggacatgctgcgggacatcatggatgcccagaggcggcagaggccctacgtggtgaccttctgtggggtgaatggagtgggcaagagcaccaacctggccaagatctccttctggctgctggagaatggcttctctgtgctgattgctgcctgtgacaccttccgggccggggctgtggagcagctgcggacccacacccggcggctgagcgccctgcaccccccagagaagcatggaggccgcaccatggtgcagctgtttgagaagggctacggcaaggatgctgctggcatcgccatggaggccatcgcctttgccaggaaccagggctttgatgtggtgctggtggacacagctggccgcatgcaggacaatgcccccctgatgacagccctggccaagctgatcaccgtgaacaccccagacctggtgctgtttgtgggggaggccctggtgggcaatgaagctgtggaccagctggtgaagttcaacagagccctggccgaccacagcatggcccagaccccccggctgattgatggcatcgtgctgaccaagtttgacaccattgatgacaaggtgggcgccgccatctccatgacctacatcaccagcaagcccatcgtgtttgtgggcaccggccagacctactgtgacctgcggagcctgaatgccaaggctgtggtggccgccctgatgaaggcctag

SEQ ID NO: 169761 - DNA, 552 bp, Artificial Sequence
  Description of Artificial Sequence: Synthetic coding sequence
atgaggctgctgagctttgtggtgctggccctgtttgctgtgacccaggccgaggagggcgcccggctgctggccagcaagagcctgctgaacagatatgctgtggagggccgggacctgaccctgcagtacaacatctacaacgtgggcagcagcgctgccctggatgtggagctgagtgatgacagcttccccccagaagattttggaattgtgtctggcatgctgaatgtgaagtgggacagaattgccccagccagcaatgtgagccacacagtggtgctgcggcccctgaaggccggctacttcaacttcaccagcgccaccatcacctacctggcccaggaggatggccctgtggtgattggcagcaccagcgcccctggccagggcggcatcctggcccagcgggagtttgaccggcgcttcagcccccacttcctggactgggccgcctttggagtgatgaccctgcccagcatcggcatccccctgctgctgtggtacagcagcaagaggaaatatgacacccccaagaccaagaagaactag

SEQ ID NO: 169762 - DNA, 552 bp, Artificial Sequence; identical to SEQ ID NO: 169761
  Description of Artificial Sequence: Synthetic coding sequence

SEQ ID NO: 169763 - DNA, 258 bp, Artificial Sequence
  Description of Artificial Sequence: Synthetic coding sequence
atgaggctgctgagctttgtggtgctggccctgtttgctgtgacccaggccgaggagggcgcccggctgctggccagcaagagcctgctgaacagatatgctgtggagggccgggacctgaccctgcagtacaacatctacaacgtgggcagcagcgctgccctggatgtggagctgagtgatgacagcttccccccagaagattttggaattgtgtctggcatgctgaatgtgaagtgggacagaattgccccctag

SEQ ID NO: 169764 - DNA, 444 bp, Artificial Sequence
  Description of Artificial Sequence: Synthetic coding sequence
atgaggctgctgagctttgtggtgctggccctgtttgctgtgacccaggccgaggagggcgcccggctgctggccagcaagagcctgctgaacagatatgctgtggagggccgggacctgaccctgcagtacaacatctacaacgtgggcagcagcgctgccctggatgtggagctgagtgatgacagcttccccccagaagattttggaattgtgtctggcatgctgaatgtgaagtgggacagaattgccccagccagcaatgtgagccacacagtggtgctgcggcccctgaaggccggctacttcaacttcaccagcgccaccatcacctacctggcccaggaggatggccctgtggtgattggcagcaccagcgcccctggccagggcggcatcctggcccagcgggagtttgaccggcgcttcagcccccacttctag

SEQ ID NO: 169765 - DNA, 522 bp, Artificial Sequence
  Description of Artificial Sequence: Synthetic coding sequence
atggccgccatggccagcctgggcgccctggccctgctgctgctgagcagcctgagccgctgcagcgctgaggcctgcctggagccccagatcacccccagctactacaccaccagtgatgctgtgatcagcacagaaacagtgttcatcgtggagatcagcctgacctgcaagaacagagtgcagaacatggccctgtatgcagatgtgggcggcaagcagtttcctgtgacccggggccaggatgtgggccgctaccaggtgtcctggagcctggaccacaagagcgcccatgctggcacctatgaggtgcgcttctttgatgaggagagctacagcctgctgaggaaggcccagaggaacaatgaagacatcagcatcatccccccactcttcaccgtgtctgtggaccaccggggcacctggaatggcccctgggtgtccacagaggtgctggccgccgccatcggcctggtgatctactacctggccttcagcgccaagagccacatccaggcctag

SEQ ID NO: 169766 - DNA, 447 bp, Artificial Sequence
  Description of Artificial Sequence: Synthetic coding sequence
atggccgccatggccagcctgggcgccctggccctgctgctgctgagcagcctgagccgctgcagcgctgaggcctgcctggagccccagatcacccccagctactacaccaccagtgatgctgtgatcagcacagaaacagtgttcatcgtggagatcagcctgacctgcaagaacagagtgcaggtgtcctggagcctggaccacaagagcgcccacgccggcacctatgaggtgcgcttctttgatgaggagagctacagcctgctgaggaaggcccagagaaataatgaagacatcagcatcatccccccactcttcaccgtgtctgtggaccaccggggcacctggaatggcccctgggtgtccacagaggtgctggccgccgccatcggcctggtgatctactacctggccttcagcgccaagagccacatccaggcctag

SEQ ID NO: 169767 - DNA, 522 bp, Artificial Sequence; identical to SEQ ID NO: 169765
  Description of Artificial Sequence: Synthetic coding sequence

SEQ ID NO: 169768 - DNA, 522 bp, Artificial Sequence; identical to SEQ ID NO: 169765
  Description of Artificial Sequence: Synthetic coding sequence

SEQ ID NO: 169769 - DNA, 363 bp, Artificial Sequence
  Description of Artificial Sequence: Synthetic coding sequence
tgagtgggcagcggctgccgctctgctgctgtgtctgccctggtggtgcgggtggccccaccctgccccctgtgcccccacagcgcccagcaccccacccaggtgtcctggagcctggaccacaagagcgcccacgccggcacctatgaggtgcgcttctttgatgaggagagctacagcctgctgaggaaggcccagagaaataatgaagacatcagcatcatccccccactcttcaccgtgtctgtggaccaccggggcacctggaatggcccctgggtgtccacagaggtgctggccgccgccatcggcctggtgatctactacctggccttcagcgccaagagccacatccaggcctag

SEQ ID NO: 169770 - DNA, 2544 bp, Artificial Sequence
  Description of Artificial Sequence: Synthetic coding sequence
atgagcctgtggggcctggtgtccaagatgcctcctgagaaggtgcagaggctgtatgtggacttcccccagcacctgcggcacctgctgggggactggctggagagccagccctgggagttcctggtgggcagtgatgccttctgctgcaacctggccagcgccctgctgagtgacacagtgcagcacctgcaggcctctgtgggggagcagggcgagggcagcaccatcctgcagcacatcagcaccctggagagcatctaccagagggaccccctgaagctggtggccaccttccggcagatcctgcagggcgagaagaaggctgtgatggagcagttccgccacctgcccatgcccttccactggaagcaggaggagctgaagttcaagacaggcctgcggcggctgcagcaccgggtgggggagatccacctgctgcgggaggccctgcagaagggagctgaggccggccaggtgtccctgcacagcctcatcgagaccccagccaatggaacaggccccagcgaggccctggccatgctgctgcaggagaccactggagagctggaggccgccaaggccctggtgctgaagaggatccagatctggaagaggcagcagcagctggccggaaatggagccccctttgaggagagcctggcccccctgcaggagcgctgtgagagcctggtggacatctacagccagctgcagcaggaggtgggcgctgctggaggagagctggagcccaagacccgggccagcctgaccggccgcctggatgaggtgctgcggaccctggtgaccagctgcttcctggtggagaagcagcccccccaggtgctgaagacccagaccaagttccaggccggcgtgcgcttcctgctgggcctgcgcttcctgggcgccccagccaagccacccctggtgcgggctgacatggtgacagagaagcaggcccgggagctgtctgtgccccagggccctggggccggggctgagagcactggagagatcatcaacaacacagtgcccctggagaacagcatccctggcaactgctgcagcgccctcttcaagaacctgctgctgaagaagatcaagagatgtgagaggaagggcacagagagcgtgacagaggagaagtgtgctgtgctcttcagcgccagcttcaccctgggccctgggaagctgcccatccagctgcaggccctgagcctgcccctggtggtgattgtgcacggcaaccaggacaacaatgccaaggccaccatcctgtgggacaatgccttcagcgagatggacagagtgccctttgtggtggccgagcgggtgccctgggagaagatgtgtgagaccctgaacctgaagttcatggccgaggtgggcaccaacagaggcctgctgcctgagcacttcctgttcctggcccagaagatcttcaatgacaacagcctgtccatggaggccttccagcacaggtctgtgtcctggagccagttcaacaaggagatcctgctgggccggggcttcaccttctggcagtggtttgatggagtgctggacctgaccaagcgctgcctgcggagctactggagcgacaggctcatcatcggcttcatcagcaagcagtatgtgaccagcctgctgctgaatgaaccagatggcaccttcctgctgcgcttcagtgacagcgagatcggcggcatcaccatcgcccacgtgatccggggccaggacggcagcccccagatcgagaacatccagcccttcagcgccaaggacctgagcatccgcagcctgggggaccgcatccgggacctggcccagctgaagaacctgtaccccaagaagcccaaggatgaggccttccgcagccactacaagccagagcagatgggcaaggatggccggggctacgtgcctgccaccatcaagatgacagtggagcgggaccagcccctgcccaccccagagctgcagatgcccaccatggtgcccagctatgacctgggcatggccccagacagctccatgtccatgcagctgggccctgacatggtgccccaggtgtacccaccccacagccacagcatccccccctaccagggcctgagccctgaggagagcgtgaatgtgctgagcgccttccaggagccccacctgcagatgccacccagcctgggccagatgagcctgccctttgaccagccccacccccagggcctgctgccctgccagccccaggagcacgctgtgagcagcccagaccccctgctgtgcagtgatgtgaccatggtggaggacagctgcctgagccagcctgtgacagccttcccccagggcacctggattggagaggacatcttcccccccctgctgcccccaacagagcaggacctgaccaagctgctgctggagggccagggcgagagcggcggcggcagcctgggcgcccagcccctgctgcagcccagccactacggccagagcggcatctccatgagccacatggacctgcgggccaaccccagctggtag

SEQ ID NO: 169771 - DNA, 2544 bp, Artificial Sequence; identical to SEQ ID NO: 169770
  Description of Artificial Sequence: Synthetic coding sequence

SEQ ID NO: 169772 - DNA, 2214 bp, Artificial Sequence
  Description of Artificial Sequence: Synthetic coding sequence
atggagcagttccgccacctgcccatgcccttccactggaagcaggaggagctgaagttcaagacaggcctgcggcggctgcagcaccgggtgggggagatccacctgctgcgggaggccctgcagaagggagctgaggccggccaggtgtccctgcacagcctcatcgagaccccagccaatggaacaggccccagcgaggccctggccatgctgctgcaggagaccactggagagctggaggccgccaaggccctggtgctgaagaggatccagatctggaagaggcagcagcagctggccggaaatggagccccctttgaggagagcctggcccccctgcaggagcgctgtgagagcctggtggacatctacagccagctgcagcaggaggtgggcgctgctggaggagagctggagcccaagacccgggccagcctgaccggccgcctggatgaggtgctgcggaccctggtgaccagctgcttcctggtggagaagcagcccccccaggtgctgaagacccagaccaagttccaggccggcgtgcgcttcctgctgggcctgcgcttcctgggcgccccagccaagccacccctggtgcgggctgacatggtgacagagaagcaggcccgggagctgtctgtgccccagggccctggggccggggctgagagcactggagagatcatcaacaacacagtgcccctggagaacagcatccctggcaactgctgcagcgccctcttcaagaacctgctgctgaagaagatcaagagatgtgagaggaagggcacagagagcgtgacagaggagaagtgtgctgtgctcttcagcgccagcttcaccctgggccctgggaagctgcccatccagctgcaggccctgagcctgcccctggtggtgattgtgcacggcaaccaggacaacaatgccaaggccaccatcctgtgggacaatgccttcagcgagatggacagagtgccctttgtggtggccgagcgggtgccctgggagaagatgtgtgagaccctgaacctgaagttcatggccgaggtgggcaccaacagaggcctgctgcctgagcacttcctgttcctggcccagaagatcttcaatgacaacagcctgtccatggaggccttccagcacaggtctgtgtcctggagccagttcaacaaggagatcctgctgggccggggcttcaccttctggcagtggtttgatggagtgctggacctgaccaagcgctgcctgcggagctactggagcgacaggctcatcatcggcttcatcagcaagcagtatgtgaccagcctgctgctgaatgaaccagatggcaccttcctgctgcgcttcagtgacagcgagatcggcggcatcaccatcgcccacgtgatccggggccaggacggcagcccccagatcgagaacatccagcccttcagcgccaaggacctgagcatccgcagcctgggggaccgcatccgggacctggcccagctgaagaacctgtaccccaagaagcccaaggatgaggccttccgcagccactacaagccagagcagatgggcaaggatggccggggctacgtgcctgccaccatcaagatgacagtggagcgggaccagcccctgcccaccccagagctgcagatgcccaccatggtgcccagctatgacctgggcatggccccagacagctccatgtccatgcagctgggccctgacatggtgccccaggtgtacccaccccacagccacagcatccccccctaccagggcctgagccctgaggagagcgtgaatgtgctgagcgccttccaggagccccacctgcagatgccacccagcctgggccagatgagcctgccctttgaccagccccacccccagggcctgctgccctgccagccccaggagcacgctgtgagcagcccagaccccctgctgtgcagtgatgtgaccatggtggaggacagctgcctgagccagcctgtgacagccttcccccagggcacctggattggagaggacatcttcccccccctgctgcccccaacagagcaggacctgaccaagctgctgctggagggccagggcgagagcggcggcggcagcctgggcgcccagcccctgctgcagcccagccactacggccagagcggcatctccatgagccacatggacctgcgggccaaccccagctggtag

SEQ ID NO: 169773 - DNA, 2214 bp, Artificial Sequence; identical to SEQ ID NO: 169772
  Description of Artificial Sequence: Synthetic coding sequence

SEQ ID NO: 169774 - DNA, 2214 bp, Artificial Sequence; identical to SEQ ID NO: 169772
  Description of Artificial Sequence: Synthetic coding sequence

SEQ ID NO: 169775 - DNA, 2040 bp, Artificial Sequence
  Description of Artificial Sequence: Synthetic coding sequence
atgagcctgtggggcctggtgtccaagatgcctcctgagaaggtgcagaggctgtatgtggacttcccccagcacctgcggcacctgctgggggactggctggagagccagccctgggagttcctggtgggcagtgatgccttctgctgcaacctggccagcgccctgctgagtgacacagtgcagcacctgcaggcctctgtgggggagcagggcgagggcagcaccatcctgcagcacatcagcaccctggagagcatctaccagagggaccccctgaagctggtggccaccttccggcagatcctgcagggcgagaagaaggctgtgatggagcagttccgccacctgcccatgcccttccactggaagcaggaggagctgaagttcaagacaggcctgcggcggctgcagcaccgggtgggggagatccacctgctgcgggaggccctgcagaagggagctgaggccggccaggtgtccctgcacagcctcatcgagaccccagccaatggaacaggccccagcgaggccctggccatgctgctgcaggagaccactggagagctggaggccgccaaggccctggtgctgaagaggatccagatctggaagaggcagcagcagctggccggaaatggagccccctttgaggagagcctggcccccctgcaggagcgctgtgagagcctggtggacatctacagccagctgcagcaggaggtgggcgctgctggaggagagctggagcccaagacccgggccagcctgaccggccgcctggatgaggtgctgcggaccctggtgaccagctgcttcctggtggagaagcagcccccccaggtgctgaagacccagaccaagttccaggccggcgtgcgcttcctgctgggcctgcgcttcctgggcgccccagccaagccacccctggtgcgggctgacatggtgacagagaagcaggcccgggagctgtctgtgccccagggccctggggccggggctgagagcactggagagatcatcaacaacacagtgcccctggagaacagcatccctggcaactgctgcagcgccctcttcaagaacctgctgctgaagaagatcaagagatgtgagaggaagggcacagagagcgtgacagaggagaagtgtgctgtgctcttcagcgccagcttcaccctgggccctgggaagctgcccatccagctgcaggccctgagcctgcccctggtggtgattgtgcacggcaaccaggacaacaatgccaaggccaccatcctgtgggacaatgccttcagcgagatggacagagtgccctttgtggtggccgagcgggtgccctgggagaagatgtgtgagaccctgaacctgaagttcatggccgaggtgggcaccaacagaggcctgctgcctgagcacttcctgttcctggcccagaagatcttcaatgacaacagcctgtccatggaggccttccagcacaggtctgtgtcctggagccagttcaacaaggagatcctgctgggccggggcttcaccttctggcagtggtttgatggagtgctggacctgaccaagcgctgcctgcggagctactggagcgacaggctcatcatcggcttcatcagcaagcagtatgtgaccagcctgctgctgaatgaaccagatggcaccttcctgctgcgcttcagtgacagcgagatcggcggcatcaccatcgcccacgtgatccggggccaggacggcagcccccagatcgagaacatccagcccttcagcgccaaggacctgagcatccgcagcctgggggaccgcatccgggacctggcccagctgaagaacctgtaccccaagaagcccaaggatgaggccttccgcagccactacaagccagagcagatgggcaaggatggccggggctacgtgcctgccaccatcaagatgacagtggagcgggaccagcccctgcccaccccagagctgcagatgcccaccatggtgcccagctatgacctgggcatggccctgatccccccatag

SEQ ID NO: 169776 - DNA, 2193 bp, Artificial Sequence
  Description of Artificial Sequence: Synthetic coding sequence
atggagcagttccgccacctgcccatgcccttccactggaagcaggaggagctgaagttcaagacaggcctgcggcggctgcagcaccgggtgggggagatccacctgctgcgggaggccctgcagaagggagctgaggccggccaggtgtccctgcacagcctcatcgagaccccagccaatggaacaggccccagcgaggccctggccatgctgctgcaggagaccactggagagctggaggccgccaaggccctggtgctgaagaggatccagatctggaagaggcagcagcagctggccggaaatggagccccctttgaggagagcctggcccccctgcaggagcgctgtgagagcctggtggacatctacagccagctgcagcaggaggtgggcgctgctggaggagagctggagcccaagacccgggccagcctgaccggccgcctggatgaggtgctgcggaccctggtgaccagctgcttcctggtggagaagcagcccccccaggtgctgaagacccagaccaagttccaggccggcgtgcgcttcctgctgggcctgcgcttcctgggcgccccagccaagccacccctggtgcgggctgacatggtgacagagaagcaggcccgggagctgtctgtgccccagggccctggggccggggctgagagcactggagagatcatcaacaacacagtgcccctggagaacagcatccctggcaactgctgcagcgccctcttcaagaacctgctgctgaagaagatcaagagatgtgagaggaagggcacagagagcgtgacagaggagaagtgtgctgtgctcttcagcgccagcttcaccctgggccctgggaagctgcccatccagctgcaggccctgagcctgcccctggtggtgattgtgcacggcaaccaggacaacaatgccaaggccaccatcctgtgggacaatgccttcagcgagatggacagagtgccctttgtggtggccgagcgggtgccctgggagaagatgtgtgagaccctgaacctgaagttcatggccgaggtgggcaccaacagaggcctgctgcctgagcacttcctgttcctggcccagaagatcttcaatgacaacagcctgtccatggaggccttccagcacaggtctgtgtcctggagccagttcaacaaggagatcctgctgggccggggcttcaccttctggcagtggtttgatggagtgctggacctgaccaagcgctgcctgcggagctactggagcgacaggctcatcatcggcttcatcagcaagcagtatgtgaccagcctgctgctgaatgaaccagatggcaccttcctgctgcgcttcagtgacagcgagatcggcggcatcaccatcgcccacgtgatccggggccaggacggcagcccccagatcgagaacatccagcccttcagcgccaaggacctgagcatccgcagcctgggggaccgcatccgggacctggcccagctgaagaacctgtaccccaagaagcccaaggatgaggccttccgcagccactacaagccagagcagatgggcaaggatggccggggctacgtgcctgccaccatcaagatgacagtggagcgggaccagcccctgcccaccccagagctgcagatgcccaccatggtgcccagctatgacctgggcatggccccagacagctccatgtccatgcagctgggccctgacatggtgccccaggtgtacccaccccacagccacagcatccccccctaccagggcctgagccctgaggagagcgtgaatgtgctgagcgccttccaggagccccacctgcagatgccacccagcctgggccagatgagcctgccctttgaccagccccacccccagggcctgctgccctgccagccccaggagcacgctgtgagcagcccagaccccctgctgtgcagtgatgtgaccatggtggaggacagctgcctgagccagcctgtgacagccttcccccagggcacctggattggagaggacatcttcccccccctgctgcccccaacagagcaggacctgaccaagctgctgctggagggccagggcgagagcggcggcggcagcctgggccacagccccagctgcagcccccccaccatgggcaacctgggcagccagtgccccacctggacctag

SEQ ID NO: 169777 - DNA, 2544 bp, Artificial Sequence; identical to SEQ ID NO: 169770
  Description of Artificial Sequence: Synthetic coding sequence

SEQ ID NO: 169778 - DNA, 195 bp, Artificial Sequence
  Description of Artificial Sequence: Synthetic coding sequence
atgagcctgtggggcctggtgtccaagatgcctcctgagaaggtgcagaggctgtatgtggacttcccccagcacctgcggcacctgctgggggactggctggagagccagccctgggagttcctggtgggcagtgatgccttctgctgcaacctggccagcgccctgctgagtgacacagtgcagcacctgtag

SEQ ID NO: 169779 - DNA, 435 bp, Artificial Sequence
  Description of Artificial Sequence: Synthetic coding sequence
atgagcctgtggggcctggtgtccaagatgcctcctgagaaggtgcagaggctgtatgtggacttcccccagcacctgcggcacctgctgggggactggctggagagccagccctgggagttcctggtgggcagtgatgccttctgctgcaacctggccagcgccctgctgagtgacacagtgcagcacctgcaggcctctgtgggggagcagggcgagggcagcaccatcctgcagcacatcagcaccctggagagcatctaccagagggaccccctgaagctggtggccaccttccggcagatcctgcagggcgagaagaaggctgtgatggagcagttccgccacctgcccatgcccttccactggaagcaggaggagctgaagttcaagacaggcctgcggcggctgcagcaccgggtgggggagatctag

SEQ ID NO: 169780 - DNA, 465 bp, Artificial Sequence
  Description of Artificial Sequence: Synthetic coding sequence
atgagcctgtggggcctggtgtccaagatgcctcctgagaaggtgcagaggctgtatgtggacttcccccagcacctgcggcacctgctgggggactggctggagagccagccctgggagttcctggtgggcagtgatgccttctgctgcaacctggccagcgccctgctgagtgacacagtgcagcacctgcaggcctctgtgggggagcagggcgagggcagcaccatcctgcagcacatcagcaccctggagagcatctaccagagggaccccctgaagctggtggccaccttccggcagatcctgcagggcgagaagaaggctgtgatggagcagttccgccacctgcccatgcccttccactggaagcaggaggagctgaagttcaagacaggcctgcggcggctgcagcaccgggtgggggagatccacctgctgcgggaggccctgcagaagggctag

SEQ ID NO: 169781 - DNA, 318 bp, Artificial Sequence
  Description of Artificial Sequence: Synthetic coding sequence
atgagcctgtggggcctggtgtccaagatgcctcctgagaaggtgcagaggctgtatgtggacttcccccagcacctgcggcacctgctgggggactggctggagagccagccctgggagttcctggtgggcagtgatgccttctgctgcaacctggccagcgccctgctgagtgacacagtgcagcacctgcaggcctctgtgggggagcagggcgagggcagcaccatcctgcagcacatcagcaccctggagagcatctaccagagggaccccctgaagctggtggccaccttccggcagatcctgcagggctag

SEQ ID NO: 169782 - DNA, 312 bp, Artificial Sequence
  Description of Artificial Sequence: Synthetic coding sequence
atgagcctgtggggcctggtgtccaagatgcctcctgagaaggtgcagaggctgtatgtggacttcccccagcacctgcggcacctgctgggggactggctggagagccagccctgggagttcctggtgggcagtgatgccttctgctgcaacctggccagcgccctgctgagtgacacagtgcagcacctgcaggcctctgtgggggagcagggcgagggcagcaccatcctgcagcacatcagcaccctggagagcatctaccagagggaccccctgaagctggtggccaccttccggcagatcctgtag

SEQ ID NO: 169783 - DNA, 480 bp, Artificial Sequence
  Description of Artificial Sequence: Synthetic coding sequence
atgagcctgtggggcctggtgtccaagatgcctcctgagaaggtgcagaggctgtatgtggacttcccccagcacctgcggcacctgctgggggactggctggagagccagccctgggagttcctggtgggcagtgatgccttctgctgcaacctggccagcgccctgctgagtgacacagtgcagcacctgcaggcctctgtgggggagcagggcgagggcagcaccatcctgcagcacatcagcaccctggagagcatctaccagagggaccccctgaagctggtggccaccttccggcagatcctgcagggcgagaagaaggctgtgatggagcagttccgccacctgcccatgcccttccactggaagcaggaggagctgaagttcaagacaggcctgcggcggctgcagcaccgggtgggggagatccacctgctgcgggaggccctgcagaagggagctgaggccggccagtag

SEQ ID NO: 169784 - DNA, 2544 bp, Artificial Sequence; identical to SEQ ID NO: 169770
  Description of Artificial Sequence: Synthetic coding sequence

SEQ ID NO: 169785 - DNA, 225 bp, Artificial Sequence
  Description of Artificial Sequence: Synthetic coding sequence
atgagcctgtggggcctggtgtccaagatgcctcctgagaaggtgcagaggctgtatgtggacttcccccagcacctgcggcacctgctgggggactggctggagagccagccctgggagttcctggtgggcagtgatgccttctgctgcaacctggccagcgccctgctgagtgacacagtgcagcacctgcaggcctctgtgggggagcagggcgagggctag

SEQ ID NO: 169786 - DNA, 564 bp, Artificial Sequence
  Description of Artificial Sequence: Synthetic coding sequence
atgctgggccaccccaaggtgtgtgagaagctgaaggccctgatggtggagtggacagatgagttcaagaatgacccccagctgagcctcatcagcgccatgatcaagaacctgaaggagcagggcgtgaccttccctgccatcggcagccaggccgctgagcaggccaaggccagccctgccctggtggccaaggaccccggcaccgtggccaacaagaaggaggaggaggacctggccaaggccatcgagctgagcctgaaggagcagaggcagcagagcaccaccctgagcaccctgtaccccagcaccagcagcctgctgaccaaccaccagcacgagggcaggaaggtgcgggccatctatgactttgaggccgctgaggacaatgagctgaccttcaaggccggggagatcatcaccgtgctggatgacagcgaccccaactggtggaagggggagacccaccagggcatcggcctcttccccagcaactttgtgacagctgacctgacagctgagcctgagatgatcaagacagagaagaagacagtgcagttctag

SEQ ID NO: 169787 - DNA, 1623 bp, Artificial Sequence
  Description of Artificial Sequence: Synthetic coding sequence
atgcccctgtttgccaccaacccctttgaccaggatgtggagaaggccaccagcgagatgaacacagctgaggactggggcctcatcctggacatctgtgacaaggtgggccagagcaggacaggccccaaggactgcctgcggagcatcatgagaagagtgaaccacaaggacccccacgtggccatgcaggccctgaccctgctgggcgcctgtgtgagcaactgtgggaagatcttccacctggaggtgtgcagccgggactttgccagcgaggtgtccaatgtgctgaacaagggccaccccaaggtgtgtgagaagctgaaggccctgatggtggagtggacagatgagttcaagaatgacccccagctgagcctcatcagcgccatgatcaagaacctgaaggagcagggcgtgaccttccctgccatcggcagccaggccgctgagcaggccaaggccagccctgccctggtggccaaggaccccggcaccgtggccaacaagaaggaggaggaggacctggccaaggccatcgagctgagcctgaaggagcagaggcagcagagcaccaccctgagcaccctgtaccccagcaccagcagcctgctgaccaaccaccagcacgagggcaggaaggtgcgggccatctatgactttgaagctgctgaagataatgagctgaccttcaaggccggggagatcatcaccgtgctggatgacagcgaccccaactggtggaagggggagacccaccagggcatcggcctcttccccagcaactttgtgacagctgacctgacagctgagcctgagatgatcaagacagagaagaagacagtgcagttcagtgatgatgtgcaggtggagaccatcgagcctgagcctgagcccgccttcattgatgaggacaagatggaccagctgctgcagatgctgcagagcacagaccccagtgatgaccagcctgacctgcctgagctgctgcacctggaggccatgtgccaccagatgggccccctgattgatgagaagctggaggacatcgacaggaagcacagcgagctgtctgagctgaatgtgaaggtgatggaggccctgagcctgtacaccaagctgatgaatgaagaccccatgtacagcatgtatgccaagctgcagaaccagccctactacatgcagagcagtggagtgtctggcagccaggtgtatgccggccccccaccttctggggcctacctggtggccggaaatgcccagatgagccacctgcagagctacagcctgcccccagagcagctgagcagcctgagccaggccgtggtgccccccagcgccaacccagccctgcccagccagcagacccaggccgcctaccccaacaccatggtgtcctctgtgcagggcaacacctaccccagccaggcccctgtgtacagccccccacctgctgccacagctgctgctgccacagcagatgtgaccctgtaccagaatgccggccccaacatgccccaggtgcccaactacaacctgaccagcagcaccctgccccagcccggcggcagccagcagcccccccagccccagcagccctacagccagaaggccctgctgtag

SEQ ID NO: 169788 - DNA, 357 bp, Artificial Sequence
  Description of Artificial Sequence: Synthetic coding sequence
atgagaagagtgaaccacaaggacccccacgtggccatgcaggccctgaccctgctgggcgcctgtgtgagcaactgtgggaagatcttccacctggaggtgtgcagccgggactttgccagcgaggtgtccaatgtgctgaacaagggccaccccaaggtgtgtgagaagctgaaggccctgatggtggagtggacagatgagttcaagaatgacccccagctgagcctcatcagcgccatgatcaagaacctgaaggagcagggcgtgaccttccctgccatcggcagccaggccgctgagcaggccaaggccagccctgccctggtggccaaggaccccggcaccgtggcctag

SEQ ID NO: 169789 - DNA, 1290 bp, Artificial Sequence
  Description of Artificial Sequence: Synthetic coding sequence
atggtggagtggacagatgagttcaagaatgacccccagctgagcctcatcagcgccatgatcaagaacctgaaggagcagggcgtgaccttccctgccatcggcagccaggccgctgagcaggccaaggccagccctgccctggtggccaaggaccccggcaccgtggccaacaagaaggaggaggaggacctggccaaggccatcgagctgagcctgaaggagcagaggcagcagagcaccaccctgagcaccctgtaccccagcaccagcagcctgctgaccaaccaccagcacgagggcaggaaggtgcgggccatctatgactttgaggccgctgaggacaatgagctgaccttcaaggccggggagatcatcaccgtgctggatgacagcgaccccaactggtggaagggggagacccaccagggcatcggcctcttccccagcaactttgtgacagctgacctgacagctgagcctgagatgatcaagacagagaagaagacagtgcagttcagtgatgatgtgcaggtggagaccatcgagcctgagcctgagcccgccttcattgatgaggacaagatggaccagctgctgcagatgctgcagagcacagaccccagtgatgaccagcctgacctgcctgagctgctgcacctggaggccatgtgccaccagatgggccccctgattgatgagaagctggaggacatcgacaggaagcacagcgagctgtctgagctgaatgtgaaggtgatggaggccctgagcctgtacaccaagctgatgaatgaagaccccatgtacagcatgtatgccaagctgcagaaccagccctactacatgcagagcagcggcgtgtctggcagccaggtgtatgccggccccccacccagcggggcctacctggtggccggaaatgcccagatgagccacctgcagagctacagcctgcccccagagcagctgagcagcctgagccaggccgtggtgcccccatctgccaacccagccctgcccagccagcagacccaggccgcctaccccaacaccatggtgtcctctgtgcagggcaacacctaccccagccaggcccctgtgtacagccccccacctgctgccacagctgctgctgccacagcagatgtgaccctgtaccagaatgccggccccaacatgccccaggtgcccaactacaacctgaccagcagcaccctgccccagcccggcggcagccagcagcccccccagccccagcagccctacagccagaaggccctgctgtag

SEQ ID NO: 169790 - DNA, 1578 bp, Artificial Sequence
  Description of Artificial Sequence: Synthetic coding sequence
atgcccctcttcaccgccaacccctttgagcaggatgtggagaaggccaccaatgagtacaacaccacagaggactggagcctcatcatggacatctgtgacaaggtgggcagcaccccaaatggagccaaggactgcctgaaggccatcatgaagagggtgaaccacaaggtgccccacgtggccctgcaggccctgaccctgctgggcgcctgtgtggccaactgtgggaagatcttccacctggaggtgtgcagccgggactttgccacagaggtgcgggctgtgatcaagaacaaggcccaccccaaggtgtgtgagaagctgaagagcctgatggtggagtggagcgaggagttccagaaggacccccagttcagcctcatcagcgccaccatcaagtccatgaaggaggagggcatcaccttccccccagctggcagccagacagtgtctgctgctgccaagaatggcaccagcagcaacaagaacaaggaggatgaggacatcgccaaggccatcgagctgagcctgcaggagcagaagcagcagcacacagagaccaagagcctgtaccccagcagcgagatccagctgaacaacaaggtggccaggaaggtgcgggccctgtatgactttgaagctgtggaggacaatgagctgaccttcaagcatggagagatcatcatcgtgctggatgacagtgatgccaactggtggaagggggagaaccaccggggcatcggcctcttccccagcaactttgtgaccaccaacctgaacatcgagacagaggccgctgctgtggacaagctgaatgtgattgatgatgatgtggaggagatcaagaagtctgagcctgagcctgtgtacattgatgaggacaagatggaccgggccctgcaggtgctgcagagcattgaccccacagacagcaagccagacagccaggacctgctggacctggaggacatctgccagcagatgggccccatgattgatgagaagctggaggagattgacaggaagcacagcgagctgtctgagctgaatgtgaaggtgctggaggccctggagctgtacaacaagctggtgaatgaggcccctgtgtacagcgtgtacagcaagctgcaccccccagcccactaccccccagccagcagcggcgtgcccatgcagacctaccctgtgcagagccacggcggcaactacatgggccagagcatccaccaggtgacagtggcccagagctacagcctgggccctgaccagatcggccccctgcggagcctgccccccaacgtgaacagctctgtgacagcccagcctgcccagaccagctacctgagcacaggccaggacacagtgagcaaccccacctacatgaaccagaacagcaacctgcagagcgccaccggcaccacagcctacacccagcagatgggcatgtctgtggacatgagcagctaccagaacaccaccagcaacctgccccagctggccggcttccctgtgacagtgcctgcccaccctgtggcccagcagcacaccaactaccaccagcagcccctgctgtag

SEQ ID NO: 169791 - DNA, 3129 bp, Artificial Sequence
  Description of Artificial Sequence: Synthetic coding sequence
atgcccatgtgggccggcggcgtgggcagcccccggcggggcatggccccagccagcacagatgacctgtttgccaggaagctgcggcagcctgcccggccccccctgaccccccacacctttgagcccaggcctgtgcggggccccctgctgcggagcggcagtgatgctggggaggcccggccccccaccccagccagcccccgggcccgggcccacagccatgaggaggccagcaggcctgctgccaccagcaccaggctcttcacagaccccctggccctgctgggcctgcctgctgaggagcctgagcccgccttcccccctgtgctggagccccgctggtttgcccactatgatgtgcagagcctgctgtttgactgggcccccaggagccagggcatgggcagccacagcgaggccagcagcggcaccctggccagcgctgaggaccaggccgccagcagtgacctgctgcacggggcccctggctttgtgtgtgagctgggcggggagggggagctgggcctgggcggccctgccagcccccctgtgcccccagccctgcccaatgctgctgtgtccatcctggaggagccccagaacagaacatctgcctacagcctggagcacgccgacctgggcgccggctactacaggaagtacttctacggcaaggagcaccagaacttcttcggcatggatgagagcctgggccctgtggccgtgtccctgcggcgggaggagaaggagggcagcggcggcggcaccctgcacagctacagagtcatcgtgaggaccacccagctgcggaccctgcggggcaccatcagtgaagatgccctgcccccaggccccccccggggcctgagccccaggaagctgctggagcacgtggccccccagctgagccccagctgcctgcggctgggcagcgccagccccaaggtgcccaggaccctgctgaccctggatgagcaggtgctgtccttccagaggaaggtgggcatcctgtactgccgggccggccagggcagcgaggaggagatgtacaacaaccaggaggccggccctgccttcatgcagttcctgaccctgctgggagatgtggtgcggctgaagggctttgagagctaccgggcccagctggacaccaagacagacagcacaggcacccacagcctgtacaccacctaccaggaccacgagatcatgtttcatgtgtccaccatgctgccctacacccccaacaaccagcagcagctgctgaggaagaggcacatcggaaatgacatcgtgaccatcgtgttccaggagcccggcagcaagcccttctgccccaccaccatccgcagccacttccagcacgtgttcctggtggtgcgggcccacaccccctgcaccccccacaccacctacagagtggccgtgtccaggacccaggacaccccagccttcggccctgccctgcctgctgggggcggcccctttgctgccaatgctgacttccgggccttcctgctggccaaggccctgaatggagagcaggccgccggccacgcccggcagttccacgccatggccaccaggacccggcagcagtacctgcaggacctggccaccaatgaggtgaccaccaccagcctggacagcgccagcagatttggcctgcccagcctgggcggcagaagaagagctgccccccggggccctggagctgagctgcaggccgccggcagcctggtgtggggcgtgcgggccgcccctggggcccgggtggccgccggggcccaggccagcggccctgagggcatcgaggtgccctgcctgctgggcatctctgctgaggccctggtgctggtggcccccagagatggccgggtggtgttcaactgtgcctgcagagatgtgctggcctggaccttcagcgagcagcagctggacctgtaccacggccgcggggaggccatcaccctgcgctttgatggcagccctggccaggccgtgggggaggtggtggcccggctgcagctggtgtcccggggctgtgagacccgggagctggccctgcccagagatggccagggccgcctgggctttgaggtggatgctgagggctttgtgacccacgtggagcgcttcacctttgctgagacagctggcctgcggcctggggcccggctgctgcgggtgtgtggccagaccctgcccagcctgcggcctgaggccgccgcccagctgctgcggagcgcccccaaggtgtgtgtgacagtgctgcccccagatgagagcggccggccccggcgctccttcagcgagctgtacaccctgagcctgcaggagcccagccggcggggggccccagaccctgtgcaggatgaggtgcagggcgtgaccctgctgcccaccaccaagcagctgctgcacctgtgcctgcaggacggcggcagccccccaggccctggggacctggccgaggagaggacagagttcctgcacagccagaacagcctgagccccaggagcagcctgagtgatgaggcccctgtgctgcccaacaccaccccagacctgctgctggccaccacagccaagcccagcgtgcccagcgctgacagcgagacccccctgacccaggaccggcccggcagccccagcggctctgaagataaaggaaatcctgcccctgagctgcgggccagcttcctgcccaggaccctgagcctgaggaacagcatcagccgcatcatgtctgaggccggcagcggcaccctggaggatgagtggcaggccatcagcgagatcgccagcacctgcaacaccatcctggagagcctgagccgggagggccagcccatccctgagagcggggaccccaagggcacccccaagagtgatgctgagcctgagcccggcaacctgtctgagaaggtgagccacctggagagcatgctgaggaagctgcaggaggacctgcagaaggagaaggctgaccgggccgccctggaggaggaggtgcgcagcctgcggcacaacaacagaaggctgcaggccgagagcgagagcgctgccacccggctgctgctggccagcaagcagctgggcagccccacagctgacctggcctag

SEQ ID NO: 169792 - DNA, 2823 bp, Artificial Sequence
  Description of Artificial Sequence: Synthetic coding sequence
atgcccatgtgggccggcggcgtgggcagcccccggcggggcatggccccagccagcacagatgacctgtttgccaggaagctgcggcagcctgcccggccccccctgaccccccacacctttgagcccaggcctgtgcggggccccctgctgcggagcggcagtgatgctggggaggcccggccccccaccccagccagcccccgggcccgggcccacagccatgaggaggccagcaggcctgctgccaccagcaccaggctcttcacagaccccctggccctgctgggcctgcctgctgaggagcctgagcccgccttcccccctgtgctggagccccgctggtttgcccactatgatgtgcagagcctgctgtttgactgggcccccaggagccagggcatgggcagccacagcgaggccagcagcggcaccctggccagcgctgaggaccaggccgccagcagtgacctgctgcacggggcccctggctttgtgtgtgagctgggcggggagggggagctgggcctgggcggccctgccagcccccctgtgcccccagccctgcccaatgctgctgtgtccatcctggaggagccccagaacagaacatctgcctacagcctggagcacgccgacctgggcgccggctactacaggaagtacttctacggcaaggagcaccagaacttcttcggcatggatgagagcctgggccctgtggccgtgtccctgcggcgggaggagaaggagggcagcggcggcggcaccctgcacagctacagagtcatcgtgaggaccacccagctgcggaccctgcggggcaccatcagtgaagatgccctgcccccaggccccccccggggcctgagccccaggaagctgctggagcacgtggccccccagctgagccccagctgcctgcggctgggcagcgccagccccaaggtgcccaggaccctgctgaccctggatgagcaggtgctgtccttccagaggaaggtgggcatcctgtactgccgggccggccagggcagcgaggaggagatgtacaacaaccaggaggccggccctgccttcatgcagttcctgaccctgctgggagatgtggtgcggctgaagggctttgagagctaccgggcccagctggacaccaagacagacagcacaggcacccacagcctgtacaccacctaccaggaccacgagatcatgtttcatgtgtccaccatgctgccctacacccccaacaaccagcagcagctgctgaggaagaggcacatcggaaatgacatcgtgaccatcgtgttccaggagcccggcagcaagcccttctgccccaccaccatccgcagccacttccagcacgtgttcctggtggtgcgggcccacaccccctgcaccccccacaccacctacagagtggccgtgtccaggacccaggacaccccagccttcggccctgccctgcctgctgggggcggcccctttgctgccaatgctgacttccgggccttcctgctggccaaggccctgaatggagagcaggccgccggccacgcccggcagttccacgccatggccaccaggacccggcagcagtacctgcaggacctggccaccaatgagcagctggacctgtaccacggccgcggggaggccatcaccctgcgctttgatggcagccctggccaggccgtgggggaggtggtggcccggctgcagctggtgtcccggggctgtgagacccgggagctggccctgcccagagatggccagggccgcctgggctttgaggtggatgctgagggctttgtgacccacgtggagcgcttcacctttgctgagacagctggcctgcggcctggggcccggctgctgcgggtgtgtggccagaccctgcccagcctgcggcctgaggccgccgcccagctgctgcggagcgcccccaaggtgtgtgtgacagtgctgcccccagatgagagcggccggccccggcgctccttcagcgagctgtacaccctgagcctgcaggagcccagccggcggggggccccagaccctgtgcaggatgaggtgcagggcgtgaccctgctgcccaccaccaagcagctgctgcacctgtgcctgcaggacggcggcagccccccaggccctggggacctggccgaggagaggacagagttcctgcacagccagaacagcctgagccccaggagcagcctgagtgatgaggcccctgtgctgcccaacaccaccccagacctgctgctggccaccacagccaagcccagcgtgcccagcgctgacagcgagacccccctgacccaggaccggcccggcagccccagcggctctgaagataaaggaaatcctgcccctgagctgcgggccagcttcctgcccaggaccctgagcctgaggaacagcatcagccgcatcatgtctgaggccggcagcggcaccctggaggatgagtggcaggccatcagcgagatcgccagcacctgcaacaccatcctggagagcctgagccgggagggccagcccatccctgagagcggggaccccaagggcacccccaagagtgatgctgagcctgagcccggcaacctgtctgagaaggtgagccacctggagagcatgctgaggaagctgcaggaggacctgcagaaggagaaggctgaccgggccgccctggaggaggaggtgcgcagcctgcggcacaacaacagaaggctgcaggccgagagcgagagcgctgccacccggctgctgctggccagcaagcagctgggcagccccacagctgacctggcctag

SEQ ID NO: 169793 - DNA, 21 bp, Artificial Sequence
  Description of Artificial Sequence: Synthetic coding sequence
atgcccatgtgggccggctag

SEQ ID NO: 169794 - DNA, 312 bp, Artificial Sequence
  Description of Artificial Sequence: Synthetic coding sequence
atgcccatgtgggccggcggcgtgggcagcccccggcggggcatggccccagccagcacagatgacctgtttgccaggaagctgcggcagcctgcccggccccccctgaccccccacacctttgagcccaggcctgtgcggggccccctgctgcggagcggcagtgatgctggggaggcccggccccccaccccagccagcccccgggcccgggcccacagccatgaggaggccagcaggcctgctgccaccagcaccaggctcttcacagaccccctggccctgctgggcctgcctgctgaggagccctag

SEQ ID NO: 169795 - DNA, 3129 bp, Artificial Sequence; identical to SEQ ID NO: 169791
  Description of Artificial Sequence: Synthetic coding sequence

SEQ ID NO: 169796 - DNA, 5169 bp, Artificial Sequence
  Description of Artificial Sequence: Synthetic coding sequence
atgtctgacccccggcagagccaggaggagaagcacaagctgggccgggccagcagcaagttcaaggaccccccacgcatcatgcagagtgatgactactttgccaggaagttcaaggccatcaatggaaacatgggccccaccaccagcctgaatgccagcaacagcaatgaaacaggaggcggcggccctgccaacggcaccccagctgtgcccaagatgggcgtgcgggcccgggtgtctgagtggccacccaagaaggactgcagcaaggagctgacctgcaaggccctgtgggagagccgcagccagaccagctatgagagcatcacctctgtgctgcagaatggccagagcgaccagagcgagggccagcaggatgagcagctggacctggactttgtggaggccaagtacaccatcggggacatctttgtgcacagcccccagaggggcctgcaccccatccggcagaggagcaacagtgatgtgaccatcagtgacattgatgctgaagatgtgctggaccagaatgctgtgaaccccaacacaggagctgccctgcaccgggagtatggcagcaccagcagcattgaccggcagggcctgagcggggagaacttctttgccatgctgcggggctacagagtggagaactatgaccacaaggccatggtgcccttcggcttccctgagttcttccgctgtgaccctgccatcagccccagcctgcacgccgccgcccagatcagcagaggagaatttgtgcgcatcagcggcctggactatgtggacagcgccctgctgatgggccgggaccgggacaagcccttcaagaggcggctgaagtctgagagcgtggagaccagcctcttcaggaagctgaggacagtgaagtctgagcacgagaccttcaagttcaccagcgagctggaggagagccggctggagcggggcatccggccctggaactgccagcgctgctttgcccactatgatgtgcagagcatcctcttcaacatcaatgaggccatggccacccgggccaacgtgggcaagaggaagaacatcaccactggagccagcgctgccagccagacccagatgcccaccggccagacaggcaactgtgagagccccctgggcagcaaagaagacctgaacagcaaagaaaacctggatgctgatgaaggagatggcaagagcaatgacctggtgctgagctgcccctacttcagaaatgagaccggcggggagggggaccggcgcatcgccctgagccgggccaacagcagcagcttcagcagcggggagagctgcagctttgagagcagcctgagcagccactgcaccaatgccggcgtgtctgtgctggaggtgccccgggagaaccagcccatccaccgggagaaggtgaagcgctacatcatcgagcacatcgacctgggcgcctactactacaggaagttcttctacggcaaggagcaccagaactacttcggcattgatgagaacctgggccctgtggccgtgtccatccggcgggagaaggtggaggatgccaaggagaaggagggcagccagttcaactacagagtggccttccgcaccagcgagctgaccaccctgcggggggccatcctggaggatgccatccccagcacagcccggcacggcacagcccggggcctgcccctgaaggaggtgctggagtatgtgattcctgagctgagcatccagtgcctgcggcaggccagcaacagccccaaggtgtctgagcagctgctgaagctggatgagcagggcctgtccttccagcacaagattggcatcctgtactgcaaggccggccagagcacagaggaggagatgtacaacaatgaaacagctggccctgcctttgaggagttcctggacctgctgggccagagggtgcggctgaagggcttcagcaagtaccgggcccagctggacaacaagacagacagcacaggcacccacagcctgtacaccacctacaaggactatgagctgatgtttcatgtgtccaccctgctgccctacatgcccaacaaccggcagcagctgctgaggaagaggcacatcggaaatgacatcgtgaccatcgtgttccaggagcccggggccctgcccttcacccccaagagcatccgcagccacttccagcacgtgtttgtgattgtgaaggtgcacaacccctgcacagaaaatgtgtgctacagcgtgggcgtgagccgcagcaaggatgtgccccccttcggcccccccatccccaagggcgtgaccttccccaagtctgctgtgttccgggacttcctgctggccaaggtgatcaatgcagaaaatgctgcccacaagtctgagaagttccgggccatggccaccaggacccggcaggagtacctgaaggacctggccgagaactttgtgaccacagccaccgtggacacctctgtgaagttctccttcatcaccctgggcgccaagaagaaggagaaggtgaagcccaggaaggatgcccacctgttcagcatcggggccatcatgtggcacgtgattgcccgggactttggccagagcgctgacattgaatgtctgctgggcatcagcaatgagttcatcatgctgattgagaaggacagcaagaatgtggtgttcaactgcagctgcagagatgtgattggctggaccagcggcctggtgtccatcaaggtgttctatgaaagaggagaatgtgtgctgctgagctctgtggacaactgtgccgaggacatccgggagatcgtgcagaggctggtgattgtgacccggggctgtgagaccgtggagatgaccctgcggagaaatggcctgggccagctgggcttccacgtgaactttgagggcatcgtggctgatgtggagccctttggatttgcctggaaggccggcctgcggcagggcagccggctggtggagatctgcaaggtggccgtggccaccctgacccatgagcagatgattgacctgctgcggacctctgtgacagtgaaggtggtgatcatccagccccatgatgatggcagcccccggcggggctgcagcgagctgtgccgcatccccatggtggagtacaagctggacagcgagggcaccccctgtgagtacaagacccccttcagaagaaacaccacctggcaccgggtgcccaccccagccctgcagcccctgagccgggccagccccatccctggcaccccagaccggctgccctgccagcagctgctgcagcaggcccaggccgccatccccaggagcaccagctttgacaggaagctgcctgatggcaccaggagcagccccagcaaccagagcagcagcagtgaccccggccctgggggcagcggcccctggaggccccaggtgggctatgatggctgccagagccccctgctgctggagcaccagggcagcggccccctggagtgtgatggagcccgggagcgggaggacaccatggaggccagccgccaccctgagaccaagtggcacggcccccccagcaaggtgctgggcagctacaaggagcgggccctgcagaaggatggcagctgcaaggacagccccaacaagctgagccacatcggggacaagagctgcagcagccacagcagcagcaacaccctgagcagcaacaccagcagcaacagtgatgacaagcacttcggcagcggggacctgatggaccctgagctgctgggcctgacctacatcaagggggccagcacagattctggaattgacacagccccctgcatgcctgccaccatcctgggccctgtgcacctggccggcagccgcagcctcatccacagcagagctgagcagtgggcagatgctgctgatgtgtctggcccagatgatgagcccgccaagctgtacagcgtgcacggctacgccagcaccatctctgctggcagcgctgctgagggctccatgggagacctgtctgagatcagcagccacagcagcggcagccaccacagcggcagccccagcgcccactgcagcaagagcagcggcagcctggacagcagcaaggtgtacatcgtgagccacagcagcggccagcaggtgcccggctccatgagcaagccctaccaccggcagggcgctgtgaacaagtatgtgattggctggaagaagtctgagggcagccccccacctgaggagcctgaggtgacagagtgccccggcatgtacagcgagatggatgtgatgagcacagccacccagcaccagacagtggtgggagatgctgtggccgagacccagcacgtgctgagcaaagaagacttcctgaagctgatgctgcctgacagccccctggtggaggagggccgcaggaagttctccttctacggcaacctgagcccccggcgcagcctgtaccgcaccctgagtgatgagagcatctgcagcaacagaagaggcagcagctttggcagcagccgcagctctgtgctggaccaggccctgcccaatgacatcctcttcagcaccaccccaccctaccacagcaccctgcccccccgggcccacccagcccccagcatgggcagcctgagaaatgagttctggttcagtgatggcagcctgagtgacaagagcaaatgtgccgaccccggcctgatgcccctgcctgacacagccaccggcctggactggacccacctggtggatgctgcccgggcctttgagggcctggacagtgatgaggagctgggcctgctgtgccaccacaccagctacctggaccagagggtggccagcttctgcaccctgacagacatgcagcacggccaggacctggagggcgcccaggagctgcccctgtgtgtggaccccggcagcggcaaggagttcatggacaccaccggggagaggagccccagccccctgaccgggaaggtgaaccagctggagctgatcctgcggcagctgcagacagacctgaggaaggagaagcaggacaaggctgtgctgcaggccgaggtgcagcacctgcggcaggacaacatgaggctgcaggaggagagccagacagccacagcccagctgaggaagttcacagagtggttcttcaccaccatcgacaagaagagctag

SEQ ID NO: 169797 - DNA, 2337 bp, Artificial Sequence
  Description of Artificial Sequence: Synthetic coding sequence
atgagcccctgcttctccttcatcggctgcaagctgtgcagcatcgtgacccggggctgtgagaccgtggagatgaccctgcggagaaatggcctgggccagctgggcttccacgtgaactttgagggcatcgtggctgatgtggagccctttggatttgcctggaaggccggcctgcggcagggcagccggctggtggagatctgcaaggtggccgtggccaccctgacccatgagcagatgattgacctgctgcggacctctgtgacagtgaaggtggtgatcatccagccccatgatgatggcagcccccggcggggctgcagcgagctgtgccgcatccccatggtggagtacaagctggacagcgagggcaccccctgtgagtacaagacccccttcagaagaaacaccacctggcaccgggtgcccaccccagccctgcagcccctgagccgggccagccccatccctggcaccccagaccggctgccctgccagcagctgctgcagcaggcccaggccgccatccccaggagcaccagctttgacaggaagctgcctgatggcaccaggagcagccccagcaaccagagcagcagcagtgaccccggccctgggggcagcggcccctggaggccccaggtgggctatgatggctgccagagccccctgctgctggagcaccagggcagcggccccctggagtgtgatggagcccgggagcgggaggacaccatggaggccagccgccaccctgagaccaagtggcacggcccccccagcaaggtgctgggcagctacaaggagcgggccctgcagaaggatggcagctgcaaggacagccccaacaagctgagccacatcggggacaagagctgcagcagccacagcagcagcaacaccctgagcagcaacaccagcagcaacagtgatgacaagcacttcggcagcggggacctgatggaccctgagctgctgggcctgacctacatcaagggggccagcacagattctggaattgacacagccccctgcatgcctgccaccatcctgggccctgtgcacctggccggcagccgcagcctcatccacagcagagctgagcagtgggcagatgctgctgatgtgtctggcccagatgatgagcccgccaagctgtacagcgtgcacggctacgccagcaccatctctgctggcagcgctgctgagggctccatgggagacctgtctgagatcagcagccacagcagcggcagccaccacagcggcagccccagcgcccactgcagcaagagcagcggcagcctggacagcagcaaggtgtacatcgtgagccacagcagcggccagcaggtgcccggctccatgagcaagccctaccaccggcagggcgctgtgaacaagtatgtgattggctggaagaagtctgagggcagccccccacctgaggagcctgaggtgacagagtgccccggcatgtacagcgagatggatgtgatgagcacagccacccagcaccagacagtggtgggagatgctgtggccgagacccagcacgtgctgagcaaagaagacttcctgaagctgatgctgcctgacagccccctggtggaggagggccgcaggaagttctccttctacggcaacctgagcccccggcgcagcctgtaccgcaccctgagtgatgagagcatctgcagcaacagaagaggcagcagctttggcagcagccgcagctctgtgctggaccaggccctgcccaatgacatcctcttcagcaccaccccaccctaccacagcaccctgcccccccgggcccacccagcccccagcatgggcagcctgagaaatgagttctggttcagtgatggcagcctgagtgacaagagcaaatgtgccgaccccggcctgatgcccctgcctgacacagccaccggcctggactggacccacctggtggatgctgcccgggcctttgaggaccagagggtggccagcttctgcaccctgacagacatgcagcacggccaggacctggagggcgcccaggagctgcccctgtgtgtggaccccggcagcggcaaggagttcatggacaccaccggggagaggagccccagccccctgaccgggaaggtgaaccagctggagctgatcctgcggcagctgcagacagacctgaggaaggagaagcaggacaaggctgtgctgcaggccgaggtgcagcacctgcggcaggacaacatgaggctgcaggaggagagccagacagccacagcccagctgaggaagttcacagagtggttcttcaccaccatcgacaagaagagctag

SEQ ID NO: 169798 - DNA, 5169 bp, Artificial Sequence; identical to SEQ ID NO: 169796
  Description of Artificial Sequence: Synthetic coding sequence

SEQ ID NO: 169799 - DNA, 918 bp, Artificial Sequence
  Description of Artificial Sequence: Synthetic coding sequence
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagaatgtgtctgtgcagcgcttctgcctgcagctgcggctgtatgagcaggtgtccaccccagagatcaaggtgctgaacaagacccaggagaatggcacctgcaccctcatcctgggctgcaccgtggagaagggggaccacgtggcctacagctggagcgagaaggccggcacccaccccctgaacccagccaacagcagccacctgctgagcctgaccctgggcccccagcacgccgacaacatctacatctgcaccgtgagcaaccccatcagcaacaacagccagaccttcagcccctggccaggctgcaggacagaccccagcggcaagaccaaccactaccagaccaccgtggagaagaagagcctgaccatctatgcccaggtgcagaagccaggccccctgcagaagaagctggacagcttccctgcccaggacccctgcaccaccatctacgtggccgccacagagcctgtgcctgagagcgtgcaggagaccaacagcatcaccgtgtatgcctctgtgaccctgcctgagagctag

SEQ ID NO: 169800 - DNA, 1008 bp, Artificial Sequence
  Description of Artificial Sequence: Synthetic coding sequence
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagaatgtgtctgtgcagcgcttctgcctgcagctgcggctgtatgagcaggtgtccaccccagagatcaaggtgctgaacaagacccaggagaatggcacctgcaccctcatcctgggctgcaccgtggagaagggggaccacgtggcctacagctggagcgagaaggccggcacccaccccctgaacccagccaacagcagccacctgctgagcctgaccctgggcccccagcacgccgacaacatctacatctgcaccgtgagcaaccccatcagcaacaacagccagaccttcagcccctggccaggctgcaggacagaccccagcgagaccaagccctgggccgtgtatgccggcctgctgggcggcgtcatcatgatcctgatcatggtggtgatcctgcagctgcggcggcggggcaagaccaaccactaccagaccaccgtggagaagaagagcctgaccatctatgcccaggtgcagaagccaggccccctgcagaagaagctggacagcttccctgcccaggacccctgcaccaccatctacgtggccgccacagagcctgtgcctgagagcgtgcaggagaccaacagcatcaccgtgtatgcctctgtgaccctgcctgagagctag

SEQ ID NO: 169801 - DNA, 897 bp, Artificial Sequence
  Description of Artificial Sequence: Synthetic coding sequence
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagaatgtgtctgtgcagcgcttctgcctgcagctgcggctgtatgagcaggtgtccaccccagagatcaaggtgctgaacaagacccaggagaatggcacctgcaccctcatcctgggctgcaccgtggagaagggggaccacgtggcctacagctggagcgagaaggccggcacccaccccctgaacccagccaacagcagccacctgctgagcctgaccctgggcccccagcacgccgacaacatctacatctgcaccgtgagcaaccccatcagcaacaacagccagaccttcagcccctggccaggctgcaggacagaccccagcgagaccaagccctgggccgtgtatgccggcctgctgggcggcgtcatcatgatcctgatcatggtggtgatcctgcagctgcggcggcggggcaagaccaaccactaccagaccaccgtggagaagaagagcctgaccatctatgcccaggtgcagaagccaggggacagccaccaccagaccagtgacctcttctag

SEQ ID NO: 169802 - DNA, 435 bp, Artificial Sequence
  Description of Artificial Sequence: Synthetic coding sequence
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagagcctgcacttcggctacctgtactttgtgctgggcgctgaccatgacaacctgcagacctag

SEQ ID NO: 169803 - DNA, 810 bp, Artificial Sequence
  Description of Artificial Sequence: Synthetic coding sequence
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagaatgtgtctgtgcagcgcttctgcctgcagctgcggctgtatgagcaggtgtccaccccagagatcaaggtgctgaacaagacccaggagaatggcacctgcaccctcatcctgggctgcaccgtggagaagggggaccacgtggcctacagctggagcgagaaggccggcacccaccccctgaacccagccaacagcagccacctgctgagcctgaccctgggcccccagcacgccgacaacatctacatctgcaccgtgagcaaccccatcagcaacaacagccagaccttcagcccctggccaggctgcaggacagaccccagcgagaccaagccctgggccgtgtatgccggcctgctgggcggcgtcatcatgatcctgatcatggtggtgatcctgcagctgcggcggcgggccagcagcgaggagacctag

SEQ ID NO: 169804 - DNA, 1029 bp, Artificial Sequence
  Description of Artificial Sequence: Synthetic coding sequence
atgtgcagcaccatgtctgcccccacctgcctggcccacctgcccccctgcttcctgctgctggccctggtgctggtgcccagtgatgccagcggccagagcagcagaaatgactggcaggtgctgcagcctgagggccccatgctggtggccgagggggagaccctgctgctgcgctgcatggtggtgggcagctgcacagatggcatgatcaagtgggtgaaggtgtccacccaggaccagcaggagatctacaacttcaagaggggcagcttccctggggtgatgcccatgatccagaggaccagcgagcccctgaactgtgactacagcatctacatccacaacgtgacccgggagcacacaggcacctaccactgtgtgcgctttgatggcctgtctgagcacagcgagatgaagagtgatgagggcacctctgtgctggtgaagggggccggggaccctgagccagacctgtggatcatccagccccaggagctggtgctgggcaccaccggggacacagtgttcctgaactgcaccgtgctgggagatggccccccaggccccatccgctggttccagggcgccggcctgagccgggaggccatctacaactttggaggcatcagccaccccaaggagacagctgtgcaggccagcaacaatgacttcagcatcctgctgcagaatgtgtccagtgaagatgctggcacctactactgtgtgaagttccagaggaagcccaaccggcagtacctgagcggccagggcaccagcctgaaggtgaaggccaagagcaccagcagcaaggaggccgagttcaccagcgagcccgccacagagatgagccccaccggcctgctggtggtgtttgcccctgtggtgctgggcctgaaggccatcaccctggccgccctgctgctggccctggccaccagcagaagaagccctggccaggaggatgtgaagaccaccggccctgctggggccatgaacaccctggcctggagcaagggccaggagtag

SEQ ID NO: 169805 - DNA, 624 bp, Artificial Sequence
  Description of Artificial Sequence: Synthetic coding sequence
atgtgcagcaccatgtctgcccccacctgcctggcccacctgcccccctgcttcctgctgctggccctggtgctggtgcccagtgatgccagcggccagagcagcagaaatgactggcaggtgctgcagcctgagggccccatgctggtggccgagggcgctggggaccctgagccagacctgtggatcatccagccccaggagctggtgctgggcaccaccggggacacagtgttcctgaactgcaccgtgctgggagatggccccccaggccccatccgctggttccagggcgccggcctgagccgggaggccatctacaactttggaggcatcagccaccccaaggagacagctgtgcaggccagcaacaatgacttcagcatcctgctgcagaatgtgtccagtgaagatgctggcacctactactgtgtgaagttccagaggaagcccaaccggcagtacctgagcggccagggcaccagcctgaaggtgaaggagcagaacctgcccctgcccaagaggcagaacagccctgtgaacctgcagctgcgctgcctgcagcaggtgtctgtgcccacctctgtggagagcatgagccccccccaggcccggggcccctag

SEQ ID NO: 169806 - DNA, 624 bp, Artificial Sequence; identical to SEQ ID NO: 169805
  Description of Artificial Sequence: Synthetic coding sequence

SEQ ID NO: 169807 - DNA, 735 bp, Artificial Sequence
  Description of Artificial Sequence: Synthetic coding sequence
atgtgcagcaccatgtctgcccccacctgcctggcccacctgcccccctgcttcctgctgctggccctggtgctggtgcccagtgatgccagcggccagagcagcagaaatgactggcaggtgctgcagcctgagggccccatgctggtggccgagggcgctggggaccctgagccagacctgtggatcatccagccccaggagctggtgctgggcaccaccggggacacagtgttcctgaactgcaccgtgctgggagatggccccccaggccccatccgctggttccagggcgccggcctgagccgggaggccatctacaactttggaggcatcagccaccccaaggagacagctgtgcaggccagcaacaatgacttcagcatcctgctgcagaatgtgtccagtgaagatgctggcacctactactgtgtgaagttccagaggaagcccaaccggcagtacctgagcggccagggcaccagcctgaaggtgaaggccaagagcaccagcagcaaggaggccgagttcaccagcgagcccgccacagagatgagccccaccggcctgctggtggtgtttgcccctgtggtgctgggcctgaaggccatcaccctggccgccctgctgctggccctggccaccagcagaagaagccctggccaggaggatgtgaagaccaccggccctgctggggccatgaacaccctggcctggagcaagggccaggagtag

SEQ ID NO: 169808 - DNA, 633 bp, Artificial Sequence
  Description of Artificial Sequence: Synthetic coding sequence
atgaagagtgatgagggcacctctgtgctggtgaagggggccggggaccctgagccagacctgtggatcatccagccccaggagctggtgctgggcaccaccggggacacagtgttcctgaactgcaccgtgctgggagatggccccccaggccccatccgctggttccagggcgccggcctgagccgggaggccatctacaactttggaggcatcagccaccccaaggagacagctgtgcaggccagcaacaatgacttcagcatcctgctgcagaatgtgtccagtgaagatgctggcacctactactgtgtgaagttccagaggaagcccaaccggcagtacctgagcggccagggcaccagcctgaaggtgaaggccaagagcaccagcagcaaggaggccgagttcaccagcgagcccgccacagagatgagccccaccggggagaggacccacctgtctggagtgaatgaaagccccaccgggaagggggccatgaatggcctggtgatgggccgggagcagagccagacccctggggccaacctgccccccaggatgctgcccggcctgcacctgaactgcaggaccaggaccccagagaaccacgtgatcacagcccagctgtag

SEQ ID NO: 169809 - DNA, 2046 bp, Artificial Sequence
  Description of Artificial Sequence: Synthetic coding sequence
atgaatgccagcagcgagggggagagctttgctggctctgtgcagatccctgggggcaccaccgtgctggtggagctgaccccagacatccacatctgtggcatctgcaagcagcagttcaacaacctggatgcctttgtggcccacaagcagagcggctgccagctgaccggcaccagcgctgctgcccccagcacagtgcagtttgtgtctgaggagaccgtgcctgccacccagacccagaccaccaccaggaccatcaccagcgagacccagaccatcaccgtgtctgcccctgagtttgtgtttgaacatggctaccagacctacctgcccacagagagcaatgaaaaccagacagccaccgtcatcagcctgcctgccaagagcaggaccaagaagcccaccaccccaccagcccagaagaggctgaactgctgctacccaggctgccagttcaagacagcctacggcatgaaggacatggagcggcacctgaagatccacactggagacaagccccacaagtgtgaggtgtgtgggaagtgcttcagcaggaaggacaagctgaagacccacatgcgctgccacactggagtgaagccctacaagtgcaagacctgtgactatgctgctgctgacagcagcagcctgaacaagcacctgcgcatccacagtgatgagcggcccttcaagtgccagatctgcccctatgccagcaggaacagcagccagctgactgtgcacctgcggagccacactggagatgcccccttccagtgctggctgtgcagcgccaagttcaagatcagcagtgacctgaagaggcacatgagggtgcacagcggggagaagcccttcaagtgtgagttctgcaatgtgcgctgcaccatgaagggcaacctgaagagccacatccgcatcaagcacagcggcaacaacttcaagtgcccccactgtgacttcctgggggacagcaaggccaccctgaggaagcacagccgggtgcaccagagcgagcaccctgagaagtgcagtgaatgttcctacagctgcagcagcaaggccgccctgcgcatccacgagcgcatccactgcacagaccggcccttcaagtgcaactactgcagctttgacaccaagcagcccagcaacctgagcaagcacatgaagaagttccacggggacatggtgaagacagaggccctggagaggaaggacaccggccggcagagcagccggcaggtggccaagctggatgccaagaagagcttccactgtgacatctgtgatgccagcttcatgagggaggacagcctgcggagccacaagaggcagcacagcgagtacagcgagagcaagaacagtgatgtgacagtgctgcagttccagattgaccccagcaagcagcctgccacccccctgactgtgggccacctgcaggtgcccctgcagcccagccaggtgccccagttcagcgagggccgggtgaagatcatcgtgggccaccaggtgccccaggccaacaccatcgtgcaggccgctgctgctgctgtgaacatcgtgcccccagccctggtggcccagaaccctgaggagctgcccggcaacagccggctgcagatcctgcggcaggtgtccctgattgccccaccccagagcagccgctgccccagcgaggccggggccatgacccagcctgctgtgctgctgaccacccatgagcagacagatggagccaccctgcaccagaccctcatccccacagccagcggcggcccccaggagggcagcggcaaccagaccttcatcaccagcagcggcatcacctgcacagactttgagggcctgaatgccctgatccaggagggcacagctgaggtgacagtggtgtctgatggcggccagaacattgctgtggccaccacagcccctcctgtgttcagcagcagcagccagcaggagctgcccaagcagacctacagcatcatccagggcgccgcccacccagccctgctgtgcccagctgacagcatcccagactag

SEQ ID NO: 169810 - DNA, 1164 bp, Artificial Sequence
  Description of Artificial Sequence: Synthetic coding sequence
atgcctgtgcctgcctcctggccccaccccccaggccccttcctgctgctgaccctgctgctgggcctgacagaggtggccggggaggaggagctgcagatgatccagcctgagaagctgctgctggtgacagtgggcaagacagccaccctgcactgcaccgtgaccagcctgctgcctgtgggccctgtgctgtggttccggggcgtgggccctggccgggagctgatctacaaccagaaggagggccacttcccccgggtgaccaccgtgtctgacctgaccaagaggaacaacatggacttcagcatccgcatcagcagcatcaccccagcagatgtgggcacctactactgtgtgaagttcaggaagggcagcccagaaaatgtggagttcaagagcggccctggaacagagatggccctgggcgccaagcccagcgcccctgtggtgctgggccctgctgcccggaccaccccagagcacacagtgtccttcacctgtgagagccacggcttcagcccccgggacatcaccctgaagtggttcaagaatggaaatgagctgagtgacttccagaccaacgtggaccccaccggccagagcgtggcctacagcatccgcagcacagcccgggtggtgctggacccctgggatgtgcgcagccaggtgatctgtgaggtggcccacgtgaccctgcagggcgaccccctgcggggcacagccaacctgtctgaggccatccgggtgccccccaccctggaggtgacccagcagcccatgagggtgggcaaccaggtgaatgtgacctgccaggtgaggaagttctacccccagagcctgcagctgacctggagcgaaaatggaaatgtgtgccagcgggagacagccagcaccctgacagagaacaaggatggcacctacaactggacctcctggttcctggtgaacatcagtgaccagagagatgatgtggtgctgacctgccaggtgaagcatgatggccagctggccgtgtccaagaggctggccctggaggtgacagtgcaccagaaggaccagagcagtgatgccaccccaggccctgccagcagcctgacagccctgctgctgattgctgtgctgctgggccccatctacgtgccctggaagcagaagacctag

SEQ ID NO: 169811 - DNA, 513 bp, Artificial Sequence
  Description of Artificial Sequence: Synthetic coding sequence
atgcctgtgcctgcctcctggccccaccccccaggccccttcctgctgctgaccctgctgctgggcctgacagaggtggccggggaggaggagctgcagatgatccagcctgagaagctgctgctggtgacagtgggcaagacagccaccctgcactgcaccgtgaccagcctgctgcctgtgggccctgtgctgtggttccggggcgtgggccctggccgggagctgatctacaaccagaaggagggccacttcccccgggtgaccaccgtgtctgacctgaccaagaggaacaacatggacttcagcatccgcatcagcagcatcaccccagcagatgtgggcacctactactgtgtgaagttcaggaagggcagcccagaaaatgtggagttcaagagcggccctggaacagagatggccctgggcggccctgccagcagcctgacagccctgctgctgattgctgtgctgctgggccccatctacgtgccctggaagcagaagacctag

SEQ ID NO: 169812 - DNA, 1065 bp, Artificial Sequence
  Description of Artificial Sequence: Synthetic coding sequence
atgatccagcctgagaagctgctgctggtgacagtgggcaagacagccaccctgcactgcaccgtgaccagcctgctgcctgtgggccctgtgctgtggttccggggcgtgggccctggccgggagctgatctacaaccagaaggagggccacttcccccgggtgaccaccgtgtctgacctgaccaagaggaacaacatggacttcagcatccgcatcagcagcatcaccccagcagatgtgggcacctactactgtgtgaagttcaggaagggcagcccagaaaatgtggagttcaagagcggccctggaacagagatggccctgggcgccaagcccagcgcccctgtggtgctgggccctgctgcccggaccaccccagagcacacagtgtccttcacctgtgagagccacggcttcagcccccgggacatcaccctgaagtggttcaagaatggaaatgagctgagtgacttccagaccaacgtggaccccaccggccagagcgtggcctacagcatccgcagcacagcccgggtggtgctggacccctgggatgtgcgcagccaggtgatctgtgaggtggcccacgtgaccctgcagggcgaccccctgcggggcacagccaacctgtctgaggccatccgggtgccccccaccctggaggtgacccagcagcccatgagggtgggcaaccaggtgaatgtgacctgccaggtgaggaagttctacccccagagcctgcagctgacctggagcgaaaatggaaatgtgtgccagcgggagacagccagcaccctgacagagaacaaggatggcacctacaactggacctcctggttcctggtgaacatcagtgaccagagagatgatgtggtgctgacctgccaggtgaagcatgatggccagctggccgtgtccaagaggctggccctggaggtgacagtgcaccagaaggaccagagcagtgatgccaccccaggccctgccagcagcctgacagccctgctgctgattgctgtgctgctgggccccatctacgtgccctggaagcagaagacctag

SEQ ID NO: 169813 - DNA, 831 bp, Artificial Sequence; identical to SEQ ID NO: 154127
  Description of Artificial Sequence: Synthetic coding sequence

SEQ ID NO: 169814 - DNA, 1386 bp, Artificial Sequence
  Description of Artificial Sequence: Synthetic coding sequence
atggccccccagagcctgcccagcagcaggatggcccccctgggcatgctgctgggcctgctgatggccgcctgcttcaccttctgcctgagccaccagaacctgaaggagtttgccctgaccaaccctgagaagagcagcaccaaggagacagagaggaaggagaccaaggccgaggaggagctggatgctgaggtgctggaggtgttccaccccacccatgagtggcaggccctgcagcccggccaggccgtgcctgctggcagccacgtgcggctgaacctgcagacaggagagcgggaggccaagctgcagtatgaggacaagttcaggaacaacctgaagggcaagaggctggacatcaacaccaacacctacaccagccaggacctgaagagcgccctggccaagttcaaggagggcgctgagatggagagcagcaaagaagacaaggcccggcaggccgaggtgaagaggctcttccggcccatcgaggagctgaagaaggactttgatgagctgaatgtggtgattgaaacagacatgcagatcatggtgcggctcatcaacaagttcaacagcagcagcagcagcctggaggagaagattgctgccctgtttgacctggagtactacgtgcaccagatggacaatgcccaggacctgctgagctttggaggcctgcaggtggtgatcaatggcctgaacagcacagagcccctggtgaaggagtatgctgcctttgtgctgggcgccgccttcagcagcaaccccaaggtgcaggtggaggccattgaaggaggagccctgcagaagctgctggtgatcctggccacagagcagcccctgacagccaagaagaaggtgctgtttgccctgtgcagcctgctgcggcacttcccctatgcccagaggcagttcctgaagctgggcggcctgcaggtgctgcggaccctggtgcaggagaagggcacagaggtgctggccgtgcgggtggtgaccctgctgtatgacctggtgacagagaagatgtttgctgaggaggaggccgagctgacccaggagatgagccctgagaagctgcagcagtaccggcaggtgcacctgctgcccggcctgtgggagcagggctggtgtgagatcacagcccacctgctggccctgcctgagcatgatgcccgggagaaggtgctgcagaccctgggcgtgctgctgaccacctgccgggaccgctaccggcaggacccccagctgggccgcaccctggccagcctgcaggccgagtaccaggtgctggccagcctggagctgcaggatggagaagatgagggctacttccaggagctgctgggctctgtgaacagcctgctgaaggagctgaggtag

SEQ ID NO: 169815 - DNA, 1386 bp, Artificial Sequence; identical to SEQ ID NO: 169814
  Description of Artificial Sequence: Synthetic coding sequence

SEQ ID NO: 169816 - DNA, 288 bp, Artificial Sequence
  Description of Artificial Sequence: Synthetic coding sequence
atggccccccagagcctgcccagcagcaggatggcccccctgggcatgctgctgggcctgctgatggccgcctgcttcaccttctgcctgagccaccagaacctgaaggagtttgccctgaccaaccctgagaagagcagcaccaaggagacagagaggaaggagaccaaggccgaggaggagctggatgctgaggtgctggaggtgttccaccccacccatgagtggcaggccctgcagcccggccaggccgtgcctgctggcagccacgtgcggctgaacctgtag

SEQ ID NO: 169817 - DNA, 492 bp, Artificial Sequence
  Description of Artificial Sequence: Synthetic coding sequence
atggccccccagagcctgcccagcagcaggatggcccccctgggcatgctgctgggcctgctgatggccgcctgcttcaccttctgcctgagccaccagaacctgaaggagtttgccctgaccaaccctgagaagagcagcaccaaggagacagagaggaaggagaccaaggccgaggaggagctggatgctgaggtgctggaggtgttccaccccacccatgagtggcaggccctgcagcccggccaggccgtgcctgctggcagccacgtgcggctgaacctgcagacaggagagcgggaggccaagctgcagtatgaggacaagttcaggaacaacctgaagggcaagaggctggacatcaacaccaacacctacaccagccaggacctgaagagcgccctggccaagttcaaggagggcgctgagatggagagcagcaaagaagacaaggcccggcaggccgaggtgaagaggctcttccggccctag

SEQ ID NO: 169818 - DNA, 372 bp, Artificial Sequence
  Description of Artificial Sequence: Synthetic coding sequence
atggccccccagagcctgcccagcagcaggatggcccccctgggcatgctgctgggcctgctgatggccgcctgcttcaccttctgcctgagccaccagaacctgaaggagtttgccctgaccaaccctgagaagagcagcaccaaggagacagagaggaaggagaccaaggccgaggaggagctggatgctgaggtgctggaggtgttccaccccacccatgagtggcaggccctgcagcccggccaggccgtgcctgctggcagccacgtgcggctgaacctgcagacaggagagcgggaggccaagctgcagtatgaggacaagttcaggaacaacctgaagggcaagaggctggacatcaacacctag

SEQ ID NO: 169819 - DNA, 579 bp, Artificial Sequence
  Description of Artificial Sequence: Synthetic coding sequence
atggccgcctgcttcaccttctgcctgagccaccagaacctgaaggagtttgccctgaccaaccctgagaagagcagcaccaaggagacagagaggaaggagaccaaggccgaggaggagctggatgctgaggtgctggaggtgttccaccccacccatgagtggcaggccctgcagcccggccaggccgtgcctgctggcagccacgtgcggctgaacctgcagacaggagagcgggaggccaagctgcagtatgaggacaagttcaggaacaacctgaagggcaagaggctggacatcaacaccaacacctacaccagccaggacctgaagagcgccctggccaagttcaaggagggcgctgagatggagagcagcaaggaggacaagatggacaatgcccaggacctgctgagctttggaggcctgcaggtggtgatcaatggcctgaacagcacagagcccctggtgaaggagtatgctgcctttgtgctgggcgccgccttcagcagcaaccccaaggtgcaggtggaggccatcgagggcggggccctgcagaagctgctggtgatcctgtag

SEQ ID NO: 169820 - DNA, 3822 bp, Artificial Sequence
  Description of Artificial Sequence: Synthetic coding sequence
atgaagaggcggctggatgaccaggagagccctgtgtatgctgcccagcagaggcgcatccctggcagcacagaggccttcccccaccagcaccgggtgctggccccagcccctcctgtgtatgaagctgtgtctgagaccatgcagagcgccaccggcatccagtacagcgtgacccccagctaccaggtgtctgccatgccccagagcagcggcagccacggccctgccatcgctgctgtgcacagcagccaccaccaccccacagctgtgcagccccacggcggccaggtggtgcagagccacgcccacccagcccctcctgtggcccctgtgcagggccagcagcagttccagaggctgaaggtggaggatgccctgagctacctggaccaggtgaagctgcagtttggcagccagccccaggtgtacaatgacttcctggacatcatgaaggagttcaagagccagagcattgacaccccaggagtcatcagccgggtgtcccagctgttcaagggccacccagacctgatcatgggcttcaacaccttcctgcccccaggctacaagattgaggtgcagaccaatgacatggtgaatgtgaccaccccaggccaggtgcaccagatccccacccacggcatccagccccagccccagcccccaccccagcaccccagccagcccagcgcccagagcgccccagccccagcccagcctgccccccagcccccaccagccaaggtgtccaagcccagccagctgcaggcccacaccccagccagccagcagaccccacccctgcccccctatgccagccccaggagcccccctgtgcagccccacacccctgtgaccatcagcctgggcacagcccccagcctgcagaacaaccagcctgtggagttcaaccacgccatcaactacgtgaacaagatcaagaaccgcttccagggccagcctgacatctacaaggccttcctggagatcctgcacacctaccagaaggagcagagaaatgccaaggaggccggcggcaactacaccccagccctgacagagcaggaggtgtatgcccaggtggcccggctcttcaagaaccaggaggacctgctgtctgaatttggccagttcctgcctgatgccaacagctctgtgctgctgagcaagaccacagctgagaaggtggacagcgtgagaaatgaccacggcggcaccgtgaagaagccccagctgaacaacaagccccagaggcccagccagaatggctgccagatccgccgccaccccaccggcaccaccccacctgtgaagaagaagcccaagctgctgaacctgaaggacagctccatggctgatgccagcaagcacggcggcggcacagagagcctcttctttgacaaggtgaggaaggccctgcggtctgctgaggcctatgagaacttcctgcgctgcctggtgatcttcaaccaggaggtgatcagcagagctgagctggtgcagctggtgagccccttcctgggcaagtttcctgagctgttcaactggttcaagaacttcctgggctacaaggagagcgtgcacctggagacctaccccaaggagcgggccacagagggcatcgccatggagattgattatgccagctgcaagaggctgggcagcagctaccgggccctgcccaagagctaccagcagcccaagtgcaccggccgcacccccctgtgcaaggaggtgctgaatgacacctgggtgtccttccccagctggagcgaggacagcacctttgtgagcagcaagaagacccagtatgaggagcacatctaccgctgtgaagatgaaagatttgagctggatgtggtgctggagaccaacctggccaccatccgggtgctggaggccatccagaagaagctgagccggctgtctgctgaggagcaggccaagttccggctggacaacaccctgggcggcaccagcgaggtgatccacaggaaggccctgcagaggatctatgctgacaaggctgctgacatcattgatggcctgaggaagaaccccagcattgctgtgcccatcgtgctgaagaggctgaagatgaaggaggaggagtggagggaggcccagaggggcttcaacaaggtgtggagggagcagaatgagaagtactacctgaagagcctggaccaccagggcatcaacttcaagcagaatgacaccaaggtgctgcggagcaagagcctgctgaatgaaattgagagcatctatgatgagcggcaggagcaggccacagaagaaaatgccggcgtgcctgtgggcccccacctgagcctggcctatgaggacaagcagatcctggaggatgctgctgccctgatcatccaccacgtgaagaggcagacaggcatccagaaggaggacaagtacaagatcaagcagatcatgcaccacttcatcccagacctgctgtttgcccagagaggagacctgagtgatgtggaggaggaggaggaggaggagatggatgtggatgaggccaccggggctgtgaagaagcacaatggagtgggcggcagcccccccaagagcaagctgctcttcagcaacacagctgcccagaagctgcggggcatggatgaggtgtacaacctcttctacgtgaacaacaactggtacatcttcatgaggctgcaccagatcctgtgcctgcggctgctgcgcatctgcagccaggccgagcggcagatcgaggaggagaaccgggagcgggagtgggagcgggaggtgctgggcatcaagagggacaagagtgacagccctgccatccagctgcggctgaaggagcccatggatgtggatgtggaggactactacccagccttcctggacatggtgcgcagcctgctggatggcaacatcgacagcagccagtatgaggacagcctgcgggagatgttcaccatccacgcctacatcgccttcaccatggacaagctgatccagagcatcgtgcggcagctgcagcacatcgtgtctgatgagatctgtgtgcaggtgacagacctgtacctggccgagaacaacaacggggccactggaggccagctgaacacccagaacagccgcagcctgctggagagcacctaccagaggaaggccgagcagctgatgtctgatgagaactgcttcaagctgatgttcatccagagccagggccaggtgcagctgaccatcgagctgctggacacagaggaggagaacagtgatgatcctgtggaggccgagcgctggagcgactatgtggagcgctacatgaacagcgacaccaccagccctgagctgcgggagcacctggcccagaagcctgtgttcctgcccaggaacctgcggcgcatcaggaagtgccagaggggccgggagcagcaggagaaggagggcaaggagggcaacagcaagaagaccatggagaatgtggacagcctggacaagctggagtgccgcttcaagctgaacagctacaagatggtgtatgtgatcaagtctgaggactacatgtacagaagaacagccctgctgcgggcccaccagagccatgagcgggtgtccaagaggctgcaccagcgcttccaggcctgggtggacaagtggaccaaggagcacgtgccccgggagatggctgctgagaccagcaagtggctgatgggagagggcctggagggcctggtgccctgcaccaccacctgtgacacagagaccctgcactttgtgtccatcaacaagtacagagtgaagtatggcaccgtcttcaaggccccctag

SEQ ID NO: 169821 - DNA, 3822 bp, Artificial Sequence; identical to SEQ ID NO: 169820
  Description of Artificial Sequence: Synthetic coding sequence

SEQ ID NO: 169822 - DNA, 3822 bp, Artificial Sequence; identical to SEQ ID NO: 169820
  Description of Artificial Sequence: Synthetic coding sequence

SEQ ID NO: 169823 - DNA, 3393 bp, Artificial Sequence
  Description of Artificial Sequence: Synthetic coding sequence
atggcccacgccggcggcggcagcggcggcagcggggccggcggccctgctggccggggcctgagcggggcccgctggggccgcagcggcagcgctggccacgagaagctgcctgtgcacgtggaggatgccctgacctacctggaccaggtgaagatccgctttggaagtgaccctgccacctacaacggcttcctggagatcatgaaggagttcaagagccagagcattgacaccccaggagtcatccggcgggtgtcccagctgttccacgagcacccagacctgattgtgggcttcaatgccttcctgcccctgggctacagaattgacatccccaagaatggcaagctgaacatccagagccccctgaccagccaggagaacagccacaaccacggagatggagctgaggacttcaagcagcaggtgccctacaaggaggacaagccccaggtgcccctggagagtgacagcgtggagttcaacaatgccatctcctatgtgaacaagatcaagacccgcttcctggaccaccctgagatctaccgctccttcctggagatcctgcacacctaccagaaggagcagctgaacacccggggccggcccttccggggcatgtctgaggaggaggtgttcacagaggtggccaacctcttccggggccaggaggacctgctgtctgaatttggccagttcctgcctgaggccaagaggagcctcttcaccggaaatggcccctgtgagatgcacagcgtgcagaagaatgaacatgacaagaccccagagcacagcaggaagaggagccggcccagcctgctgcggcctgtgtctgccccagccaagaagaagatgaagctgcggggcaccaaggacctgagcattgctgctgtgggcaagtatggcaccctgcaggagttctccttctttgacaaggtgagaagagtgctgaagagccaggaggtgtatgagaacttcctgcgctgcatcgccctcttcaaccaggagctggtgtctggcagcgagctgctgcagctggtgagccccttcctgggcaagtttcctgagctgtttgcccagttcaagagcttcctgggcgtgaaggagctgagctttgccccacccatgtctgacagaagtggagatggcatcagccgggagattgattatgccagctgcaagagaattggcagcagctaccgggccctgcccaagacctaccagcagcccaagtgcagcggccgcacagccatctgcaaggaggtgctgaatgacacctgggtgtccttccccagctggagcgaggacagcacctttgtgagcagcaagaagaccccctatgaggagcagctgcaccgctgtgaagatgaaagatttgagctggatgtggtgctggagaccaacctggccaccatccgggtgctggagagcgtgcagaagaagctgagcaggatggcccctgaggaccaggagaagttccggctggatgacagcctgggcggcaccagcgaggtgatccagaggcgggccatctaccgcatctacggggacaaggcccctgagatcatcgagagcctgaagaagaaccctgtgacagctgtgcctgtggtgctgaagaggctgaaggccaaggaggaggagtggagggaggcccagcagggcttcaacaagatctggagggagcagtatgagaaggcctacctgaagagcctggaccaccaggccgtgaacttcaagcagaatgacaccaaggccctgcggagcaagagcctgctgaatgaaattgagagcgtgtatgatgagcaccaggagcagcacagcgagggccgcagcgcccccagcagcgagccccacctgatctttgtgtatgaagatcggcagatcctggaggatgctgctgccctgatctcctactacgtgaagaggcagcctgccatccagaaggaggaccagggcaccatccaccagctgctgcaccagtttgtgcccagcctcttcttcagccagcagctggacctgggcgccagcgaggagagcgcagatgaagatcgggacagcccccagggccagaccacagaccccagcgagaggaagaagccagcccctggcccccacagcagccccccagaggagaagggggcctttggagatgccccagccacagagcagccccccctgcccccaccagccccccacaagcccctggatgatgtgtacagcctcttctttgccaacaacaactggtacttcttcctgcggctgcaccagaccctgtgcagccggctgctgaagatctaccggcaggcccagaagcagctgctggagtacagaacagagaaggagcgggagaagctgctgtgtgagggcagaagagagaagggcagtgaccctgccatggagctgcggctgaagcagcccagcgaggtggagctggaggagtactacccagccttcctggacatggtgcgcagcctgctggagggcagcattgaccccacccagtatgaggacaccctgcgggagatgttcaccatccacgcctacgtgggcttcaccatggacaagctggtgcagaacatcgcccggcagctgcaccacctggtgtctgatgatgtgtgcctgaaggtggtggagctgtacctgaatgagaagaagagaggagctgctgggggcaacctgagcagccgctgtgtgcgggccgcccgggagaccagctaccagtggaaggccgagcgctgcatggctgatgagaactgcttcaaggtgatgttcctgcagaggaagggccaggtgatcatgaccatcgagctgctggacacagaggaggcccagacagaagatcctgtggaggtgcagcacctggcccgctacgtggagcagtatgtgggcacagaaggagccagcagcagccccacagagggcttcctgctgaagcctgtgttcctgcagaggaacctgaagaagttcagaagacgctggcagagcgagcaggcccgggccctgcggggggaggcccggagctcctggaagaggctggtgggcgtggagagcgcctgtgatgtggactgccgcttcaagctgagcacccacaagatggtgttcatcgtgaacagcgaggactacatgtacagaagaggcaccctgtgccgggccaagcaggtgcagcccctggtgctgctgcggcaccaccagcactttgaggagtggcacagccgctggctggaggacaacgtgacagtggaggccgccagcctggtgcaggactggctgatgggagaagaagatgaggacatggtgccctgcaagaccctgtgtgagaccgtgcacgtgcacggcctgcctgtgacccgctacagagtgcagtacagcagaagacctgccagcccctag

SEQ ID NO: 169824 - DNA, 3489 bp, Artificial Sequence
  Description of Artificial Sequence: Synthetic coding sequence
atggcccacgccggcggcggcagcggcggcagcggggccggcggccctgctggccggggcctgagcggggcccgctggggccgcagcggcagcgctggccacgagaagctgcctgtgcacgtggaggatgccctgacctacctggaccaggtgaagatccgctttggaagtgaccctgccacctacaacggcttcctggagatcatgaaggagttcaagagccagagcattgacaccccaggagtcatccggcgggtgtcccagctgttccacgagcacccagacctgattgtgggcttcaatgccttcctgcccctgggctacagaattgacatccccaagaatggcaagctgaacatccagagccccctgaccagccaggagaacagccacaaccacggagatggagctgaggacttcaagcagcaggtgccctacaaggaggacaagccccaggtgcccctggagagtgacagcgtggagttcaacaatgccatctcctatgtgaacaagatcaagacccgcttcctggaccaccctgagatctaccgctccttcctggagatcctgcacacctaccagaaggagcagctgaacacccggggccggcccttccggggcatgtctgaggaggaggtgttcacagaggtggccaacctcttccggggccaggaggacctgctgtctgaatttggccagttcctgcctgaggccaagaggagcctcttcaccggaaatggcccctgtgagatgcacagcgtgcagaagaatgaacatgacaagaccccagagcacagcaggaagaggagccggcccagcctgctgcggcctgtgtctgccccagccaagaagaagatgaagctgcggggcaccaaggacctgagcattgctgctgtgggcaagtatggcaccctgcaggagttctccttctttgacaaggtgagaagagtgctgaagagccaggaggtgtatgagaacttcctgcgctgcatcgccctcttcaaccaggagctggtgtctggcagcgagctgctgcagctggtgagccccttcctgggcaagtttcctgagctgtttgcccagttcaagagcttcctgggcgtgaaggagctgagctttgccccacccatgtctgacagaagtggagatggcatcagccgggagattgattatgccagctgcaagagaattggcagcagctaccgggccctgcccaagacctaccagcagcccaagtgcagcggccgcacagccatctgcaaggagctggaccactggaccctgctgcagggctcctggacagatgactactgcatgagcaagttcaagaacacctgctggatccctggctacagcgctggggtgctgaatgacacctgggtgtccttccccagctggagcgaggacagcacctttgtgagcagcaagaagaccccctatgaggagcagctgcaccgctgtgaagatgaaagatttgagctggatgtggtgctggagaccaacctggccaccatccgggtgctggagagcgtgcagaagaagctgagcaggatggcccctgaggaccaggagaagttccggctggatgacagcctgggcggcaccagcgaggtgatccagaggcgggccatctaccgcatctacggggacaaggcccctgagatcatcgagagcctgaagaagaaccctgtgacagctgtgcctgtggtgctgaagaggctgaaggccaaggaggaggagtggagggaggcccagcagggcttcaacaagatctggagggagcagtatgagaaggcctacctgaagagcctggaccaccaggccgtgaacttcaagcagaatgacaccaaggccctgcggagcaagagcctgctgaatgaaattgagagcgtgtatgatgagcaccaggagcagcacagcgagggccgcagcgcccccagcagcgagccccacctgatctttgtgtatgaagatcggcagatcctggaggatgctgctgccctgatctcctactacgtgaagaggcagcctgccatccagaaggaggaccagggcaccatccaccagctgctgcaccagtttgtgcccagcctcttcttcagccagcagctggacctgggcgccagcgaggagagcgcagatgaagatcgggacagcccccagggccagaccacagaccccagcgagaggaagaagccagcccctggcccccacagcagccccccagaggagaagggggcctttggagatgccccagccacagagcagccccccctgcccccaccagccccccacaagcccctggatgatgtgtacagcctcttctttgccaacaacaactggtacttcttcctgcggctgcaccagaccctgtgcagccggctgctgaagatctaccggcaggcccagaagcagctgctggagtacagaacagagaaggagcgggagaagctgctgtgtgagggcagaagagagaagggcagtgaccctgccatggagctgcggctgaagcagcccagcgaggtggagctggaggagtactacccagccttcctggacatggtgcgcagcctgctggagggcagcattgaccccacccagtatgaggacaccctgcgggagatgttcaccatccacgcctacgtgggcttcaccatggacaagctggtgcagaacatcgcccggcagctgcaccacctggtgtctgatgatgtgtgcctgaaggtggtggagctgtacctgaatgagaagaagagaggagctgctgggggcaacctgagcagccgctgtgtgcgggccgcccgggagaccagctaccagtggaaggccgagcgctgcatggctgatgagaactgcttcaaggtgatgttcctgcagaggaagggccaggtgatcatgaccatcgagctgctggacacagaggaggcccagacagaagatcctgtggaggtgcagcacctggcccgctacgtggagcagtatgtgggcacagaaggagccagcagcagccccacagagggcttcctgctgaagcctgtgttcctgcagaggaacctgaagaagttcagaagacgctggcagagcgagcaggcccgggccctgcggggggaggcccggagctcctggaagaggctggtgggcgtggagagcgcctgtgatgtggactgccgcttcaagctgagcacccacaagatggtgttcatcgtgaacagcgaggactacatgtacagaagaggcaccctgtgccgggccaagcaggtgcagcccctggtgctgctgcggcaccaccagcactttgaggagtggcacagccgctggctggaggacaacgtgacagtggaggccgccagcctggtgcaggactggctgatgggagaagaagatgaggacatggtgccctgcaagaccctgtgtgagaccgtgcacgtgcacggcctgcctgtgacccgctacagagtgcagtacagcagaagacctgccagcccctag

SEQ ID NO: 169825 - DNA, 3171 bp, Artificial Sequence
  Description of Artificial Sequence: Synthetic coding sequence
atgagcagccagcagttcccccggctgggcgcccccagcacaggcctgagccaggcccccagccagatcgccaacagcggcagcgctggcctcatcaacccagctgccaccgtgaatgatgagagcggccgggacagcgaggtgtctgcccgggagcacatgagcagcagcagcagcctgcagagccgggaggagaagcaggagcctgtggtggtgcggccctacccccaggtgcagatgctgagcacccaccacgctgtggccagcgccacccctgtggccgtgacagcccccccagcccacctgaccccagctgtgcccctgtccttcagcgagggcctgatgaagcccccacccaagcccaccatgcccagccggcccatcgccccagccccacccagcaccctgagcctgccccccaaggtgcccggccaggtgacagtgaccatggagagcagcatcccccaggccagcgccatccctgtggccaccatcagcggccagcagggccaccccagcaacctgcaccacatcatgaccaccaacgtgcagatgagcatcatccgcagcaatgcccctggcccccccctgcacatcggggccagccacctgcccagaggagctgctgctgctgctgtgatgagcagcagcaaggtgaccaccgtgctgcggcccaccagccagctgcccaatgctgccacagcccagcctgctgtgcagcacatcatccaccagcccatccagagcaggcctcctgtgaccaccagcaatgccatccccccagctgtggtggccaccgtgtctgccacccgggcccagagccctgtgatcaccaccacagctgcccacgccacagattctgccctgagccggcccaccctgagcatccagcaccccccatctgctgccatcagcatccagaggcctgcccagagcagagatgtgaccacccgcatcaccctgcccagccacccagccctgggcacccccaagcagcagctgcacaccatggcccagaagaccatcttcagcacaggcacccctgtggccgccgccaccgtggcccccatcctggccaccaacaccatccccagcgccaccacagctggctctgtgagccacacccaggcccccaccagcaccatcgtgaccatgacagtgcccagccacagcagccacgccacagctgtgaccaccagcaacatccctgtggccaaggtggtgccccagcagatcacccacaccagcccccgcatccagcctgactacccagctgagaggagcagcctcatccccatcagcggccaccgggccagccccaaccctgtggccatggagaccaggagtgacaaccggcccagcgtgcctgtgcagttccagtacttcctgcccacctacccaccttctgcctaccccctggccgcccacacctacacccccatcaccagctctgtgtccaccatccggcagtaccctgtgtctgcccaggcccccaacagcgccatcacagcccagacaggagtgggcgtggccagcacagtgcacctgaaccccatgcagctgatgacagtggatgccagccacgcccggcacatccagggcatccagcctgcccccatcagcacccagggcatccagcctgcccccatcggcaccccaggcatccagcctgcccccctgggcacccagggcatccacagcgccacccccatcaacacccagggcctgcagcctgcccccatgggcacccagcagccccagcctgagggcaagacctctgtggtgctggctgatggagccaccatcgtggccaaccccatcagcaaccccttctctgctgccccagctgccaccaccgtggtgcagacccacagccagagcgccagcaccaatgccccagcccagggcagcagcccccggcccagcatcctgaggaagaagccagccacagatggcatggctgtgaggaagaccctcatccccccccagcccccagatgtggccagcccccgggtggagagctccatgaggagcaccagcggcagccccaggcctgctggggccaagcccaagtctgagatccacgtgtccatggccacccctgtgacagtgtccatggagaccgtgagcaaccagaacaatgaccagcccaccatcgctgtgcccccaacagcccagcagcccccacccaccatccccaccatgattgctgctgccagcccccccagccagcctgctgtggccctgagcaccatccctggagctgtgcccatcaccccacccatcaccaccatcgctgctgcccccccacccagcgtgacagtgggcggcagcctgagctctgtgctgggcccccctgtgcctgagatcaaggtgaaggaggaggtggagcccatggacatcatgaggcctgtgtctgctgtgccccccctggccaccaacacagtgagccccagcctggccctgctggccaacaacctgtccatgcccaccagtgacctgcccccaggggccagccccaggaagaagcccaggaagcagcagcacgtgatcagcacagaggagggggacatgatggagaccaacagcacagatgatgagaagagcacagccaagagcctgctggtgaaggccgagaagaggaagagcccccccaaggagtacattgatgaggagggcgtgcgctacgtgcctgtgcggcccaggcctcccatcaccctgctgcggcactacagaaacccctggaaggccgcctaccaccacttccagcgctacagtgatgtgcgggtgaaggaggagaagaaggccatgctgcaggagatcgccaaccagaagggcgtgtcctgccgggcccagggctggaaggtgcacctgtgtgccgcccagctgctgcagctgaccaacctggagcatgatgtgtatgaaaggctgaccaacctgcaggagggcatcatccccaagaagaaggccgccacagatgatgacctgcaccgcatcaatgagctgatccagggcaacatgcagcgctgcaagctggtgatggaccagatcagcgaggcccgggacagcatgctgaaggtgctggaccacaaggacagagtgctgaagctgctgaacaagaatggaacagtgaagaaggtgtccaagctgaagaggaaggagaaggtgtag

SEQ ID NO: 169826 - DNA, 3147 bp, Artificial Sequence
  Description of Artificial Sequence: Synthetic coding sequence
atgggccccccaagacacccccaggccggggagattgaggccggcggggccggcggcggccgccgcctgcaggtggagatgagcagccagcagttcccccggctgggcgcccccagcacaggcctgagccaggcccccagccagatcgccaacagcggcagcgctggcctcatcaacccagctgccaccgtgaatgatgagagcggccgggacagcgaggtgtctgcccgggagcacatgagcagcagcagcagcctgcagagccgggaggagaagcaggagcctgtggtggtgcggccctacccccaggtgcagatgctgagcacccaccacgctgtggccagcgccacccctgtggccgtgacagcccccccagcccacctgaccccagctgtgcccctgtccttcagcgagggcctgatgaagcccccacccaagcccaccatgcccagccggcccatcgccccagccccacccagcaccctgagcctgccccccaaggtgcccggccaggtgacagtgaccatggagagcagcatcccccaggccagcgccatccctgtggccaccatcagcggccagcagggccaccccagcaacctgcaccacatcatgaccaccaacgtgcagatgagcatcatccgcagcaatgcccctggcccccccctgcacatcggggccagccacctgcccagaggagctgctgctgctgctgtgatgagcagcagcaaggtgaccaccgtgctgcggcccaccagccagctgcccaatgctgccacagcccagcctgctgtgcagcacatcatccaccagcccatccagagcaggcctcctgtgaccaccagcaatgccatccccccagctgtggtggccaccgtgtctgccacccgggcccagagccctgtgatcaccaccacagctgcccacgccacagattctgccctgagccggcccaccctgagcatccagcaccccccatctgctgccatcagcatccagaggcctgcccagagcagagatgtgaccacccgcatcaccctgcccagccacccagccctgggcacccccaagcagcagctgcacaccatggcccagaagaccatcttcagcacaggcacccctgtggccgccgccaccgtggcccccatcctggccaccaacaccatccccagcgccaccacagctggctctgtgagccacacccaggcccccaccagcaccatcgtgaccatgacagtgcccagccacagcagccacgccacagctgtgaccaccagcaacatccctgtggccaaggtggtgccccagcagatcacccacaccagcccccgcatccagcctgactacccagctgagaggagcagcctcatccccatcagcggccaccgggccagccccaaccctgtggccatggagaccaggagtgacaaccggcccagcgtgcctgtgcagttccagtacttcctgcccacctacccaccttctgcctaccccctggccgcccacacctacacccccatcaccagctctgtgtccaccatccggcagtaccctgtgtctgcccaggcccccaacagcgccatcacagcccagacaggagtgggcgtggccagcacagtgcacctgaaccccatgcagctgatgacagtggatgccagccacgcccggcacatccagggcatccagcctgcccccatcagcacccagggcatccagcctgcccccatcggcaccccaggcatccagcctgcccccctgggcacccagggcatccacagcgccacccccatcaacacccagggcctgcagcctgcccccatgggcacccagcagccccagcctgagggcaagaccagcgctgtggtgctggctgatggagccaccatcgtggccaaccccatcagcaaccccttctctgctgccccagctgccaccaccgtggtgcagacccacagccagagcgccagcaccaatgccccagcccagggcagcagcccccggcccagcatcctgaggaagaagccagccacagatggagccaagcccaagtctgagatccacgtgtccatggccacccctgtgacagtgtccatggagaccgtgagcaaccagaacaatgaccagcccaccatcgctgtgcccccaacagcccagcagcccccacccaccatccccaccatgattgctgctgccagcccccccagccagcctgctgtggccctgagcaccatccctggagctgtgcccatcaccccacccatcaccaccatcgctgctgcccccccacccagcgtgacagtgggcggcagcctgagctctgtgctgggcccccctgtgcctgagatcaaggtgaaggaggaggtggagcccatggacatcatgaggcctgtgtctgctgtgccccccctggccaccaacacagtgagccccagcctggccctgctggccaacaacctgtccatgcccaccagtgacctgcccccaggggccagccccaggaagaagcccaggaagcagcagcacgtgatcagcacagaggagggggacatgatggagaccaacagcacagatgatgagaagagcacagccaagagcctgctggtgaaggccgagaagaggaagagcccccccaaggagtacattgatgaggagggcgtgcgctacgtgcctgtgcggcccaggcctcccatcaccctgctgcggcactacagaaacccctggaaggccgcctaccaccacttccagcgctacagtgatgtgcgggtgaaggaggagaagaaggccatgctgcaggagatcgccaaccagaagggcgtgtcctgccgggcccagggctggaaggtgcacctgtgtgccgcccagctgctgcagctgaccaacctggagcatgatgtgtatgaaaggctgaccaacctgcaggagggcatcatccccaagaagaaggccgccacagatgatgacctgcaccgcatcaatgagctgatccagggcaacatgcagcgctgcaagctggtgatggaccagatcagcgaggcccgggacagcatgctgaaggtgctggaccacaaggacagagtgctgaagctgctgaacaagaatggaacagtgaagaaggtgtccaagctgaagaggaaggagaaggtgtag

SEQ ID NO: 169827 - DNA, 3252 bp, Artificial Sequence
  Description of Artificial Sequence: Synthetic coding sequence
atgggccccccaagacacccccaggccggggagattgaggccggcggggccggcggcggccgccgcctgcaggtggagatgagcagccagcagttcccccggctgggcgcccccagcacaggcctgagccaggcccccagccagatcgccaacagcggcagcgctggcctcatcaacccagctgccaccgtgaatgatgagagcggccgggacagcgaggtgtctgcccgggagcacatgagcagcagcagcagcctgcagagccgggaggagaagcaggagcctgtggtggtgcggccctacccccaggtgcagatgctgagcacccaccacgctgtggccagcgccacccctgtggccgtgacagcccccccagcccacctgaccccagctgtgcccctgtccttcagcgagggcctgatgaagcccccacccaagcccaccatgcccagccggcccatcgccccagccccacccagcaccctgagcctgccccccaaggtgcccggccaggtgacagtgaccatggagagcagcatcccccaggccagcgccatccctgtggccaccatcagcggccagcagggccaccccagcaacctgcaccacatcatgaccaccaacgtgcagatgagcatcatccgcagcaatgcccctggcccccccctgcacatcggggccagccacctgcccagaggagctgctgctgctgctgtgatgagcagcagcaaggtgaccaccgtgctgcggcccaccagccagctgcccaatgctgccacagcccagcctgctgtgcagcacatcatccaccagcccatccagagcaggcctcctgtgaccaccagcaatgccatccccccagctgtggtggccaccgtgtctgccacccgggcccagagccctgtgatcaccaccacagctgcccacgccacagattctgccctgagccggcccaccctgagcatccagcaccccccatctgctgccatcagcatccagaggcctgcccagagcagagatgtgaccacccgcatcaccctgcccagccacccagccctgggcacccccaagcagcagctgcacaccatggcccagaagaccatcttcagcacaggcacccctgtggccgccgccaccgtggcccccatcctggccaccaacaccatccccagcgccaccacagctggctctgtgagccacacccaggcccccaccagcaccatcgtgaccatgacagtgcccagccacagcagccacgccacagctgtgaccaccagcaacatccctgtggccaaggtggtgccccagcagatcacccacaccagcccccgcatccagcctgactacccagctgagaggagcagcctcatccccatcagcggccaccgggccagccccaaccctgtggccatggagaccaggagtgacaaccggcccagcgtgcctgtgcagttccagtacttcctgcccacctacccaccttctgcctaccccctggccgcccacacctacacccccatcaccagctctgtgtccaccatccggcagtaccctgtgtctgcccaggcccccaacagcgccatcacagcccagacaggagtgggcgtggccagcacagtgcacctgaaccccatgcagctgatgacagtggatgccagccacgcccggcacatccagggcatccagcctgcccccatcagcacccagggcatccagcctgcccccatcggcaccccaggcatccagcctgcccccctgggcacccagggcatccacagcgccacccccatcaacacccagggcctgcagcctgcccccatgggcacccagcagccccagcctgagggcaagaccagcgctgtggtgctggctgatggagccaccatcgtggccaaccccatcagcaaccccttctctgctgccccagctgccaccaccgtggtgcagacccacagccagagcgccagcaccaatgccccagcccagggcagcagcccccggcccagcatcctgaggaagaagccagccacagatggcatggctgtgaggaagaccctcatccccccccagcccccagatgtggccagcccccgggtggagagctccatgaggagcaccagcggcagccccaggcctgctggggccaagcccaagtctgagatccacgtgtccatggccacccctgtgacagtgtccatggagaccgtgagcaaccagaacaatgaccagcccaccatcgctgtgcccccaacagcccagcagcccccacccaccatccccaccatgattgctgctgccagcccccccagccagcctgctgtggccctgagcaccatccctggagctgtgcccatcaccccacccatcaccaccatcgccgccgcccctcctccttctgtgacagtgggcggcagcctgagctctgtgctgggcccccctgtgcctgagatcaaggtgaaggaggaggtggagcccatggacatcatgaggcctgtgtctgctgtgccccccctggccaccaacacagtgagccccagcctggccctgctggccaacaacctgtccatgcccaccagtgacctgcccccaggggccagccccaggaagaagcccaggaagcagcagcacgtgatcagcacagaggagggggacatgatggagaccaacagcacagatgatgagaagagcacagccaagagcctgctggtgaaggccgagaagaggaagagcccccccaaggagtacattgatgaggagggcgtgcgctacgtgcctgtgcggccccggccccccatcaccctgctgcggcactacagaaacccctggaaggccgcctaccaccacttccagcgctacagtgatgtgcgggtgaaggaggagaagaaggccatgctgcaggagatcgccaaccagaagggcgtgtcctgccgggcccagggctggaaggtgcacctgtgtgccgcccagctgctgcagctgaccaacctggagcatgatgtgtatgagcggctgaccaacctgcaggagggcatcatccccaagaagaaggccgccacagatgatgacctgcaccgcatcaatgaactcatccagggcaacatgcagcgctgcaagctggtgatggaccagatcagcgaggcccgggacagcatgctgaaggtgctggaccacaaggacagagtgctgaagctgctgaacaagaatggcaccgtgaagaaggtgtccaagctgaagaggaaggagaaggtgtag

SEQ ID NO: 169828 - DNA, 789 bp, Artificial Sequence
  Description of Artificial Sequence: Synthetic coding sequence
atgagcagccagcagttcccccggctgggcgcccccagcacaggcctgagccaggcccccagccagatcgccaacagcggcagcgctggcctcatcaacccagctgccaccgtgaatgatgagagcggccgggacagcgaggtgtctgcccgggagcacatgagcagcagcagcagcctgcagagccgggaggagaagcaggagcctgtggtggtgcggccctacccccaggtgcagatgctgagcacccaccacgctgtggccagcgccacccctgtggccgtgacagcccccccagcccacctgaccccagctgtgcccctgtccttcagcgagggcctgatgaagcccccacccaagcccaccatgcccagccggcccatcgccccagccccacccagcaccctgagcctgccccccaaggtgcccggccaggtgacagtgaccatggagagcagcatcccccaggccagcgccatccctgtggccaccatcagcggccagcagggccaccccagcaacctgcaccacatcatgaccaccaacgtgcagatgagcatcatccgcagcaatgcccctggcccccccctgcacatcggggccagccacctgcccagaggagctgctgctgctgctgtgatgagcagcagcaaggtgaccaccgtgctgcggcccaccagccagctgcccaatgctgccacagcccagcctgctgtgcagcacatcatccaccagcccatccagagcaggcctcctgtgaccaccagcaatgccatccccccagcctag

SEQ ID NO: 169829 - DNA, 630 bp, Artificial Sequence
  Description of Artificial Sequence: Synthetic coding sequence
atgaaccccagcatgaagcagaagcaggaggagatcaaggagaacatcaagaacagctctgtgcccaggaggaccctgaagatgatccagcccagcgccagcggcagcctggtgggcagagaaaatgagctgtctgctggcctgagcaagaggaagcacagaaatgaccacctgaccagcaccaccagcagccctggggtcatcgtgcctgagagcagcgagaacaagaacctgggcggcgtgacccaggagagctttgacctgatgatcaaggagaaccccagcagccagtactggaaggaggtggccgagaagaggaggaaggccctgtatgaggccctgaaggaaaatgagaagctgcacaaggagattgagcagaaggacaatgaaattgcccggctgaagaaggagaacaaggagctggccgaggtggccgagcacgtgcagtacatggccgagctgattgagcggctgaatggagagcccctggacaactttgagagcctggacaaccaggagtttgacagcgaggaggagaccgtggaggacagcctggtggaggacagcgagatcggcacctgtgccgagggcaccgtgagcagcagcacagatgccaagccctgcatctag

SEQ ID NO: 169830 - DNA, 2622 bp, Artificial Sequence
  Description of Artificial Sequence: Synthetic coding sequence
atggccgagatggagaaggagggccggcccccagagaacaagaggagcaggaagccagcccaccctgtgaagcgggagatcaatgaggagatgaagaactttgctgagaacaccatgaatgagctgctgggctggtacggctatgacaaggtggagctgaaggatggagaagatattgagttccgcagctaccccacagatggagagagccggcagcacatctctgtgctgaaggagaacagcctgcccaagcccaagctgcctgaagattctgtcatcagcccctacaacatcagcacaggctacagcggcctggccactggaaatggcctgagtgacagccctgctggcagcaaggaccacggctctgtgcccatcatcgtgcccctcatccccccacccttcatcaagcccccagcagaagatgatgtgtccaatgtgcagatcatgtgtgcctggtgccagaaggtgggcatcaagcgctacagcctgtccatgggcagcgaggtgaagagcttctgcagcgagaagtgctttgctgcctgcagaagagcctacttcaagaggaacaaggccagagatgaagatggccatgctgagaacttcccccagcagcactacgccaaggagaccccccggctggccttcaagaacaactgtgagctgctggtgtgtgactggtgcaagcacatccgccacaccaaggagtacctggactttggagatggagagcggcggctgcagttctgcagcgccaagtgcctgaaccagtacaagatggacatcttctacaaggagacccaggccaacctgcctgctggcctgtgcagcaccctgcacccccccatggagaacaaggccgagggcaccggggtgcagctgctgaccccagacagctggaacatccccctgacagatgcccggaggaaggcccccagccctgtggccacagctggccagagccagggccctggccccagcgccagcaccaccgtgagccccagcgacacagccaactgcagcgtgaccaagatccccacccctgtgcccaagagcatccccatcagcgagacccccaacatcccccctgtgtctgtgcagcccccagccagcatcggcccccccctgggcgtgcccccaagaagcccccccatggtgatgaccaacagaggccctgtgcccctgcccatcttcatggagcagcagatcatgcagcagatccggccccccttcatccggggccccccccaccacgccagcaaccccaacagccccctgagcaaccccatgctgcccggcatcggccccccacctgggggccccaggaacctgggccccaccagcagccccatgcaccggcccatgctgagcccccacatccacccccccagcacccccaccatgcctggcaaccccccaggcctgctgcccccacctcctcctggggcccccctgcccagcctgcccttcccccctgtgtccatgatgcccaacggccccatgcctgtgccccagatgatgaactttggcctgcccagcctggcccccctggtgcccccacccaccctgctggtgccctaccctgtgattgtgcccctgcctgtgcccatccccatccccatccccatcccccacgtgtctgacagcaagcccccaaatggcttcagcagcaatggagagaacttcatccccaatgcccctggggacagcgctgctgctgggggcaagcccagcggccacagcctgagcccccgggacagcaagcagggcagcagcaagtctgctgacagccccccaggctgcagcggccaggccctgagcctggcccccaccccagctgagcacggccgctctgaggtggtggacctgaccaggagagctggcagccccccaggccccccaggggccggcggccagctgggcttccctggggtgctgcagggcccccaggatggagtcatcgacctgactgtgggccaccgggcccggctgcacaacgtcatccaccgggccctgcacgcccacgtgaaggccgagcgggagcccagcgctgctgagaggaggacctgtggcggctgcagagatggccactgcagccccccagctgctggggaccccggccctggggccccagctggccctgaggccgccgccgcctgcaatgtgattgtgaatggcaccagaggagctgctgctgagggcgccaagtctgctgagcccccacctgagcagcccccacctcctcctcctccagccccacccaagaagctgctgagccctgaggagcctgctgtgtctgagctggagagcgtgaaggagaacaactgtgccagcaactgccacctggatggagaggccgccaagaagctgatgggagaggaggccctggccggcggggacaagagtgaccccaacctgaacaacccagcagatgaggaccacgcctatgccctgaggatgctgcccaagacaggctgcgtcatccagcctgtgcccaagccagctgagaaggccgccatggccccctgcatcatcagcagccccatgctgtctgctggccctgaggacctggagccccccctgaagaggcgctgcctgcgcatccggaaccagaacaagtag

SEQ ID NO: 169831 - DNA, 1233 bp, Artificial Sequence
  Description of Artificial Sequence: Synthetic coding sequence
atgcctggggtgtgtgaccgggccccagacttcctgagccccagcgaggaccaggtgctgcggcctgccctgggcagctctgtggccctgaactgcacagcctgggtggtgtctggcccccactgcagcctgcccagcgtgcagtggctgaaggatggcctgcccctgggcatcggcggccactacagcctgcacgagtacagctgggtgaaggccaacctgtctgaggtgctggtgtcctctgtgctgggcgtgaatgtgaccagcacagaggtgtatggagccttcacctgcagcatccagaacatctccttcagcagcttcaccctgcagagagctggccccaccagccacgtggccgctgtgctggccagcctgctggtgctgctggccctgctgctggccgccctgctgtatgtgaagtgccgcctgaatgtgctgctgtggtaccaggatgcctacggggaggtggagatcaatgatggcaagctgtatgatgcctacgtgtcctacagcgactgcccagaggacaggaagtttgtgaacttcatcctgaagccccagctggagcggcggcggggctacaagctgttcctggatgaccgggacctgctgcccagggctgagcccagcgctgacctgctggtgaacctgagccgctgccggcggctgattgtggtgctgagtgatgccttcctgagccgggcctggtgcagccacagcttccgggagggcctgtgccgcctgctggagctgacccggcggcccatcttcatcacctttgagggccagaggcgggaccctgcccacccagccctgcggctgctgcggcagcaccgccacctggtgaccctgctgctgtggaggcctggctctgtgacccccagcagtgacttctggaaggaggtgcagctggccctgcccaggaaggtgcagtacagacctgtggagggggacccccagacccagctgcaggatgacaaggaccccatgctgatcctgcggggccgggtgcctgagggccgggccctggacagcgaggtggaccctgaccctgagggggacctgggcgtgcggggccctgtgtttggagagcccagcgccccaccccacaccagcggcgtgtccctgggggagagccgcagcagcgaggtggatgtgtctgacctgggcagcaggaactacagcgccaggacagacttctactgcctggtgtccaaggatgacatgtag

SEQ ID NO: 169832 - DNA, 1515 bp, Artificial Sequence
  Description of Artificial Sequence: Synthetic coding sequence
atgcctggggtgtgtgaccgggccccagacttcctgagccccagcgaggaccaggtgctgcggcctgccctgggcagctctgtggccctgaactgcacagcctgggtggtgtctggcccccactgcagcctgcccagcgtgcagtggctgaaggatggcctgcccctgggcatcggcggccactacagcctgcacgagtacagctgggtgaaggccaacctgtctgaggtgctggtgtcctctgtgctgggcgtgaatgtgaccagcacagaggtgtatggagccttcacctgcagcatccagaacatctccttcagcagcttcaccctgcagagagctggccccaccagccacgtggccgctgtgctggccagcctgctggtgctgctggccctgctgctggccgccctgctgtatgtgaagtgccgcctgaatgtgctgctgtggtaccaggatgcctacggggaggtggagatcaatgatggcaagctgtatgatgcctacgtgtcctacagcgactgcccagaggacaggaagtttgtgaacttcatcctgaagccccagctggagcggcggcggggctacaagctgttcctggatgaccgggacctgctgcccagggctgagcccagcgctgacctgctggtgaacctgagccgctgccggcggctgattgtggtgctgagtgatgccttcctgagccgggcctggtgcagccacagcttccgggagggcctgtgccgcctgctggagctgacccggcggcccatcttcatcacctttgagggccagaggcgggaccctgcccacccagccctgcggctgctgcggcagcaccgccacctggtgaccctgctgctgtggaggcctggctctgtgacccccagcagtgacttctggaaggaggtgcagctggccctgcccaggaaggtgcagtacagacctgtggagggggacccccagacccagctgcaggatgacaaggaccccatgctgatcctgcggggccgggtgcctgagggccgggccctggacagcgaggtggaccctgaccctgagggggacctgggcatgcctgcccagccccacagccccaccggggaggcccagcacagagctgagtggggccaggcccagggcactggacctggaggagcccctggggtggaggacagcagccgccaccgggagcccctgcacggcctgtgccctgggggcgcccggcccagcgtgtgcctgggcacctcctgggccagccaggccatcacagctggaggagagcagggccagcccctggccgtgggcctgggccagggctgcggctggccaccccaggccagccgcagcccccacccccgctgccctggggcctgcctgtggagggccatcagcagcacagcccaccagtggggcctggccggccgggagcctgagcagaggagcggccgcctgggcagccggctggccaagctgcagtgcccccaccggctgctgctgcccggggtgcagggctag

SEQ ID NO: 169833 - DNA, 1233 bp, Artificial Sequence; identical to SEQ ID NO: 169831
  Description of Artificial Sequence: Synthetic coding sequence

SEQ ID NO: 169834 - DNA, 1233 bp, Artificial Sequence; identical to SEQ ID NO: 169831
  Description of Artificial Sequence: Synthetic coding sequence

SEQ ID NO: 169835 - DNA, 1515 bp, Artificial Sequence; identical to SEQ ID NO: 169832
  Description of Artificial Sequence: Synthetic coding sequence

SEQ ID NO: 169836 - DNA, 1107 bp, Artificial Sequence
  Description of Artificial Sequence: Synthetic coding sequence
atgtttgccaagggcaagggcagcgctgtgcccagtgatggccaggcccgggagaagctggccctgtatgtgtatgagtacctgctgcacgtgggcgcccagaagagcgcccagaccttcctgtctgagatccgctgggagaagaacatcaccctgggggagcccccaggcttcctgcacagctggtggtgtgtgttctgggacctgtactgtgccgcccctgagcggcgggacacctgtgagcacagcagcgaggccaaggccttccatgactacagcgctgctgctgcccccagccctgtgctgggcaacatccccccaaatgatggcatgcctgggggccccatccccccaggcttcttccagggccccccaggcagccagcccagcccccacgcccagcccccaccccacaaccccagctccatgatgggcccccacagccagcccccaggaggagtgcccggcacccagcccctgctgcccaacagcatggaccccacccggcagcagggccaccccaacatgggcggctccatgcagaggatgaaccccccccggggcatgggccccatgggccctggcccccagaactacggcagcggcatgaggcccccacccaacagcctgggccctgccatgcctggcatcaacatgggccctggagctggccggccctggcccaaccccaacagcgccaacagcatcccctacagcagcagcagccctggcacctacgtgggccccccaggcggcggcggccccccaggcacccccatcatgcccagccctgctgacagcaccaacagcagtgacaacatctacaccatgatcaaccctgtgcccccaggcggcagccgcagcaacttccccatgggccctggcagtgatggccccatgggcggcatgggcggcatggagccccaccacatgaatggcagcctgggcagcggggacattgatggcctgcccaagaacagccccaacaacatcagcggcatcagcaaccccccaggcaccccaagagatgatggagagctgggcggcaacttcctgcacagcttccagaatgacaactacagccccagcatgaccatgtctgtgtag

SEQ ID NO: 169837 - DNA, 1086 bp, Artificial Sequence
  Description of Artificial Sequence: Synthetic coding sequence
atgtttgccaagggcaagggcagcgctgtgcccagtgatggccaggcccgggagaagctggccctgtatgtgtatgagtacctgctgcacgtgggcgcccagaagagcgcccagaccttcctgtctgagatccgctgggagaagaacatcaccctgggggagcccccaggcttcctgcacagctggtggtgtgtgttctgggacctgtactgtgccgcccctgagcggcgggacacctgtgagcacagcagcgaggccaaggccttccatgactacagcgctgctgctgcccccagccctgtgctgggcaacatccccccaaatgatggcatgcctgggggccccatccccccaggcttcttccagcccttcatgagccccaggtatgctgggggccccaggcctcccatccgcatgggcaaccagcccccaggcggcgtgcccggcacccagcccctgctgcccaacagcatggaccccacccggcagcagggccaccccaacatgggcggctccatgcagaggatgaaccccccccggggcatgggccccatgggccctggcccccagaactacggcagcggcatgaggcccccacccaacagcctgggccctgccatgcctggcatcaacatgggccctggggccggccggccctggcccaaccccaacagcgccaacagcatcccctacagcagcagcagccctggcacctacgtgggccccccaggcggcggcggccccccaggcacccccatcatgcccagccctgctgacagcaccaacagcagtgacaacatctacaccatgatcaaccctgtgcccccaggcggcagccgcagcaacttccccatgggccctggcagtgatggccccatgggcggcatgggcggcatggagccccaccacatgaatggcagcctgggcagcggggacattgatggcctgcccaagaacagccccaacaacatcagcggcatcagcaaccccccaggcaccccaagagatgatggagagctgggcggcaacttcctgcacagcttccagaatgacaactacagccccagcatgaccatgtctgtgtag

SEQ ID NO: 169838 - DNA, 1167 bp, Artificial Sequence
  Description of Artificial Sequence: Synthetic coding sequence
atgtttgccaagggcaagggcagcgctgtgcccagtgatggccaggcccgggagaagctggccctgtatgtgtatgagtacctgctgcacgtgggcgcccagaagagcgcccagaccttcctgtctgagatccgctgggagaagaacatcaccctgggggagcccccaggcttcctgcacagctggtggtgtgtgttctgggacctgtactgtgccgcccctgagcggcgggacacctgtgagcacagcagcgaggccaaggccttccatgactacagcgctgctgctgcccccagccctgtgctgggcaacatccccccaaatgatggcatgcctgggggccccatccccccaggcttcttccagggccccccaggcagccagcccagcccccacgcccagcccccaccccacaaccccagctccatgatgggcccccacagccagcccttcatgagccccaggtatgccggcggcccccggccccccatccgcatgggcaaccagcccccaggaggagtgcccggcacccagcccctgctgcccaacagcatggaccccacccggcagcagggccaccccaacatgggcggctccatgcagaggatgaaccccccccggggcatgggccccatgggccctggcccccagaactacggcagcggcatgaggcccccacccaacagcctgggccctgccatgcctggcatcaacatgggccctggagctggccggccctggcccaaccccaacagcgccaacagcatcccctacagcagcagcagccctggcacctacgtgggccccccaggcggcggcggccccccaggcacccccatcatgcccagccctgctgacagcaccaacagcagtgacaacatctacaccatgatcaaccctgtgcccccaggcggcagccgcagcaacttccccatgggccctggcagtgatggccccatgggcggcatgggcggcatggagccccaccacatgaatggcagcctgggcagcggggacattgatggcctgcccaagaacagccccaacaacatcagcggcatcagcaaccccccaggcaccccaagagatgatggagagctgggcggcaacttcctgcacagcttccagaatgacaactacagccccagcatgaccatgtctgtgtag

SEQ ID NO: 169839 - DNA, 837 bp, Artificial Sequence
  Description of Artificial Sequence: Synthetic coding sequence
atgcctgggggccccatccccccaggcttcttccagggccccccaggcagccagcccagcccccacgcccagcccccaccccacaaccccagctccatgatgggcccccacagccagcccttcatgagccccaggtatgccggcggcccccggccccccatccgcatgggcaaccagcccccaggaggagtgcccggcacccagcccctgctgcccaacagcatggaccccacccggcagcagggccaccccaacatgggcggctccatgcagaggatgaaccccccccggggcatgggccccatgggccctggcccccagaactacggcagcggcatgaggcccccacccaacagcctgggccctgccatgcctggcatcaacatgggccctggagctggccggccctggcccaaccccaacagcgccaacagcatcccctacagcagcagcagccctggcacctacgtgggccccccaggcggcggcggccccccaggcacccccatcatgcccagccctgctgacagcaccaacagcagtgacaacatctacaccatgatcaaccctgtgcccccaggcggcagccgcagcaacttccccatgggccctggcagtgatggccccatgggcggcatgggcggcatggagccccaccacatgaatggcagcctgggcagcggggacattgatggcctgcccaagaacagccccaacaacatcagcggcatcagcaaccccccaggcaccccaagagatgatggagagctgggcggcaacttcctgcacagcttccagaatgacaactacagccccagcatgaccatgtctgtgtag

SEQ ID NO: 169840 - DNA, 471 bp, Artificial Sequence
  Description of Artificial Sequence: Synthetic coding sequence
cctcctgggggcgtgcccggcacccagcccctgctgcccaacagcatggaccccacccggcagcagggccaccccaacatgggcggctccatgcagaggatgaaccccccccggggcatgggccccatgggccctggcccccagaactacggcagcggcatgaggcccccacccaacagcctgggccctgccatgcctggcatcaacatgggccctggggccggccggccctggcccaaccccaacagcgccaacagcatcccctacagcagcagcagccctggcacctacgtgggccccccaggcggcggcggccccccaggcacccccatcatgcccagccctgctgacagcaccaacagcagtgacaacatctacaccatgatcaaccctgtgcccccaggcggcagccgcagcaatgtgtccctgctgagcaacaacctgcacatccgccaccacaacaagagctag

SEQ ID NO: 169841 - DNA, 1158 bp, Artificial Sequence
  Description of Artificial Sequence: Synthetic coding sequence
atgtatgccaagggcggcaaaggatctgctgtgcccagcgacagccaggcccgggagaagctggccctgtatgtgtatgagtacctgctgcacatcggggcccagaagagcgcccagaccttcctgtctgagatccgctgggagaagaacatcaccctgggggagcccccaggcttcctgcacagctggtggtgtgtgttctgggacctgtactgtgccgccccagacagaagagaggcctgtgagcacagcggggaggccaaggccttccaggactacagcgctgctgctgcccccagccctgtgatgggctccatggcccctggggacaccatggccgccggctccatggctgctggcttcttccagggccccccaggcagccagcccagcccccacaaccccaatgcccccatgatgggcccccacggccagcccttcatgagcccccgcttccctgggggcccccggcccaccctgaggatgcccagccagcccccagctggcctgcccggcagccagcccctgctgcccggggccatggagcccagcccccgggcccagggccaccccagcatgggcggccccatgcagagggtgaccccaccccggggcatggcctctgtgggcccccagagctatggaggcggcatgaggcccccacccaacagcctggccggccctggcctgcctgccatgaacatgggccctggggtgcggggcccctgggccagccccagcggcaacagcatcccctacagcagcagcagccctggcagctacacaggccccccaggcggcggcggccccccaggcacccccatcatgcccagccctggggacagcaccaacagcagcgagaacatgtacaccatcatgaaccccatcggccagggcgccggccgggccaacttccccctgggccctggccctgagggccccatggccgccatgtctgccatggagccccaccacgtgaatggcagcctgggcagcggggacatggatggcctgcccaagagcagccctggagctgtggccggcctgagcaatgcccctggcaccccaagagatgatggagagatggctgctgctggcaccttcctgcaccccttccccagcgagagctacagccctggcatgaccatgtctgtgtag

SEQ ID NO: 169842 - DNA, 1092 bp, Artificial Sequence
  Description of Artificial Sequence: Synthetic coding sequence
atgtatgccaagggcggcaaaggatctgctgtgcccagcgacagccaggcccgggagaagctggccctgtatgtgtatgagtacctgctgcacatcggggcccagaagagcgcccagaccttcctgtctgagatccgctgggagaagaacatcaccctgggggagcccccaggcttcctgcacagctggtggtgtgtgttctgggacctgtactgtgccgccccagacagaagagaggcctgtgagcacagcggggaggccaaggccttccaggactacagcgctgctgctgcccccagccctgtgatgggctccatggcccctggggacaccatggccgccggctccatggctgctggcttcttccagcccttcatgagcccccgcttccctgggggcccccggcccaccctgaggatgcccagccagcccccagctggcctgcccggcagccagcccctgctgcccggggccatggagcccagcccccgggcccagggccaccccagcatgggcggccccatgcagagggtgaccccaccccggggcatggcctctgtgggcccccagagctatggaggcggcatgaggcccccacccaacagcctggccggccctggcctgcctgccatgaacatgggccctggggtgcggggcccctgggccagccccagcggcaacagcatcccctacagcagcagcagccctggcagctacacaggccccccaggcggcggcggccccccaggcacccccatcatgcccagccctggggacagcaccaacagcagcgagaacatgtacaccatcatgaaccccatcggccagggcgccggccgggccaacttccccctgggccctggccctgagggccccatggccgccatgtctgccatggagccccaccacgtgaatggcagcctgggcagcggggacatggatggcctgcccaagagcagccctggagctgtggccggcctgagcaatgcccctggcaccccaagagatgatggagagatggctgctgctggcaccttcctgcaccccttccccagcgagagctacagccctggcatgaccatgtctgtgtag

SEQ ID NO: 169843 - DNA, 2301 bp, Artificial Sequence
  Description of Artificial Sequence: Synthetic coding sequence
atgaaggagaagagcaagaatgctgcccggacccggcgggagaaggagaacagcgagttctatgagctggccaagctgctgcccctgcccagcgccatcaccagccagctggacaaggccagcatcatccggctgaccaccagctacctgaagatgagggtggtgtttcctgagggcctgggggaggcctggggccacagcagcaggaccagccccctggacaacgtgggccgggagctgggcagccacctgctgcagaccctggatggcttcatctttgtggtggccccagatggcaagatcatgtacatcagcgagacagcctctgtgcacctgggcctgagccaggtggagctgaccggcaacagcatctatgagtacatccaccctgctgaccatgatgagatgacagctgtgctgacagcccaccagccctaccacagccactttgtgcaggagtatgaaattgaaagaagcttcttcctgaggatgaagtgtgtgctggccaagagaaatgccggcctgacctgtggcggctacaaggtgatccactgcagcggctacctgaagatccggcagtacagcctggacatgagcccctttgatggctgctaccagaatgtgggcctggtggccgtgggccacagcctgccccccagcgctgtgacagagatcaagctgcacagcaacatgttcatgttccgggccagcctggacatgaagctgatcttcctggacagccgggtggccgagctgaccggctatgagccccaggacctgattgagaagaccctgtaccaccacgtgcacggctgtgacaccttccacctgcgctgtgcccaccacctgctgctggtgaagggccaggtgaccaccaagtactaccgcttcctggccaagcatggaggctgggtgtgggtgcagagctatgccaccatcgtgcacaacagccgcagcagccggccccactgcatcgtgtctgtgaactacgtgctgacagacacagagtacaagggcctgcagctgagcctggaccagatcagcgccagcaagccagccttctcctacaccagcagcagcacccccaccatgacagacaacagaaaaggagccaagagccggctgagcagcagcaagagcaagagcaggaccagcccctacccccagtacagcggcttccacacagagaggtctgagagtgaccatgacagccagtggggcggcagccccctgacagacacagccagcccccagctgctggaccctgctgaccggcccggcagccagcatgatgccagctgtgcctaccggcagttcagtgacaggagcagcctgtgctacggctttgccctggaccacagccggctggtggaggagcggcacttccacacccaggcctgtgagggcggccgctgtgaggccggccgctacttcctgggcaccccccaggccggccgggagccctggtggggcagccgggccgccctgcccctgaccaaggccagccctgagagccgggaggcctatgagaacagcatgccccacatcgcctctgtgcaccgcatccacggccggggccactgggatgaggacagcgtggtgagcagcccagaccccggcagcgccagcgagagcggggaccgctacagaacagagcagtaccagagcagcccccatgagcccagcaagattgagaccctcatccgggccacccagcagatgatcaaggaggaggagaaccggctgcagctgaggaaggcccccagcgaccagctggccagcatcaacggggccggcaagaagcacagcctgtgctttgccaactaccagcagcccccacccactggagaggtgtgccacggcagcgccctggccaacaccagcccctgtgaccacatccagcagcgggagggcaagatgctgagcccccatgaaaatgactatgacaacagccccacagccctgagccgcatcagcagccccaacagcgaccgcatcagcaagagcagcctcatcctggccaaggactacctgcacagcgacatcagcccccaccagacagctggggaccaccccaccgtgagccccaactgcttcggcagccaccggcagtactttgacaagcacgcctacaccctgaccggctacgccctggagcacctgtatgacagcgagaccatccggaactacagcctgggctgcaatggcagccactttgatgtgaccagccacctgaggatgcagcctgaccctgcccagggccacaagggcaccagcgtcatcatcaccaacggcagctag

SEQ ID NO: 169844 - DNA, 2301 bp, Artificial Sequence; identical to SEQ ID NO: 169843
  Description of Artificial Sequence: Synthetic coding sequence

SEQ ID NO: 169845 - DNA, 2004 bp, Artificial Sequence
  Description of Artificial Sequence: Synthetic coding sequence
atgaaggagaagagcaagaatgctgccaagacccggcgggagaaggaaaatggagagttctatgagctggccaagctgctgcccctgcccagcgccatcaccagccagctggacaaggccagcatcatccggctgaccaccagctacctgaagatgagagctgtgtttcctgagggcctgggagatgcctggggccagcccagccgggccggccccctggatggagtggccaaggagctgggcagccacctgctgcagaccctggatggctttgtgtttgtggtggccagtgatggcaagatcatgtacatcagcgagacagcctctgtgcacctgggcctgagccaggtggagctgaccggcaacagcatctatgagtacatccaccccagcgaccatgatgagatgacagctgtgctgacagcccaccagcccctgcaccaccacctgctgcaggagtatgaaattgaaagaagcttcttcctgaggatgaagtgtgtgctggccaagagaaatgccggcctgacctgcagcggctacaaggtgatccactgcagcggctacctgaagatccggcagtacatgctggacatgagcctgtatgacagctgctaccagatcgtgggcctggtggccgtgggccagagcctgccccccagcgccatcacagagatcaagctgtacagcaacatgttcatgttccgggccagcctggacctgaagctgatcttcctggacagccgggtgacagaggtgacaggctatgagccccaggacctgattgagaagaccctgtaccaccacgtgcacggctgtgatgtgttccacctgcgctatgcccaccacctgctgctggtgaagggccaggtgaccaccaagtactaccgcctgctgagcaagaggggcggctgggtgtgggtgcagagctatgccaccgtggtgcacaacagccgcagcagccggccccactgcatcgtgtctgtgaactacgtgctgacagaaattgagtacaaggagctgcagctgagcctggagcaggtgtccacagccaagagccaggacagctggaggacagccctgagcaccagccaggagaccaggaagctggtgaagcccaagaacaccaagatgaagaccaagctgcggaccaacccctacccaccccagcagtacagcagcttccagatggacaagctggagtgtggccagctgggcaactggagggccagccccccagccagcgctgctgcccctcctgagctgcagccccacagcgagagcagtgacctgctgtacacccccagctacagcctgcccttctcctaccactacggccacttccccctggacagccacgtgttcagcagcaagaagcccatgctgcctgccaagtttggccagccccagggcagcccctgtgaggtggcccgcttcttcctgagcaccctgcctgccagcggggagtgccagtggcactacgccaaccccctggtgcccagcagcagcagccctgccaagaaccccccagagcccccagccaacacagcccggcacagcctggtgcccagctatgaggccccagctgctgctgtgagaagatttggagaggacacagccccacccagcttccccagctgtggccactaccgggaggagcccgccctgggccctgccaaggccgcccggcaggccgccagagatggagcccggctggccctggcccgggccgcccctgagtgctgtgccccacccaccccagaggcccctggggccccagcccagctgccctttgtgctgctgaactaccaccgggtgctggcccggcggggccccctgggcggggccgccccagctgccagcggcctggcctgtgcccctgggggccctgaggccgccactggagccctgcggctgcggcaccccagccctgctgccaccagccccccaggggcccccctgccccactacctgggcgccagcgtcatcatcaccaatggaagatag

SEQ ID NO: 169846 - DNA, 1713 bp, Artificial Sequence
  Description of Artificial Sequence: Synthetic coding sequence
atgaaggagaagagcaagaatgctgccaagacccggcgggagaaggaaaatggagagttctatgagctggccaagctgctgcccctgcccagcgccatcaccagccagctggacaaggccagcatcatccggctgaccaccagctacctgaagatgagagctgtgtttcctgagggcctgggagatgcctggggccagcccagccgggccggccccctggatggagtggccaaggagctgggcagccacctgctgcagaccctggatggctttgtgtttgtggtggccagtgatggcaagatcatgtacatcagcgagacagcctctgtgcacctgggcctgagccaggtggagctgaccggcaacagcatctatgagtacatccaccccagcgaccatgatgagatgacagctgtgctgacagcccaccagcccctgcaccaccacctgctgcaggagtatgaaattgaaagaagcttcttcctgaggatgaagtgtgtgctggccaagagaaatgccggcctgacctgcagcggctacaaggtgatccactgcagcggctacctgaagatccggcagtacatgctggacatgagcctgtatgacagctgctaccagatcgtgggcctggtggccgtgggccagagcctgccccccagcgccatcacagagatcaagctgtacagcaacatgttcatgttccgggccagcctggacctgaagctgatcttcctggacagccgggtgacagaggtgacaggctatgagccccaggacctgattgagaagaccctgtaccaccacgtgcacggctgtgatgtgttccacctgcgctatgcccaccacctgctgctggtgaagggccaggtgaccaccaagtactaccgcctgctgagcaagaggggcggctgggtgtgggtgcagagctatgccaccgtggtgcacaacagccgcagcagccggccccactgcatcgtgtctgtgaactacgtgctgacagaaattgagtacaaggagctgcagctgagcctggagcaggtgtccacagccaagagccaggacagctggaggacagccctgagcaccagccaggagaccaggaagctggtgaagcccaagaacaccaagatgaagaccaagctgcggaccaacccctacccaccccagcagtacagcagcttccagatggacaagctggagtgtggccagctgggcaactggagggccagccccccagccagcgctgctgcccctcctgagctgcagccccacagcgagagcagtgacctgctgtacacccccagctacagcctgcccttctcctaccactacggccacttccccctggacagccacgtgttcagcagcaagaagcccatgctgcctgccaagtttggccagccccagggcagcccctgtgaggtggcccgcttcttcctgagcaccctgcctgccagcggggagtgccagtggcactacgccaaccccctggtgcccagcagcagcagccctgccaagaaccccccagagcccccagccaacacagcccggcacagcctggtgcccagctatgagggcggcagcggcctgctggtgggcaaggtgggcggcctgaggacagctggcagccgcagcagccatggaggcggctggcagatggagacagagcccagccgcttcggccagacctgccccctgagcgccagcaagtag

SEQ ID NO: 169847 - DNA, 447 bp, Artificial Sequence
  Description of Artificial Sequence: Synthetic coding sequence
atgttcagaagacctgtgctgcaggtgctgcggcagtttgtgagacatgagagcgagaccaccaccagcctggtgctggagaggagcctgaacagagtgcacctgctgggccgggtgggccaggaccctgtgctgcggcaggtggagggcaagaaccctgtgaccatcttcagcctggccaccaatgagatgtggaggtctggggacagcgaggtgtaccagctgggagatgtgtcccagaagaccacctggcaccgcatcagcgtcttccggcccggcctgagagatgtggcctaccagtatgtgaagaagggcagccgcatctacctggagggcaagattgattatggagagtacatggacaagaacaacgtgcggcggcaggccaccaccatcatcgctgacaacatcatcttcctgagtgaccagaccaaggagaaggagtag

SEQ ID NO: 169848 - DNA, 366 bp, Artificial Sequence
  Description of Artificial Sequence: Synthetic coding sequence
atgttcagaagacctgtgctgcaggtgctgcggcagtttgtgagacatgagagcgagaccaccaccagcctggtgctggagaggagcctgaacagagtgcacctgctgggccgggtgggccaggaccctgtgctgcggcaggtggagggcaagaaccctgtgaccatcttcagcctggccaccaatgagatgtggaggtctggggacagcgaggtgtaccagctgggagatgtgtcccagaagaccacctggcaccgcatcagcgtcttccggcccggcctgagagatgtggcctaccagtatgtgaagaagggcagccgcatctacctggagggcaagattgattatggagagtacatggactag

SEQ ID NO: 169849 - DNA, 447 bp, Artificial Sequence; identical to SEQ ID NO: 169847
  Description of Artificial Sequence: Synthetic coding sequence

SEQ ID NO: 169850 - DNA, 408 bp, Artificial Sequence
  Description of Artificial Sequence: Synthetic coding sequence
atgttcagaagacctgtgctgcaggtgctgcggcagtttgtgagacatgagagcgagaccaccaccagcctggtgctggagaggagcctgaacagagtgcacctgctgggccgggtgggccaggaccctgtgctgcggcaggtggagggcaagaaccctgtgaccatcttcagcctggccaccaatgagatgtggaggtctggggacagcgaggtgtaccagctgggagatgtgtcccagaagaccacctggcaccgcatcagcgtcttccggcccggcctgagagatgtggcctaccagtatgtgaagaagggcagccgcatctacctggagggcaagattgattatggagagtacatggacaagaacaacgtgcggcggcaggccaccaccatcatcgctgactag

SEQ ID NO: 169851 - DNA, 87 bp, Artificial Sequence
  Description of Artificial Sequence: Synthetic coding sequence
atgttcagaagacctgtgctgcaggtgctgcggcagtttgtgagacatgagagcgagaccaccaccagcctggtgctggagaggtag

SEQ ID NO: 169852 - DNA, 447 bp, Artificial Sequence; identical to SEQ ID NO: 169847
  Description of Artificial Sequence: Synthetic coding sequence

SEQ ID NO: 169853 - DNA, 447 bp, Artificial Sequence; identical to SEQ ID NO: 169847
  Description of Artificial Sequence: Synthetic coding sequence

SEQ ID NO: 169854 - DNA, 447 bp, Artificial Sequence; identical to SEQ ID NO: 169847
  Description of Artificial Sequence: Synthetic coding sequence

SEQ ID NO: 169855 - DNA, 1086 bp, Artificial Sequence
  Description of Artificial Sequence: Synthetic coding sequence
atgtatggcaagggcaagagcaacagcagcgctgtgcccagcgacagccaggcccgggagaagctggccctgtatgtgtatgagtacctgctgcacgtgggcgcccagaagagcgcccagaccttcctgtctgagatccgctgggagaagaacatcaccctgggggagcccccaggcttcctgcacagctggtggtgtgtgttctgggacctgtactgtgccgcccctgagcggcgggagacctgtgagcacagcagcgaggccaaggccttccatgactacagcgctgctgctgcccccagccctgtgctgggcaacatccccccaggagatggcatgcctgtgggccctgtgcccccaggcttcttccagcccttcatgagcccccgctacccaggcggccccaggcctcccctgcgcatccccaaccaggccctgggcggcgtgcccggcagccagcccctgctgcccagcggcatggaccccacccggcagcagggccaccccaacatgggcggccccatgcagaggatgaccccaccccggggcatggtgcccctgggcccccagaactacggcggggccatgaggcctcccctgaatgccctgggcggccctggcatgcctggcatgaacatgggccctgggggcggccggccctggcccaaccccaccaatgccaacagcatcccctacagcagcgccagccctggcaactacgtgggccccccaggcggcggcggccccccaggcacccccatcatgcccagccctgctgacagcaccaacagcggggacaacatgtacaccctgatgaatgctgtgcccccaggccccaaccggcccaacttccccatgggccctggcagtgatggccccatgggcggcctgggcggcatggagagccaccacatgaatggcagcctgggcagcggggacatggacagcatcagcaagaacagccccaacaacatgagcctgagcaaccagcccggcaccccaagagatgatggagagatgggcggcaacttcctgaaccccttccagagcgagagctacagccccagcatgaccatgtctgtgtag

SEQ ID NO: 169856 - DNA, 945 bp, Artificial Sequence
  Description of Artificial Sequence: Synthetic coding sequence
atgggcaagaacatcaccctgggggagcccccaggcttcctgcacagctggtggtgtgtgttctgggacctgtactgtgccgcccctgagcggcgggagacctgtgagcacagcagcgaggccaaggccttccatgactacagcgctgctgctgcccccagccctgtgctgggcaacatccccccaggagatggcatgcctgtgggccctgtgcccccaggcttcttccagcccttcatgagcccccgctacccaggcggcccccggccccccctgcgcatccccaaccaggccctgggcggcgtgcccggcagccagcccctgctgcccagcggcatggaccccacccggcagcagggccaccccaacatgggcggccccatgcagaggatgaccccaccccggggcatggtgcccctgggcccccagaactatggaggagccatgaggcctcccctgaatgccctgggcggccctggcatgcctggcatgaacatgggccctgggggcggccggccctggcccaaccccaccaatgccaacagcatcccctacagcagcgccagccctggcaactacgtgggccccccaggcggcggcggccccccaggcacccccatcatgcccagccctgctgacagcaccaacagcggggacaacatgtacaccctgatgaatgctgtgcccccaggccccaaccggcccaacttccccatgggccctggcagtgatggccccatgggcggcctgggcggcatggagagccaccacatgaatggcagcctgggcagcggggacatggacagcatcagcaagaacagccccaacaacatgagcctgagcaaccagcccggcaccccaagagatgatggagagatgggcggcaacttcctgaaccccttccagagcgagagctacagccccagcatgaccatgtctgtgtag

SEQ ID NO: 169857 - DNA, 1026 bp, Artificial Sequence
  Description of Artificial Sequence: Synthetic coding sequence
atgtatggcaagggcaagagcaacagcagcgctgtgcccagcgacagccaggcccgggagaagctggccctgtatgtgtatgagtacctgctgcacgtgggcgcccagaagagcgcccagaccttcctgtctgagatccgctgggagaagaacatcaccctgggggagcccccaggcttcctgcacagctggtggtgtgtgttctgggacctgtactgtgccgcccctgagcggcgggagacctgtgagcacagcagcgaggccaaggccttccatgactacagcgctgctgctgcccccagccctgtgctgggcaacatccccccaggagatggcatgcctgtgggccctgtgcccccaggcttcttccaggccctgggcggcgtgcccggcagccagcccctgctgcccagcggcatggaccccacccggcagcagggccaccccaacatgggcggccccatgcagaggatgaccccaccccggggcatggtgcccctgggcccccagaactacggcggggccatgaggcctcccctgaatgccctgggcggccctggcatgcctggcatgaacatgggccctgggggcggccggccctggcccaaccccaccaatgccaacagcatcccctacagcagcgccagccctggcaactacgtgggccccccaggcggcggcggccccccaggcacccccatcatgcccagccctgctgacagcaccaacagcggggacaacatgtacaccctgatgaatgctgtgcccccaggccccaaccggcccaacttccccatgggccctggcagtgatggccccatgggcggcctgggcggcatggagagccaccacatgaatggcagcctgggcagcggggacatggacagcatcagcaagaacagccccaacaacatgagcctgagcaaccagcccggcaccccaagagatgatggagagatgggcggcaacttcctgaaccccttccagagcgagagctacagccccagcatgaccatgtctgtgtag

SEQ ID NO: 169858 - DNA, 1200 bp, Artificial Sequence
  Description of Artificial Sequence: Synthetic coding sequence
atggccttctggggctggagggctgctgctgccctgcggctgtggggccgggtggtggagcgggtggaggccggcggcggcgtgggccccttccaggcctgtggctgccgcctggtgctgggcggcagagatgatgtgtctgctggcctgcggggcagccacggggcccggggggagcccctggaccctgcccggcccctgcagaggcctcccaggcctgaggtgccccgggccttccggcggcagcccagggctgctgcccccagcttcttcttcagcagcatcaagggcggcagaagaagcatctccttctctgtgggcgccagctctgtggtgggcagcggcggcagcagtgacaagggcaagctgagcctgcaggatgtggccgagctgatccgggcccgggcctgccagagggtggtggtgatggtgggcgccggcatcagcacccccagcggcatcccagacttccgcagccctggcagcggcctgtacagcaacctgcagcagtatgacctgccctacccagaggccatctttgagctgcccttcttcttccacaaccccaagcccttcttcaccctggccaaggagctgtacccaggcaactacaagcccaacgtgacccactacttcctgcggctgctgcatgacaagggcctgctgctgcggctgtacacccagaacattgatggcctggagcgggtgtctggcatcccagccagcaagctggtggaggcccacggcacctttgccagcgccacctgcaccgtgtgccagaggcccttccctggagaggacatccgggcagatgtgatggctgacagagtgccccgctgccctgtgtgcaccggggtggtgaagccagacatcgtgttcttcggggagcccctgccccagcgcttcctgctgcacgtggtggacttccccatggctgacctgctgctgatcctgggcaccagcctggaggtggagccctttgccagcctgacagaagctgtgcgcagctctgtgccccggctgctgatcaacagagacctggtgggccccctggcctggcaccccaggagcagagatgtggcccagctgggagatgtggtgcacggcgtggagagcctggtggagctgctgggctggacagaggagatgagggacctggtgcagcgggagaccgggaagctggatggccctgacaagtag

SEQ ID NO: 169859 - DNA, 957 bp, Artificial Sequence
  Description of Artificial Sequence: Synthetic coding sequence
atggccttctggggctggagggctgctgctgccctgcggctgtggggccgggtggtggagcgggtggaggccggcggcggcgtgggccccttccaggcctgtggctgccgcctggtgctgggcggcagagatgatgatgtggccgagctgatccgggcccgggcctgccagagggtggtggtgatggtgggcgccggcatcagcaccccatctggcatcccagacttccgcagccctggcagcggcctgtacagcaacctgcagcagtatgacctgccctacccagaggccatctttgagctgcccttcttcttccacaaccccaagcccttcttcaccctggccaaggagctgtacccaggcaactacaagcccaacgtgacccactacttcctgcggctgctgcatgacaagggcctgctgctgcggctgtacacccagaacattgatggcctggagcgggtgtctggcatcccagccagcaagctggtggaggcccacggcacctttgccagcgccacctgcaccgtgtgccagaggcccttccctggagaggacatccgggcagatgtgatggctgacagagtgccccgctgccctgtgtgcacaggagtggtgaagccagacatcgtgttctttggagagcccctgccccagcgcttcctgctgcacgtggtggacttccccatggctgacctgctgctgatcctgggcaccagcctggaggtggagccctttgccagcctgacagaggccgtgcgcagctctgtgccccggctgctgatcaacagagacctggtgggccccctggcctggcaccccaggagcagagatgtggcccagctgggagatgtggtgcatggagtggagagcctggtggagctgctgggctggacagaggagatgagggacctggtgcagcgggagaccgggaagctggatggccctgacaagtag

SEQ ID NO: 169860 - DNA, 774 bp, Artificial Sequence
  Description of Artificial Sequence: Synthetic coding sequence
atggtgggcgccggcatcagcacccccagcggcatcccagacttccgcagccctggcagcggcctgtacagcaacctgcagcagtatgacctgccctacccagaggccatctttgagctgcccttcttcttccacaaccccaagcccttcttcaccctggccaaggagctgtacccaggcaactacaagcccaacgtgacccactacttcctgcggctgctgcatgacaagggcctgctgctgcggctgtacacccagaacattgatggcctggagcgggtgtctggcatcccagccagcaagctggtggaggcccacggcacctttgccagcgccacctgcaccgtgtgccagaggcccttccctggagaggacatccgggcagatgtgatggctgacagagtgccccgctgccctgtgtgcaccggggtggtgaagccagacatcgtgttcttcggggagcccctgccccagcgcttcctgctgcacgtggtggacttccccatggctgacctgctgctgatcctgggcaccagcctggaggtggagccctttgccagcctgacagaagctgtgcgcagctctgtgccccggctgctgatcaacagagacctggtgggccccctggcctggcaccccaggagcagagatgtggcccagctgggagatgtggtgcacggcgtggagagcctggtggagctgctgggctggacagaggagatgagggacctggtgcagcgggagaccgggaagctggatggccctgacaagtag

SEQ ID NO: 169861 - DNA, 945 bp, Artificial Sequence
  Description of Artificial Sequence: Synthetic coding sequence
atgaagatgagctttgccctgaccttccgcagcgccaagggccgctggatcgccaaccccagccagccctgcagcaaggccagcatcggcctgtttgtgcctgccagcccccccctggaccctgagaaggtgaaggagctgcagcgcttcatcaccctgagcaagaggctgctggtgatgactggagctggcatcagcacagaaagtggcatcccagactacagaagtgagaaggtgggcctgtatgccaggacagacagaagacccatccagcacggggactttgtgcgcagcgcccccatccggcagcgctactgggccaggaactttgtgggctggccccagttcagcagccaccagcccaacccagcccactgggccctgagcacctgggagaagctgggcaagctgtactggctggtgacccagaatgtggatgccctgcacaccaaggccggcagccggcggctgacagagctgcacggctgcatggacagagtgctgtgcctggactgtggggagcagaccccccggggcgtgctgcaggagcgcttccaggtgctgaaccccacctggagcgctgaggcccacggcctggccccagatggagatgtgttcctgtctgaggagcaggtgcgctccttccaggtgcccacctgtgtgcagtgtggcggccacctgaagccagatgtggtgttcttcggggacacagtgaacccagacaaggtggactttgtgcacaagagggtgaaggaggccgacagcctgctggtggtgggcagcagcctgcaggtgtacagcggctaccgcttcatcctgacagcctgggagaagaagctgcccatcgccatcctgaacatcggccccaccaggagtgatgacctggcctgcctgaagctgaacagccgctgtggggagctgctgcccctgattgacccctgctag

SEQ ID NO: 169862 - DNA, 879 bp, Artificial Sequence
  Description of Artificial Sequence: Synthetic coding sequence
atgaggcccctgcagatcgtgcccagccgcctcatcagccagctgtactgcggcctgaagcccccagccagcaccaggaaccagatctgcctgaagatggcccggcccagcagctccatggctgacttcaggaagttctttgccaaggccaagcacatcgtcatcatctctggagctggggtgtctgctgagagcggcgtgcccaccttcagaggagctgggggctactggaggaagtggcaggcccaggacctggccacccccctggcctttgcccacaaccccagccgggtgtgggagttctaccactacagaagagaggtgatgggcagcaaggagcccaatgccggccaccgggccatcgcagaatgtgagacccggctgggcaagcagggcagaagagtggtggtgatcacccagaacattgatgagctgcacaggaaggccggcaccaagaacctgctggagatccacggcagcctcttcaagacccgctgcaccagctgtggggtggtggccgagaactacaagagccccatctgcccagccctgagcggcaagggctgtgaggaggccggctgcggcggcctgctgcggccccacgtggtgtggtttggagagaacctggaccctgccatcctggaggaggtggaccgggagctggcccactgtgacctgtgcctggtggtgggcaccagctctgtggtgtacccagctgccatgtttgccccccaggtggccgcccggggcgtgcctgtggccgagttcaacacagagaccaccccagccaccaaccgcttccgcttccacttccagggcccctgtggcaccaccctgcctgaggccctggcctgccatgaaaatgagaccgtgtcctag

SEQ ID NO: 169863 - DNA, 933 bp, Artificial Sequence
  Description of Artificial Sequence: Synthetic coding sequence
atgaggcccctgcagatcgtgcccagccgcctcatcagccagctgtactgcggcctgaagcccccagccagcaccaggaaccagatctgcctgaagatggcccggcccagcagctccatggctgacttcaggaagttctttgccaaggccaagcacatcgtcatcatctctggagctggggtgtctgctgagagcggcgtgcccaccttcagaggagctgggggctactggaggaagtggcaggcccaggacctggccacccccctggcctttgcccacaaccccagccgggtgtgggagttctaccactacagaagagaggtgatgggcagcaaggagcccaatgccggccaccgggccatcgcagaatgtgagacccggctgggcaagcagggcagaagagtggtggtgatcacccagaacattgatgagctgcacaggaaggccggcaccaagaacctgctggagatccacggcagcctcttcaagacccgctgcaccagctgtggggtggtggccgagaactacaagagccccatctgcccagccctgtctggaaaaggagcccctgagcccggcacccaggatgccagcatccctgtggagaagctgccccgctgtgaggaggccggctgcggcggcctgctgcggccccacgtggtgtggtttggagagaacctggaccctgccatcctggaggaggtggaccgggagctggcccactgtgacctgtgcctggtggtgggcaccagctctgtggtgtacccagctgccatgtttgccccccaggtggccgcccggggcgtgcctgtggccgagttcaacacagagaccaccccagccaccaaccgcttccgcttccacttccagggcccctgtggcaccaccctgcctgaggccctggcctgccatgaaaatgagaccgtgtcctag

SEQ ID NO: 169864 - DNA, 900 bp, Artificial Sequence
  Description of Artificial Sequence: Synthetic coding sequence
atgaggcccctgcagatcgtgcccagccgcctcatcagccagctgtactgcggcctgaagcccccagccagcaccaggaaccagatctgcctgaagatggcccggcccagcagctccatggctgacttcaggaagttctttgccaaggccaagcacatcgtcatcatctctggagctggggtgtctgctgagagcggcgtgcccaccttcagaggagctgggggctactggaggaagtggcaggcccaggacctggccacccccctggcctttgcccacaaccccagccgggtgtgggagttctaccactacagaagagaggtgatgggcagcaaggagcccaatgccggccaccgggccatcgcagaatgtgagacccggctgggcaagcagggcagaagagtggtggtgatcacccagaacattgatgagctgcacaggaaggccggcaccaagaacctgctggagatccacggcagcctcttcaagacccgctgcaccagctgtggggtggtggccgagaactacaagagccccatctgcccagccctgtctggaaaaggagcccctgagcccggcacccaggatgccagcatccctgtggagaagctgccccgctgtgaggaggccggctgcggcggcctgctgcggccccacgtggtgtggtttggagagaacctggaccctgccatcctggaggaggtggaccgggagctggcccactgtgacctgtgcctggtggtgggcaccagctctgtggtgtacccagctgccatgtttgccccccaggtggccgcccggggcgtgcctgtggccgagttcaacacagagaccaccccagccaccaaccgcttcagccacctgatcagcatcagcagcctcatcatcatcaagaactag

SEQ ID NO: 169865 - DNA, 609 bp, Artificial Sequence
  Description of Artificial Sequence: Synthetic coding sequence
atgggcagcaaggagcccaatgccggccaccgggccatcgcagaatgtgagacccggctgggcaagcagggcagaagagtggtggtgatcacccagaacattgatgagctgcacaggaaggccggcaccaagaacctgctggagatccacggcagcctcttcaagacccgctgcaccagctgtggggtggtggccgagaactacaagagccccatctgcccagccctgtctggaaaaggagcccctgagcccggcacccaggatgccagcatccctgtggagaagctgccccgctgtgaggaggccggctgcggcggcctgctgcggccccacgtggtgtggtttggagagaacctggaccctgccatcctggaggaggtggaccgggagctggcccactgtgacctgtgcctggtggtgggcaccagctctgtggtgtacccagctgccatgtttgccccccaggtggccgcccggggcgtgcctgtggccgagttcaacacagagaccaccccagccaccaaccgcttccgcttccacttccagggcccctgtggcaccaccctgcctgaggccctggcctgccatgaaaatgagaccgtgtcctag

SEQ ID NO: 169866 - DNA, 1203 bp, Artificial Sequence
  Description of Artificial Sequence: Synthetic coding sequence
atggctgctgggggcctgagccgctctgagaggaaggctgctgagcgggtgcggcggctgcgggaggagcagcagcgggagcggctgcggcaggtgagccgcatcctgaggaaggctgctgctgagaggtctgctgaggagggccgcctgctggccgagagcgctgacctggtgacagagctgcagggccgcagcagaagaagagagggcctgaagaggcggcaggaggaggtgtgtgatgatcctgaggagctgcggggcaaggtgcgggagctggccagcgctgtgagaaatgccaagtacctggtggtgtacaccggggccggcatcagcacagctgccagcatcccagactaccggggccccaatggagtgtggaccctgctgcagaagggccgctctgtgtctgctgctgacctgtctgaggccgagcccaccctgacccacatgagcatcacccggctgcacgagcagaagctggtgcagcacgtggtgtcccagaactgtgatggcctgcacctgcggagcggcctgcccaggacagccatcagcgagctgcacggcaacatgtacatcgaggtgtgcaccagctgtgtgcccaaccgggagtatgtgcgggtgtttgatgtgacagagaggacagccctgcaccgccaccagacaggccgcacctgccacaagtgtggcacccagctgcgggacaccatcgtgcactttggagagcggggcaccctgggccagcccctgaactgggaggccgccacagaagctgccagcagagctgacaccatcctgtgcctgggcagcagcctgaaggtgctgaagaagtacccccggctgtggtgcatgaccaagccacccagcagaagacccaagctgtacatcgtgaacctgcagtggacccccaaggatgactgggccgccctgaagctgcacggcaaatgtgatgatgtgatgaggctgctgatggccgagctgggcctggagatcccagcctacagccgctggcaggaccccatcttcagcctggccacccccctgcgggccggggaggagggcagccacagcaggaagagcctgtgccgcagccgggaggaggcccctcctggggacagaggagcccccctgagcagcgcccccatcctgggcggctggtttggccggggctgcaccaagaggaccaagaggaagaaggtgacctag

SEQ ID NO: 169867 - DNA, 963 bp, Artificial Sequence
  Description of Artificial Sequence: Synthetic coding sequence
atgcctggcccccggcggcgcagccccagcgcctgcccccaggtgagccgcatcctgaggaaggctgctgctgagaggtctgctgaggagggccgcctgctggccgagagcgctgacctggtgacagagctgcagggccgcagcagaagaagagagggcctgaagaggcggcaggaggaggtgtgtgatgatcctgaggagctgcggggcaaggtgcgggagctggccagcgctgtgagaaatgccaagtacctggtggtgtacacaggagctggcatcagcacagctgccagcatcccagactaccggggccccaacggggtgtggaccctgctgcagaagggccgctctgtgtctgctgctgacctgtctgaggccgagcccaccctgacccacatgagcatcacccggctgcacgagcagaagctggtgcagcacgtggtgtcccagaactgtgatggcctgcacctgcggagcggcctgcccaggacagccatcagcgagctgcacggcaacatgtacatcgaggtgtgcaccagctgtgtgcccaaccgggagtatgtgcgggtgtttgatgtgacagagaggacagccctgcaccgccaccagacaggccgcacctgccacaagtgtggcacccagctgcgggacaccatcgtgcactttggagagcggggcaccctgggccagcccctgaactgggaggccgccacagaggccgccagcagagctgacaccatcctgtgcctgggcagcagcctgaaggtgctgaagaagtacccccggctgtggtgcatgaccaagccacccagccggcggcccaagctgtacatcgtgaacctgcagtggacccccaaggatgactgggccgccctgaagctgcatggaaaatgtgatgatgtgatgaggctgctgatggccgagctgggcctggagatcccagcctacagccgggtgctgtag

SEQ ID NO: 169868 - DNA, 855 bp, Artificial Sequence
  Description of Artificial Sequence: Synthetic coding sequence
atgtccatgctgcccagctttggcttcacccaggagcaggtggcctgtgtgtgtgaggtgctgcagcagggcggcaacctggagcggctgggccgcttcctgtggagcctgcctgcctgtgaccacctgcacaagaatgaatctgtgctgaaggccaaggctgtggtggccttccaccggggcaacttccgggagctgtacaagatcctggagagccaccagttcagcccccacaaccaccccaagctgcagcagctgtggctgaaggcccactacgtggaggccgagaagctgcggggccggcccctgggcgctgtgggcaagtacagagtgcggaggaagttccccctgcccaggaccatctgggatggagaggagaccagctactgcttcaaggagaagagcagaggagtgctgcgggagtggtacgcccacaacccctaccccagcccccgggagaagcgggagctggccgaggccaccggcctgaccaccacccaggtgagcaactggttcaagaacagacggcagagggacagagctgctgaggccaaggagcgggagaacacagagaacaacaacagcagcagcaacaagcagaaccagctgagccccctggagggcggcaagcccctgatgagcagcagcgaggaggagttcagccccccccagagcccagaccagaacagcgtgctgctgctgcagggcaacatgggccacgcccggagcagcaactacagcctgcccggcctgacagccagccagcccagccacggcctgcagacccaccagcaccagctgcaggacagcctgctgggccccctgaccagcagcctggtggacctgggcagctag

SEQ ID NO: 169869 - DNA, 876 bp, Artificial Sequence
  Description of Artificial Sequence: Synthetic coding sequence
atgtccatgctgcccaccttcggcttcacccaggagcaggtggcctgtgtgtgtgaggtgctgcagcagggcggcaacatcgagcggctgggccgcttcctgtggagcctgcctgcctgtgagcacctgcacaagaatgaatctgtgctgaaggccaaggctgtggtggccttccaccggggcaacttccgggagctgtacaagatcctggagagccaccagttcagcccccacaaccacgccaagctgcagcagctgtggctgaaggcccactacattgaagctgagaagctgcggggccggcccctgggcgctgtgggcaagtacagagtgcggaggaagttccccctgcccaggagcatctgggatggagaggagaccagctactgcttcaaggagaagagccgctctgtgctgcgggagtggtacgcccacaacccctaccccagcccccgggagaagcgggagctggccgaggccaccggcctgaccaccacccaggtgagcaactggttcaagaacagacggcagagggacagagctgctgaggccaaggagcgggagaacaatgaaaacagcaacagcaacagccacaaccccctgaatggcagcggcaagtctgtgctgggcagcagtgaagatgagaagaccccatctggcaccccagaccacagcagcagcagccctgccctgctgctgagccccccacctcctggcctgcccagcctgcacagcctgggccaccccccaggccccagcgctgtgcctgtgcctgtgcctgggggcggcggcgctgaccccctgcagcaccaccacggcctgcaggacagcatcctgaaccccatgtctgccaacctggtggacctgggcagctag

SEQ ID NO: 169870 - DNA, 999 bp, Artificial Sequence
  Description of Artificial Sequence: Synthetic coding sequence
atggtgttccgcagccccctggacctgtacagcagccacttcctgctgcccaactttgctgacagccaccacaggagcatcctgctggccagcagcggcggcggcaatggagctgggggcggcggcggggccggcggcggcagcggcggcggcaatggagctgggggcggcggggccggcggggccggcggcggcggcggcggcggcagccgggcccctcctgaggagctgtccatgttccagctgcccaccctgaacttcagccctgagcaggtggcctctgtgtgtgagaccctggaggagaccggggacatcgagcggctgggccgcttcctgtggagcctgcctgtggcccctggggcctgtgaggccatcaacaagcatgagagcatcctgcgggcccgggctgtggtggccttccacacaggcaacttccgggacctgtaccacatcctggagaaccacaagttcaccaaggagagccacggcaagctgcaggccatgtggctggaggcccactaccaggaggccgagaagctgcggggccggcccctgggccctgtggacaagtacagagtgaggaagaagttccccctgcccaggaccatctgggatggagagcagaagacccactgcttcaaggagaggaccaggagcctgctgcgggagtggtacctgcaggacccctaccccaaccccagcaagaagcgggagctggcccaggccaccggcctgacccccacccaggtgggcaactggttcaagaacagacggcagagggacagagctgctgctgccaagaaccggctgcagcaccaggccatcggccccagcggcatgaggagcctggccgagcccggctgccccacccacggcagcgctgagagccccagcacagctgccagccccaccacctctgtgagcagcctgacagaaagagctgacaccggcaccagcatcctgtctgtgaccagcagtgacagtgaatgtgatgtgtag

SEQ ID NO: 169871 - DNA, 1020 bp, Artificial Sequence; identical to SEQ ID NO: 149700
  Description of Artificial Sequence: Synthetic coding sequence

SEQ ID NO: 169872 - DNA, 2220 bp, Artificial Sequence
  Description of Artificial Sequence: Synthetic coding sequence
atggccaccctgcctgctgagcccagcgctggccctgctgctggaggagaggccgtggccgctgctgctgccacagaggaggaggaggaggaggcccggcagctgctgcagaccctgcaggccgctgagggggaggccgctgctgctgctggggccggggccggggctgctgctgctggagctgagggccctggcagccctggggtgcccggcagccccccagaggccgccagcgagccccccaccggcctgcgcttcagccctgagcaggtggcctgtgtgtgtgaggccctgctgcaggccggccacgccggccgcctgagccgcttcctgggcgccctgcccccagctgagcggctgcggggcagtgaccctgtgctgcgggcccgggccctggtggccttccagagaggagaatatgcagagctgtaccgcctgctggagagccggcccttccctgctgcccaccacgccttcctgcaggacctgtacctgcgggcccgctaccacgaggccgagcgggcccggggccgggccctgggcgctgtggacaagtaccgcctgaggaagaagttccccctgcccaagaccatctgggatggagaggagaccgtgtactgcttcaaggagaggagccgggccgccctgaaggcctgctaccggggcaaccgctaccccaccccagatgagaagaggcggctggccaccctgaccggcctgagcctgacccaggtgagcaactggttcaagaacagacggcagagggacagaactggagctgggggcggggccccctgcaagtctgagagtgatggcaaccccaccacagaagatgagagcagccgcagccctgaggacctggagagaggagctgcccctgtgtctgctgaggccgccgcccagggcagcatcttcctggccggcactggacctccagccccctgcccagccagcagcagcatcctggtgaatggcagcttcctggccgccagcggcagccctgctgtgctgctgaatggaggccctgtgatcatcaatggcctggccctgggggaggccagcagcctgggccccctgctgctgaccggcggcggcggggcccccccaccccagcccagcccccagggcgccagcgagaccaagaccagcctggtgctggacccccagacaggagaggtgcggctggaggaggcccagagcgaggcccctgagaccaagggggcccaggtggccgcccctggccctgccctgggggaggaggtgctgggccccctggcccaggtggtgcccggccccccaacagctgccaccttccccctgcccccaggccctgtgcctgctgtggccgccccccaggtggtgcccctgagccccccacctggctaccccaccggcctgagccccaccagccccctgctgaacctgccccaggtggtgcccaccagccaggtggtgaccctgccccaggccgtgggccccctgcagctgctggccgccggccctggcagccctgtgaaggtggccgctgctgctggccctgccaacgtgcacctgatcaacagcggcgtgggcgtgacagccctgcagctgcccagcgccacagcccctggcaacttcctgctggccaaccctgtgtctggcagccccatcgtgactggagtggccctgcagcagggcaagatcatcctgacagccaccttccccacctccatgctggtgtcccaggtgctgcccccagcccctggcctggccctgcccctgaagccagagacagccatctctgtgcctgagggcggcctgcctgtggcccccagccctgccctgcctgaggcccacgccctgggcaccctgagcgcccagcagcccccacctgctgctgccaccaccagcagcaccagcctgcccttctccccagacagccctggcctgctgcccaacttccctgcccctcctcctgagggcctgatgctgagccctgctgctgtgcctgtgtggagcgctggcctggagctgtctgctggaacagagggcctgctggaggccgagaagggcctgggcacccaggccccccacacagtgctgcggctgcctgaccctgaccctgagggcctgctgctgggcgccacagctggaggagaggtggatgagggcctggaggccgaggccaaggtgctgacccagctgcagagcgtgcctgtggaggagcccctggagctgtag

SEQ ID NO: 169873 - DNA, 741 bp, Artificial Sequence
  Description of Artificial Sequence: Synthetic coding sequence
atgttccagctgcccatcctgaacttcagcccccagcaggtggccggcgtgtgtgagaccctggaggagagcggagatgtggagcggctgggccgcttcctgtggagcctgcctgtggccccagctgcctgtgaggccctgaacaagaatgaatctgtgctgcgggcccgggccatcgtggccttccatggaggcaactaccgggagctgtaccacatcctggagaaccacaagttcaccaaggagagccacgccaagctgcaggccctgtggctggaggcccactaccaggaggccgagaagctgcggggccggcccctgggccctgtggacaagtacagagtgaggaagaagttccccctgcccaggaccatctgggatggagagcagaagacccactgcttcaaggagaggaccaggcacctgctgcgggagtggtacctgcaggacccctaccccaaccccagcaagaagcgggagctggcccaggccaccggcctgacccccacccaggtgggcaactggttcaagaacagacggcagagggacagagctgctgctgccaagaaccggctgcagcagcaggtgctgagccagggcagcggccgggccctgcgggcagaaggagatggcaccccagaggtgctgggcgtggccaccagccctgctgccagcctgagcagcaaggccgccaccagcgccatcagcatcaccagcagtgacagtgaatgtgacatctag

SEQ ID NO: 169874 - DNA, 360 bp, Artificial Sequence
  Description of Artificial Sequence: Synthetic coding sequence
atgacccagcagggcgccgccctgcagaactacaacaatgagctggtgaagtgcatcgaggagctgtgccagaagcgggaggagctgtgccggcagatccaggaggaggaggatgagaagcagaggctgcagaatgaggtgcggcagctgacagagaagctggcccgggtgaatgaaaacctggccaggaagatcgccagcagaaatgaatttgacaggaccatcgccgagacagaggccgcctacctgaagatcctggagagcagccagaccctgctgtctgtgctgaagcgggaggccggcaacctgaccaaggccacagccccagaccagaagagcagcggcggccgggacagctag

SEQ ID NO: 169875 - DNA, 666 bp, Artificial Sequence
  Description of Artificial Sequence: Synthetic coding sequence
atgctgtggctgttccagagcctgctgtttgtgttctgcttcggccctggccagctgaggaacatccaggtgaccaaccacagccagctgttccagaacatgacctgtgagctgcacctgacctgcagcgtggaggatgctgatgacaacgtgtccttccgctgggaggccctgggcaacaccctgagcagccagcccaacctgactgtgtcctgggacccccgcatcagcagcgagcaggactacacctgcatcgcagaaaatgctgtgagcaacctgtccttctctgtgtctgcccagaagctgtgtgaagatgtgaagatccagtacacagacaccaagatgatcctcttcatggtgtctggcatctgcatcgtgtttggcttcatcatcctgctgctgctggtgctgaggaagaggcgggacagcctgagcctgagcacccagaggacccagggccctgctgagagcgccaggaacctggagtatgtgtctgtgagccccaccaacaacacagtgtatgcctctgtgacccacagcaaccgggagacagagatctggaccccaagagaaaatgacaccatcaccatctacagcaccatcaaccacagcaaggagagcaagcccaccttcagccgggccacagccctggacaacgtggtgtag

SEQ ID NO: 169876 - DNA, 999 bp, Artificial Sequence
  Description of Artificial Sequence: Synthetic coding sequence
atgctgtggctgttccagagcctgctgtttgtgttctgcttcggccctggaaatgtggtgtcccagagcagcctgacccccctgatggtgaatggcatcctgggggagagcgtgaccctgcccctggagttccctgctggggagaaggtgaacttcatcacctggctgttcaatgagaccagcctggccttcatcgtgccccatgagaccaagagccctgagatccacgtgaccaaccccaagcagggcaagaggctgaacttcacccagagctacagcctgcagctgagcaacctgaagatggaggacaccggcagctaccgggcccagatcagcaccaagaccagcgccaagctgagcagctacaccctgcgcatcctgcggcagctgaggaacatccaggtgaccaaccacagccagctgttccagaacatgacctgtgagctgcacctgacctgcagcgtggaggatgctgatgacaacgtgtccttccgctgggaggccctgggcaacaccctgagcagccagcccaacctgactgtgtcctgggacccccgcatcagcagcgagcaggactacacctgcatcgccgagaatgctgtgagcaacctgtccttctctgtgtctgcccagaagctgtgtgaagatgtgaagatccagtacacagacaccaagatgatcctcttcatggtgtctggcatctgcatcgtgtttggcttcatcatcctgctgctgctggtgctgaggaagagaagagacagcctgagcctgagcacccagaggacccagggccctgctgagagcgccaggaacctggagtatgtgtctgtgagccccaccaacaacacagtgtatgcctctgtgacccacagcaaccgggagacagagatctggaccccccgggagaatgacaccatcaccatctacagcaccatcaaccacagcaaggagagcaagcccaccttcagccgggccacagccctggacaacgtggtgtag

SEQ ID NO: 169877 - DNA, 996 bp, Artificial Sequence
  Description of Artificial Sequence: Synthetic coding sequence
atgctgtggctgttccagagcctgctgtttgtgttctgcttcggccctggaaatgtggtgtcccagagcagcctgacccccctgatggtgaatggcatcctgggggagagcgtgaccctgcccctggagttccctgctggggagaaggtgaacttcatcacctggctgttcaatgagaccagcctggccttcatcgtgccccatgagaccaagagccctgagatccacgtgaccaaccccaagcagggcaagaggctgaacttcacccagagctacagcctgcagctgagcaacctgaagatggaggacaccggcagctaccgggcccagatcagcaccaagaccagcgccaagctgagcagctacaccctgcgcatcctgcggcagctgaggaacatccaggtgaccaaccacagccagctgttccagaacatgacctgtgagctgcacctgacctgcagcgtggaggatgctgatgacaacgtgtccttccgctgggaggccctgggcaacaccctgagcagccagcccaacctgactgtgtcctgggacccccgcatcagcagcgagcaggactacacctgcatcgccgagaatgctgtgagcaacctgtccttctctgtgtctgcccagaagctgtgtgaagatgtgaagatccagtacacagacaccaagatgatcctcttcatggtgtctggcatctgcatcgtgtttggcttcatcatcctgctgctgctggtgctgaggaagagaagagacagcctgagcctgagcacccagaggacccagggccctgagagcgccaggaacctggagtatgtgtctgtgagccccaccaacaacacagtgtatgcctctgtgacccacagcaaccgggagacagagatctggaccccaagagaaaatgacaccatcaccatctacagcaccatcaaccacagcaaggagagcaagcccaccttcagccgggccacagccctggacaacgtggtgtag

SEQ ID NO: 169878 - DNA, 891 bp, Artificial Sequence
  Description of Artificial Sequence: Synthetic coding sequence
atggccggcagccccacctgcctgaccctcatctacatcctgtggcagctgaccggcagcgctgccagcggccctgtgaaggagctggtgggctctgtgggcggcgctgtgaccttccccctgaagagcaaggtgaagcaggtggacagcatcgtgtggaccttcaacaccacccccctggtgaccatccagcctgagggcggcaccatcatcgtgacccagaacagaaaccgggagcgggtggacttcccagatggcggctacagcctgaagctgagcaagctgaagaagaatgacagcggcatctactacgtgggcatctacagcagcagcctgcagcagcccagcacccaggagtatgtgctgcacgtgtatgagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccaggaaccctgtgtccaggaacttcagcagccccatcctggccaggaagctgtgtgagggcgctgctgatgatcctgacagctccatggtgctgctgtgcctgctgctggtgcccctgctgctgagcctgtttgtgctgggcctcttcctgtggttcctgaagcgggagcggcaggaggagaacaaccccaagggccgcagcagcaaatatggcctgctgcactgcggcaacacagagaaggatggcaagagccccctgacagcccatgatgcccggcacaccaaggccatctgcctgtag

SEQ ID NO: 169879 - DNA, 687 bp, Artificial Sequence
  Description of Artificial Sequence: Synthetic coding sequence
atggccggcagccccacctgcctgaccctcatctacatcctgtggcagctgacagagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccagaaatcctgtgtccaggaacttcagcagccccatcctggccaggaagctgtgtgagggcgctgctgatgatcctgacagctccatggtgctgctgtgcctgctgctggtgcccctgctgctgagcctgtttgtgctgggcctcttcctgtggttcctgaagcgggagcggcaggaggagtacatcgaggagaagaagagggtggacatctgccgggagacccccaacatctgcccccacagcggagaaaatacagaatatgacaccatcccccacaccaacagaaccatcctgaaggaggaccctgccaacacagtgtacagcacagtggagatccccaagaagatggagaacccccacagcctgctgaccatgccagacaccccccggctgtttgcctatgaaaatgtcatctag

SEQ ID NO: 169880 - DNA, 1008 bp, Artificial Sequence
  Description of Artificial Sequence: Synthetic coding sequence
atggccggcagccccacctgcctgaccctcatctacatcctgtggcagctgaccggcagcgctgccagcggccctgtgaaggagctggtgggctctgtgggcggcgctgtgaccttccccctgaagagcaaggtgaagcaggtggacagcatcgtgtggaccttcaacaccacccccctggtgaccatccagcctgagggcggcaccatcatcgtgacccagaacagaaaccgggagcgggtggacttcccagatggcggctacagcctgaagctgagcaagctgaagaagaatgacagcggcatctactacgtgggcatctacagcagcagcctgcagcagcccagcacccaggagtatgtgctgcacgtgtatgagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccaggaaccctgtgtccaggaacttcagcagccccatcctggccaggaagctgtgtgagggcgctgctgatgatcctgacagctccatggtgctgctgtgcctgctgctggtgcccctgctgctgagcctgtttgtgctgggcctcttcctgtggttcctgaagcgggagcggcaggaggagtacatcgaggagaagaagagggtggacatctgccgggagacccccaacatctgcccccacagcggggagaacacagaatatgacaccatcccccacaccaacagaaccatcctgaaggaggaccctgccaacacagtgtacagcacagtggagatccccaagaagatggagaacccccacagcctgctgaccatgccagacaccccccggctgtttgcctatgaaaatgtcatctag

SEQ ID NO: 169881 - DNA, 615 bp, Artificial Sequence
  Description of Artificial Sequence: Synthetic coding sequence
atggccggcagccccacctgcctgaccctcatctacatcctgtggcagctgaccggcagcgctgccagcggccctgtgaaggagctggtgggctctgtgggcggcgctgtgaccttccccctgaagagcaaggtgaagcaggtggacagcatcgtgtggaccttcaacaccacccccctggtgaccatccagcctgagggcggcaccatcatcgtgacccagaacagaaaccgggagcgggtggacttcccagatggcggctacagcctgaagctgagcaagctgaagaagaatgacagcggcatctactacgtgggcatctacagcagcagcctgcagcagcccagcacccaggagtatgtgctgcacgtgtatgagtacatcgaggagaagaagagggtggacatctgccgggagacccccaacatctgcccccacagcggagaaaatacagaatatgacaccatcccccacaccaacagaaccatcctgaaggaggaccctgccaacacagtgtacagcacagtggagatccccaagaagatggagaacccccacagcctgctgaccatgccagacaccccccggctgtttgcctatgaaaatgtcatctag

SEQ ID NO: 169882 - DNA, 498 bp, Artificial Sequence
  Description of Artificial Sequence: Synthetic coding sequence
atggccggcagccccacctgcctgaccctcatctacatcctgtggcagctgaccggcagcgctgccagcggccctgtgaaggagctggtgggctctgtgggcggcgctgtgaccttccccctgaagagcaaggtgaagcaggtggacagcatcgtgtggaccttcaacaccacccccctggtgaccatccagcctgagggcggcaccatcatcgtgacccagaacagaaaccgggagcgggtggacttcccagatggcggctacagcctgaagctgagcaagctgaagaagaatgacagcggcatctactacgtgggcatctacagcagcagcctgcagcagcccagcacccaggagtatgtgctgcacgtgtatgagaacaaccccaagggccgcagcagcaaatatggcctgctgcactgcggcaacacagagaaggatggcaagagccccctgacagcccatgatgcccggcacaccaaggccatctgcctgtag

SEQ ID NO: 169883 - DNA, 450 bp, Artificial Sequence
  Description of Artificial Sequence: Synthetic coding sequence
atggccggcagccccacctgcctgaccctcatctacatcctgtggcagctgacagagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccagaaatcctgtgtccaggaacttcagcagccccatcctggccaggaagctgtgtgaggagaacaaccccaagggccgcagcagcaaatatggcctgctgcactgcggcaacacagagaaggatggcaagagccccctgacagcccatgatgcccggcacaccaaggccatctgcctgtag

SEQ ID NO: 169884 - DNA, 567 bp, Artificial Sequence
  Description of Artificial Sequence: Synthetic coding sequence
atggccggcagccccacctgcctgaccctcatctacatcctgtggcagctgacagagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccagaaatcctgtgtccaggaacttcagcagccccatcctggccaggaagctgtgtgaggagtacatcgaggagaagaagagggtggacatctgccgggagacccccaacatctgcccccacagcggagaaaatacagaatatgacaccatcccccacaccaacagaaccatcctgaaggaggaccctgccaacacagtgtacagcacagtggagatccccaagaagatggagaacccccacagcctgctgaccatgccagacaccccccggctgtttgcctatgaaaatgtcatctag

SEQ ID NO: 169885 - DNA, 858 bp, Artificial Sequence
  Description of Artificial Sequence: Synthetic coding sequence
atggtgatgaggcccctgtggagcctgctgctgtgggaggccctgctgcccatcaccgtgactggagcccaggtgctgagcaaggtgggcggctctgtgctgctggtggccgcccggcccccaggcttccaggtgcgggaggccatctggaggagcctgtggcccagcgaggagctgctggccaccttcttccggggcagcctggagaccctgtaccacagccgcttcctgggccgggcccagctgcacagcaacctgagcctggagctgggccccctggagagcggggacagcggcaacttctctgtgctgatggtggacacccggggccagccctggacccagaccctgcagctgaaggtgtatgatgctgtgcccaggcctgtggtgcaggtgttcatcgctgtggagagagatgcccagcccagcaagacctgccaggtgttcctgagctgctgggcccccaacatcagcgagatcacctacagctggaggcgggagaccaccatggactttggcatggagccccacagcctcttcacagatggccaggtgctgagcatcagcctgggccctggggacagagatgtggcctacagctgcatcgtgagcaaccctgtgtcctgggacctggccaccgtgaccccctgggacagctgccaccacgaggccgcccctgggaaggccagctacaaggatgtgctgctggtggtggtgcctgtgtccctgctgctgatgctggtgaccctcttcagcgcctggcactggtgcccctgcagcggcaagaagaagaaggatgtgcatgctgacagagtgggccctgagacagagaaccccctggtgcaggacctgccctag

SEQ ID NO: 169886 - DNA, 531 bp, Artificial Sequence
  Description of Artificial Sequence: Synthetic coding sequence
atggtgatgaggcccctgtggagcctgctgctgtgggaggatgctgtgcccaggcctgtggtgcaggtgttcatcgctgtggagagagatgcccagcccagcaagacctgccaggtgttcctgagctgctgggcccccaacatcagcgagatcacctacagctggaggcgggagaccaccatggactttggcatggagccccacagcctcttcacagatggccaggtgctgagcatcagcctgggccctggggacagagatgtggcctacagctgcatcgtgagcaaccctgtgtcctgggacctggccaccgtgaccccctgggacagctgccaccatgaagctgcccctgggaaggccagctacaaggatgtgctgctggtggtggtgcctgtgtccctgctgctgatgctggtgaccctcttcagcgcctggcactggtgcccctgcagcggcaagaagaagaaggatgtgcacgccgacagagtgggccctgagacagagaaccccctggtgcaggacctgccctag

SEQ ID NO: 169887 - DNA, 444 bp, Artificial Sequence
  Description of Artificial Sequence: Synthetic coding sequence
atgggcggccgccaccacctgcagaggcaggtgtctgagagcatgtctgccctcttccaggccgtgcggctggagagcgcctgggccgacagagtgcgctacatggtggtggtgtacagcagcggccggcaggacacagaggagaacatcctgctgggcgtggacttcagcagcaaggagagcggcttctctgtgtccacagctggccgcatgcacatcttcaagcctgtgtctgtgcaggccatgtggagcgccctgcaggtgctgcacaaggcctgtgaggtggcccggcggcacaactacttccctggaggagtggccctgatctgggccacctactatgagagctgcatcagcagcgagcagagctgcatcaatgagtggaatgccatgcaggacctggagagcaccaggccagacagccctgccctgtttgtggactag

SEQ ID NO: 169888 - DNA, 2112 bp, Artificial Sequence
  Description of Artificial Sequence: Synthetic coding sequence
atggcccgggccaggagagctgtggtgggctctgtgagagatgtgtccacagctgccaccaacctcttctacttcacagacttctgcatcttcctgcagcccacccactgcttctgctgcccagaggtgagcagcagcaactacctgtctgagagcttcttcatggtgaagggagctgccctcttcctgcagcagggcagcagcccccagggccagaggagcctgcagcacccccacaagcacgccggggacctgccccagcacctgcaggtgatgatcaacctgctgcgctgtgaagatcgcatcaagctggccgtgcggctggagagcgcctgggccgacagagtgcgctacatggtggtggtgtacagcagcggccggcaggacacagaggagaacatcctgctgggcgtggacttcagcagcaaggagagcaagagctgcaccatcggcatggtgctgcggctgtggagcgacaccaagatccacctggatggagatggcggcttctctgtgtccacagctggccgcatgcacatcttcaagcctgtgtctgtgcaggccatgtggagcgccctgcaggtgctgcacaaggcctgtgaggtggcccggcggcacaactacttccctgggggcgtggccctgatctgggccacctactatgagagctgcatcagcagcgagcagagctgcatcaatgagtggaatgccatgcaggacctggagagcaccaggccagacagccctgccctgtttgtggacaagcccacagaaggagagaggacagagcggctcatcaaggccaagctgcggagcatcatgatgagccaggacctggagaatgtgaccagcaaggagatcagaaatgagctggagaagcagatgaactgcaacctgaaggagctgaaggagttcatcgacaatgagatgctgctgatcctgggccagatggacaagcccagcctcatctttgaccacctgtacctgggcagcgagtggaatgccagcaacctggaggagctgcagggcagcggcgtggactacatcctgaatgtgacccgggagattgacaacttcttccctggcctgtttgcctaccacaacatccgggtgtatgatgaggagaccacagacctgctggcccactggaatgaggcctaccacttcatcaacaaggccaagaggaaccacagcaagtgcctggtgcactgcaagatgggcgtgagccgcagcgccagcaccgtcatcgcctatgccatgaaggagtttggctggcccctggagaaggcctacaactacgtgaagcagaagaggagcatcacccggcccaatgccggcttcatgaggcagctgtctgaatatgagggcatcctggatgccagcaagcagaggcacaacaagctgtggaggcagcagacagacagcagcctgcagcagcctgtggatgatcctgctggccctggggacttcctgcctgagaccccagatggcaccccagagagccagctgcccttcctggatgatgctgcccagcccggcctgggcccccccctgccctgctgcttccggcggctgagtgaccccctgctgcccagcccagaagatgaaacaggcagcctggtgcacctggaggaccctgagcgggaggccctgctggaggaggccgcccctcctgctgaggtgcacaggcctgcccggcagccccagcagggcagcggcctgtgtgagaaggatgtgaagaagaagctggagtttggcagccccaagggccgcagcggcagcctgctgcaggtggaggagacagagcgggaggagggcctgggcgccggccgctggggccagctgcccacccagctggaccagaacctgctgaacagcgagaacctgaacaacaacagcaagaggagctgccccaacggcatggaggtgggccgggcccggcctgctggctggcacacccccagcctgcccagccacagcaactggcccaccagcgcctctgtggtgggcaccaccggcaccaggcaccacacccagctgatcttcttctactgcctgctgtgggcccccagcagccacctgcagggccctgagggcagcttcaccggctag

SEQ ID NO: 169889 - DNA, 3150 bp, Artificial Sequence
  Description of Artificial Sequence: Synthetic coding sequence
atggccctggtgaccctgcagaggagccccaccccatctgctgccagcagcagcgccagcaacagcgagctggaggccggcagcgaggaggacaggaagctgaacctgagcctgtctgagagcttcttcatggtgaagggggccgccctcttcctgcagcagggcagcagcccccagggccagaggagcctgcagcacccccacaagcatgctggggacctgccccagcacctgcaggtgatgatcaacctgctgcgctgtgaggaccgcatcaagctggccgtgcggctggagagcgcctgggccgacagagtgcgctacatggtggtggtgtacagcagcggccggcaggacacagaggagaacatcctgctgggcgtggacttcagcagcaaggagagcaagagctgcaccatcggcatggtgctgcggctgtggagcgacaccaagatccacctggatggagatggcggcttctctgtgtccacagctggccgcatgcacatcttcaagcctgtgtctgtgcaggccatgtggagcgccctgcaggtgctgcacaaggcctgtgaggtggcccggcggcacaactacttccctggaggagtggccctgatctgggccacctactatgagagctgcatcagcagcgagcagagctgcatcaatgagtggaatgccatgcaggacctggagagcaccaggccagacagccctgccctgtttgtggacaagcccacagaaggagagaggacagagcggctcatcaaggccaagctgcggagcatcatgatgagccaggacctggagaatgtgaccagcaaggagatcagaaatgagctggagaagcagatgaactgcaacctgaaggagctgaaggagttcatcgacaatgagatgctgctgatcctgggccagatggacaagcccagcctcatctttgaccacctgtacctgggcagcgagtggaatgccagcaacctggaggagctgcagggcagcggcgtggactacatcctgaatgtgacccgggagattgacaacttcttccctggcctgtttgcctaccacaacatccgggtgtatgatgaggagaccacagacctgctggcccactggaatgaggcctaccacttcatcaacaaggccaagaggaaccacagcaagtgcctggtgcactgcaagatgggcgtgagccgcagcgccagcacagtgattgcctatgccatgaaggagtttggctggcccctggagaaggcctacaactacgtgaagcagaagaggagcatcacccggcccaatgccggcttcatgaggcagctgtctgaatatgagggcatcctggatgccagcaagcagaggcacaacaagctgtggaggcagcagacagacagcagcctgcagcagcctgtggatgatcctgctggccctggggacttcctgcctgagaccccagatggcaccccagagagccagctgcccttcctggatgatgctgcccagcccggcctgggcccccccctgccctgctgcttccggcggctgagtgaccccctgctgcccagcccagaagatgagaccggcagcctggtgcacctggaggaccctgagcgggaggccctgctggaggaggccgcccccccagctgaggtgcacaggcctgcccggcagccccagcagggcagcggcctgtgtgagaaggatgtgaagaagaagctggagtttggcagccccaagggccgcagcggcagcctgctgcaggtggaggagacagagcgggaggagggcctgggcgccggccgctggggccagctgcccacccagctggaccagaacctgctgaacagcgagaacctgaacaacaacagcaagaggagctgccccaacggcatggaggatgatgccatcttcggcatcctgaacaaggtgaagcccagctacaagagctgtgccgactgcatgtaccccacagccagcggggcccctgaggccagccgggagcgctgtgaggaccccaatgccccagccatctgcacccagcctgccttcctgccccacatcaccagcagccctgtggcccacctggccagccgcagccgggtgcctgagaagccagccagcggccccacagagcccccacccttcctgcccccagctggcagcagaagagctgacaccagcggccctggggccggggccgccctggagcccccagccagcctgctggagcccagccgggagacccccaaggtgctgcccaagagcctgctgctgaagaacagccactgtgacaagaacccccccagcacagaggtggtgatcaaggaggagagcagccccaagaaggacatgaagccagccaaggacctgcggctgctcttcagcaatgaaagtgagaagcccaccaccaacagctacctgatgcagcaccaggagagcatcatccagctgcagaaggccggcctggtgaggaagcacaccaaggagctggagcggctgaagtctgtgcctgctgaccctgccccacccagcagagatggccctgccagccggctggaggccagcatccctgaggagagccaggaccctgctgccctgcacgagctgggccccctggtgatgcccagccaggccggcagtgatgagaagtctgaggccgccccagccagcctggagggcggcagcctgaagagccccccacccttcttctaccgcctggaccacaccagcagcttcagcaaggacttcctgaagaccatctgctacacccccaccagcagctccatgagcagcaacctgaccaggagcagcagcagtgacagcatccacagcgtgcggggcaagccaggcctggtgaagcagaggacccaggagattgagacccggctgcggctggccggcctgactgtgagcagccccctgaagaggagccacagcctggccaagctgggcagcctgaccttcagcacagaggacctgagcagcgaggccgaccccagcacagtggccgacagccaggacaccaccctgtctgagagcagcttcctgcacgagccccagggcaccccccgggaccctgctgccaccagcaagcccagcggcaagccagcccctgagaacctgaagagccccagctggatgagcaagagctag

SEQ ID NO: 169890 - DNA, 2214 bp, Artificial Sequence
  Description of Artificial Sequence: Synthetic coding sequence
atgcgctgctacctgtcctgggaccgctggaccagcccccccctgagcagcatcatcttcatctctgtggactacatcctgaatgtgacccgggagattgacaacttcttccctggcctgtttgcctaccacaacatccgggtgtatgatgaggagaccacagacctgctggcccactggaatgaggcctaccacttcatcaacaaggccaagaggaaccacagcaagtgcctggtgcactgcaagatgggcgtgagccgcagcgccagcacagtgattgcctatgccatgaaggagtttggctggcccctggagaaggcctacaactacgtgaagcagaagaggagcatcacccggcccaatgccggcttcatgaggcagctgtctgaatatgagggcatcctggatgccagcaagcagaggcacaacaagctgtggaggcagcagacagacagcagcctgcagcagcctgtggatgatcctgctggccctggggacttcctgcctgagaccccagatggcaccccagagagccagctgcccttcctggatgatgctgcccagcccggcctgggcccccccctgccctgctgcttccggcggctgagtgaccccctgctgcccagcccagaagatgagaccggcagcctggtgcacctggaggaccctgagcgggaggccctgctggaggaggccgcccccccagctgaggtgcacaggcctgcccggcagccccagcagggcagcggcctgtgtgagaaggatgtgaagaagaagctggagtttggcagccccaagggccgcagcggcagcctgctgcaggtggaggagacagagcgggaggagggcctgggcgccggccgctggggccagctgcccacccagctggaccagaacctgctgaacagcgagaacctgaacaacaacagcaagaggagctgccccaacggcatggaggatgatgccatcttcggcatcctgaacaaggtgaagcccagctacaagagctgtgccgactgcatgtaccccacagccagcggggcccctgaggccagccgggagcgctgtgaggaccccaatgccccagccatctgcacccagcctgccttcctgccccacatcaccagcagccctgtggcccacctggccagccgcagccgggtgcctgagaagccagccagcggccccacagagcccccacccttcctgcccccagctggcagcagaagagctgacaccagcggccctggggccggggccgccctggagcccccagccagcctgctggagcccagccgggagacccccaaggtgctgcccaagagcctgctgctgaagaacagccactgtgacaagaacccccccagcacagaggtggtgatcaaggaggagagcagccccaagaaggacatgaagccagccaaggacctgcggctgctcttcagcaatgaaagtgagaagcccaccaccaacagctacctgatgcagcaccaggagagcatcatccagctgcagaaggccggcctggtgaggaagcacaccaaggagctggagcggctgaagtctgtgcctgctgaccctgccccacccagcagagatggccctgccagccggctggaggccagcatccctgaggagagccaggaccctgctgccctgcacgagctgggccccctggtgatgcccagccaggccggcagtgatgagaagtctgaggccgccccagccagcctggagggcggcagcctgaagagccccccacccttcttctaccgcctggaccacaccagcagcttcagcaaggacttcctgaagaccatctgctacacccccaccagcagctccatgagcagcaacctgaccaggagcagcagcagtgacagcatccacagcgtgcggggcaagccaggcctggtgaagcagaggacccaggagattgagacccggctgcggctggccggcctgactgtgagcagccccctgaagaggagccacagcctggccaagctgggcagcctgaccttcagcacagaggacctgagcagcgaggccgaccccagcacagtggccgacagccaggacaccaccctgtctgagagcagcttcctgcacgagccccagggcaccccccgggaccctgctgccaccagcaagcccagcggcaagccagcccctgagaacctgaagagccccagctggatgagcaagagctag

SEQ ID NO: 169891 - DNA, 2079 bp, Artificial Sequence
  Description of Artificial Sequence: Synthetic coding sequence
atggccctggtgaccctgcagaggagccccaccccatctgctgccagcagcagcgccagcaacagcgagctggaggccggcagcgaggaggacaggaagctgaacctgagcctgtctgagagcttcttcatggtgaagggggccgccctcttcctgcagcagggcagcagcccccagggccagaggagcctgcagcacccccacaagcatgctggggacctgccccagcacctgcaggtgatgatcaacctgctgcgctgtgaggaccgcatcaagctggccgtgcggctggagagcgcctgggccgacagagtgcgctacatggtggtggtgtacagcagcggccggcaggacacagaggagaacatcctgctgggcgtggacttcagcagcaaggagagcaagagctgcaccatcggcatggtgctgcggctgtggagcgacaccaagatccacctggatggagatggcggcttctctgtgtccacagctggccgcatgcacatcttcaagcctgtgtctgtgcaggccatgtggagcgccctgcaggtgctgcacaaggcctgtgaggtggcccggcggcacaactacttccctggaggagtggccctgatctgggccacctactatgagagctgcatcagcagcgagcagagctgcatcaatgagtggaatgccatgcaggacctggagagcaccaggccagacagccctgccctgtttgtggacaagcccacagaaggagagaggacagagcggctcatcaaggccaagctgcggagcatcatgatgagccaggacctggagaatgtgaccagcaaggagatcagaaatgagctggagaagcagatgaactgcaacctgaaggagctgaaggagttcatcgacaatgagatgctgctgatcctgggccagatggacaagcccagcctcatctttgaccacctgtacctgggcagcgagtggaatgccagcaacctggaggagctgcagggcagcggcgtggactacatcctgaatgtgacccgggagattgacaacttcttccctggcctgtttgcctaccacaacatccgggtgtatgatgaggagaccacagacctgctggcccactggaatgaggcctaccacttcatcaacaaggccaagaggaaccacagcaagtgcctggtgcactgcaagatgggcgtgagccgcagcgccagcacagtgattgcctatgccatgaaggagtttggctggcccctggagaaggcctacaactacgtgaagcagaagaggagcatcacccggcccaatgccggcttcatgaggcagctgtctgaatatgagggcatcctggatgccagcaagcagaggcacaacaagctgtggaggcagcagacagacagcagcctgcagcagcctgtggatgatcctgctggccctggggacttcctgcctgagaccccagatggcaccccagagagccagctgcccttcctggatgatgctgcccagcccggcctgggcccccccctgccctgctgcttccggcggctgagtgaccccctgctgcccagcccagaagatgagaccggcagcctggtgcacctggaggaccctgagcgggaggccctgctggaggaggccgcccccccagctgaggtgcacaggcctgcccggcagccccagcagggcagcggcctgtgtgagaaggatgtgaagaagaagctggagtttggcagccccaagggccgcagcggcagcctgctgcaggtggaggagacagagcgggaggagggcctgggcgccggccgctggggccagctgcccacccagctggaccagaacctgctgaacagcgagaacctgaacaacaacagcaagaggagctgccccaacggcatggaggtgggccgggcccggcctgctggctggcacacccccagcctgcccagccacagcaactggcccaccagcgcctctgtggtgggcaccaccggcaccaggcaccacacccagctgatcttcttctactgcctgctgtgggcccccagcagccacctgcagggccctgagggcagcttcaccggctag

SEQ ID NO: 169892 - DNA, 4272 bp, Artificial Sequence
  Description of Artificial Sequence: Synthetic coding sequence
atggccctggtgacagtgcagaggagccccacccccagcaccaccagcagcccctgtgccagcgaggccgacagcggggaggaggagtgccgcagccagcccaggagcatcagcgagagcttcctgactgtgaagggagctgccctcttcctgcccagaggaaatggcagcagcaccccccgcatcagccacagaagaaacaagcacgccggggacctgcagcagcacctgcaggccatgttcatcctgctgcggcctgaggacaacatccggctggccgtgcggctggagagcacctaccagaacagaacccgctacatggtggtggtgtccaccaacggccggcaggacacagaggagagcatcgtgctgggcatggacttcagcagcaatgacagcagcacctgcaccatgggcctggtgctgcccctgtggagcgacaccctcatccacctggatggagatggcggcttctctgtgtccacagacaacagagtgcacatcttcaagcctgtgtctgtgcaggccatgtggagcgccctgcagagcctgcacaaggcctgtgaggtggcccgggcccacaactactacccaggcagcctcttcctgacctgggtgtcctactatgagagccacatcaacagcgaccagagctctgtgaatgagtggaatgccatgcaggatgtgcagagccacaggccagacagccctgccctcttcacagacatccccacagagcgggagaggacagagcggctcatcaagaccaagctgcgggagatcatgatgcagaaggacctggagaacatcaccagcaaggagatcagaacagagctggagatgcagatggtgtgcaacctgcgggagttcaaggagttcatcgacaatgagatgatcgtcatcctgggccagatggacagccccacccagatctttgagcacgtgttcctgggcagcgagtggaatgccagcaacctggaggacctgcagaacagaggagtgcgctacatcctgaatgtgacccgggagattgacaacttcttccctggggtgtttgagtaccacaacatccgggtgtatgatgaggaggccacagacctgctggcctactggaatgacacctacaagttcatcagcaaggccaagaagcacggcagcaagtgcctggtgcactgcaagatgggcgtgagccgcagcgccagcaccgtcatcgcctatgccatgaaggagtatggctggaacctggaccgggcctatgactatgtgaaggagaggagaacagtgaccaagcccaaccccagcttcatgaggcagctggaggagtaccagggcatcctgctggccagcaagcagaggcacaacaagctgtggaggagccacagcgacagcgacctgagtgaccaccacgagcccatctgcaagccaggcctggagctgaacaagaaggacatcaccaccagcgctgaccagattgctgaggtgaagaccatggagagccacccccccatcccccctgtgtttgtggagcacatggtgccccaggatgccaaccagaagggcctgtgcaccaaggagaggatgatctgcctggagttcaccagccgggagttccacgccggccagattgaagatgagctgaacctgaatgacatcaatggctgcagcagcggctgctgcctgaatgaaagcaagttccccctggacaactgccacgccagcaaggccctgatccagcccggccacgtgcctgagatggccaacaagttcccagacctgactgtggaggacctggagacagatgccctgaaggctgacatgaatgtgcacctgctgcccatggaggagctgaccagccccctgaaggacccccccatgagcccagaccctgagagccccagcccccagcccagctgccagacagagatcagtgacttcagcacagacagaattgacttcttcagcgccctggagaagtttgtggagctgagccaggagaccaggagccgctccttcagccacagcaggatggaggagctgggcggcggcagaaatgaaagctgccgcctgtctgtggtggaggtggcccccagcaaggtgacagcagatgaccagaggagcagcagcctgagcaacaccccccacgccagcgaggagagctccatggatgaggagcagagcaaggccatcagcgagctggtgtccccagacatcttcatgcagagccacagtgaaaatgccatctctgtgaaggagatcgtgacagaaattgagagcatcagccagggcgtgggccagatccagctgaagggggacatcctgcccaacccctgccacacccccaagaagaacagcatccacgagctgctgctggagcgggcccagaccccagagaacaagccaggccacatggagcaggatgaggacagctgcacagcccagcctgagctggccaaggacagcggcatgtgcaaccctgagggctgcctgaccacccacagcagcattgctgacctggaggagggggagcctgctgagggggagcaggagctgcagggcagcggcatgcaccctggggccaagtggtacccaggctctgtgagaagagccaccctggagtttgaggagcggctgcggcaggagcaggagcaccacggggccgcccccacctgcaccagcctgagcaccaggaagaacagcaagaatgacagctctgtggccgacctggcccccaagggcaagagtgatgaggcccctcctgagcacagctttgtgctgaaggagcctgagatgagcaagggcaagggcaagtacagcggcagcgaggccggcagcctgagccacagcgagcagaatgccaccgtgcctgccccccgggtgctggagtttgaccacctgcctgacccccaggagggccctggcagtgacaccggcacccagcaggagggcgtgctgaaggacctgaggacagtcatcccctaccaggagagcgagacccaggccgtgcccctgcccctgcccaagagggtggagatcatcgagtacacccacatcgtgaccagccccaaccacacaggccctggcagcgagatcgccaccagcgagaagagcggggagcagggcctgaggaaggtgaacatggagaagtctgtgacagtgctgtgcaccctggatgagaacctgaacagaaccctggaccccaaccaggtgtccctgcacccccaggtgctgcccctgccccacagcagcagccctgagcacaaccggcccacagaccaccccaccagcatcctgagcagcccagaagatcggggcagcagcctgagcacagccctggagacagctgccccctttgtgagccacaccacccacctgctgagcgccagcctggactacctgcacccccagaccatggtgcacctggagggcttcacagagcagagcagcaccacagatgagcccagcgctgagcaggtgtcctgggaggagagccaggagagccccctgagcagcggcagcgaggtgccctacaaggacagccagctgagcagcgctgacctgagcctcatcagcaagctgggggacaacacaggagagctgcaggagaagatggaccccctgcctgtggcctgccgcctgccccacagcagcagcagcgagaacatcaagagcctgagccacagccctggggtggtgaaggagcgggccaaggagattgagagccgggtggtgttccaggccggcctgaccaagcccagccagatgagaagaagtgccagcctggccaagctgggctacctggacctgtgcaaggactgcctgcctgagcgggagcccgccagctgtgagagcccccacctgaagctgctgcagcccttcctgaggacagattctggcatgcacgccatggaggaccaggagagcctggagaaccctggggccccccacaaccctgagcccaccaagagctttgtggagcagctgaccaccacagaatgtattgtgcagagcaagcctgtggagcggcccctggtgcagtatgccaaggagtttggcagcagccagcagtacctgctgcccagggctggcctggagctgaccagcagcgagggcggcctgcctgtgctgcagacccagggcctgcagtgtgcctgcccagcccctggcctggccgtggccccccggcagcagcacggccgcacccaccccctgcggcggctgaagaaggccaatgacaagaagaggaccaccaaccccttctacaacaccatgtag

SEQ ID NO: 169893 - DNA, 609 bp, Artificial Sequence
  Description of Artificial Sequence: Synthetic coding sequence
atgaccctgagcaccctggccaggaagaggaaggcccccctggcctgcacctgcagcctgggcggccctgacatgatcccctacttcagcgccaatgctgtgatcagccagaatgccatcaaccagctgatcagcgagagcttcctgactgtgaagggggccgccctcttcctgcccagaggaaatggcagcagcaccccccgcatcagccacagaagaaacaagcatgctggggacctgcagcagcacctgcaggccatgttcatcctgctgcggcctgaggacaacatccggctggccgtgcggctggagagcacctaccagaacagaacccgctacatggtggtggtgtccaccaacggccggcaggacacagaggagagcatcgtgctgggcatggacttcagcagcaatgacagcagcacctgcaccatgggcctggtgctgcccctgtggagcgacaccctcatccacctggatggagatggcggcttctctgtgtccacagacaacagagtgcacatcttcaagcctgtgtctgtgcaggccatgtgggtggaccgggacagcaggaacaagcactgtgatgtgctgctggtggaggagtag

SEQ ID NO: 169894 - DNA, 1350 bp, Artificial Sequence
  Description of Artificial Sequence: Synthetic coding sequence
atggccctggtgacagtgcagaggagccccacccccagcaccaccagcagcccctgtgccagcgaggccgacagcggggaggaggagtgccgcagccagcccaggagcatcagcgagagcttcctgactgtgaagggagctgccctcttcctgcccagaggaaatggcagcagcaccccccgcatcagccacagaagaaacaagcacgccggggacctgcagcagcacctgcaggccatgttcatcctgctgcggcctgaggacaacatccggctggccgtgcggctggagagcacctaccagaacagaacccgctacatggtggtggtgtccaccaacggccggcaggacacagaggagagcatcgtgctgggcatggacttcagcagcaatgacagcagcacctgcaccatgggcctggtgctgcccctgtggagcgacaccctcatccacctggatggagatggcggcttctctgtgtccacagacaacagagtgcacatcttcaagcctgtgtctgtgcaggccatgtggagcgccctgcagagcctgcacaaggcctgtgaggtggcccgggcccacaactactacccaggcagcctcttcctgacctgggtgtcctactatgagagccacatcaacagcgaccagagctctgtgaatgagtggaatgccatgcaggatgtgcagagccacaggccagacagccctgccctcttcacagacatccccacagagcgggagaggacagagcggctcatcaagaccaagctgcgggagatcatgatgcagaaggacctggagaacatcaccagcaaggagatcagaacagagctggagatgcagatggtgtgcaacctgcgggagttcaaggagttcatcgacaatgagatgatcgtcatcctgggccagatggacagccccacccagatctttgagcacgtgttcctgggcagcgagtggaatgccagcaacctggaggacctgcagaacagaggagtgcgctacatcctgaatgtgacccgggagattgacaacttcttccctggggtgtttgagtaccacaacatccgggtgtatgatgaggaggccacagacctgctggcctactggaatgacacctacaagttcatcagcaaggccaagaagcacggcagcaagtgcctggtgcactgcaagatgggcgtgagccgcagcgccagcaccgtcatcgcctatgccatgaaggagtatggctggaacctggaccgggcctatgactatgtgaaggagaggagaacagtgaccaagcccaaccccagcttcatgaggcagctggaggagtaccagggcatcctgctggccaggtag

SEQ ID NO: 169895 - DNA, 4353 bp, Artificial Sequence
  Description of Artificial Sequence: Synthetic coding sequence
atggccctggtgacagtgcagaggagccccacccccagcaccaccagcagcccctgtgccagcagcagccacctggaggacagcgagagcgctgccctgctgtgctgtgaatgtgaggagagcgagatcttcacagacagcaatgaggccgacagcggggaggaggagtgccgcagccagcccaggagcatcagcgagagcttcctgactgtgaagggggccgccctcttcctgcccagaggaaatggcagcagcaccccccgcatcagccacagaagaaacaagcatgctggggacctgcagcagcacctgcaggccatgttcatcctgctgcggcctgaggacaacatccggctggccgtgcggctggagagcacctaccagaacagaacccgctacatggtggtggtgtccaccaacggccggcaggacacagaggagagcatcgtgctgggcatggacttcagcagcaatgacagcagcacctgcaccatgggcctggtgctgcccctgtggagcgacaccctcatccacctggatggagatggcggcttctctgtgtccacagacaacagagtgcacatcttcaagcctgtgtctgtgcaggccatgtggagcgccctgcagagcctgcacaaggcctgtgaggtggcccgggcccacaactactacccaggcagcctcttcctgacctgggtgtcctactatgagagccacatcaacagcgaccagagctctgtgaatgagtggaatgccatgcaggatgtgcagagccacaggccagacagccctgccctcttcacagacatccccacagagcgggagaggacagagcggctcatcaagaccaagctgcgggagatcatgatgcagaaggacctggagaacatcaccagcaaggagatcagaacagagctggagatgcagatggtgtgcaacctgcgggagttcaaggagttcatcgacaatgagatgatcgtcatcctgggccagatggacagccccacccagatctttgaacatgtgttcctgggcagcgagtggaatgccagcaacctggaggacctgcagaacagaggagtgcgctacatcctgaatgtgacccgggagattgacaacttcttccctggggtgtttgagtaccacaacatccgggtgtatgatgaggaggccacagacctgctggcctactggaatgacacctacaagttcatcagcaaggccaagaagcacggcagcaagtgcctggtgcactgcaagatgggcgtgagccgcagcgccagcacagtgattgcctatgccatgaaggagtatggctggaacctggaccgggcctatgactatgtgaaggagaggagaacagtgaccaagcccaaccccagcttcatgaggcagctggaggagtaccagggcatcctgctggccagcaagcagaggcacaacaagctgtggaggagccacagcgacagcgacctgagtgaccaccacgagcccatctgcaagccaggcctggagctgaacaagaaggacatcaccaccagcgctgaccagattgctgaggtgaagaccatggagagccacccccccatcccccctgtgtttgtggagcacatggtgccccaggatgccaaccagaagggcctgtgcaccaaggagaggatgatctgcctggagttcaccagccgggagttccacgccggccagattgaagatgagctgaacctgaatgacatcaatggctgcagcagcggctgctgcctgaatgaaagcaagttccccctggacaactgccacgccagcaaggccctgatccagcccggccacgtgcctgagatggccaacaagttcccagacctgactgtggaggacctggagacagatgccctgaaggctgacatgaatgtgcacctgctgcccatggaggagctgaccagccccctgaaggacccccccatgagcccagaccctgagagccccagcccccagcccagctgccagacagagatcagtgacttcagcacagacagaattgacttcttcagcgccctggagaagtttgtggagctgagccaggagaccaggagccgctccttcagccacagcaggatggaggagctgggcggcggcagaaatgaaagctgccgcctgtctgtggtggaggtggcccccagcaaggtgacagcagatgaccagaggagcagcagcctgagcaacacccctcatgccagcgaggagagctccatggatgaggagcagagcaaggccatcagcgagctggtgtccccagacatcttcatgcagagccacagtgaaaatgccatctctgtgaaggagatcgtgacagaaattgagagcatcagccagggcgtgggccagatccagctgaagggggacatcctgcccaacccctgccacacccccaagaagaacagcatccacgagctgctgctggagcgggcccagaccccagagaacaagccaggccacatggagcaggatgaggacagctgcacagcccagcctgagctggccaaggacagcggcatgtgcaaccctgagggctgcctgaccacccacagcagcattgctgacctggaggagggggagcctgctgagggggagcaggagctgcagggcagcggcatgcaccctggggccaagtggtacccaggctctgtgcggcgggccaccctggagtttgaggagcggctgcggcaggagcaggagcaccacggggccgcccccacctgcaccagcctgagcaccaggaagaacagcaagaatgacagctctgtggccgacctggcccccaagggcaagagtgatgaggcccctcctgagcacagctttgtgctgaaggagcctgagatgagcaagggcaagggcaagtacagcggcagcgaggccggcagcctgagccacagcgagcagaatgccaccgtgcctgccccccgggtgctggagtttgaccacctgcctgacccccaggagggccctggcagtgacaccggcacccagcaggagggcgtgctgaaggacctgaggacagtcatcccctaccaggagagcgagacccaggccgtgcccctgcccctgcccaagagggtggagatcatcgagtacacccacatcgtgaccagccccaaccacactggacctggcagcgagatcgccaccagcgagaagtctggagagcagggcctgaggaaggtgaacatggagaagtctgtgacagtgctgtgcaccctggatgagaacctgaacagaaccctggaccccaaccaggtgtccctgcacccccaggtgctgcccctgccccacagcagcagccctgagcacaaccggcccacagaccaccccaccagcatcctgagcagccctgaggaccggggcagcagcctgagcacagccctggagacagctgccccctttgtgagccacaccacccacctgctgagcgccagcctggactacctgcacccccagaccatggtgcacctggagggcttcacagagcagagcagcaccacagatgagcccagcgctgagcaggtgtcctgggaggagagccaggagagccccctgagcagcggcagcgaggtgccctacaaggacagccagctgagcagcgctgacctgagcctcatcagcaagctgggggacaacacaggagagctgcaggagaagatggaccccctgcctgtggcctgccgcctgccccacagcagcagcagcgagaacatcaagagcctgagccacagccctggggtggtgaaggagcgggccaaggagattgagagccgggtggtgttccaggccggcctgaccaagcccagccagatgagaagaagtgccagcctggccaagctgggctacctggacctgtgcaaggactgcctgcctgagcgggagcccgccagctgtgagagcccccacctgaagctgctgcagcccttcctgaggacagacagcggcatgcacgccatggaggaccaggagagcctggagaaccctggggccccccacaaccctgagcccaccaagagctttgtggagcagctgaccaccacagagtgcatcgtgcagagcaagcctgtggagcggcccctggtgcagtatgccaaggagtttggcagcagccagcagtacctgctgccccgggccggcctggagctgaccagcagcgagggcggcctgcctgtgctgcagacccagggcctgcagtgtgcctgcccagcccctggcctggccgtggccccccggcagcagcacggccgcacccaccccctgcggcggctgaagaaggccaatgacaagaagaggaccaccaaccccttctacaacaccatgtag

SEQ ID NO: 169896 - DNA, 1980 bp, Artificial Sequence
  Description of Artificial Sequence: Synthetic coding sequence
atggccctggtgacagtgagccgcagccccccaggcagcggggccagcacccctgtgggcccctgggaccaggccgtgcagaggaggagccggctgcagaggcggcagagctttgctgtgctgcggggagctgtgctgggcctgcaggacggcggggacaatgatgatgctgctgaggccagcagcgagcccacagagaaggcccccagcgaggaggagctgcatggagaccagacagactttggccagggcagccagagcccccagaagcaggaggagcagaggcagcacctgcacctgatggtgcagctgctgcggccccaggatgacatccggctggccgcccagctggaggccccccggcccccccggctgcgctacctgctggtggtgtccacccgggagggggagggcctgagccaggatgagaccgtgctgctgggcgtggacttcccagacagcagcagccccagctgcaccctgggcctggtgctgcccctgtggagcgacacccaggtgtacctggatggagatggcggcttctctgtgaccagcggcggccagagccgcatcttcaagcccatcagcatccagaccatgtgggccaccctgcaggtgctgcaccaggcctgtgaggccgccctgggcagcggcctggtgcctgggggcagcgccctgacctgggccagccactaccaggagcggctgaacagcgagcagagctgcctgaatgagtggacagccatggctgacctggagagcctgcggcccccatctgctgagcccggcggcagcagcgagcaggagcagatggagcaggccatccgggcagagctgtggaaggtgctggatgtgtctgacctggagagcgtgaccagcaaggagatccggcaggccctggagctgcggctgggcctgcccctgcagcagtacagagacttcatcgacaaccagatgctgctgctggtggcccagagggaccgggccagccgcatcttcccccacctgtacctgggcagcgagtggaatgctgccaacctggaggagctgcagaggaacagagtgacccacatcctgaacatggcccgggagattgacaacttctacccagagcgcttcacctaccacaacgtgcggctgtgggatgaggagagcgcccagctgctgccccactggaaggagacccaccgcttcattgaagctgcccgggcccagggcacccacgtgctggtgcactgcaagatgggcgtgagccgctctgctgccaccgtgctggcctatgccatgaagcagtatgaatgttccctggagcaggccctgcggcacgtgcaggagctgcggcccatcgcccggcccaaccctggcttcctgcggcagctgcagatctaccagggcatcctgacagccagccggcagagccacgtgtgggagcagaaggtgggcggcgtgtccccagaggagcacccagcccctgaggtgtccacccccttcccccccctgcccccagagcctgagggcggcggggaggagaaggtggtgggcatggaggagagccaggccgcccccaaggaggagcccggcccccggccccgcatcaacctgcggggcgtgatgaggagcatcagcctgctggagcccagcctggagctggagagcaccagcgagaccagtgacatgcctgaggtgttcagcagccatgagagcagccatgaggagcccctgcagcccttcccccagctggcccggaccaagggcggccagcaggtggaccggggcccccagcctgccctgaagagccggcagagcgtggtgaccctgcagggcagcgctgtggtggccaacagaacccaggccttccaggagcaggagcagggccagggccagggccagggcgagccctgcatcagcagcaccccccgcttcaggaaggtggtgcggcaggcctctgtgcatgattctggagaggagggggaggcctag

SEQ ID NO: 169897 - DNA, 2091 bp, Artificial Sequence
  Description of Artificial Sequence: Synthetic coding sequence
atgctgctgtggatcctgctgctggagaccagcctgtgctttgctgctggaaatgtgactggagatgtgtgcaaggagaagatctgcagctgcaatgaaattgaaggagacctgcacgtggactgtgagaagaagggcttcaccagcctgcagcgcttcaccgcccccaccagccagttctaccacctgttcctgcacggcaacagcctgaccaggctcttccccaatgaatttgccaacttctacaatgctgtgtccctgcacatggagaacaacggcctgcatgaaattgtgcctggggccttcctgggcctgcagctggtgaagaggctgcacatcaacaacaacaagatcaagagcttcaggaagcagaccttcctgggcctggatgacctggagtacctgcaggccgacttcaacctgctgcgggacattgatcctggggccttccaggacctgaacaagctggaggtgctgatcctgaatgacaacctgatcagcaccctgcctgccaacgtgttccagtatgtgcccatcacccacctggacctgcggggcaaccggctgaagaccctgccctatgaggaggtgctggagcagatccctggcattgctgagatcctgctggaggacaacccctgggactgcacctgtgacctgctgagcctgaaggagtggctggagaacatccccaagaatgccctgattggccgggtggtgtgtgaggcccccacccggctgcagggcaaggacctgaatgagaccacagagcaggacctgtgccccctgaagaacagagtggacagcagcctgcctgcccccccagcccaggaggagacctttgcccctggccccctgcccacccccttcaagaccaacggccaggaggaccacgccaccccaggcagcgcccccaacggcggcaccaagatccctggcaactggcagatcaagatccggcccacagctgccatcgccaccggcagcagcaggaacaagcccctggccaacagcctgccctgccctgggggctgcagctgtgaccacatccctggcagcggcctgaagatgaactgcaacaacagaaatgtgagcagcctggccgacctgaagcccaagctgagcaatgtgcaggagctgttcctgcgggacaacaagatccacagcatcaggaagagccactttgtggactacaagaacctgatcctgctggacctgggcaacaacaacatcgccaccgtggagaacaacaccttcaagaacctgctggacctgcgctggctgtacatggacagcaactacctggacaccctgagccgggagaagtttgctggcctgcagaacctggagtacctgaatgtggagtacaatgccatccagctgatcctgcccggcaccttcaatgccatgcccaagctgcgcatcctgatcctgaacaacaacctgctgcggagcctgcctgtggatgtgtttgctggggtgtccctgagcaagctgagcctgcacaacaactacttcatgtacctgcctgtggccggcgtgctggaccagctgaccagcatcatccagattgacctgcacggcaacccctgggagtgcagctgcaccatcgtgcccttcaagcagtgggccgagcggctgggcagcgaggtgctgatgtctgacctgaagtgtgagacccctgtgaacttcttcaggaaggacttcatgctgctgagcaatgatgagatctgcccccagctgtatgcccgcatcagccccaccctgaccagccacagcaagaacagcacaggcctggccgagaccggcacccacagcaacagctacctggacaccagccgggtgtccatctctgtgctggtgcccggcctgctgctggtgtttgtgaccagcgccttcaccgtggtgggcatgctggtgttcatcctgaggaacaggaagaggagcaagagaagagatgccaacagcagcgccagcgagatcaacagcctgcagacagtgtgtgacagcagctactggcacaacggcccctacaatgctgatggagcccaccgggtgtatgactgtggcagccacagcctgagtgactag

SEQ ID NO: 169898 - DNA, 2175 bp, Artificial Sequence
  Description of Artificial Sequence: Synthetic coding sequence
atgctgtctggagtgtggttcctgtctgtgctgactgtggccggcatcctgcagacagagagcaggaagacagccaaggacatctgcaagatccgctgcctgtgtgaggagaaggaaaatgtgctgaacatcaactgtgaaaataaaggcttcaccaccgtgtccctgctgcagcccccccagtaccgcatctaccagctgttcctgaatggaaacctgctgacccggctgtacccaaatgaatttgtgaactacagcaatgctgtgaccctgcacctgggcaacaacggcctgcaggagatcagaactggagccttcagcggcctgaagaccctgaagaggctgcacctgaacaacaacaagctggagatcctgcgggaggacaccttcctgggcctggagagcctggagtacctgcaggccgactacaactacatcagcgccattgaagctggggccttcagcaagctgaacaagctgaaggtgctgatcctgaatgacaacctgctgctgagcctgcccagcaatgtgttccgctttgtgctgctgacccacctggacctgcggggcaaccggctgaaggtgatgccctttgctggggtgctggagcacatcggcggcatcatggagatccagctggaggagaacccctggaactgcacctgtgacctgctgcccctgaaggcctggctggacaccatcaccgtgtttgtgggggagatcgtgtgtgagacccccttccggctgcacggcaaggatgtgacccagctgacccggcaggacctgtgccccaggaagagcgccagtgacagcagccagaggggcagccacgccgacacccacgtgcagaggctgagccccaccatgaacccagccctgaaccccacccgggcccccaaggccagccggccccccaagatgaggaaccggcccaccccccgggtgacagtgtccaaggaccggcagagctttggccccatcatggtgtaccagaccaagagccctgtgcccctgacctgccccagcagctgtgtgtgcaccagccagagcagtgacaatggcctgaatgtgaactgccaggagaggaagttcaccaacatcagtgacctgcagcccaagcccaccagccccaagaagctgtacctgactggaaactacctgcagacagtgtacaagaatgacctgctggagtacagcagcctggacctgctgcacctgggcaacaacagaattgctgtgatccaggagggcgccttcaccaacctgaccagcctgcggcggctgtacctgaatggaaactacctggaggtgctgtaccccagcatgtttgatggcctgcagagcctgcagtacctgtacctggagtacaacgtcatcaaggagatcaagcccctgacctttgatgccctgatcaacctgcagctgctcttcctgaacaacaacctgctgcggagcctgcctgacaacatctttggaggaacagccctgacccggctgaacctgaggaacaaccacttcagccacctgcctgtgaagggcgtgctggaccagctgcctgccttcatccagattgacctgcaggagaacccctgggactgcacctgtgacatcatgggcctgaaggactggacagagcacgccaacagccctgtgatcatcaatgaggtgacctgtgagagccctgccaagcatgctggggagatcctgaagttcctgggccgggaggccatctgcccagacagccccaacctgagtgatggcaccgtgctgtccatgaaccacaacacagacacccccaggagcctgtctgtgagccccagcagctacccagagctgcacacagaggtgcccctgtctgtgctgatcctgggcctgctggtggtgttcatcctgtctgtgtgctttggagctggcctgtttgtgtttgtgctgaagaggaggaagggcgtgcccagcgtgcccaggaacaccaacaacctggatgtgagcagcttccagctgcagtatggcagctacaacacagagacccatgacaagacagatggccacgtgtacaactacatccccccacctgtgggccagatgtgccagaaccccatctacatgcagaaggagggggaccctgtggcctactacagaaacctgcaggagttctcctacagcaacctggagtag

SEQ ID NO: 169899 - DNA, 2538 bp, Artificial Sequence
  Description of Artificial Sequence: Synthetic coding sequence
atgctgtctggagtgtggttcctgtctgtgctgactgtggccggcatcctgcagacagagagcaggaagacagccaaggacatctgcaagatccgctgcctgtgtgaggagaaggaaaatgtgctgaacatcaactgtgaaaataaaggcttcaccaccgtgtccctgctgcagcccccccagtaccgcatctaccagctgttcctgaatggaaacctgctgacccggctgtacccaaatgaatttgtgaactacagcaatgctgtgaccctgcacctgggcaacaacggcctgcaggagatcagaactggagccttcagcggcctgaagaccctgaagaggctgcacctgaacaacaacaagctggagatcctgcgggaggacaccttcctgggcctggagagcctggagtacctgcaggccgactacaactacatcagcgccattgaagctggggccttcagcaagctgaacaagctgaaggtgctgatcctgaatgacaacctgctgctgagcctgcccagcaatgtgttccgctttgtgctgctgacccacctggacctgcggggcaaccggctgaaggtgatgccctttgctggggtgctggagcacatcggcggcatcatggagatccagctggaggagaacccctggaactgcacctgtgacctgctgcccctgaaggcctggctggacaccatcaccgtgtttgtgggggagatcgtgtgtgagacccccttccggctgcacggcaaggatgtgacccagctgacccggcaggacctgtgccccaggaagagcgccagtgacagcagccagaggggcagccacgccgacacccacgtgcagaggctgagccccaccatgaacccagccctgaaccccacccgggcccccaaggccagccggccccccaagatgaggaaccggcccaccccccgggtgacagtgtccaaggaccggcagagctttggccccatcatggtgtaccagaccaagagccctgtgcccctgacctgccccagcagctgtgtgtgcaccagccagagcagtgacaatggcctgaatgtgaactgccaggagaggaagttcaccaacatcagtgacctgcagcccaagcccaccagccccaagaagctgtacctgactggaaactacctgcagacagtgtacaagaatgacctgctggagtacagcagcctggacctgctgcacctgggcaacaacagaattgctgtgatccaggagggcgccttcaccaacctgaccagcctgcggcggctgtacctgaatggaaactacctggaggtgctgtaccccagcatgtttgatggcctgcagagcctgcagtacctgtacctggagtacaacgtcatcaaggagatcaagcccctgacctttgatgccctgatcaacctgcagctgctcttcctgaacaacaacctgctgcggagcctgcctgacaacatctttggaggaacagccctgacccggctgaacctgaggaacaaccacttcagccacctgcctgtgaagggcgtgctggaccagctgcctgccttcatccagattgacctgcaggagaacccctgggactgcacctgtgacatcatgggcctgaaggactggacagagcacgccaacagccctgtgatcatcaatgaggtgacctgtgagagccctgccaagcatgctggggagatcctgaagttcctgggccgggaggccatctgcccagacagccccaacctgagtgatggcaccgtgctgtccatgaaccacaacacagacacccccaggagcctgtctgtgagccccagcagctacccagagctgcacacagaggtgcccctgtctgtgctgatcctgggcctgctggtggtgttcatcctgtctgtgtgctttggagctggcctgtttgtgtttgtgctgaagaggaggaagggcgtgcccagcgtgcccaggaacaccaacaacctggatgtgagcagcttccagctgcagtatggcagctacaacacagagacccatgacaagacagatggccacgtgtacaactacatccccccacctgtgggccagatgtgccagaaccccatctacatgcagaaggagggggaccctgtggcctactacagaaacctgcaggagttctcctacagcaacctggaggagaagaaggaggagcccgccaccccagcctacaccatcagcgccacagagctgctggagaagcaggccaccccccgggagcctgagctgctgtaccagaacattgctgagcgggtgaaggagctgcccagcgctggcctggtgcactacaacttctgcaccctgcccaagaggcagtttgcccccagctatgagagccggcggcagaaccaggaccgcatcaacaagacagtgctgtatggcacccccaggaaatgttttgtgggccagagcaagcccaaccaccccctgctgcaggccaagccccagagcgagccagactacctggaggtgctggagaagcagacagccatcagccagctgtag

SEQ ID NO: 169900 - DNA, 2538 bp, Artificial Sequence; identical to SEQ ID NO: 169899
  Description of Artificial Sequence: Synthetic coding sequence

SEQ ID NO: 169901 - DNA, 2538 bp, Artificial Sequence; identical to SEQ ID NO: 169899
  Description of Artificial Sequence: Synthetic coding sequence

SEQ ID NO: 169902 - DNA, 2538 bp, Artificial Sequence; identical to SEQ ID NO: 169899
  Description of Artificial Sequence: Synthetic coding sequence

SEQ ID NO: 169903 - DNA, 2538 bp, Artificial Sequence; identical to SEQ ID NO: 169899
  Description of Artificial Sequence: Synthetic coding sequence

SEQ ID NO: 169904 - DNA, 2934 bp, Artificial Sequence
  Description of Artificial Sequence: Synthetic coding sequence
atgaagcccagcattgctgagatgctgcaccggggccgcatgctgtggatcatcctgctgagcaccatcgccctgggctggaccacccccatccccctgattgaagattctgaggagattgatgagccctgctttgacccctgctactgtgaggtgaaggagagcctcttccacatccactgtgacagcaagggcttcaccaacatcagccagatcacagagttctggagccggcccttcaagctgtacctgcagaggaacagcatgaggaagctgtacaccaacagcttcctgcacctgaacaatgctgtgtccatcaacctgggcaacaatgccctgcaggacatccagacaggagccttcaacggcctgaagatcctgaagaggctgtacctgcacgagaacaagctggatgtgttcagaaatgacaccttcctgggcctggagagcctggagtacctgcaggccgactacaacgtcatcaagagaattgagagcggggccttcaggaacctgagcaagctgcgggtgctgatcctgaatgacaacctgatccccatgctgcccaccaacctcttcaaggctgtgtccctgacccacctggacctgcggggcaaccggctgaaggtgctcttctaccggggcatgctggaccacatcggccgcagcctgatggagctgcagctggaggagaacccctggaactgcacctgtgagatcgtgcagctgaagtcctggctggagcgcatcccctacacagccctggtgggggacatcacctgtgagacccccttccacttccacggcaaggacctgcgggagatcaggaagacagagctgtgccccctgctgagtgacagcgaggtggaggccagcctgggcatcccccacagcagcagcagcaaagaaaatgcctggcccaccaagcccagctccatgctgagctctgtgcacttcaccgccagctctgtggagtacaagagcagcaacaagcagcccaagcccaccaagcagcccaggaccccccggccccccagcaccagccaggccctgtacccaggccccaaccagccccccatcgccccctaccagaccaggcctcccatccccatcatctgccccaccggctgcacctgcaacctgcacatcaatgacctgggcctgactgtgaactgcaaggagcggggcttcaacaacatcagcgagctgctgccccggcccctgaatgccaagaagctgtacctgagcagcaacctgatccagaagatctacagaagtgacttctggaacttcagcagcctggacctgctgcacctgggcaacaaccgcatctcctatgtgcaggatggagccttcatcaacctgcccaacctgaagagcctcttcctgaatggaaatgacatcgagaagctgaccccaggcatgttccggggcctgcagagcctgcactacctgtactttgagttcaacgtcatccgggagatccagcctgctgccttcagcctgatgcccaacctgaagctgctcttcctgaacaacaacctgctgcggaccctgcccacagatgcctttgctggcaccagcctggcccggctgaacctgaggaagaactacttcctgtacctgcctgtggccggcgtgctggagcacctgaatgccatcgtgcagattgacctgaatgaaaacccctgggactgcacctgtgacctggtgcccttcaagcagtggattgagaccatcagctctgtgtctgtggtgggagatgtgctgtgccgcagccctgagaacctgacccacagagatgtgaggaccatcgagctggaggtgctgtgcccagagatgctgcacgtggccccagctggggagagccctgcccagcccggggacagccacctgattggagcccccaccagcgccagcccctatgagttcagccccccaggcggccctgtgcccctgtctgtgctgatcctgagcctgctggtgctcttcttctctgctgtgtttgtggccgccggcctgtttgcctacgtgctgcggcggcggaggaagaagctgcccttccgcagcaagaggcaggagggcgtggacctgaccggcatccagatgcagtgccaccggctgtttgaagatggcggcggcggcggcggcggcagcggcggcggcggccggcccaccctgagcagccctgagaaggcccctcctgtgggccacgtgtatgagtacatcccccaccctgtgacccagatgtgcaacaaccccatctacaagccccgggaggaggaggaggtggccgtgagcagcgcccaggaggccggcagcgctgagcggggcggccctggcacccagcccccaggcatgggagaggccctgctgggcagcgagcagtttgctgagacccccaaggagaaccacagcaactaccgcaccctgctggagaaggagaaggagtgggccctggccgtgagcagcagccagctgaacaccatcgtgacagtgaaccaccaccacccccaccaccctgctgtgggcggcgtgtctggagtggtgggcggcactggaggagacctggccggcttccgccaccacgagaagaatggaggagtggtgctcttccccccaggcggcggctgcggcagcggctccatgctgctggaccgggagcggccccagcctgccccctgcaccgtgggctttgtggactgcctgtatggcaccgtgcccaagctgaaggagctgcacgtgcaccccccaggcatgcagtacccagacctgcagcaggatgcccggctgaaggagaccctgctcttctctgctgggaagggcttcacagaccaccagacccagaagagtgactacctggagctgcgggccaagctgcagaccaagccagactacctggaggtgctggagaagaccacctaccgcttctag

SEQ ID NO: 169905 - DNA, 2934 bp, Artificial Sequence; identical to SEQ ID NO: 169904
  Description of Artificial Sequence: Synthetic coding sequence

SEQ ID NO: 169906 - DNA, 492 bp, Artificial Sequence
  Description of Artificial Sequence: Synthetic coding sequence
atgaagcccagcattgctgagatgctgcaccggggccgcatgctgtggatcatcctgctgagcaccatcgccctgggctggaccacccccatccccctgattgaagattctgaggagattgatgagccctgctttgacccctgctactgtgaggtgaaggagagcctcttccacatccactgtgacagcaagggcttcaccaacatcagccagatcacagagttctggagccggcccttcaagctgtacctgcagaggaacagcatgaggaagctgtacaccaacagcttcctgcacctgaacaatgctgtgtccatcaacctgggcaacaatgccctgcaggacatccagacaggagccttcaacggcctgaagatcctgaagaggctgtacctgcacgagaacaagctggatgtgttcagaaatgacaccttcctgggcctggagagcctggagtacctgcaggccgactacaacgtcatcaagaggtag

SEQ ID NO: 169907 - DNA, 2514 bp, Artificial Sequence
  Description of Artificial Sequence: Synthetic coding sequence
atgttcctgtggctgttcctgatcctgagcgccctgatcagcagcaccaatgctgacagcgacatctctgtggagatctgcaatgtgtgcagctgtgtgtctgtggagaatgtgctgtatgtgaactgtgagaaggtgtctgtgtaccggcccaaccagctgaagccaccctggagcaacttctaccacctgaacttccagaacaacttcctgaacatcctgtaccccaacaccttcctgaacttcagccatgctgtgtccctgcacctgggcaacaacaagctgcagaacatcgagggcggggccttcctgggcctgagcgccctgaagcagctgcacctgaacaacaatgagctgaagatcctgcgggctgacaccttcctgggcatcgagaacctggagtacctgcaggccgactacaacctgatcaagtacatcgagcggggggccttcaacaagctgcacaagctgaaggtgctgatcctgaatgacaacctgatctccttcctgcctgacaacatcttccgctttgccagcctgacccacctggacatccggggcaaccgcatccagaagctgccctacatcggcgtgctggagcacatcggccgggtggtggagctgcagctggaggacaacccctggaactgcagctgtgacctgctgcccctgaaggcctggctggagaacatgccctacaacatctacatcggggaggccatctgtgagacccccagcgacctgtatggccgcctgctgaaggagaccaacaagcaggagctgtgccccatgggcaccggcagtgactttgatgtgcgcatcctgccccccagccagctggagaatggctacaccacccccaacggccacaccacccagaccagcctgcaccggctggtgaccaagccacccaagaccaccaaccccagcaagatctctggaattgtggccggcaaggccctgagcaacagaaacctgagccagatcgtgtcctaccagaccagggtgccccccctgaccccctgcccagccccctgcttctgcaagacccaccccagcgacctgggcctgtctgtgaactgccaggagaagaacatccagagcatgtctgagctgatccccaagcccctgaatgccaagaagctgcacgtgaatggaaacagcatcaaggatgtggatgtgtctgacttcacagactttgagggcctggacctgctgcacctgggcagcaaccagatcaccgtcatcaagggagatgtgttccacaacctgaccaacctgcggcggctgtacctgaatggaaaccagatcgagcggctgtacccagagatcttcagcggcctgcacaacctgcagtacctgtacctggagtacaacctgatcaaggagatctctgctggcacctttgacagcatgcccaacctgcagctgctgtacctgaacaacaacctgctgaagagcctgcctgtgtacatcttcagcggggcccccctggcccggctgaacctgaggaacaacaagttcatgtacctgcctgtgtctggagtgctggaccagctgcagagcctgacccagattgacctggagggcaacccctgggactgcacctgtgacctggtggccctgaagctgtgggtggagaagctgagtgatggcatcgtggtgaaggagctgaagtgtgagacccctgtgcagtttgccaacatcgagctgaagagcctgaagaatgagatcctgtgccccaagctgctgaacaagcccagcgcccccttcaccagccctgccccagccatcaccttcaccacccccctgggccccatccgcagccccccaggcggccctgtgcccctgagcatcctgatcctgagcatcctggtggtgctgatcctgactgtgtttgtggccttctgcctgctggtgtttgtgctgcggaggaacaagaagcccaccgtgaagcatgagggcctgggcaacccagactgtggctccatgcagctgcagctgaggaagcatgaccacaagaccaacaagaaggatggcctgagcacagaggccttcatcccccagaccatcgagcagatgagcaagagccacacctgtggcctgaaggagagcgagaccggcttcatgttcagtgaccccccaggccagaaggtggtgatgagaaatgtggccgacaaggagaaggacctgctgcacgtggacaccaggaagaggctgagcaccattgatgagctggatgagctgttccccagccgggacagcaatgtgttcatccagaacttcctggagagcaagaaggagtacaacagcattggagtgtctggctttgagatccgctacccagagaagcagcctgacaagaagagcaagaagagcctgattggaggcaaccacagcaagatcgtggtggagcagaggaagtctgagtactttgagctgaaggccaagctgcagagcagcccagactacctgcaggtgctggaggagcagacagccctgaacaagatctag

SEQ ID NO: 169908 - DNA, 2514 bp, Artificial Sequence; identical to SEQ ID NO: 169907
  Description of Artificial Sequence: Synthetic coding sequence

SEQ ID NO: 169909 - DNA, 2514 bp, Artificial Sequence; identical to SEQ ID NO: 169907
  Description of Artificial Sequence: Synthetic coding sequence

SEQ ID NO: 169910 - DNA, 2877 bp, Artificial Sequence
  Description of Artificial Sequence: Synthetic coding sequence
atgcacacctgctgcccccctgtgaccctggagcaggacctgcacaggaagatgcacagctggatgctgcagaccctggcctttgctgtgaccagcctggtgctgagctgtgccgagaccatcgactactacggggagatctgtgacaatgcctgcccctgtgaggagaaggatggcatcctgactgtgtcctgtgagaacagaggcatcatcagcctgtctgagatcagccccccacgcttccccatctaccacctgctgctgagcggcaacctgctgaaccggctgtacccaaatgaatttgtgaactacacaggagccagcatcctgcacctgggcagcaatgtcatccaggacatcgagaccggggccttccacggcctgcggggcctgcggcggctgcacctgaacaacaacaagctggagctgctgagagatgacaccttcctgggcctggagaacctggagtacctgcaggtggactacaactacatcagcgtcatcgagcccaatgccttcggcaagctgcacctgctgcaggtgctgatcctgaatgacaacctgctgagcagcctgcccaacaacctcttccgctttgtgcccctgacccacctggacctgcggggcaaccggctgaagctgctgccctacgtgggcctgctgcagcacatggacaaggtggtggagctgcagctggaggagaacccctggaactgcagctgtgagctgatcagcctgaaggactggctggacagcatctcctacagcgccctggtgggagatgtggtgtgtgagacccccttccggctgcacggccgggacctggatgaggtgtccaagcaggagctgtgcccccggcggctcatcagtgactatgagatgaggccccagacccccctgagcaccaccggctacctgcacaccaccccagcctctgtgaacagcgtggccaccagcagcagcgctgtgtacaagccacccctgaagccacccaagggcacccggcagcccaacaagccccgggtgcggcccaccagccggcagcccagcaaggacctgggctacagcaactacggccccagcatcgcctaccagaccaagagccctgtgcccctggagtgccccacagcctgcagctgcaacctgcagatcagtgacctgggcctgaatgtgaactgccaggagaggaagattgagagcattgctgagctgcagcccaagccctacaaccccaagaagatgtacctgacagagaactacatcgctgtggtgagaagaacagacttcctggaggccaccggcctggacctgctgcacctgggcaacaaccgcatctccatgatccaggaccgggcctttggagacctgaccaacctgcggcggctgtacctgaatggaaacagaattgagcggctgagccctgagctgttctacggcctgcagagcctgcagtacctgttcctgcagtacaacctgatccgggagatccagagcggcacctttgatcctgtgcccaacctgcagctgctcttcctgaacaacaacctgctgcaggccatgcccagcggggtcttcagcggcctgaccctgctgcggctgaacctgcggagcaaccacttcaccagcctgcctgtgtctggagtgctggaccagctgaagagcctcatccagattgacctgcatgacaacccctgggactgcacctgtgacatcgtgggcatgaagctgtgggtggagcagctgaaggtgggcgtgctggtggatgaggtgatctgcaaggcccccaagaagtttgctgagacagacatgaggagcatcaagtctgagctgctgtgcccagactacagtgatgtggtggtgtccacccccacccccagcagcatccaggtgcctgcccggaccagcgctgtgaccccagctgtgcggctgaacagcactggagccccagccagcctgggcgctgggggcggggccagctctgtgcccctgtctgtgctgatcctgagcctgctgctggtgttcatcatgtctgtgtttgtggccgccggcctgtttgtgctggtgatgaagaggaggaagaagaaccagagcgaccacaccagcaccaacaacagtgatgtgtcctccttcaacatgcagtacagcgtgtatggaggcggcggcggcactggaggccacccccacgcccacgtgcaccaccggggccctgccctgcccaaggtgaagaccccagctggccacgtgtatgagtacatcccccaccccctgggccacatgtgcaagaaccccatctaccgcagccgggagggcaacagcgtggaggactacaaggacctgcacgagctgaaggtgacctacagcagcaaccaccacctgcagcagcagcagcagcccccacctccaccccagcagccccagcagcagcccccaccccagctgcagctgcagcctggagaggaggagcggcgggagagccaccacctgcggagccctgcctacagcgtgtccaccatcgagccccgggaggacctgctgagccctgtgcaggatgctgaccgcttctaccggggcatcctggagccagacaagcactgcagcaccaccccagctggcaacagcctgcctgagtaccccaagttcccctgcagccctgctgcctacaccttcagccccaactatgacctgcggcggccccaccagtacctgcaccctggggccggggacagccggctgcgggagcctgtgctgtacagccccccatctgctgtgtttgtggagcccaacagaaatgagtacctggagctgaaggccaagctgaatgtggagccagactacctggaggtgctggagaagcagaccaccttcagccagttctag

SEQ ID NO: 169911 - DNA, 2154 bp, Artificial Sequence
  Description of Artificial Sequence: Synthetic coding sequence
atgggcgccggcaagcaccgggagggcggcggcggggaccccaccagcctgaatggctgtgccgacctgatccagaggagaacagagatcagccgggacctggatgaggtgtccaagcaggagctgtgccccaggaggctcatcagtgactatgagatgaggccccagacccccctgagcaccaccggctacctgcacaccaccccagcctctgtgaacagcgtggccaccagcagcagcgctgtgtacaagccacccctgaagccacccaagggcacccggcagcccaacaagccccgggtgcggcccaccagccggcagcccagcaaggacctgggctacagcaactacggccccagcatcgcctaccagaccaagagccctgtgcccctggagtgccccacagcctgcagctgcaacctgcagatcagtgacctgggcctgaatgtgaactgccaggagaggaagattgagagcattgctgagctgcagcccaagccctacaaccccaagaagatgtacctgacagagaactacatcgctgtggtgcggaggacagacttcctggaggccaccggcctggacctgctgcacctgggcaacaaccgcatctccatgatccaggaccgggccttcggggacctgaccaacctgcggcggctgtacctgaatggaaaccgcatcgagcggctgagccctgagctgttctacggcctgcagagcctgcagtacctgttcctgcagtacaacctgatccgggagatccagagcggcacctttgatcctgtgcccaacctgcagctgctcttcctgaacaacaacctgctgcaggccatgcccagcggggtcttcagcggcctgaccctgctgcggctgaacctgcggagcaaccacttcaccagcctgcctgtgtctggagtgctggaccagctgaagagcctcatccagattgacctgcatgacaacccctgggactgcacctgtgacatcgtgggcatgaagctgtgggtggagcagctgaaggtgggcgtgctggtggatgaagtcatctgcaaggcccccaagaagtttgctgagacagacatgaggagcatcaagtctgagctgctgtgcccagactacagtgatgtggtggtgtccacccccacccccagcagcatccaggtgcctgcccggaccagcgctgtgaccccagctgtgcggctgaacagcactggagccccagccagcctgggcgccggcggcggggccagctctgtgcccctgtctgtgctgatcctgagcctgctgctggtgttcatcatgtctgtgtttgtggccgccggcctgtttgtgctggtgatgaagaggaggaagaagaaccagagcgaccacaccagcaccaacaacagtgatgtgagcagcttcaacatgcagtacagcgtgtatggaggcggcggcggcaccggcggccacccccacgcccacgtgcaccaccggggccctgccctgcccaaggtgaagaccccagctggccacgtgtatgagtacatcccccaccccctgggccacatgtgcaagaaccccatctaccgcagccgggagggcaacagcgtggaggactacaaggacctgcacgagctgaaggtgacctacagcagcaaccaccacctgcagcagcagcagcagcccccacctccaccccagcagccccagcagcagcccccaccccagctgcagctgcagcccggggaggaggagcggcgggagagccaccacctgcggagccctgcctacagcgtgtccaccatcgagccccgggaggacctgctgagccctgtgcaggatgctgaccgcttctaccggggcatcctggagccagacaagcactgcagcaccaccccagctggcaacagcctgcctgagtaccccaagttcccctgcagccctgctgcctacaccttcagccccaactatgacctgcggcggccccaccagtacctgcaccctggagctggggacagccggctgcgggagcctgtgctgtacagcccccccagcgctgtgtttgtggagcccaacagaaatgagtacctggagctgaaggccaagctgaatgtggagccagactacctggaggtgctggagaagcagaccaccttcagccagttctag

SEQ ID NO: 169912 - DNA, 2526 bp, Artificial Sequence
  Description of Artificial Sequence: Synthetic coding sequence
atgaagctgtggatccacctgttctacagcagcctgctggcctgcatcagcctgcacagccagacccctgtgctgagcagccggggcagctgtgacagcctgtgcaactgtgaggagaaggatggcaccatgctgatcaactgtgaggccaagggcatcaagatggtgtctgagatctctgtgccccccagccggcccttccagctgagcctgctgaacaacggcctgaccatgctgcacaccaatgacttcagcggcctgaccaatgccatcagcatccacctgggcttcaacaacattgctgacattgaaattggagccttcaacggcctgggcctgctgaagcagctgcacatcaaccacaacagcctggagatcctgaaggaggacaccttccacggcctggagaacctggagttcctgcaggccgacaacaacttcatcaccgtgattgagcccagcgccttcagcaagctgaaccggctgaaggtgctgatcctgaatgacaatgccatcgagagcctgccccccaacatcttccgctttgtgcccctgacccacctggacctgcggggcaaccagctgcagaccctgccctacgtgggcttcctggagcacatcggccgcatcctggacctgcagctggaggacaacaagtgggcctgcaactgtgacctgctgcagctgaagacctggctggagaacatgccaccccagagcatcattggagatgtggtgtgcaacagcccccccttcttcaagggcagcatcctgagccggctgaagaaggagagcatctgccccaccccacctgtgtatgaggagcacgaggaccccagcggcagcctgcacctggccgccaccagcagcatcaatgacagcaggatgagcaccaagaccaccagcatcctgaagctgcccaccaaggcccctggcctcatcccctacatcaccaagcccagcacccagctgcccggcccctactgccccatcccctgcaactgcaaggtgctgagccccagcggcctgctgatccactgccaggagaggaacatcgagagcctgagtgacctgcggcccccaccccagaaccccaggaagctgatcctggccggcaacatcatccacagcctgatgaagagtgacctggtggagtacttcaccctggagatgctgcacctgggcaacaacagaattgaggtgctggaggagggcagcttcatgaacctgacccggctgcagaagctgtacctgaatggaaaccacctgaccaagctgagcaagggcatgttcctgggcctgcacaacctggagtacctgtacctggagtacaatgccatcaaggagatcctgcccggcaccttcaaccccatgcccaagctgaaggtgctgtacctgaacaacaacctgctgcaggtgctgcccccccacatcttcagcggcgtgcccctgaccaaggtgaacctgaagaccaaccagttcacccacctgcctgtgagcaacatcctggatgacctggacctgctgacccagattgacctggaggacaacccctgggactgcagctgtgacctggtgggcctgcagcagtggatccagaagctgagcaagaacacagtgacagatgacatcctgtgcaccagccctggccacctggacaagaaggagctgaaggccctgaacagcgagatcctgtgccccggcctggtgaacaaccccagcatgcccacccagaccagctacctgatggtgaccaccccagccaccaccaccaacacagctgacaccatcctgcggagcctgacagatgctgtgcccctgtctgtgctgatcctgggcctgctgatcatgttcatcaccatcgtgttctgtgccgccggcatcgtggtgctggtgctgcacagaagaagacgctacaagaagaagcaggtggatgagcagatgagggacaacagccctgtgcacctgcagtacagcatgtatggccacaagaccacccaccacaccacagagcggcccagcgccagcctgtatgagcagcacatggtgagccccatggtgcacgtgtaccgcagccccagctttggccccaagcacctggaggaggaggaggagagaaatgagaaggagggcagtgatgccaagcacctgcagaggagcctgctggagcaggagaaccacagccccctgaccggcagcaacatgaagtacaagaccaccaaccagagcacagagttcctgtccttccaggatgccagcagcctgtacagaaacatcctggagaaggagcgggagctgcagcagctgggcatcacagagtacctgaggaagaacatcgcccagctgcagcctgacatggaggcccactacccaggggcccacgaggagctgaagctgatggagaccctgatgtacagccggcccaggaaggtgctggtggagcagaccaagaatgagtactttgagctgaaggccaacctgcatgctgagccagactacctggaggtgctggagcagcagacctag

SEQ ID NO: 169913 - DNA, 4578 bp, Artificial Sequence
  Description of Artificial Sequence: Synthetic coding sequence
atgagaggagtgggctggcagatgctgagcctgagcctgggcctggtgctggccatcctgaacaaggtggccccccaggcctgcccagcccagtgcagctgcagcggcagcacagtggactgccacggcctggccctgcggtctgtgcccaggaacatccccaggaacacagagcggctggacctgaatggaaacaacatcacccgcatcaccaagacagactttgctggcctgcggcacctgcgggtgctgcagctgatggagaacaagatcagcaccatcgagcggggggccttccaggacctgaaggagctggagcggctgcggctgaacagaaaccacctgcagctgtttcctgagctgctcttcctgggcacagccaagctgtaccgcctggacctgtctgagaaccagatccaggccatccccaggaaggccttcagaggagctgtggacatcaagaacctgcagctggactacaaccagatcagctgcattgaagatggagccttccgggccctgcgggacctggaggtgctgaccctgaacaacaacaacatcacccggctgtctgtggccagcttcaaccacatgcccaagctgcggaccttccggctgcacagcaacaacctgtactgtgactgccacctggcctggctgagtgactggctgcggcagaggccccgggtgggcctgtacacccagtgcatgggccccagccacctgcggggccacaacgtggccgaggtgcagaagcgggagtttgtgtgcagcggcaagggggagggccaccagagcttcatggcccccagctgcagcgtgctgcactgcccagctgcctgcacctgcagcaacaacatcgtggactgccggggcaagggcctgacagagatccccaccaacctgcctgagaccatcacagagatccggctggagcagaacaccatcaaggtgatccccccaggggccttcagcccctacaagaagctgcggagaattgacctgagcaacaaccagatcagcgagctggccccagatgccttccagggcctgcggagcctgaacagcctggtgctgtatggcaacaagatcacagagctgcccaagagcctgtttgagggcctcttcagcctgcagctgctgctgctgaatgccaacaagatcaactgcctgcgggtggatgccttccaggacctgcacaacctgaacctgctgagcctgtatgacaacaagctgcagaccatcgccaagggcaccttcagccccctgcgggccatccagaccatgcacctggcccagaaccccttcatctgtgactgccacctgaagtggctggccgactacctgcacaccaaccccatcgagaccagcggggcccgctgcaccagcccccggcggctggccaacaagagaattggccagatcaagagcaagaagttccgctgcagcggcacagaggactaccgcagcaagctgagcggggactgctttgctgacctggcctgcccagagaagtgccgctgtgagggcaccaccgtggactgcagcaaccagaagctgaacaagatccctgagcacatcccccagtacacagctgagctgcggctgaacaacaatgagttcaccgtgctggaggccaccggcatcttcaagaagctgccccagctgaggaagatcaacttcagcaacaacaagatcacagacatcgaggagggcgcctttgagggcgccagcggcgtgaatgagatcctgctgaccagcaaccggctggagaatgtgcagcacaagatgttcaagggcctggagagcctgaagaccctgatgctgcggagcaaccgcatcacctgtgtgggcaatgacagcttcatcggcctgagctctgtgcggctgctgagcctgtatgacaaccagatcaccaccgtggcccctggggcctttgacaccctgcacagcctgagcaccctgaacctgctggccaaccccttcaactgcaactgctacctggcctggctgggggagtggctgaggaagaagagaattgtgacaggcaacccccgctgccagaagccctacttcctgaaggagatccccatccaggatgtggccatccaggacttcacctgtgatgatggaaatgatgacaacagctgcagccccctgagccgctgccccacagagtgcacctgcctggacacagtggtgcgctgcagcaacaagggcctgaaggtgctgcccaagggcatccccagagatgtgacagagctgtacctggatggcaaccagttcaccctggtgcccaaggagctgagcaactacaagcacctgaccctgattgacctgagcaacaaccgcatcagcaccctgagcaaccagagcttcagcaacatgacccagctgctgaccctcatcctgagctacaaccggctgcgctgcatcccccccaggacctttgatggcctgaagagcctgcggctgctgagcctgcatggaaatgacatctctgtggtgcctgagggcgccttcaatgacctgagcgccctgagccacctggccatcggggccaaccccctgtactgtgactgcaacatgcagtggctgagtgactgggtgaagtctgagtacaaggagcccggcatcgcccgctgtgccggccctggagagatggctgacaagctgctgctgaccacccccagcaagaagttcacctgccagggccctgtggatgtgaacatcctggccaagtgcaacccctgcctgagcaacccctgcaagaatgatggcacctgcaacagcgaccctgtggacttctaccgctgcacctgcccctacggcttcaagggccaggactgtgatgtgcccatccacgcctgcatcagcaacccctgcaagcacggcggcacctgccacctgaaggagggggaggaggatggcttctggtgcatctgtgctgatggctttgaaggagagaactgtgaggtgaatgtggatgactgtgaagataatgactgtgagaacaacagcacctgtgtggatggcatcaacaactacacctgcctgtgccccccagagtacacaggagagctgtgtgaggagaagctggacttctgtgcccaggacctgaacccctgccagcacgacagcaagtgcatcctgacccccaagggcttcaagtgtgactgcaccccaggctacgtgggggagcactgtgacatcgactttgatgactgccaggacaacaagtgcaagaatggagcccactgcacagatgctgtgaatggctacacctgcatctgcccagagggctacagcggcctcttctgtgagttcagcccccccatggtgctgcccaggaccagcccctgtgacaactttgactgccagaatggagcccagtgcatcgtgcgcatcaatgagcccatctgccagtgcctgcccggctaccagggcgagaagtgtgagaagctggtgtctgtgaacttcatcaacaaggagagctacctgcagatccccagcgccaaggtgcggccccagaccaacatcaccctgcagatcgccacagatgaggacagcggcatcctgctgtacaagggggacaaggaccacatcgctgtggagctgtaccggggccgggtgcgggccagctatgacaccggcagccacccagccagcgccatctacagcgtggagaccatcaatgatggcaacttccacatcgtggagctgctggccctggaccagagcctgagcctgtctgtggatggcggcaaccccaagatcatcaccaacctgagcaagcagagcaccctgaactttgacagccccctgtatgtgggcggcatgcctgggaagagcaatgtggccagcctgcggcaggcccctggccagaatggcaccagcttccacggctgcatccggaacctgtacatcaacagcgagctgcaggacttccagaaggtgcccatgcagacaggcatcctgcccggctgtgagccctgccacaagaaggtgtgtgcccacggcacctgccagcccagcagccaggccggcttcacctgtgagtgccaggagggctggatgggccccctgtgtgaccagaggaccaatgacccctgcctgggcaacaagtgtgtgcacggcacctgcctgcccatcaatgccttctcctacagctgcaagtgcctggagggccatggaggagtgctgtgtgatgaggaggaggacctcttcaacccctgccaggccatcaagtgcaagcatggaaaatgtcggctgagcggcctgggccagccctactgtgaatgtagcagcggctacacaggagacagctgtgaccgggagatcagctgccgcggggagcgcatccgggactactaccagaagcagcagggctatgctgcctgccagaccaccaagaaggtgtcccggctggagtgccggggcggctgtgccggcggccagtgctgcggccccctgcggagcaagaggaggaagtacagctttgaatgtacagatggcagcagctttgtggatgaggtggagaaggtggtgaagtgtggctgcacccgctgtgtgtcctag

SEQ ID NO: 169914 - DNA, 4566 bp, Artificial Sequence
  Description of Artificial Sequence: Synthetic coding sequence
atgagaggagtgggctggcagatgctgagcctgagcctgggcctggtgctggccatcctgaacaaggtggccccccaggcctgcccagcccagtgcagctgcagcggcagcacagtggactgccacggcctggccctgcggtctgtgcccaggaacatccccaggaacacagagcggctggacctgaatggaaacaacatcacccgcatcaccaagacagactttgctggcctgcggcacctgcgggtgctgcagctgatggagaacaagatcagcaccatcgagcggggggccttccaggacctgaaggagctggagcggctgcggctgaacagaaaccacctgcagctgtttcctgagctgctcttcctgggcacagccaagctgtaccgcctggacctgtctgagaaccagatccaggccatccccaggaaggccttcagaggagctgtggacatcaagaacctgcagctggactacaaccagatcagctgcattgaagatggagccttccgggccctgcgggacctggaggtgctgaccctgaacaacaacaacatcacccggctgtctgtggccagcttcaaccacatgcccaagctgcggaccttccggctgcacagcaacaacctgtactgtgactgccacctggcctggctgagtgactggctgcggcagaggccccgggtgggcctgtacacccagtgcatgggccccagccacctgcggggccacaacgtggccgaggtgcagaagcgggagtttgtgtgcagcggccaccagagcttcatggcccccagctgcagcgtgctgcactgcccagctgcctgcacctgcagcaacaacatcgtggactgccggggcaagggcctgacagagatccccaccaacctgcctgagaccatcacagagatccggctggagcagaacaccatcaaggtgatccccccaggggccttcagcccctacaagaagctgcggagaattgacctgagcaacaaccagatcagcgagctggccccagatgccttccagggcctgcggagcctgaacagcctggtgctgtatggcaacaagatcacagagctgcccaagagcctgtttgagggcctcttcagcctgcagctgctgctgctgaatgccaacaagatcaactgcctgcgggtggatgccttccaggacctgcacaacctgaacctgctgagcctgtatgacaacaagctgcagaccatcgccaagggcaccttcagccccctgcgggccatccagaccatgcacctggcccagaaccccttcatctgtgactgccacctgaagtggctggccgactacctgcacaccaaccccatcgagaccagcggggcccgctgcaccagcccccggcggctggccaacaagagaattggccagatcaagagcaagaagttccgctgcagcggcacagaggactaccgcagcaagctgagcggggactgctttgctgacctggcctgcccagagaagtgccgctgtgagggcaccaccgtggactgcagcaaccagaagctgaacaagatccctgagcacatcccccagtacacagctgagctgcggctgaacaacaatgagttcaccgtgctggaggccaccggcatcttcaagaagctgccccagctgaggaagatcaacttcagcaacaacaagatcacagacatcgaggagggcgcctttgagggcgccagcggcgtgaatgagatcctgctgaccagcaaccggctggagaatgtgcagcacaagatgttcaagggcctggagagcctgaagaccctgatgctgcggagcaaccgcatcacctgtgtgggcaatgacagcttcatcggcctgagctctgtgcggctgctgagcctgtatgacaaccagatcaccaccgtggcccctggggcctttgacaccctgcacagcctgagcaccctgaacctgctggccaaccccttcaactgcaactgctacctggcctggctgggggagtggctgaggaagaagagaattgtgacaggcaacccccgctgccagaagccctacttcctgaaggagatccccatccaggatgtggccatccaggacttcacctgtgatgatggaaatgatgacaacagctgcagccccctgagccgctgccccacagagtgcacctgcctggacacagtggtgcgctgcagcaacaagggcctgaaggtgctgcccaagggcatccccagagatgtgacagagctgtacctggatggcaaccagttcaccctggtgcccaaggagctgagcaactacaagcacctgaccctgattgacctgagcaacaaccgcatcagcaccctgagcaaccagagcttcagcaacatgacccagctgctgaccctcatcctgagctacaaccggctgcgctgcatcccccccaggacctttgatggcctgaagagcctgcggctgctgagcctgcatggaaatgacatctctgtggtgcctgagggcgccttcaatgacctgagcgccctgagccacctggccatcggggccaaccccctgtactgtgactgcaacatgcagtggctgagtgactgggtgaagtctgagtacaaggagcccggcatcgcccgctgtgccggccctggagagatggctgacaagctgctgctgaccacccccagcaagaagttcacctgccagggccctgtggatgtgaacatcctggccaagtgcaacccctgcctgagcaacccctgcaagaatgatggcacctgcaacagcgaccctgtggacttctaccgctgcacctgcccctacggcttcaagggccaggactgtgatgtgcccatccacgcctgcatcagcaacccctgcaagcacggcggcacctgccacctgaaggagggggaggaggatggcttctggtgcatctgtgctgatggctttgaaggagagaactgtgaggtgaatgtggatgactgtgaagataatgactgtgagaacaacagcacctgtgtggatggcatcaacaactacacctgcctgtgccccccagagtacacaggagagctgtgtgaggagaagctggacttctgtgcccaggacctgaacccctgccagcacgacagcaagtgcatcctgacccccaagggcttcaagtgtgactgcaccccaggctacgtgggggagcactgtgacatcgactttgatgactgccaggacaacaagtgcaagaatggagcccactgcacagatgctgtgaatggctacacctgcatctgcccagagggctacagcggcctcttctgtgagttcagcccccccatggtgctgcccaggaccagcccctgtgacaactttgactgccagaatggagcccagtgcatcgtgcgcatcaatgagcccatctgccagtgcctgcccggctaccagggcgagaagtgtgagaagctggtgtctgtgaacttcatcaacaaggagagctacctgcagatccccagcgccaaggtgcggccccagaccaacatcaccctgcagatcgccacagatgaggacagcggcatcctgctgtacaagggggacaaggaccacatcgctgtggagctgtaccggggccgggtgcgggccagctatgacaccggcagccacccagccagcgccatctacagcgtggagaccatcaatgatggcaacttccacatcgtggagctgctggccctggaccagagcctgagcctgtctgtggatggcggcaaccccaagatcatcaccaacctgagcaagcagagcaccctgaactttgacagccccctgtatgtgggcggcatgcctgggaagagcaatgtggccagcctgcggcaggcccctggccagaatggcaccagcttccacggctgcatccggaacctgtacatcaacagcgagctgcaggacttccagaaggtgcccatgcagacaggcatcctgcccggctgtgagccctgccacaagaaggtgtgtgcccacggcacctgccagcccagcagccaggccggcttcacctgtgagtgccaggagggctggatgggccccctgtgtgaccagaggaccaatgacccctgcctgggcaacaagtgtgtgcacggcacctgcctgcccatcaatgccttctcctacagctgcaagtgcctggagggccatggaggagtgctgtgtgatgaggaggaggacctcttcaacccctgccaggccatcaagtgcaagcatggaaaatgtcggctgagcggcctgggccagccctactgtgaatgtagcagcggctacacaggagacagctgtgaccgggagatcagctgccgcggggagcgcatccgggactactaccagaagcagcagggctatgctgcctgccagaccaccaagaaggtgtcccggctggagtgccggggcggctgtgccggcggccagtgctgcggccccctgcggagcaagaggaggaagtacagctttgaatgtacagatggcagcagctttgtggatgaggtggagaaggtggtgaagtgtggctgcacccgctgtgtgtcctag

SEQ ID NO: 169915 - DNA, 4578 bp, Artificial Sequence
  Description of Artificial Sequence: Synthetic coding sequence
atgagaggagtgggctggcagatgctgagcctgagcctgggcctggtgctggccatcctgaacaaggtggccccccaggcctgcccagcccagtgcagctgcagcggcagcacagtggactgccacggcctggccctgcggtctgtgcccaggaacatccccaggaacacagagcggctggacctgaatggaaacaacatcacccgcatcaccaagacagactttgctggcctgcggcacctgcgggtgctgcagctgatggagaacaagatcagcaccatcgagcggggggccttccaggacctgaaggagctggagcggctgcggctgaacagaaaccacctgcagctgtttcctgagctgctcttcctgggcacagccaagctgtaccgcctggacctgtctgagaaccagatccaggccatccccaggaaggccttcagaggagctgtggacatcaagaacctgcagctggactacaaccagatcagctgcattgaagatggagccttccgggccctgcgggacctggaggtgctgaccctgaacaacaacaacatcacccggctgtctgtggccagcttcaaccacatgcccaagctgcggaccttccggctgcacagcaacaacctgtactgtgactgccacctggcctggctgagtgactggctgcggcagaggccccgggtgggcctgtacacccagtgcatgggccccagccacctgcggggccacaacgtggccgaggtgcagaagcgggagtttgtgtgcagtgatgaggaggagggccaccagagcttcatggcccccagctgcagcgtgctgcactgcccagctgcctgcacctgcagcaacaacatcgtggactgccggggcaagggcctgacagagatccccaccaacctgcctgagaccatcacagagatccggctggagcagaacaccatcaaggtgatccccccaggggccttcagcccctacaagaagctgcggagaattgacctgagcaacaaccagatcagcgagctggccccagatgccttccagggcctgcggagcctgaacagcctggtgctgtatggcaacaagatcacagagctgcccaagagcctgtttgagggcctcttcagcctgcagctgctgctgctgaatgccaacaagatcaactgcctgcgggtggatgccttccaggacctgcacaacctgaacctgctgagcctgtatgacaacaagctgcagaccatcgccaagggcaccttcagccccctgcgggccatccagaccatgcacctggcccagaaccccttcatctgtgactgccacctgaagtggctggccgactacctgcacaccaaccccatcgagaccagcggggcccgctgcaccagcccccggcggctggccaacaagagaattggccagatcaagagcaagaagttccgctgcagcggcacagaggactaccgcagcaagctgagcggggactgctttgctgacctggcctgcccagagaagtgccgctgtgagggcaccaccgtggactgcagcaaccagaagctgaacaagatccctgagcacatcccccagtacacagctgagctgcggctgaacaacaatgagttcaccgtgctggaggccaccggcatcttcaagaagctgccccagctgaggaagatcaacttcagcaacaacaagatcacagacatcgaggagggcgcctttgagggcgccagcggcgtgaatgagatcctgctgaccagcaaccggctggagaatgtgcagcacaagatgttcaagggcctggagagcctgaagaccctgatgctgcggagcaaccgcatcacctgtgtgggcaatgacagcttcatcggcctgagctctgtgcggctgctgagcctgtatgacaaccagatcaccaccgtggcccctggggcctttgacaccctgcacagcctgagcaccctgaacctgctggccaaccccttcaactgcaactgctacctggcctggctgggggagtggctgaggaagaagagaattgtgacaggcaacccccgctgccagaagccctacttcctgaaggagatccccatccaggatgtggccatccaggacttcacctgtgatgatggaaatgatgacaacagctgcagccccctgagccgctgccccacagagtgcacctgcctggacacagtggtgcgctgcagcaacaagggcctgaaggtgctgcccaagggcatccccagagatgtgacagagctgtacctggatggcaaccagttcaccctggtgcccaaggagctgagcaactacaagcacctgaccctgattgacctgagcaacaaccgcatcagcaccctgagcaaccagagcttcagcaacatgacccagctgctgaccctcatcctgagctacaaccggctgcgctgcatcccccccaggacctttgatggcctgaagagcctgcggctgctgagcctgcatggaaatgacatctctgtggtgcctgagggcgccttcaatgacctgagcgccctgagccacctggccatcggggccaaccccctgtactgtgactgcaacatgcagtggctgagtgactgggtgaagtctgagtacaaggagcccggcatcgcccgctgtgccggccctggagagatggctgacaagctgctgctgaccacccccagcaagaagttcacctgccagggccctgtggatgtgaacatcctggccaagtgcaacccctgcctgagcaacccctgcaagaatgatggcacctgcaacagcgaccctgtggacttctaccgctgcacctgcccctacggcttcaagggccaggactgtgatgtgcccatccacgcctgcatcagcaacccctgcaagcacggcggcacctgccacctgaaggagggggaggaggatggcttctggtgcatctgtgctgatggctttgaaggagagaactgtgaggtgaatgtggatgactgtgaagataatgactgtgagaacaacagcacctgtgtggatggcatcaacaactacacctgcctgtgccccccagagtacacaggagagctgtgtgaggagaagctggacttctgtgcccaggacctgaacccctgccagcacgacagcaagtgcatcctgacccccaagggcttcaagtgtgactgcaccccaggctacgtgggggagcactgtgacatcgactttgatgactgccaggacaacaagtgcaagaatggagcccactgcacagatgctgtgaatggctacacctgcatctgcccagagggctacagcggcctcttctgtgagttcagcccccccatggtgctgcccaggaccagcccctgtgacaactttgactgccagaatggagcccagtgcatcgtgcgcatcaatgagcccatctgccagtgcctgcccggctaccagggcgagaagtgtgagaagctggtgtctgtgaacttcatcaacaaggagagctacctgcagatccccagcgccaaggtgcggccccagaccaacatcaccctgcagatcgccacagatgaggacagcggcatcctgctgtacaagggggacaaggaccacatcgctgtggagctgtaccggggccgggtgcgggccagctatgacaccggcagccacccagccagcgccatctacagcgtggagaccatcaatgatggcaacttccacatcgtggagctgctggccctggaccagagcctgagcctgtctgtggatggcggcaaccccaagatcatcaccaacctgagcaagcagagcaccctgaactttgacagccccctgtatgtgggcggcatgcctgggaagagcaatgtggccagcctgcggcaggcccctggccagaatggcaccagcttccacggctgcatccggaacctgtacatcaacagcgagctgcaggacttccagaaggtgcccatgcagacaggcatcctgcccggctgtgagccctgccacaagaaggtgtgtgcccacggcacctgccagcccagcagccaggccggcttcacctgtgagtgccaggagggctggatgggccccctgtgtgaccagaggaccaatgacccctgcctgggcaacaagtgtgtgcacggcacctgcctgcccatcaatgccttctcctacagctgcaagtgcctggagggccatggaggagtgctgtgtgatgaggaggaggacctcttcaacccctgccaggccatcaagtgcaagcatggaaaatgtcggctgagcggcctgggccagccctactgtgaatgtagcagcggctacacaggagacagctgtgaccgggagatcagctgccgcggggagcgcatccgggactactaccagaagcagcagggctatgctgcctgccagaccaccaagaaggtgtcccggctggagtgccggggcggctgtgccggcggccagtgctgcggccccctgcggagcaagaggaggaagtacagctttgaatgtacagatggcagcagctttgtggatgaggtggagaaggtggtgaagtgtggctgcacccgctgtgtgtcctag

SEQ ID NO: 169916 - DNA, 4590 bp, Artificial Sequence
  Description of Artificial Sequence: Synthetic coding sequence
atgagaggagtgggctggcagatgctgagcctgagcctgggcctggtgctggccatcctgaacaaggtggccccccaggcctgcccagcccagtgcagctgcagcggcagcacagtggactgccacggcctggccctgcggtctgtgcccaggaacatccccaggaacacagagcggctggacctgaatggaaacaacatcacccgcatcaccaagacagactttgctggcctgcggcacctgcgggtgctgcagctgatggagaacaagatcagcaccatcgagcggggggccttccaggacctgaaggagctggagcggctgcggctgaacagaaaccacctgcagctgtttcctgagctgctcttcctgggcacagccaagctgtaccgcctggacctgtctgagaaccagatccaggccatccccaggaaggccttcagaggagctgtggacatcaagaacctgcagctggactacaaccagatcagctgcattgaagatggagccttccgggccctgcgggacctggaggtgctgaccctgaacaacaacaacatcacccggctgtctgtggccagcttcaaccacatgcccaagctgcggaccttccggctgcacagcaacaacctgtactgtgactgccacctggcctggctgagtgactggctgcggcagaggccccgggtgggcctgtacacccagtgcatgggccccagccacctgcggggccacaacgtggccgaggtgcagaagcgggagtttgtgtgcagcggccaccagagcttcatggcccccagctgcagcgtgctgcactgcccagctgcctgcacctgcagcaacaacatcgtggactgccggggcaagggcctgacagagatccccaccaacctgcctgagaccatcacagagatccggctggagcagaacaccatcaaggtgatccccccaggggccttcagcccctacaagaagctgcggagaattgacctgagcaacaaccagatcagcgagctggccccagatgccttccagggcctgcggagcctgaacagcctggtgctgtatggcaacaagatcacagagctgcccaagagcctgtttgagggcctcttcagcctgcagctgctgctgctgaatgccaacaagatcaactgcctgcgggtggatgccttccaggacctgcacaacctgaacctgctgagcctgtatgacaacaagctgcagaccatcgccaagggcaccttcagccccctgcgggccatccagaccatgcacctggcccagaaccccttcatctgtgactgccacctgaagtggctggccgactacctgcacaccaaccccatcgagaccagcggggcccgctgcaccagcccccggcggctggccaacaagagaattggccagatcaagagcaagaagttccgctgcagcgccaaggagcagtacttcatccctggaacagaggactaccgcagcaagctgagcggggactgctttgctgacctggcctgcccagagaagtgccgctgtgagggcaccaccgtggactgcagcaaccagaagctgaacaagatccctgagcacatcccccagtacacagctgagctgcggctgaacaacaatgagttcaccgtgctggaggccaccggcatcttcaagaagctgccccagctgaggaagatcaacttcagcaacaacaagatcacagacatcgaggagggcgcctttgagggcgccagcggcgtgaatgagatcctgctgaccagcaaccggctggagaatgtgcagcacaagatgttcaagggcctggagagcctgaagaccctgatgctgcggagcaaccgcatcacctgtgtgggcaatgacagcttcatcggcctgagctctgtgcggctgctgagcctgtatgacaaccagatcaccaccgtggcccctggggcctttgacaccctgcacagcctgagcaccctgaacctgctggccaaccccttcaactgcaactgctacctggcctggctgggggagtggctgaggaagaagagaattgtgacaggcaacccccgctgccagaagccctacttcctgaaggagatccccatccaggatgtggccatccaggacttcacctgtgatgatggaaatgatgacaacagctgcagccccctgagccgctgccccacagagtgcacctgcctggacacagtggtgcgctgcagcaacaagggcctgaaggtgctgcccaagggcatccccagagatgtgacagagctgtacctggatggcaaccagttcaccctggtgcccaaggagctgagcaactacaagcacctgaccctgattgacctgagcaacaaccgcatcagcaccctgagcaaccagagcttcagcaacatgacccagctgctgaccctcatcctgagctacaaccggctgcgctgcatcccccccaggacctttgatggcctgaagagcctgcggctgctgagcctgcatggaaatgacatctctgtggtgcctgagggcgccttcaatgacctgagcgccctgagccacctggccatcggggccaaccccctgtactgtgactgcaacatgcagtggctgagtgactgggtgaagtctgagtacaaggagcccggcatcgcccgctgtgccggccctggagagatggctgacaagctgctgctgaccacccccagcaagaagttcacctgccagggccctgtggatgtgaacatcctggccaagtgcaacccctgcctgagcaacccctgcaagaatgatggcacctgcaacagcgaccctgtggacttctaccgctgcacctgcccctacggcttcaagggccaggactgtgatgtgcccatccacgcctgcatcagcaacccctgcaagcacggcggcacctgccacctgaaggagggggaggaggatggcttctggtgcatctgtgctgatggctttgaaggagagaactgtgaggtgaatgtggatgactgtgaagataatgactgtgagaacaacagcacctgtgtggatggcatcaacaactacacctgcctgtgccccccagagtacacaggagagctgtgtgaggagaagctggacttctgtgcccaggacctgaacccctgccagcacgacagcaagtgcatcctgacccccaagggcttcaagtgtgactgcaccccaggctacgtgggggagcactgtgacatcgactttgatgactgccaggacaacaagtgcaagaatggagcccactgcacagatgctgtgaatggctacacctgcatctgcccagagggctacagcggcctcttctgtgagttcagcccccccatggtgctgcccaggaccagcccctgtgacaactttgactgccagaatggagcccagtgcatcgtgcgcatcaatgagcccatctgccagtgcctgcccggctaccagggcgagaagtgtgagaagctggtgtctgtgaacttcatcaacaaggagagctacctgcagatccccagcgccaaggtgcggccccagaccaacatcaccctgcagatcgccacagatgaggacagcggcatcctgctgtacaagggggacaaggaccacatcgctgtggagctgtaccggggccgggtgcgggccagctatgacaccggcagccacccagccagcgccatctacagcgtggagaccatcaatgatggcaacttccacatcgtggagctgctggccctggaccagagcctgagcctgtctgtggatggcggcaaccccaagatcatcaccaacctgagcaagcagagcaccctgaactttgacagccccctgtatgtgggcggcatgcctgggaagagcaatgtggccagcctgcggcaggcccctggccagaatggcaccagcttccacggctgcatccggaacctgtacatcaacagcgagctgcaggacttccagaaggtgcccatgcagacaggcatcctgcccggctgtgagccctgccacaagaaggtgtgtgcccacggcacctgccagcccagcagccaggccggcttcacctgtgagtgccaggagggctggatgggccccctgtgtgaccagaggaccaatgacccctgcctgggcaacaagtgtgtgcacggcacctgcctgcccatcaatgccttctcctacagctgcaagtgcctggagggccatggaggagtgctgtgtgatgaggaggaggacctcttcaacccctgccaggccatcaagtgcaagcatggaaaatgtcggctgagcggcctgggccagccctactgtgaatgtagcagcggctacacaggagacagctgtgaccgggagatcagctgccgcggggagcgcatccgggactactaccagaagcagcagggctatgctgcctgccagaccaccaagaaggtgtcccggctggagtgccggggcggctgtgccggcggccagtgctgcggccccctgcggagcaagaggaggaagtacagctttgaatgtacagatggcagcagctttgtggatgaggtggagaaggtggtgaagtgtggctgcacccgctgtgtgtcctag

SEQ ID NO: 169917 - DNA, 4419 bp, Artificial Sequence
  Description of Artificial Sequence: Synthetic coding sequence
atggcccctggctgggccggcgtgggcgctgctgtgcgggcccggctggccctggccctggccctggcctctgtgctgagcggccccccagctgtggcctgccccaccaagtgcacctgcagcgctgcctctgtggactgccacggcctgggcctgcgggctgtgccccggggcatccccagaaatgctgagcggctggacctggacaggaacaacatcacccgcatcaccaagatggactttgctggcctgaagaacctgcgggtgctgcacctggaggacaaccaggtgtctgtcatcgagcggggggccttccaggacctgaagcagctggagcggctgcggctgaacaagaacaagctgcaggtgctgcctgagctgctcttccagagcacccccaagctgacccggctggacctgtctgagaaccagatccagggcatccccaggaaggccttccggggcatcacagatgtgaagaacctgcagctggacaacaaccacatcagctgcattgaagatggagccttccgggccctgcgggacctggagatcctgaccctgaacaacaacaacatcagccgcatcctggtgaccagcttcaaccacatgcccaagatccgcaccctgcggctgcacagcaaccacctgtactgtgactgccacctggcctggctgagtgactggctgcggcagaggagaacagtgggccagttcaccctgtgcatggcccctgtgcacctgcggggcttcaacgtggctgatgtgcagaagaaggagtatgtgtgcccagccccccacagcgagccccccagctgcaatgccaacagcatcagctgccccagcccctgcacctgcagcaacaacatcgtggactgccggggcaagggcctgatggagatcccagccaacctgcctgagggcatcgtggagatccggctggagcagaacagcatcaaggccatcccagctggggccttcacccagtacaagaagctgaagagaattgacatcagcaagaaccagatcagtgacatcgccccagatgccttccagggcctgaagagcctgaccagcctggtgctgtatggcaacaagatcacagagatcgtgaagggcctgtttgatggcctggtgtccctgcagctgctgctgctgaatgccaacaagatcaactgcctgcgggtgaacaccttccaggacctgcagaacctgaacctgctgagcctgtatgacaacaagctgcagaccatcagcaagggcctgtttgcccccctgcagagcatccagaccctgcacctggcccagaacccctttgtgtgtgactgccacctgaagtggctggccgactacctgcaggacaaccccatcgagaccagcggggcccgctgcagcagcccccggcggctggccaacaagaggatcagccagatcaagagcaagaagttccgctgcagcggcagcgaggactaccgcagccgcttcagcagcgagtgcttcatggacctggtgtgcccagagaagtgccgctgtgagggcaccatcgtggactgcagcaaccagaagctggtgcgcatccccagccacctgcctgaatatgtgacagacctgcggctgaatgacaatgaggtgtctgtgctggaggccaccggcatcttcaagaagctgcccaacctgaggaagatcaacctgagcaacaacaagatcaaggaggtgcgggagggcgcctttgatggagctgcctctgtgcaggagctgatgctgactggaaaccagctggagaccgtgcacggccgggtcttccggggcctgagcggcctgaagaccctgatgctgcggagcaacctgattggctgtgtgtccaatgacacctttgctggcctgagctctgtgcggctgctgagcctgtatgacaaccgcatcaccaccatcacccctggggccttcaccaccctggtgtccctgagcaccatcaacctgctgagcaaccccttcaactgcaactgccacctggcctggctgggcaagtggctgaggaagagaagaattgtgtctggcaacccccgctgccagaagcccttcttcctgaaggagatccccatccaggatgtggccatccaggacttcacctgtgatggaaatgaggagagcagctgccagctgagcccccgctgcccagagcagtgcacctgcatggagaccgtggtgcgctgcagcaacaagggcctgcgggccctgccccggggcatgcccaaggatgtgacagagctgtacctggagggcaaccacctgacagctgtgccccgggagctgagcgccctgcggcacctgaccctgattgacctgagcaacaacagcatctccatgctgaccaactacaccttcagcaacatgagccacctgagcaccctcatcctgagctacaaccggctgcgctgcatccctgtgcacgccttcaacggcctgcggagcctgcgggtgctgaccctgcatggaaatgacatcagctctgtgcctgagggcagcttcaatgacctgaccagcctgagccacctggccctgggcaccaaccccctgcactgtgactgcagcctgcgctggctgtctgagtgggtgaaggccggctacaaggagcccggcatcgcccgctgcagcagccctgagcccatggctgaccggctgctgctgaccacccccacccaccgcttccagtgcaagggccctgtggacatcaacatcgtggccaagtgcaatgcctgcctgagcagcccctgcaagaacaacggcacctgcacccaggaccctgtggagctgtaccgctgtgcctgcccctacagctacaagggcaaggactgcaccgtgcccatcaacacctgcatccagaacccctgccagcacggcggcacctgccacctgagtgacagccacaaggatggcttcagctgcagctgccccctgggctttgagggccagagatgtgagatcaacccagatgactgtgaagataatgactgtgagaacaatgccacctgtgtggatggcatcaacaactacgtgtgcatctgcccccccaactacacaggagagctgtgtgatgaggtgattgaccactgtgtgcctgagctgaacctgtgccagcacgaggccaagtgcatccccctggacaagggcttcagctgtgaatgtgtgcccggctacagcggcaagctgtgtgaaacagacaatgatgactgtgtggcccacaagtgcagacatggagcccagtgtgtggacaccatcaatggctacacctgcacctgcccccagggcttcagcggccccttctgtgagcaccccccacccatggtgctgctgcagaccagcccctgtgaccagtatgagtgccagaatggagcccagtgcatcgtggtgcagcaggagcccacctgccgctgccccccaggctttgctggcccccgctgtgagaagctgatcaccgtgaactttgtgggcaaggacagctatgtggagctggccagcgccaaggtgcggccccaggccaacatcagcctgcaggtggccacagacaaggacaatggcatcctgctgtacaagggggacaatgaccccctggccctggagctgtaccagggccacgtgcggctggtgtatgacagcctgagcagcccccccaccaccgtgtacagcgtggagaccgtgaatgatggccagttccacagcgtggagctggtgaccctgaaccagaccctgaacctggtggtggacaagggcacccccaagagcctgggcaagctgcagaagcagcctgctgtgggcatcaacagccccctgtacctgggcggcatccccaccagcacaggcctgagcgccctgcggcagggcacagaccggcccctgggcggcttccacggctgcatccacgaggtgcgcatcaacaatgagctgcaggacttcaaggccctgcccccccagagcctgggcgtgtccccaggctgcaagagctgcaccgtgtgcaagcacggcctgtgccgctctgtggagaaggacagcgtggtgtgtgagtgcaggcctggctggacaggccccctgtgtgaccaggaggcccgggacccctgcctgggccaccgctgccaccacggcaaatgtgtggccaccggcaccagctacatgtgcaagtgtgccgagggctatggaggagacctgtgtgacaacaagaatgacagcgccaatgcctgcagcgccttcaagtgccaccacggccagtgccacatcagtgaccagggcgagccctactgcctgtgccagcccggcttctctggagagcactgccagcaggtgttccgggcccaggtgttccagagcagcctgcccggcaactgctcctggagctgctggccacccaggcctcccatgccctag

SEQ ID NO: 169918 - DNA, 4572 bp, Artificial Sequence
  Description of Artificial Sequence: Synthetic coding sequence
atggcccctggctgggccggcgtgggcgctgctgtgcgggcccggctggccctggccctggccctggcctctgtgctgagcggccccccagctgtggcctgccccaccaagtgcacctgcagcgctgcctctgtggactgccacggcctgggcctgcgggctgtgccccggggcatccccagaaatgctgagcggctggacctggacaggaacaacatcacccgcatcaccaagatggactttgctggcctgaagaacctgcgggtgctgcacctggaggacaaccaggtgtctgtcatcgagcggggggccttccaggacctgaagcagctggagcggctgcggctgaacaagaacaagctgcaggtgctgcctgagctgctcttccagagcacccccaagctgacccggctggacctgtctgagaaccagatccagggcatccccaggaaggccttccggggcatcacagatgtgaagaacctgcagctggacaacaaccacatcagctgcattgaagatggagccttccgggccctgcgggacctggagatcctgaccctgaacaacaacaacatcagccgcatcctggtgaccagcttcaaccacatgcccaagatccgcaccctgcggctgcacagcaaccacctgtactgtgactgccacctggcctggctgagtgactggctgcggcagaggagaacagtgggccagttcaccctgtgcatggcccctgtgcacctgcggggcttcaacgtggctgatgtgcagaagaaggagtatgtgtgcccagccccccacagcgagccccccagctgcaatgccaacagcatcagctgccccagcccctgcacctgcagcaacaacatcgtggactgccggggcaagggcctgatggagatcccagccaacctgcctgagggcatcgtggagatccggctggagcagaacagcatcaaggccatcccagctggggccttcacccagtacaagaagctgaagagaattgacatcagcaagaaccagatcagtgacatcgccccagatgccttccagggcctgaagagcctgaccagcctggtgctgtatggcaacaagatcacagagatcgtgaagggcctgtttgatggcctggtgtccctgcagctgctgctgctgaatgccaacaagatcaactgcctgcgggtgaacaccttccaggacctgcagaacctgaacctgctgagcctgtatgacaacaagctgcagaccatcagcaagggcctgtttgcccccctgcagagcatccagaccctgcacctggcccagaacccctttgtgtgtgactgccacctgaagtggctggccgactacctgcaggacaaccccatcgagaccagcggggcccgctgcagcagcccccggcggctggccaacaagaggatcagccagatcaagagcaagaagttccgctgcagcggcagcgaggactaccgcagccgcttcagcagcgagtgcttcatggacctggtgtgcccagagaagtgccgctgtgagggcaccatcgtggactgcagcaaccagaagctggtgcgcatccccagccacctgcctgaatatgtgacagacctgcggctgaatgacaatgaggtgtctgtgctggaggccaccggcatcttcaagaagctgcccaacctgaggaagatcaacctgagcaacaacaagatcaaggaggtgcgggagggcgcctttgatggagctgcctctgtgcaggagctgatgctgactggaaaccagctggagaccgtgcacggccgggtcttccggggcctgagcggcctgaagaccctgatgctgcggagcaacctgattggctgtgtgtccaatgacacctttgctggcctgagctctgtgcggctgctgagcctgtatgacaaccgcatcaccaccatcacccctggggccttcaccaccctggtgtccctgagcaccatcaacctgctgagcaaccccttcaactgcaactgccacctggcctggctgggcaagtggctgaggaagagaagaattgtgtctggcaacccccgctgccagaagcccttcttcctgaaggagatccccatccaggatgtggccatccaggacttcacctgtgatggaaatgaggagagcagctgccagctgagcccccgctgcccagagcagtgcacctgcatggagaccgtggtgcgctgcagcaacaagggcctgcgggccctgccccggggcatgcccaaggatgtgacagagctgtacctggagggcaaccacctgacagctgtgccccgggagctgagcgccctgcggcacctgaccctgattgacctgagcaacaacagcatctccatgctgaccaactacaccttcagcaacatgagccacctgagcaccctcatcctgagctacaaccggctgcgctgcatccctgtgcacgccttcaacggcctgcggagcctgcgggtgctgaccctgcatggaaatgacatcagctctgtgcctgagggcagcttcaatgacctgaccagcctgagccacctggccctgggcaccaaccccctgcactgtgactgcagcctgcgctggctgtctgagtgggtgaaggccggctacaaggagcccggcatcgcccgctgcagcagccctgagcccatggctgaccggctgctgctgaccacccccacccaccgcttccagtgcaagggccctgtggacatcaacatcgtggccaagtgcaatgcctgcctgagcagcccctgcaagaacaacggcacctgcacccaggaccctgtggagctgtaccgctgtgcctgcccctacagctacaagggcaaggactgcaccgtgcccatcaacacctgcatccagaacccctgccagcacggcggcacctgccacctgagtgacagccacaaggatggcttcagctgcagctgccccctgggctttgagggccagagatgtgagatcaacccagatgactgtgaagataatgactgtgagaacaatgccacctgtgtggatggcatcaacaactacgtgtgcatctgcccccccaactacacaggagagctgtgtgatgaggtgattgaccactgtgtgcctgagctgaacctgtgccagcacgaggccaagtgcatccccctggacaagggcttcagctgtgaatgtgtgcccggctacagcggcaagctgtgtgaaacagacaatgatgactgtgtggcccacaagtgcagacatggagcccagtgtgtggacaccatcaatggctacacctgcacctgcccccagggcttcagcggccccttctgtgagcaccccccacccatggtgctgctgcagaccagcccctgtgaccagtatgagtgccagaatggagcccagtgcatcgtggtgcagcaggagcccacctgccgctgccccccaggctttgctggcccccgctgtgagaagctgatcaccgtgaactttgtgggcaaggacagctatgtggagctggccagcgccaaggtgcggccccaggccaacatcagcctgcaggtggccacagacaaggacaatggcatcctgctgtacaagggggacaatgaccccctggccctggagctgtaccagggccacgtgcggctggtgtatgacagcctgagcagcccccccaccaccgtgtacagcgtggagaccgtgaatgatggccagttccacagcgtggagctggtgaccctgaaccagaccctgaacctggtggtggacaagggcacccccaagagcctgggcaagctgcagaagcagcctgctgtgggcatcaacagccccctgtacctgggcggcatccccaccagcacaggcctgagcgccctgcggcagggcacagaccggcccctgggcggcttccacggctgcatccacgaggtgcgcatcaacaatgagctgcaggacttcaaggccctgcccccccagagcctgggcgtgtccccaggctgcaagagctgcaccgtgtgcaagcacggcctgtgccgctctgtggagaaggacagcgtggtgtgtgagtgcaggcctggctggacaggccccctgtgtgaccaggaggcccgggacccctgcctgggccaccgctgccaccacggcaaatgtgtggccaccggcaccagctacatgtgcaagtgtgccgagggctatggaggagacctgtgtgacaacaagaatgacagcgccaatgcctgcagcgccttcaagtgccaccacggccagtgccacatcagtgaccagggcgagccctactgcctgtgccagcccggcttctctggagagcactgccagcaggagaacccctgcctgggccaggtggtgcgggaggtgatccggcggcagaagggctacgccagctgtgccacagccagcaaggtgcccatcatggagtgccggggcggctgcggcccccagtgctgccagcccaccaggagcaagaggaggaaatatgtgttccagtgcacagatggcagcagctttgtggaggaggtggagcggcacctggagtgtggctgcctggcctgcagctag

SEQ ID NO: 169919 - DNA, 3258 bp, Artificial Sequence
  Description of Artificial Sequence: Synthetic coding sequence
atgagcacccccagccgcttcaagaaggacaaggagatcatcgccgagtatgagagccaggtgaaggagatccgggcccagctggtggagcagcagaagtgcctggagcagcagacagagatgagggtgcagctgctgcaggacctgcaggacttcttcaggaagaaggccgagattgaaacagagtacagcaggaacctggagaagctggccgagcgcttcatggccaagaccaggagcaccaaggaccaccagcagtacaagaaggaccagaacctgctgagccctgtgaactgctggtacctgctgctgaaccaggtgcggcgggagagcaaggaccacgccaccctgagtgacatctacctgaacaacgtcatcatgaggttcatgcagatcagcgaggacagcaccaggatgttcaagaagagcaaggagatcgccttccagctgcacgaggacctgatgaaggtgctgaatgagctgtacacagtgatgaagacctaccacatgtaccacgccgagagcatctctgctgagagcaagctgaaggaggccgagaagcaggaggagaagcagatcggccgcagcggggaccctgtgttccacatccggctggaggagcggcaccagaggaggagctctgtgaagaagattgagaagatgaaggagaagaggcaggccaagtacagcgagaacaagctgaagagcatcaaggccagaaatgagtacctgctgaccctggaggccaccaatgcctctgtgttcaagtactacatccatgacctgagtgacctgattgactgctgtgacctgggctaccacgccagcctgaacagagccctgcggacctacctgtctgctgagtacaacctggagaccagcagacatgagggcctggacatcattgaaaatgctgtggacaacctggagcccaggagtgacaagcagcgcttcatggagatgtacccagctgccttctgcccccccatgaagtttgagttccagagccacatgggagatgaggtgtgccaggtgtctgcccagcagcctgtgcaggccgagctgatgctgcgctaccagcagctgcagagccggctggccaccctgaagattgaaaatgaggaggtgaagaagaccacagaggccaccctgcagaccatccaggacatggtgaccatcgaggactatgatgtgtctgagtgcttccagcacagccgcagcacagagagcgtgaagagcacagtgtctgagacctacctgagcaagcccagcatcgccaagaggcgggccaaccagcaggagacagagcagttctacttcatgaagctgcgggagtacctggagggcagcaacctgatcaccaagctgcaggccaagcatgacctgctgcagaggaccctgggggagggccacagagctgagtacatgaccacccggccccccaacgtgccccccaagccccagaagcacaggaagagccggcccaggagccagtacaacaccaagctgttcaatggagacctggagacctttgtgaaggacagcggccaggtgatccccctcatcgtggagagctgcatccgcttcatcaacctgtatggcctgcagcaccagggcatcttccgggtgtctggcagccaggtggaggtgaatgacatcaagaacagctttgaaagaggagagaaccccctggctgatgaccagagcaaccacgacatcaacagcgtggccggcgtgctgaagctgtacttccggggcctggagaaccccctcttccccaaggagcgcttcaatgacctgatcagctgcatcagaattgacaacctgtatgaaagagccctgcacatcaggaagctgctgctgaccctgcccaggtctgtgctgattgtgatgagatacctgtttgccttcctgaaccacctgagccagtacagtgatgagaacatgatggacccctacaacctggccatctgcttcggccccaccctgatgcctgtgcctgagatccaggaccaggtgtcctgccaggcccacgtgaatgagatcatcaagaccatcatcatccaccacgagaccatcttcccagatgccaaggagctggatggccctgtgtatgagaagtgcatggctggagatgactactgtgacagcccctacagcgagcacggcaccctggaggaggtggaccaggatgctggaacagagccccacaccagtgaagatgaatgtgagcccatcgaggccatcgccaagtttgattatgtgggccgcagcgcccgggagctgtccttcaagaagggggccagcctgctgctgtaccaccgggccagcgaggactggtgggagggccgccacaacggcattgatggcctggtgccccaccagtacatcgtggtgcaggacatggatgacaccttcagtgacaccctgagccagaaggctgacagcgaggccagcagcggccctgtgacagaggacaagagcagcagcaaggacatgaacagccccacagacagacacccagatggctacctggcccggcagaggaagagaggagagcccccacctcctgtgagaagacctggccgcaccagtgatggccactgccccctgcacccccctcatgccctgagcaacagctctgtggacctgggcagccccagcctggccagccacccccggggcctgctgcagaacagaggcctgaacaatgacagccctgagaggagaagaagacctggccacggcagcctgaccaacatcagcagacatgacagcctgaagaagattgacagcccccccatccgccgcagcaccagcagcggccagtacacaggcttcaatgaccacaagcccctggaccctgagaccatcgcccaggacatcgaggagaccatgaacacagccctgaatgagctgcgggagctggagcggcagagcacagccaagcacgccccagatgtggtgctggacaccctggagcaggtgaagaacagccccaccccagccaccagcacagagagcctgagccccctgcacaacgtggccctgcggagcagcgagccccagatcagaagaagcaccagcagcagcagtgacaccatgagcaccttcaagcccatggtggcccccaggatgggcgtgcagctgaagcccccagccctgcggcccaagccagctgtgctgcccaagaccaaccccaccatcggccctgcccccccaccccagggccccacagacaagagctgcaccatgtag

SEQ ID NO: 169920 - DNA, 3189 bp, Artificial Sequence
  Description of Artificial Sequence: Synthetic coding sequence
atgagcacccccagccgcttcaagaaggacaaggagatcatcgccgagtatgagagccaggtgaaggagatccgggcccagctggtggagcagcagaagtgcctggagcagcagacagagatgagggtgcagctgctgcaggacctgcaggacttcttcaggaagaaggccgagattgaaacagagtacagcaggaacctggagaagctggccgagcgcttcatggccaagaccaggagcaccaaggaccaccagcagtacaagaaggaccagaacctgctgagccctgtgaactgctggtacctgctgctgaaccaggtgcggcgggagagcaaggaccacgccaccctgagtgacatctacctgaacaacgtcatcatgaggttcatgcagatcagcgaggacagcaccaggatgttcaagaagagcaaggagatcgccttccagctgcacgaggacctgatgaaggtgctgaatgagctgtacacagtgatgaagacctaccacatgtaccacgccgagagcatctctgctgagagcaagctgaaggaggccgagaagcaggaggagaagcagatcggccgcagcggggaccctgtgttccacatccggctggaggagcggcaccagaggaggagctctgtgaagaagattgagaagatgaaggagaagaggcaggccaagtacagcgagaacaagctgaagagcatcaaggccagaaatgagtacctgctgaccctggaggccaccaatgcctctgtgttcaagtactacatccatgacctgagtgacctgattgactgctgtgacctgggctaccacgccagcctgaacagagccctgcggacctacctgtctgctgagtacaacctggagaccagcagacatgagggcctggacatcattgaaaatgctgtggacaacctggagcccaggagtgacaagcagcgcttcatggagatgtacccagctgccttctgcccccccatgaagtttgagttccagagccacatgggagatgaggtgtgccaggtgtctgcccagcagcctgtgcaggccgagctgatgctgcgctaccagcagctgcagagccggctggccaccctgaagattgaaaatgaggaggtgaagaagaccacagaggccaccctgcagaccatccaggacatggtgaccatcgaggactatgatgtgtctgagtgcttccagcacagccgcagcacagagagcgtgaagagcacagtgtctgagacctacctgagcaagcccagcatcgccaagaggcgggccaaccagcaggagacagagcagttctacttcatgaagctgcgggagtacctggagggcagcaacctgatcaccaagctgcaggccaagcatgacctgctgcagaggaccctgggggagggccacagagctgagtacatgaccaccagccggggcagaagaaacagccacaccaggcaccaggacagcggccaggtgatccccctgattgtggagagctgcatccgcttcatcaacctgtatggcctgcagcaccagggcatcttccgggtgtctggcagccaggtggaggtgaatgacatcaagaacagctttgagcggggggagaaccccctggctgatgaccagagcaaccacgacatcaacagcgtggccggcgtgctgaagctgtacttccggggcctggagaaccccctcttccccaaggagcgcttcaatgacctgatcagctgcatcagaattgacaacctgtatgagcgggccctgcacatcaggaagctgctgctgaccctgcccaggtctgtgctgattgtgatgagatacctgtttgccttcctgaaccacctgagccagtacagtgatgagaacatgatggacccctacaacctggccatctgcttcggccccaccctgatgcctgtgcctgagatccaggaccaggtgtcctgccaggcccacgtgaatgagatcatcaagaccatcatcatccaccacgagaccatcttcccagatgccaaggagctggatggccctgtgtatgagaagtgcatggctggagatgactactgtgacagcccctacagcgagcacggcaccctggaggaggtggaccaggatgctggaacagagccccacaccagtgaagatgaatgtgagcccatcgaggccatcgccaagtttgattatgtgggccgcagcgcccgggagctgtccttcaagaagggggccagcctgctgctgtaccaccgggccagcgaggactggtgggagggccgccacaatggaattgatggcctggtgccccaccagtacatcgtggtgcaggacatggatgacaccttcagtgacaccctgagccagaaggctgacagcgaggccagcagcggccctgtgacagaggacaagagcagcagcaaggacatgaacagccccacagacagacacccagatggctacctggcccggcagaggaagagaggagagcccccacctcctgtgcggcggcccggccgcaccagtgatggccactgccccctgcaccccccccacgccctgagcaacagctctgtggacctgggcagccccagcctggccagccacccccggggcctgctgcagaacagaggcctgaacaatgacagccctgagaggagaagaagacctggccacggcagcctgaccaacatcagcagacatgacagcctgaagaagattgacagcccccccatcagaagaagcaccagcagcggccagtacacaggcttcaatgaccacaagcccctggaccctgagaccatcgcccaggacatcgaggagaccatgaacacagccctgaatgagctgcgggagctggagcggcagagcacagccaagcacgccccagatgtggtgctggacaccctggagcaggtgaagaacagccccaccccagccaccagcacagagagcctgagccccctgcacaacgtggccctgcggagcagcgagccccagatccgccgcagcaccagcagcagcagtgacaccatgagcaccttcaagcccatggtggcccccaggatgggcgtgcagctgaagcccccagccctgcggcccaagccagctgtgctgcccaagaccaaccccaccatcggccctgcccccccaccccagggccccacagacaagagctgcaccatgtag

SEQ ID NO: 169921 - DNA, 2958 bp, Artificial Sequence
  Description of Artificial Sequence: Synthetic coding sequence
tgaaaagaccagaatgtgctgagccctgtgaactgctggaacctgctgctgaaccaggtgaagcgggagagccgggaccacaccaccctgagtgacatctacctgaacaacatcatccccaggtttgtgcaggtgtctgaagattctggccgcctcttcaagaagagcaaggaggtgggccagcagctgcaggatgacctgatgaaggtgctgaatgagctgtacagcgtgatgaagacctaccacatgtacaatgctgacagcatcagcgcccagagcaagctgaaggaggccgagaagcaggaggagaagcagatcggcaagtctgtgaagcaggaggaccggcagacccccaggagcccagacagcacagccaacgtgagaattgaggagaagcacgtgagaagaagctctgtgaagaagattgagaagatgaaggagaagaggcaggccaagtacacagagaacaagctgaaggccatcaaggccagaaatgagtacctgctggccctggaggccaccaatgcctctgtgttcaagtactacatccatgacctgagtgacctgattgaccagtgctgtgacctgggctaccacgccagcctgaacagagccctgcggaccttcctgtctgctgagctgaacctggagcagagcaagcatgagggcctggatgccattgaaaatgctgtggagaacctggatgccaccagtgacaagcagaggctgatggagatgtacaacaacgtgttctgcccccccatgaagtttgagttccagccccacatgggagacatggccagccagctgtgtgcccagcagcctgtgcagagcgagctggtgcagcgctgccagcagctgcagagccggctgagcaccctgaagattgaaaatgaggaggtgaagaagaccatggaggccaccctgcagaccatccaggacatcgtgacagtggaggactttgatgtgtctgactgcttccagtacagcaacagcatggagagcgtgaagagcacagtgtctgagaccttcatgagcaagcccagcatcgccaagagaagagccaaccagcaggagacagagcagttctacttcaccaagatgaaggagtacctggagggcaggaacctgatcaccaagctgcaggccaagcatgacctgctgcagaagaccctgggggagagccagaggacagactgcagcctggcccggcgcagcagcacagtgaggaagcaggacagcagccaggccatccccctggtggtggagagctgcatccgcttcatcagccgccacggcctgcagcacgagggcatcttccgggtgtctggcagccaggtggaggtgaatgacatcaagaatgcctttgagcggggggaggaccccctggccggggaccagaatgaccatgacatggacagcattgctggggtgctgaagctgtacttccggggcctggagcaccccctcttccccaaggacatcttccatgacctgatggcctgtgtgaccatggacaacctgcaggagcgggccctgcacatcaggaaggtgctgctggtgctgcccaagaccaccctcatcatcatgagatacctgtttgccttcctgaaccacctgagccagttcagcgaggagaacatgatggacccctacaacctggccatctgcttcggccccagcctgatgtctgtgcctgagggccatgaccaggtgtcctgccaggcccacgtgaatgaactcatcaagaccatcatcatccagcacgagaacatcttccccagcccccgggagctggagggccctgtgtacagcagaggaggctccatggaggactactgtgacagcccccacggggagaccacctctgtggaggacagcacccaggatgtgacagctgagcaccacaccagtgatgatgaatgtgagcccatcgaggccatcgccaagtttgattatgtgggccgcacagcccgggagctgtccttcaagaagggggccagcctgctgctgtaccagagggccagtgatgactggtgggagggccgccacaatggaattgatggcctcatcccccaccagtacatcgtggtgcaggacacagaagatggagtggtggagaggagcagccccaagtcagaaattgaagtcatcagcgagcccccagaggagaaggtgacagcccgggccggggccagctgccccagcggcggccacgtggccgacatctacctggccaacatcaacaagcagaggaagaggcctgagagcggcagcatcaggaagaccttcagaagtgacagccacggcctgagcagcagcctgacagacagcagcagccctggggtgggcgccagctgccggcccagcagccagcccatcatgagccagagcctgcccaaggagggccctgacaagtgcagcatcagcggccacggcagcctgaacagcatcagccgccacagcagcctgaagaaccggctggacagcccccagatcaggaagacagccacagctggccgcagcaagagcttcaacaaccaccggcccatggaccctgaggtgattgcccaggacatcgaggccaccatgaacagcgccctgaatgagctgcgggagctggagcggcagagctctgtgaagcacaccccagatgtggtgctggacaccctggagcccctgaagaccagccctgtggtggcccccaccagcgagcccagcagccccctgcacacccagctgctgaaggaccctgagcccgccttccagaggtctgccagcacagctggggacatcgcctgtgccttccggcctgtgaagtctgtgaagatggccgcccctgtgaagcccccagccacccggcccaagcccaccgtcttccccaagaccaatgccaccagccctggggtgaacagcagcaccagcccccagagcacagacaagagctgcaccgtgtag

SEQ ID NO: 169922 - DNA, 2796 bp, Artificial Sequence
  Description of Artificial Sequence: Synthetic coding sequence
cagagcaaggaggtgggccagcagctgcaggatgacctgatgaaggtgctgaatgagctgtacagcgtgatgaagacctaccacatgtacaatgctgacagcatcagcgcccagagcaagctgaaggaggccgagaagcaggaggagaagcagatcggcaagtctgtgaagcaggaggaccggcagacccccaggagcccagacagcacagccaacgtgagaattgaggagaagcacgtgagaagaagctctgtgaagaagattgagaagatgaaggagaagaggcaggccaagtacacagagaacaagctgaaggccatcaaggccagaaatgagtacctgctggccctggaggccaccaatgcctctgtgttcaagtactacatccatgacctgagtgacctgattgaccagtgctgtgacctgggctaccacgccagcctgaacagagccctgcggaccttcctgtctgctgagctgaacctggagcagagcaagcatgagggcctggatgccattgaaaatgctgtggagaacctggatgccaccagtgacaagcagaggctgatggagatgtacaacaacgtgttctgcccccccatgaagtttgagttccagccccacatgggagacatggccagccagctgtgtgcccagcagcctgtgcagagcgagctggtgcagcgctgccagcagctgcagagccggctgagcaccctgaagattgaaaatgaggaggtgaagaagaccatggaggccaccctgcagaccatccaggacatcgtgacagtggaggactttgatgtgtctgactgcttccagtacagcaacagcatggagagcgtgaagagcacagtgtctgagaccttcatgagcaagcccagcatcgccaagagaagagccaaccagcaggagacagagcagttctacttcaccaagatgaaggagtacctggagggcaggaacctgatcaccaagctgcaggccaagcatgacctgctgcagaagaccctgggggagagccagaggacagactgcagcctggcccggcgcagcagcacagtgaggaagcaggacagcagccaggccatccccctggtggtggagagctgcatccgcttcatcagccgccacggcctgcagcacgagggcatcttccgggtgtctggcagccaggtggaggtgaatgacatcaagaatgcctttgagcggggggaggaccccctggccggggaccagaatgaccatgacatggacagcattgctggggtgctgaagctgtacttccggggcctggagcaccccctcttccccaaggacatcttccatgacctgatggcctgtgtgaccatggacaacctgcaggagcgggccctgcacatcaggaaggtgctgctggtgctgcccaagaccaccctcatcatcatgagatacctgtttgccttcctgaaccacctgagccagttcagcgaggagaacatgatggacccctacaacctggccatctgcttcggccccagcctgatgtctgtgcctgagggccatgaccaggtgtcctgccaggcccacgtgaatgaactcatcaagaccatcatcatccagcacgagaacatcttccccagcccccgggagctggagggccctgtgtacagcagaggaggctccatggaggactactgtgacagcccccacggggagaccacctctgtggaggacagcacccaggatgtgacagctgagcaccacaccagtgatgatgaatgtgagcccatcgaggccatcgccaagtttgattatgtgggccgcacagcccgggagctgtccttcaagaagggggccagcctgctgctgtaccagagggccagtgatgactggtgggagggccgccacaatggaattgatggcctcatcccccaccagtacatcgtggtgcaggacacagaagatggagtggtggagaggagcagccccaagtcagaaattgaagtcatcagcgagcccccagaggagaaggtgacagcccgggccggggccagctgccccagcggcggccacgtggccgacatctacctggccaacatcaacaagcagaggaagaggcctgagagcggcagcatcaggaagaccttcagaagtgacagccacggcctgagcagcagcctgacagacagcagcagccctggggtgggcgccagctgccggcccagcagccagcccatcatgagccagagcctgcccaaggagggccctgacaagtgcagcatcagcggccacggcagcctgaacagcatcagccgccacagcagcctgaagaaccggctggacagcccccagatcaggaagacagccacagctggccgcagcaagagcttcaacaaccaccggcccatggaccctgaggtgattgcccaggacatcgaggccaccatgaacagcgccctgaatgagctgcgggagctggagcggcagagctctgtgaagcacaccccagatgtggtgctggacaccctggagcccctgaagaccagccctgtggtggcccccaccagcgagcccagcagccccctgcacacccagctgctgaaggaccctgagcccgccttccagaggtctgccagcacagctggggacatcgcctgtgccttccggcctgtgaagtctgtgaagatggccgcccctgtgaagcccccagccacccggcccaagcccaccgtcttccccaagaccaatgccaccagccctggggtgaacagcagcaccagcccccagagcacagacaagagctgcaccgtgtag

SEQ ID NO: 169923 - DNA, 2112 bp, Artificial Sequence
  Description of Artificial Sequence: Synthetic coding sequence
aggaaggaccagaatgtgctgagccctgtgaactgctggaacctgctgctgaaccaggtgaagcgggagagccgggaccacaccaccctgagtgacatctacctgaacaacatcatccccaggtttgtgcaggtgtctgaagattctggccgcctcttcaagaagagcaaggaggtgggccagcagctgcaggatgacctgatgaaggtgctgaatgagctgtacagcgtgatgaagacctaccacatgtacaatgctgacagcatcagcgcccagagcaagctgaaggaggccgagaagcaggaggagaagcagatcggcaagtctgtgaagcaggaggaccggcagacccccaggagcccagacagcacagccaacgtgagaattgaggagaagcacgtgagaagaagctctgtgaagaagattgagaagatgaaggagaagaggcaggccaagtacacagagaacaagctgaaggccatcaaggccagaaatgagtacctgctggccctggaggccaccaatgcctctgtgttcaagtactacatccatgacctgagtgacctgattgactgctgtgacctgggctaccacgccagcctgaacagagccctgcggaccttcctgtctgctgagctgaacctggagcagagcaagcatgagggcctggatgccattgaaaatgctgtggagaacctggatgccaccagtgacaagcagaggctgatggagatgtacaacaacgtgttctgcccccccatgaagtttgagttccagccccacatgggagacatggccagccagctgtgtgcccagcagcctgtgcagagcgagctggtgcagcgctgccagcagctgcagagccggctgagcaccctgaagattgaaaatgaggaggtgaagaagaccatggaggccaccctgcagaccatccaggacatcgtgacagtggaggactttgatgtgtctgactgcttccagtacagcaacagcatggagagcgtgaagagcacagtgtctgagaccttcatgagcaagcccagcatcgccaagaggcgggccaaccagcaggagacagagcagttctacttcaccaagatgaaggagtacctggagggcaggaacctgatcaccaagctgcaggccaagcatgacctgctgcagaagaccctgggggagagccagaggacagactgcagcctggcccggcgcagcagcacagtgaggaagcaggacagcagccaggccatccccctggtggtggagagctgcatccgcttcatcagcagacatggcctgcagcacgagggcatcttccgggtgtctggcagccaggtggaggtgaatgacatcaagaatgcctttgaaagaggagaggaccccctggccggggaccagaatgaccatgacatggacagcattgctggggtgctgaagctgtacttccggggcctggagcaccccctcttccccaaggacatcttccatgacctgatggcctgtgtgaccatggacaacctgcaggagcgggccctgcacatcaggaaggtgctgctggtgctgcccaagaccaccctcatcatcatgagatacctgtttgccttcctgaaccacctgagccagttcagcgaggagaacatgatggacccctacaacctggccatctgcttcggccccagcctgatgtctgtgcctgagggccatgaccaggtgtcctgccaggcccacgtgaatgagctgatcaagaccatcatcatccagcacgagaacatcttccccagcccccgggagctggagggccctgtgtacagccggggcggctccatggaggactactgtgacagcccccatggagagaccacctctgtggaggacagcacccaggatgtgacagctgagcaccacaccagtgatgatgaatgtgagcccatcgaggccatcgccaagtttgattatgtgggccgcacagcccgggagctgtccttcaagaagggggccagcctgctgctgtaccagagggccagtgatgactggtgggagggccgccacaacggcattgatggcctcatcccccaccagtacatcgtggtgcaggacaccctcatctcctag

SEQ ID NO: 169924 - DNA, 759 bp, Artificial Sequence
  Description of Artificial Sequence: Synthetic coding sequence
atggaggactactgtgacagcccccatggagagaccacctctgtggaggacagcacccaggatgtgacagctgagcaccacaccagtgatgatgaatgtgagcccatcgaggccatcgccaagtttgattatgtgggccgcacagcccgggagctgtccttcaagaagggggccagcctgctgctgtaccagagggccagtgatgactggtgggagggccgccacaacggcattgatggcctcatcccccaccagtacatcgtggtgcaggacacagaagatggagtggtggagaggagcagccccaagtcagaaattgaggtgatcagcgagcccccagaggagaaggtgacagcccgggccggggccagctgccccagcggcggccacgtggccgacatctacctggccaacatcaacaacaacctgcacctggacaacaccaagcctgtgaccaccaagcagaggaagaggcctgagagcggcagcatcaggaagaccttcagaagtgacagccacggcctgagcagcagcctgacagacagcagcagccctggggtgggcgccagctgccggcccagcagccagcccatcatgagccagagcctgcccaaggagggccctgacaagtgcagcatcagcggccacggcagcctgaacagcatcagccgccacagcagcctgaagaaccggctggacagcccccagatcaggaagacagccacagctggccgcagcaagagcttcaacaaccactag

SEQ ID NO: 169925 - DNA, 693 bp, Artificial Sequence
  Description of Artificial Sequence: Synthetic coding sequence
tgagctgagcaccacaccagtgatgatgaatgtgagcccatcgaggccatcgccaagtttgattatgtgggccgcacagcccgggagctgtccttcaagaagggggccagcctgctgctgtaccagagggccagtgatgactggtgggagggccgccacaacggcattgatggcctcatcccccaccagtacatcgtggtgcaggacacagaagatggagtggtggagaggagcagccccaagtcagaaattgaggtgatcagcgagcccccagaggagaaggtgacagcccgggccggggccagctgccccagcggcggccacgtggccgacatctacctggccaacatcaacaacaacctgcacctggacaacaccaagcctgtgaccaccaagcagaggaagaggcctgagagcggcagcatcaggaagaccttcagaagtgacagccacggcctgagcagcagcctgacagacagcagcagccctggggtgggcgccagctgccggcccagcagccagcccatcatgagccagagcctgcccaaggagggccctgacaagtgcagcatcagcggccacggcagcctgaacagcatcagccgccacagcagcctgaagaaccggctggacagcccccagatcaggaagacagccacagctggccgcagcaagagcttcaacaaccactag

SEQ ID NO: 169926 - DNA, 1353 bp, Artificial Sequence
  Description of Artificial Sequence: Synthetic coding sequence
gtgaagaagaccatggaggccaccctgcagaccatccaggacatcgtgacagtggaggactttgatgtgtctgactgcttccagtacagcaacagcatggagagcgtgaagagcacagtgtctgagaccttcatgagcaagcccagcatcgccaagagaagagccaaccagcaggagacagagcagttctacttcaccaagatgaaggagtacctggagggcaggaacctgatcaccaagctgcaggccaagcatgacctgctgcagaagaccctgggggagagccagaggacagactgcagcctggcccggcgcagcagcacagtgaggaagcaggacagcagccaggccatccccctggtggtggagagctgcatccgcttcatcagccgccacggcctgcagcacgagggcatcttccgggtgtctggcagccaggtggaggtgaatgacatcaagaatgcctttgagcggggggaggaccccctggccggggaccagaatgaccatgacatggacagcattgctggggtgctgaagctgtacttccggggcctggagcaccccctcttccccaaggacatcttccatgacctgatggcctgtgtgaccatggacaacctgcaggagcgggccctgcacatcaggaaggtgctgctggtgctgcccaagaccaccctcatcatcatgagatacctgtttgccttcctgaaccacctgagccagttcagcgaggagaacatgatggacccctacaacctggccatctgcttcggccccagcctgatgtctgtgcctgagggccatgaccaggtgtcctgccaggcccacgtgaatgaactcatcaagaccatcatcatccagcacgagaacatcttccccagcccccgggagctggagggccctgtgtacagcagaggaggctccatggaggactactgtgacagcccccacggggagaccacctctgtggaggacagcacccaggatgtgacagctgagcaccacaccagtgatgatgaatgtgagcccatcgaggccatcgccaagtttgattatgtgggccgcacagcccgggagctgtccttcaagaagggggccagcctgctgctgtaccagagggccagtgatgactggtgggagggccgccacaatggaattgatggcctcatcccccaccagtacatcgtggtgcaggacacagaagatggagtggtggagaggagcagccccaagtcagaaattgaagtcatcagcgagcccccagaggagaaggtgacagcccgggccggggccagctgccccagcggcggccacgtggccgacatctacctggccaacatcaacaagtag

SEQ ID NO: 169927 - DNA, 3228 bp, Artificial Sequence
  Description of Artificial Sequence: Synthetic coding sequence
atgagcagccagaccaagttcaagaaggacaaggagatcatcgccgagtatgaggcccagatcaaggagatccgcacccagctggtggagcagttcaagtgcctggagcagcagagcgagagccggctgcagctgctgcaggacctgcaggagttcttccggaggaaggccgagattgagctggagtacagccgcagcctggagaagctggccgagcgcttcagcagcaagatccgcagcagccgggagcaccagttcaagaaggaccagtacctgctgagccctgtgaactgctggtacctggtgctgcaccagacccggcgggagagccgggaccacgccaccctgaatgacatcttcatgaacaacgtgattgtgcggctgagccagatcagtgaagatgtgatccgcctcttcaagaagagcaaggagatcggcctgcagatgcatgaggagctgctgaaggtgaccaatgagctgtacacagtgatgaagacctaccacatgtaccacgccgagagcatctctgctgagagcaagctgaaggaggccgagaagcaggaggagaagcagttcaacaagagcggggacctgtccatgaacctgctgcggcatgaggaccggccccagaggaggagctctgtgaagaagattgagaagatgaaggagaagaggcaggccaagtacagcgagaacaagctgaagtgcaccaaggccagaaatgactacctgctgaacctggccgccaccaatgctgccatcagcaagtactacatccatgatgtgtctgacctgattgactgctgtgacctgggcttccacgccagcctggcccggaccttccgcacctacctgtctgctgagtacaacctggagaccagcagacatgagggcctggatgtgattgaaaatgctgtggacaacctggacagcagaagtgacaagcacacagtgatggacatgtgcaaccaggtgttctgcccccccctgaagtttgagttccagccccacatgggagatgaggtgtgccaggtgtctgcccagcagcctgtgcagacagagctgctgatgagataccaccagctgcagagccggctggccaccctgaagattgaaaatgaggaggtgaggaagaccctggatgccaccatgcagaccctgcaggacatgctgactgtggaggactttgatgtgtctgatgccttccagcacagccgcagcacagagagcgtgaagtctgctgccagcgagacctacatgagcaagatcaacatcgccaagaggcgggccaaccagcaggagacagagatgttctacttcaccaagttcaaggagtatgtgaatggcagcaacctgatcaccaagctgcaggccaagcatgacctgctgaagcagaccctgggggagggggagcgggcagaatgtggcaccacccggggcagaagaaatgcccggaccaggaaccaggacagcggccaggccatccccctggtggtggagagctgcatccgctacatcaacctgtatggcctgcagcagcagggcatcttccgggtgcccggcagccaggtggaggtgaatgacatcaagaacagctttgaaagaggagaggaccccctggtggatgaccagaatgaaagagacatcaacagcgtggccggcgtgctgaagctgtacttccggggcctggagaaccccctcttccccaaggagcgcttccaggacctgatcagcaccatcaagctggagaacccagctgagcgggtgcaccagatccagcagatcctggtgaccctgccccgggtggtgattgtggtgatgagatacctgtttgccttcctgaaccacctgagccagtacagtgatgagaacatgatggacccctacaacctggccatctgcttcggccccaccctgatgcacatcccagatggccaggaccctgtgtcctgccaggcccacatcaatgaggtgatcaagaccatcatcatccaccacgaggccatcttccccagcccccgggagctggagggccctgtgtatgagaagtgcatggccggcggggaggagtactgtgacagcccccacagcgagcccggggccattgatgaggtggaccatgacaatggaacagagccccacaccagtgatgaggaggtggagcagatcgaggccatcgccaagtttgactacatgggccgcagcccccgggagctgtccttcaagaagggggccagcctgctgctgtaccaccgggccagcgaggactggtgggagggccgccacaatggagtggatggcctcatcccccaccagtacatcgtggtgcaggacatggatgatgccttcagtgacagcctgagccagaaggctgacagcgaggccagcagcggccccctgctggatgacaaggccagcagcaagaatgacctgcagagccccacagagcacatcagtgactatggctttggaggagtgatgggccgggtgcggctgcggagtgatggagctgccatcccccggcggcgcagcggcggggacacccacagccccccccggggcctgggccccagcattgacaccccacccagggctgctgcctgccccagcagcccccacaagatccccctgacccggggccgcatcgagagccctgagaagaggaggatggccacctttggatctgctggcagcatcaactacccagacaagaaggccctgtctgagggccacagcatgaggagcacctgtggcagcaccaggcacagcagcctgggggaccacaagagcctggaggccgaggccctggccgaggacatcgagaagaccatgagcacagccctgcacgagctgcgggagctggagcggcagaacacagtgaagcaggccccagatgtggtgctggacaccctggagcccctgaagaaccccccaggccctgtgtcctctgagcccgccagccccctgcacaccatcgtcatccgggaccctgatgctgccatgaggaggagcagcagcagcagcacagagatgatgaccaccttcaagccagccctgagcgcccggctggccggggcccagctgcggcccccacccatgaggcctgtgcggcctgtggtgcagcacaggagcagcagcagcagcagcagcggcgtgggcagccctgctgtgacccccacagagaagatgttccccaacagcagcgctgacaagagcggcaccatgtag

SEQ ID NO: 169928 - DNA, 3300 bp, Artificial Sequence
  Description of Artificial Sequence: Synthetic coding sequence
atgagcagccagaccaagttcaagaaggacaaggagatcatcgccgagtatgaggcccagatcaaggagatccgcacccagctggtggagcagttcaagtgcctggagcagcagagcgagagccggctgcagctgctgcaggacctgcaggagttcttccggaggaaggccgagattgagctggagtacagccgcagcctggagaagctggccgagcgcttcagcagcaagatccgcagcagccgggagcaccagttcaagaaggaccagtacctgctgagccctgtgaactgctggtacctggtgctgcaccagacccggcgggagagccgggaccacgccaccctgaatgacatcttcatgaacaacgtgattgtgcggctgagccagatcagtgaagatgtgatccgcctcttcaagaagagcaaggagatcggcctgcagatgcatgaggagctgctgaaggtgaccaatgagctgtacacagtgatgaagacctaccacatgtaccacgccgagagcatctctgctgagagcaagctgaaggaggccgagaagcaggaggagaagcagttcaacaagagcggggacctgtccatgaacctgctgcggcatgaggaccggccccagaggaggagctctgtgaagaagattgagaagatgaaggagaagaggcaggccaagtacagcgagaacaagctgaagtgcaccaaggccagaaatgactacctgctgaacctggccgccaccaatgctgccatcagcaagtactacatccatgatgtgtctgacctgattgactgctgtgacctgggcttccacgccagcctggcccggaccttccgcacctacctgtctgctgagtacaacctggagaccagcagacatgagggcctggatgtgattgaaaatgctgtggacaacctggacagcagaagtgacaagcacacagtgatggacatgtgcaaccaggtgttctgcccccccctgaagtttgagttccagccccacatgggagatgaggtgtgccaggtgtctgcccagcagcctgtgcagacagagctgctgatgagataccaccagctgcagagccggctggccaccctgaagattgaaaatgaggaggtgaggaagaccctggatgccaccatgcagaccctgcaggacatgctgactgtggaggactttgatgtgtctgatgccttccagcacagccgcagcacagagagcgtgaagtctgctgccagcgagacctacatgagcaagatcaacatcgccaagaggcgggccaaccagcaggagacagagatgttctacttcaccaagttcaaggagtatgtgaatggcagcaacctgatcaccaagctgcaggccaagcatgacctgctgaagcagaccctgggggagggggagcgggcagaatgtggcaccacccggcccccctgcctgccccccaagccccagaagatgagaagaccccggcccctgtctgtgtacagccacaagctgttcaacggctccatggaggccttcatcaaggacagcggccaggccatccccctggtggtggagagctgcatccgctacatcaacctgtatggcctgcagcagcagggcatcttccgggtgcccggcagccaggtggaggtgaatgacatcaagaacagctttgaaagaggagaggaccccctggtggatgaccagaatgaaagagacatcaacagcgtggccggcgtgctgaagctgtacttccggggcctggagaaccccctcttccccaaggagcgcttccaggacctgatcagcaccatcaagctggagaacccagctgagcgggtgcaccagatccagcagatcctggtgaccctgccccgggtggtgattgtggtgatgagatacctgtttgccttcctgaaccacctgagccagtacagtgatgagaacatgatggacccctacaacctggccatctgcttcggccccaccctgatgcacatcccagatggccaggaccctgtgtcctgccaggcccacatcaatgaggtgatcaagaccatcatcatccaccacgaggccatcttccccagcccccgggagctggagggccctgtgtatgagaagtgcatggccggcggggaggagtactgtgacagcccccacagcgagcccggggccattgatgaggtggaccatgacaatggaacagagccccacaccagtgatgaggaggtggagcagatcgaggccatcgccaagtttgactacatgggccgcagcccccgggagctgtccttcaagaagggggccagcctgctgctgtaccaccgggccagcgaggactggtgggagggccgccacaatggagtggatggcctcatcccccaccagtacatcgtggtgcaggacatggatgatgccttcagtgacagcctgagccagaaggctgacagcgaggccagcagcggccccctgctggatgacaaggccagcagcaagaatgacctgcagagccccacagagcacatcagtgactatggctttggaggagtgatgggccgggtgcggctgcggagtgatggagctgccatcccccggcggcgcagcggcggggacacccacagccccccccggggcctgggccccagcattgacaccccacccagggctgctgcctgccccagcagcccccacaagatccccctgacccggggccgcatcgagagccctgagaagaggaggatggccacctttggatctgctggcagcatcaactacccagacaagaaggccctgtctgagggccacagcatgaggagcacctgtggcagcaccaggcacagcagcctgggggaccacaagagcctggaggccgaggccctggccgaggacatcgagaagaccatgagcacagccctgcacgagctgcgggagctggagcggcagaacacagtgaagcaggccccagatgtggtgctggacaccctggagcccctgaagaaccccccaggccctgtgtcctctgagcccgccagccccctgcacaccatcgtcatccgggaccctgatgctgccatgaggaggagcagcagcagcagcacagagatgatgaccaccttcaagccagccctgagcgcccggctggccggggcccagctgcggcccccacccatgaggcctgtgcggcctgtggtgcagcacaggagcagcagcagcagcagcagcggcgtgggcagccctgctgtgacccccacagagaagatgttccccaacagcagcgctgacaagagcggcaccatgtag

SEQ ID NO: 169929 - DNA, 1008 bp, Artificial Sequence
  Description of Artificial Sequence: Synthetic coding sequence
atgaacaacgtgattgtgcggctgagccagatcagtgaagatgtgatccgcctcttcaagaagagcaaggagatcggcctgcagatgcatgaggagctgctgaaggtgaccaatgagctgtacacagtgatgaagacctaccacatgtaccacgccgagagcatctctgctgagagcaagctgaaggaggccgagaagcaggaggagaagcagttcaacaagagcggggacctgtccatgaacctgctgcggcatgaggaccggccccagaggaggagctctgtgaagaagattgagaagatgaaggagaagaggcaggccaagtacagcgagaacaagctgaagtgcaccaaggccagaaatgactacctgctgaacctggccgccaccaatgctgccatcagcaagtactacatccatgatgtgtctgacctgattgactgctgtgacctgggcttccacgccagcctggcccggaccttccgcacctacctgtctgctgagtacaacctggagaccagcagacatgagggcctggatgtgattgaaaatgctgtggacaacctggacagcagaagtgacaagcacacagtgatggacatgtgcaaccaggtgttctgcccccccctgaagtttgagttccagccccacatgggagatgaggtgtgccaggtgtctgcccagcagcctgtgcagacagagctgctgatgagataccaccagctgcagagccggctggccaccctgaagattgaaaatgaggaggtgaggaagaccctggatgccaccatgcagaccctgcaggacatgctgactgtggaggactttgatgtgtctgatgccttccagcacagccgcagcacagagagcgtgaagtctgctgccagcgagacctacatgagcaagatcaacatcgccaagaggcgggccaaccagcaggagacagagatgttctacttcaccaagggcccagatgatgtgttccccatctgccacccccggctgtag

SEQ ID NO: 169930 - DNA, 360 bp, Artificial Sequence
  Description of Artificial Sequence: Synthetic coding sequence
atgtcctggtggaggaacaacttctggatcatcctggccgtggccatcatcgtggtgtctgtgggcctgggcctcatcctgtactgtgtgtgcaagtggcagctgcggcggggcaagaagtgggagatcgccaagcccctgaagcacaagcaggtggatgaggagaagatgtatgacttcctgctgctgaggacagcctgcagcctgccccccctgcccctgcactaccgcacctccatgacagagacctacggcgtgctgctgtgcaggcctggctggagcgccctggcccggagccggctgacagctgccagcgcctcctgggtgcaggccatcctgctgccccagccccccaagtag

SEQ ID NO: 169931 - DNA, 438 bp, Artificial Sequence
  Description of Artificial Sequence: Synthetic coding sequence
atggacaccttcaccgtgcaggacagcacagccatgtcctggtggaggaacaacttctggatcatcctggccgtggccatcatcgtggtgtctgtgggcctgggcctcatcctgtactgtgtgtgcaagtggcagctgcggcggggcaagaagtgggagatcgccaagcccctgaagcacaagcaggtggatgaggagaagatgtatgaaaatgtgctgaatgaaagccctgtgcagctgccccccctgccccccaggaactggcccagcctggaggacagcagcccccaggaggcccccagccagcccccagccacctacagcctggtgaacaaggtgaagaacaagaagacagtgtccatccccagctacatcgagccagaagatgattatgatgatgtggagatcccagccaacacagagaaggccagcttctag

SEQ ID NO: 169932 - DNA, 438 bp, Artificial Sequence; identical to SEQ ID NO: 169931
  Description of Artificial Sequence: Synthetic coding sequence

SEQ ID NO: 169933 - DNA, 1398 bp, Artificial Sequence
  Description of Artificial Sequence: Synthetic coding sequence
atgaatgtgaccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagctgccccggccagcccagcaactgtgtgaccatccccaggagcctggatggccgcctgcaggtgagccacaggaagggcctgccccacgtgatctactgccgggtgtggcgctggccagacctgcagagccaccacgagctgaagcccctggagtgctgtgagttccccttcggcagcaagcagaaggaggtgtgcatcaacccctaccactacaagagggtggagagccctgtgctgccccctgtgctggtgcccaggcacagcgagtacaacccccagcacagcctgctggcccagttcaggaacctgggccagaatgagccccacatgcccctgaatgccaccttcccagacagcttccagcagcccaacagccaccccttcccccacagccccaacagcagctaccccaacagccctggcagcagcagcagcacctacccccacagccccaccagcagtgaccccggcagccccttccagatgcctgctgacaccccacctccagcctacctgcccccagaggaccccatgacccaggacggcagccagcccatggacaccaacatgatggccccacccctgcccagcgagatcaacagaggagatgtgcaggccgtggcctatgaggagcccaagcactggtgcagcatcgtgtactatgagctgaacaacagagtgggggaggccttccacgccagcagcacctctgtgctggtggatggcttcacagaccccagcaacaacaagaaccgcttctgcctgggcctgctgagcaatgtgaacagaaacagcaccatcgagaacaccaggaggcacatcggcaagggcgtgcacctgtactacgtgggcggggaggtgtatgcagagtgcctgagtgacagcagcatctttgtgcagagcaggaactgcaactaccaccacggcttccaccccaccaccgtgtgcaagatccccagcggctgcagcctgaagatcttcaacaaccaggagtttgcccagctgctggcccagagcgtgaaccacggctttgagaccgtgtatgagctgaccaagatgtgcaccatccgcatgagctttgtgaagggctggggcgctgagtaccaccggcaggatgtgaccagcaccccctgctggattgagatccacctgcacggccccctgcagtggctggacaaggtgctgacccagatgggcagcccccacaaccccatcagctctgtgtcctag

SEQ ID NO: 169934 - DNA, 1398 bp, Artificial Sequence; identical to SEQ ID NO: 169933
  Description of Artificial Sequence: Synthetic coding sequence

SEQ ID NO: 169935 - DNA, 177 bp, Artificial Sequence
  Description of Artificial Sequence: Synthetic coding sequence
atgaatgtgaccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagctgcccctag

SEQ ID NO: 169936 - DNA, 33 bp, Artificial Sequence
  Description of Artificial Sequence: Synthetic coding sequence
atgaatgtgaccagcctcttctccttcacctag

SEQ ID NO: 169937 - DNA, 288 bp, Artificial Sequence
  Description of Artificial Sequence: Synthetic coding sequence
atgaatgtgaccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagctgccccggccagcccagcaactgtgtgaccatccccaggagcctggatggccgcctgcaggtgagccacaggaagggcctgccccacgtgatctactgccgggtgtggcgctggccctag

SEQ ID NO: 169938 - DNA, 402 bp, Artificial Sequence
  Description of Artificial Sequence: Synthetic coding sequence
atgaatgtgaccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagctgccccggccagcccagcaactgtgtgaccatccccaggagcctggatggccgcctgcaggtgagccacaggaagggcctgccccacgtgatctactgccgggtgtggcgctggccagacctgcagagccaccacgagctgaagcccctggagtgctgtgagttccccttcggcagcaagcagaaggaggtgtgcatcaacccctaccactacaagagggtggagagcccctag

SEQ ID NO: 169939 - DNA, 321 bp, Artificial Sequence
  Description of Artificial Sequence: Synthetic coding sequence
atgaatgtgaccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagctgccccggccagcccagcaactgtgtgaccatccccaggagcctggatggccgcctgcaggtgagccacaggaagggcctgccccacgtgatctactgccgggtgtggcgctggccagacctgcagagccaccacgagctgaagcccctgtag

SEQ ID NO: 169940 - DNA, 339 bp, Artificial Sequence
  Description of Artificial Sequence: Synthetic coding sequence
atgaatgtgaccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagctgccccggccagcccagcaactgtgtgaccatccccaggagcctggatggccgcctgcaggtgagccacaggaagggcctgccccacgtgatctactgccgggtgtggcgctggccagacctgcagagccaccacgagctgaagcccctggagtgctgtgagttcccctag

SEQ ID NO: 169941 - DNA, 1398 bp, Artificial Sequence; identical to SEQ ID NO: 169933
  Description of Artificial Sequence: Synthetic coding sequence

SEQ ID NO: 169942 - DNA, 1659 bp, Artificial Sequence
  Description of Artificial Sequence: Synthetic coding sequence
atggacaacatgagcatcaccaacacccccaccagcaatgatgcctgcctgagcatcgtgcacagcctgatgtgccaccggcagggcggggagagcgagacctttgccaagagggccatcgagagcctggtgaagaagctgaaggagaagaaggatgagctggacagcctcatcacagccatcaccaccaacggggcccaccccagcaaatgtgtgaccatccagaggaccctggatggccgcctgcaggtggccggcaggaagggcttcccccacgtgatctatgcccggctgtggcgctggccagacctgcacaagaatgagctgaagcacgtgaagtactgccagtatgcctttgacctgaagtgtgacagcgtgtgtgtgaacccctaccactatgagcgggtggtgtccccaggcatcgacctgagcggcctgaccctgcagagcaatgcccccagctccatgatggtgaaggatgaatatgtgcatgactttgagggccagcccagcctgagcacagagggccacagcatccagaccatccagcacccccccagcaacagagccagcacagagacctacagcaccccagccctgctggcccccagcgagagcaatgccaccagcacagccaacttccccaacatccctgtggccagcaccagccagcctgccagcatcctgggcggcagccacagcgagggcctgctgcagatcgccagcggcccccagcccggccagcagcagaatggcttcaccggccagcctgccacctaccaccacaacagcaccaccacctggacaggcagcaggacagccccctacacccccaacctgccccaccaccagaatggccacctgcagcaccacccccccatgccaccccaccctggccactactggcctgtgcacaatgagctggccttccagccccccatcagcaaccacccagcccctgagtactggtgcagcatcgcctactttgagatggatgtgcaggtgggggagaccttcaaggtgcccagcagctgccccatcgtgacagtggatggctacgtggaccccagcggcggggaccgcttctgcctgggccagctgagcaatgtgcacaggacagaggccatcgagcgggcccggctgcacatcggcaaaggagtgcagctggagtgcaagggggagggagatgtgtgggtgcgctgcctgagtgaccatgctgtgtttgtgcagagctactacctggaccgggaggccggccgggcccctggagatgctgtgcacaagatctaccccagcgcctacatcaaggtgtttgacctgcggcagtgccaccggcagatgcagcagcaggccgccacagcccaggccgctgctgctgcccaggccgctgctgtggccggcaacatccctggccctggctctgtgggcggcatcgccccagccatcagcctgtctgctgctgctggcatcggcgtggatgacctgcggcggctgtgcatcctgaggatgagctttgtgaagggctggggccctgactacccccggcagagcatcaaggagaccccctgctggattgagatccacctgcaccgggccctgcagctgctggatgaggtgctgcacaccatgcccatcgctgacccccagcccctggactag

SEQ ID NO: 169943 - DNA, 1659 bp, Artificial Sequence; identical to SEQ ID NO: 169942
  Description of Artificial Sequence: Synthetic coding sequence

SEQ ID NO: 169944 - DNA, 534 bp, Artificial Sequence
  Description of Artificial Sequence: Synthetic coding sequence
atggacaacatgagcatcaccaacacccccaccagcaatgatgcctgcctgagcatcgtgcacagcctgatgtgccaccggcagggcggggagagcgagacctttgccaagagggccatcgagagcctggtgaagaagctgaaggagaagaaggatgagctggacagcctcatcacagccatcaccaccaacggggcccaccccagcaaatgtgtgaccatccagaggaccctggatggccgcctgcaggtggccggcaggaagggcttcccccacgtgatctatgcccggctgtggcgctggccagacctgcacaagaatgagctgaagcacgtgaagtactgccagtatgcctttgacctgaagtgtgacagcgtgtgtgtgaacccctaccactatgagcgggtggtgtccccaggcatcgacctgagcggcctgaccctgcagagcaatgaaaacaactggtacttcagccagctgctgctggacctggacaagggcatgatccaggagcaggccatccacggcccctag

SEQ ID NO: 169945 - DNA, 1311 bp, Artificial Sequence
  Description of Artificial Sequence: Synthetic coding sequence
atggacaacatgagcatcaccaacacccccaccagcaatgatgcctgcctgagcatcgtgcacagcctgatgtgccaccggcagggcggggagagcgagacctttgccaagagggccatcgagagcctggtgaagaagctgaaggagaagaaggatgagctggacagcctcatcacagccatcaccaccaacggggcccaccccagcaaatgtgtgaccatccagaggaccctggatggccgcctgcaggtggccggcaggaagggcttcccccacgtgatctatgcccggctgtggcgctggccagacctgcacaagaatgagctgaagcacgtgaagtactgccagtatgcctttgacctgaagtgtgacagcgtgtgtgtgaacccctaccactatgagcgggtggtgtccccaggcatcgacctgagcggcctgaccctgcagagcaatgcccccagctccatgatggtgaaggatgaatatgtgcatgactttgagggccagcccagcctgagcacagagggccacagcatccagaccatccagcacccccccagcaacagagccagcacagagacctacagcaccccagccctgctggcccccagcgagagcaatgccaccagcacagccaacttccccaacatccctgtggccagcaccagccagcctgccagcatcctgggcggcagccacagcgagggcctgctgcagatcgccagcggcccccagcccggccagcagcagaatggcttcaccggccagcctgccacctaccaccacaacagcaccaccacctggacaggcagcaggacagccccctacacccccaacctgccccaccaccagaatggccacctgcagcaccacccccccatgccaccccaccctggccactactggcctgtgcacaatgagctggccttccagccccccatcagcaaccacccagcccctgagtactggtgcagcatcgcctactttgagatggatgtgcaggtgggggagaccttcaaggtgcccagcagctgccccatcgtgacagtggatggctacgtggaccccagcggcggggaccgcttctgcctgggccagctgagcaatgtgcacaggacagaggccatcgagcgggcccggctgcacatcggcaaaggagtgcagctggagtgcaagggggagggagatgtgtgggtgcgctgcctgagtgaccatgctgtgtttgtgcagagctactacctggaccgggaggccggccgggcccctggagatgctgtgcacaagatctaccccagcgcctacatcaagtag

SEQ ID NO: 169946 - DNA, 243 bp, Artificial Sequence
  Description of Artificial Sequence: Synthetic coding sequence
atgacctccatggccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagcagccctggccagcccagcaaatgtgtgaccatccccaggagcctggatggccgcctgcaggtgagccactag

SEQ ID NO: 169947 - DNA, 387 bp, Artificial Sequence
  Description of Artificial Sequence: Synthetic coding sequence
atgacctccatggccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagcagccctggccagcccagcaaatgtgtgaccatccccaggagcctggatggccgcctgcaggtgagccacaggaagggcctgccccacgtgatctactgccgggtgtggcgctggccagacctgcagagccaccacgagctgaagcccctggacatctgtgagttccccttcggcagcaagcagaaggaggtgtgcatcaacccctaccactactag

SEQ ID NO: 169948 - DNA, 6 bp, Artificial Sequence
  Description of Artificial Sequence: Synthetic coding sequence
atgtag

SEQ ID NO: 169949 - DNA, 405 bp, Artificial Sequence
  Description of Artificial Sequence: Synthetic coding sequence
atgacctccatggccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagcagccctggccagcccagcaaatgtgtgaccatccccaggagcctggatggccgcctgcaggtgagccacaggaagggcctgccccacgtgatctactgccgggtgtggcgctggccagacctgcagagccaccacgagctgaagcccctggacatctgtgagttccccttcggcagcaagcagaaggaggtgtgcatcaacccctaccactacaagagggtggagagcccctag

SEQ ID NO: 169950 - DNA, 6 bp, Artificial Sequence
  Description of Artificial Sequence: Synthetic coding sequence
atgtag

SEQ ID NO: 169951 - DNA, 1395 bp, Artificial Sequence
  Description of Artificial Sequence: Synthetic coding sequence
atgacctccatggccagcctcttctccttcaccagccctgctgtgaagaggctgctgggctggaagcagggagatgaggaggagaagtgggccgagaaggctgtggatgccctggtgaagaagctgaagaagaagaagggggccatggaggagctggagaaggccctgagcagccctggccagcccagcaaatgtgtgaccatccccaggagcctggatggccgcctgcaggtgagccacaggaagggcctgccccacgtgatctactgccgggtgtggcgctggccagacctgcagagccaccacgagctgaagcccctggacatctgtgagttccccttcggcagcaagcagaaggaggtgtgcatcaacccctaccactacaagagggtggagagccctgtgctgccccctgtgctggtgcccaggcacaatgagttcaacccccagcacagcctgctggtgcagttcaggaacctgagccacaatgagccccacatgccccagaatgccaccttcccagacagcttccaccagcccaacaacacccccttccccctgagccccaacagcccctacccacccagccctgccagcagcacctaccccaacagccctgccagcagcggccctggcagccccttccagctgcctgctgacaccccacctccagcctacatgcccccagatgaccagatgggccaggacaacagccagcccatggacaccagcaacaacatgatcccccagatcatgcccagcatcagcagcagagatgtgcagcctgtggcctatgaggagcccaagcactggtgcagcatcgtgtactatgagctgaacaacagagtgggggaggccttccacgccagcagcacctctgtgctggtggatggcttcacagaccccagcaacaacaagagccgcttctgcctgggcctgctgagcaatgtgaacagaaacagcaccatcgagaacaccaggaggcacatcggcaagggcgtgcacctgtactacgtgggcggggaggtgtatgcagagtgcctgagtgacagcagcatctttgtgcagagcaggaactgcaacttccaccacggcttccaccccaccaccgtgtgcaagatccccagcagctgcagcctgaagatcttcaacaaccaggagtttgcccagctgctggcccagagcgtgaaccacggctttgaggccgtgtatgagctgaccaagatgtgcaccatccgcatgagctttgtgaagggctggggcgctgagtaccaccggcaggatgtgaccagcaccccctgctggattgagatcctgcacggccccctgcagtggctggacaaggtgctgacccagatgggcagccccctgaaccccatcagctctgtgtcctag

SEQ ID NO: 169952 - DNA, 1395 bp, Artificial Sequence; identical to SEQ ID NO: 169951
  Description of Artificial Sequence: Synthetic coding sequence

SEQ ID NO: 169953 - DNA, 1491 bp, Artificial Sequence
  Description of Artificial Sequence: Synthetic coding sequence
atgttccgcagcaagaggagcggcctggtgcggcggctgtggaggagccgggtggtgcctgaccgggaggagggcggcagcggcggcggcggcggcggagatgaagatggcagcctgggcagcagagctgagcccgccccccgggcccgggagggcggcggctgcggccgctctgaggtgcggcctgtggccccccggcggcccagagatgctgtgggccagagaggagcccagggcgccggcagaagaagaagagctgggggccccccccggcccatgtctgagcccggggccggggccggcagcagcctgctggatgtggccgagcccggcggccctggctggctgcctgagagtgactgtgaaacagtgacctgctgcctcttcagcgagagagatgctgctggggcccccagagatgccagtgaccccctggccggggccgccctggagcctgctgggggcggccgcagccgggaggcccggagccggctgctgctgctggagcaggagctgaagacagtgacctacagcctgctgaagaggctgaaggagaggagcctggacaccctgctggaggccgtggagagcagaggaggagtgcctgggggctgtgtgctggtgcccagggctgacctgcggctgggcggccagcctgccccaccccagctgctgctgggccgcctcttccgctggccagacctgcagcacgctgtggagctgaagcccctgtgtggctgccacagctttgctgctgctgctgatggccccaccgtgtgctgcaacccctaccacttcagccggctgtgtggccctgagagccccccaccaccctacagccggctgagccccagagatgagtacaagcccctggacctgagtgacagcaccctgagctacacagaaacagaggccaccaacagcctcatcacagcccctggagagttcagtgatgcctccatgagcccagatgccaccaagcccagccactggtgcagcgtggcctactgggagcacaggaccagggtgggccgcctgtatgctgtgtatgaccaggccgtgtccatcttctatgacctgccccagggcagcggcttctgcctgggccagctgaacctggagcagaggtctgagagcgtgcggaggaccaggagcaagattggatttggcatcctgctgagcaaggagccagatggagtgtgggcctacaacagaggagagcaccccatctttgtgaacagccccaccctggatgcccctgggggccgggccctggtggtgaggaaggtgcccccaggctacagcatcaaggtgtttgattttgagaggagcggcctgcagcacgcccctgagccagatgctgctgatggcccctatgaccccaacagcgtgcgcatcagctttgccaagggctggggcccctgctacagccggcagttcatcaccagctgcccctgctggctggagatcctgctgaacaaccccaggtag

SEQ ID NO: 169954 - DNA, 708 bp, Artificial Sequence
  Description of Artificial Sequence: Synthetic coding sequence
atgagcaggatgggcaagcccatcgagacccagaagagccccccaccaccctacagccggctgagccccagagatgagtacaagcccctggacctgagtgacagcaccctgagctacacagaaacagaggccaccaacagcctcatcacagcccctggagagttcagtgatgcctccatgagcccagatgccaccaagcccagccactggtgcagcgtggcctactgggagcacaggaccagggtgggccgcctgtatgctgtgtatgaccaggccgtgtccatcttctatgacctgccccagggcagcggcttctgcctgggccagctgaacctggagcagaggtctgagagcgtgcggaggaccaggagcaagattggcttcggcatcctgctgagcaaggagccagatggagtgtgggcctacaacagaggagagcaccccatctttgtgaacagccccaccctggatgcccctgggggccgggccctggtggtgaggaaggtgcccccaggctacagcatcaaggtgtttgattttgagaggagcggcctgcagcacgcccctgagccagatgctgctgatggcccctatgaccccaacagcgtgcgcatcagctttgccaagggctggggcccctgctacagccggcagttcatcaccagctgcccctgctggctggagatcctgctgaacaaccccaggtag

SEQ ID NO: 169955 - DNA, 1017 bp, Artificial Sequence
  Description of Artificial Sequence: Synthetic coding sequence
atgttccgcagcaagaggagcggcctggtgcggcggctgtggaggagccgggtggtgcctgaccgggaggagggcggcagcggcggcggcggcggcggagatgaagatggcagcctgggcagcagagctgagcccgccccccgggcccgggagggcggcggctgcggccgctctgaggtgcggcctgtggccccccggcggcccagagatgctgtgggccagagaggagcccagggcgccggcagaagaagaagagctgggggccccccccggcccatgtctgagcccggggccggggccggcagcagcctgctggatgtggccgagcccggcggccctggctggctgcctgagagtgactgtgaaacagtgacctgctgcctcttcagcgagagagatgctgctggggcccccagagatgccagtgaccccctggccggggccgccctggagcctgctgggggcggccgcagccgggaggcccggagccggctgctgctgctggagcaggagctgaagacagtgacctacagcctgctgaagaggctgaaggagaggagcctggacaccctgctggaggccgtggagagcagaggaggagtgcctgggggctgtgtgctggtgcccagggctgacctgcggctgggcggccagcctgccccaccccagctgctgctgggccgcctcttccgctggccagacctgcagcacgctgtggagctgaagcccctgtgtggctgccacagctttgctgctgctgctgatggccccaccgtgtgctgcaacccctaccacttcagccggctgtgtggccctgagagccccccaccaccctacagccggctgagccccagagatgagtacaagcccctggacctgagtgacagcaccctgagctacacagaaacagaggccaccaacagcctcatcacagcccctggagagttctctgctgctgatgctggcatcggcagccggggcaacagaggcctggagagctctgtgccctgcagctag

SEQ ID NO: 169956 - DNA, 1293 bp, Artificial Sequence
  Description of Artificial Sequence: Synthetic coding sequence
atgcacagcaccacccccatcagcagcctcttctccttcaccagccctgctgtgaagaggctgctgggctggaagcagggagatgaggaggagaagtgggccgagaaggctgtggacagcctggtgaagaagctgaagaagaagaagggggccatggatgagctggagcgggccctgagctgccccggccagcccagcaaatgtgtgaccatccccaggagcctggatggccgcctgcaggtgagccacaggaagggcctgccccacgtgatctactgccgggtgtggcgctggccagacctgcagagccaccacgagctgaagcccctggagtgctgtgagttccccttcggcagcaagcagaaggaggtgtgcatcaacccctaccactaccgccgggtggagacccctgtgctgccccctgtgctggtgcccaggcacagcgagtacaacccccagctgagcctgctggccaagttccgcagcgccagcctgcacagcgagcccctgatgccccacaatgccacctacccagacagcttccagcagcccccctgcagcgccctgccccccagccccagccacgccttcagccagagcccctgcacagccagctacccccacagccctggcagccccagcgagcctgagagcccctaccagcacagcgacttccggcctgtgtgctatgaggagccccagcactggtgcagcgtggcctactatgagctgaacaacagagtgggggagaccttccaggccagcagccgctctgtgctgattgatggcttcacagaccccagcaacaacagaaaccgcttctgcctgggcctgctgagcaatgtgaacagaaacagcaccatcgagaacacccggcggcacatcggcaaaggagtgcacctgtactacgtgggcggggaggtgtatgcagaatgtgtgtctgacagcagcatctttgtgcagagcaggaactgcaactaccagcacggcttccacccagccaccgtgtgcaagatccccagcggctgcagcctgaaggtgttcaacaaccagctgtttgcccagctgctggcccagagcgtgcaccacggctttgaggtggtgtatgagctgaccaagatgtgcaccatccgcatgagctttgtgaagggctggggcgctgagtaccaccggcaggatgtgaccagcaccccctgctggattgagatccacctgcacggccccctgcagtggctggacaaggtgctgacccagatgggcagcccccacaaccccatcagctctgtgtcctag

SEQ ID NO: 169957 - DNA, 1404 bp, Artificial Sequence
  Description of Artificial Sequence: Synthetic coding sequence
atgcacagcaccacccccatcagcagcctcttctccttcaccagccctgctgtgaagaggctgctgggctggaagcagggagatgaggaggagaagtgggccgagaaggctgtggacagcctggtgaagaagctgaagaagaagaagggggccatggatgagctggagcgggccctgagctgccccggccagcccagcaaatgtgtgaccatccccaggagcctggatggccgcctgcaggtgagccacaggaagggcctgccccacgtgatctactgccgggtgtggcgctggccagacctgcagagccaccacgagctgaagcccctggagtgctgtgagttccccttcggcagcaagcagaaggaggtgtgcatcaacccctaccactaccgccgggtggagacccctgtgctgccccctgtgctggtgcccaggcacagcgagtacaacccccagctgagcctgctggccaagttccgcagcgccagcctgcacagcgagcccctgatgccccacaatgccacctacccagacagcttccagcagcccccctgcagcgccctgccccccagccccagccacgccttcagccagagcccctgcacagccagctacccccacagccctggcagccccagcgagcctgagagcccctaccagcacagcgtggacaccccacccctgccctaccacgccacagaggccagcgagacccagagcggccagcctgtggatgccacagctgacagacatgtggtgctgagcatccccaatggagacttccggcctgtgtgctatgaggagccccagcactggtgcagcgtggcctactatgagctgaacaacagagtgggggagaccttccaggccagcagccgctctgtgctgattgatggcttcacagaccccagcaacaacagaaaccgcttctgcctgggcctgctgagcaatgtgaacagaaacagcaccatcgagaacaccaggaggcacatcggcaagggcgtgcacctgtactacgtgggcggggaggtgtatgcagaatgtgtgtctgacagcagcatctttgtgcagagcaggaactgcaactaccagcacggcttccacccagccaccgtgtgcaagatccccagcggctgcagcctgaaggtgttcaacaaccagctgtttgcccagctgctggcccagagcgtgcaccacggctttgaggtggtgtatgagctgaccaagatgtgcaccatccgcatgagctttgtgaagggctggggcgctgagtaccaccggcaggatgtgaccagcaccccctgctggattgagatccacctgcacggccccctgcagtggctggacaaggtgctgacccagatgggcagcccccacaaccccatcagctctgtgtcctag

SEQ ID NO: 169958 - DNA, 1404 bp, Artificial Sequence; identical to SEQ ID NO: 169957
  Description of Artificial Sequence: Synthetic coding sequence

SEQ ID NO: 169959 - DNA, 1191 bp, Artificial Sequence
  Description of Artificial Sequence: Synthetic coding sequence
atgaaggctgtgaagtctgagcgggagcggggcagcagaagaagacacagagatggagatgtggtgctgcctgctggggtggtggtgaagcaggagcggctgagccctgaggtggcccccccagcccaccggcggccagaccacagcggcggcagccccagcccccccaccagcgagcccgcccggagcggccaccggggcaacagagcccggggcgtgagccgcagcccccccaagaagaagaacaaggccagcggcagaagaagcaagagccccaggagcaagaggaacagaagcccccaccacagcacagtgaaggtgaagcaggagcgggaggaccacccccggcggggccgggaggaccggcagcaccgggagcccagcgagcaggagcacagaagagccaggaacagcgaccgggacagacaccggggccacagccaccagaggaggaccagcaatgaaagacctggcagcggccagggccagggccgggaccgggacacccagaacctgcaggcccaggaggaggagcgggagttctacaatgcccggcggcgggagcaccggcagagaaatgatgtgggcggcggcggcagcgagagccaggagctggtgcccaggcctgggggcaacaacaaggagaaggaggtgcctgccaaggagaagcccagctttgagctgagcggggccctgctggaggacaccaacaccttccggggcgtggtgatcaagtacagcgagcccccagaggcccgcatccccaagaagcgctggaggctgtaccccttcaagaatgatgaggtgctgcctgtgatgtacatccaccggcagagcgcctacctgctgggccgccacagaagaattgctgacatccccatcgaccaccccagctgcagcaagcagcacgctgtgttccagtaccgcctggtggagtacaccagggcagatggcaccgtgggccggcgggtgaagccctacatcatcgacctgggcagcggaaatggcaccttcctgaacaacaagagaattgagccccagcgctactatgagctgaaggagaaggatgtgctgaagtttggcttcagcagccgggagtatgtgctgctgcacgagagcagtgacaccagcgagattgacaggaaggatgatgaagatgaggaggaggaggaggaggtgtctgacagctag

SEQ ID NO: 169960 - DNA, 1143 bp, Artificial Sequence
  Description of Artificial Sequence: Synthetic coding sequence
atgaaggctgtgaagtctgagcgggagggcgtggtggtgaagcaggagcggctgagccctgaggtggcccccccagcccaccggcggccagaccacagcggcggcagccccagcccccccaccagcgagcccgcccggagcggccaccggggcaacagagcccggggcgtgagccgcagcccccccaagaagaagaacaaggccagcggcagaagaagcaagagccccaggagcaagaggaacagaagcccccaccacagcacagtgaaggtgaagcaggagcgggaggaccacccccggcggggccgggaggaccggcagcaccgggagcccagcgagcaggagcacagaagagccaggaacagcgaccgggacagacaccggggccacagccaccagaggaggaccagcaatgaaagacctggcagcggccagggccagggccgggaccgggacacccagaacctgcaggcccaggaggaggagcgggagttctacaatgcccggcggcgggagcaccggcagagaaatgatgtgggcggcggcggcagcgagagccaggagctggtgcccaggcctgggggcaacaacaaggagaaggaggtgcctgccaaggagaagcccagctttgagctgagcggggccctgctggaggacaccaacaccttccggggcgtggtgatcaagtacagcgagcccccagaggcccgcatccccaagaagcgctggaggctgtaccccttcaagaatgatgaggtgctgcctgtgatgtacatccaccggcagagcgcctacctgctgggccgccacagaagaattgctgacatccccatcgaccaccccagctgcagcaagcagcacgctgtgttccagtaccgcctggtggagtacaccagggcagatggcaccgtgggccggcgggtgaagccctacatcatcgacctgggcagcggaaatggcaccttcctgaacaacaagagaattgagccccagcgctactatgagctgaaggagaaggatgtgctgaagtttggcttcagcagccgggagtatgtgctgctgcacgagagcagtgacaccagcgagattgacaggaaggatgatgaagatgaggaggaggaggaggaggtgtctgacagctag

SEQ ID NO: 169961 - DNA, 2274 bp, Artificial Sequence
  Description of Artificial Sequence: Synthetic coding sequence
atgagcaaccctggcaccaggagaaatggcagcagcatcaagatccggctgactgtgctgtgtgccaagaacctggccaagaaggacttcttccggctgcctgacccctttgccaagatcgtggtggatggcagcggccagtgccacagcacagacacagtgaagaacaccctggaccccaagtggaaccagcactatgacctgtatgtgggcaagacagacagcatcaccatctctgtgtggaaccacaagaagatccacaagaagcagggcgccggcttcctgggctgtgtgcggctgctgagcaatgccatcagccggctgaaggacaccggctaccagaggctggacctgtgcaagctgaaccccagcgacacagatgctgtgcggggccagatcgtggtgtccctgcagacccgggacagaattggaactggaggctctgtggtggactgccggggcctgctggagaatgaaggaacagtgtatgaggacagcggccctggccggcccctgagctgcttcatggaggagcccgccccctacacagacagcactggagctgctgctgggggcggcaactgccgctttgtggagagccccagccaggaccagaggctgcaggcccagaggctgagaaatccagatgtgcggggcagcctgcagaccccccagaaccggccccacggccaccagagccctgagctgcctgagggctatgagcagaggaccaccgtgcagggccaggtgtacttcctgcacacccagacaggagtgtccacctggcatgacccccgcatccccagccccagcggcaccatccctggaggagatgctgccttcctgtatgagttcctgctgcagggccacaccagcgagccccgggacctgaacagcgtgaactgtgatgagctgggccccctgcccccaggctgggaggtgcgcagcacagtgtctggccgcatctactttgtggaccacaacaacagaaccacccagttcacagacccccggctgcaccacatcatgaaccaccagtgccagctgaaggagcccagccagcccctgcccctgcccagcgagggcagcctggaggatgaggagctgcctgcccagagatatgaaagagacctggtgcagaagctgaaggtgctgcggcatgagctgagcctgcagcagccccaggccggccactgcagaattgaggtgtcccgggaggagatctttgaggagagctaccggcagatcatgaagatgaggcccaaggacctgaagaagaggctgatggtgaagttccggggggaggagggcctggactatggaggagtggcccgggagtggctgtacctgctgtgccacgagatgctgaacccctactacggcctcttccagtacagcacagacaacatctacatgctgcagatcaacccagacagcagcatcaacccagaccacctgagctacttccactttgtgggccgcatcatgggcctggccgtgttccacggccactacatcaatggaggcttcaccgtgcccttctacaagcagctgctgggcaagcccatccagctgagtgacctggagagcgtggaccctgagctgcacaagagcctggtgtggatcctggagaatgacatcacccctgtgctggaccacaccttctgtgtggagcacaatgccttcggccgcatcctgcagcacgagctgaagcccaatggaagaaatgtgcctgtgacagaggagaacaagaaggagtatgtgcggctgtatgtgaactggaggttcatgaggggcatcgaggcccagttcctggccctgcagaagggcttcaatgagctgatcccccagcacctgctgaagccctttgaccagaaggagctggagctgatcatcggcggcctggacaagattgacctgaatgactggaagagcaacacccggctgaagcactgtgtggccgacagcaacatcgtgcgctggttctggcaggccgtggagacctttgatgaggagcggcgggcccggctgctgcagtttgtgacaggcagcaccagggtgcccctgcagggcttcaaggccctgcagggcagcactggagctgctggccccaggctcttcaccatccacctgattgatgccaacacagacaacctgcccaaggcccacacctgcttcaacagaattgacatccccccctatgagagctatgagaagctgtatgagaagctgctgacagctgtggaggagacctgtggctttgctgtggagtag

SEQ ID NO: 169962 - DNA, 2196 bp, Artificial Sequence
  Description of Artificial Sequence: Synthetic coding sequence
atgagcaaccctggcaccaggagaaatggcagcagcatcaagatccggctgactgtgctgtgtgccaagaacctggccaagaaggacttcttccggctgcctgacccctttgccaagatcgtggtggatggcagcggccagtgccacagcacagacacagtgaagaacaccctggaccccaagtggaaccagcactatgacctgtatgtgggcaagacagacagcatcaccatctctgtgtggaaccacaagaagatccacaagaagcagggcgccggcttcctgggctgtgtgcggctgctgagcaatgccatcagccggctgaaggacaccggctaccagaggctggacctgtgcaagctgaaccccagcgacacagatgctgtgcggggccagatcgtggtgtccctgcagacccgggacagaattggaactggaggctctgtggtggactgccggggcctgctggagaatgaaggaacagtgtatgaggacagcggccctggccggcccctgagctgcttcatggaggagcccgccccctacacagacagcactggagctgctgctgggggcggcaactgccgctttgtggagagccccagccaggaccagaggctgcaggcccagaggctgagaaatccagatgtgcggggcagcctgcagaccccccagaaccggccccacggccaccagagccctgagctgcctgagggctatgagcagaggaccaccgtgcagggccaggtgtacttcctgcacacccagacaggagtgtccacctggcatgacccccgcatcccccgggacctgaacagcgtgaactgtgatgagctgggccccctgcccccaggctgggaggtgcgcagcacagtgtctggccgcatctactttgtggaccacaacaacagaaccacccagttcacagacccccggctgcaccacatcatgaaccaccagtgccagctgaaggagcccagccagcccctgcccctgcccagcgagggcagcctggaggatgaggagctgcctgcccagagatatgaaagagacctggtgcagaagctgaaggtgctgcggcatgagctgagcctgcagcagccccaggccggccactgcagaattgaggtgtcccgggaggagatctttgaggagagctaccggcagatcatgaagatgaggcccaaggacctgaagaagaggctgatggtgaagttccggggggaggagggcctggactatggaggagtggcccgggagtggctgtacctgctgtgccacgagatgctgaacccctactacggcctcttccagtacagcacagacaacatctacatgctgcagatcaacccagacagcagcatcaacccagaccacctgagctacttccactttgtgggccgcatcatgggcctggccgtgttccacggccactacatcaatggaggcttcaccgtgcccttctacaagcagctgctgggcaagcccatccagctgagtgacctggagagcgtggaccctgagctgcacaagagcctggtgtggatcctggagaatgacatcacccctgtgctggaccacaccttctgtgtggagcacaatgccttcggccgcatcctgcagcacgagctgaagcccaatggaagaaatgtgcctgtgacagaggagaacaagaaggagtatgtgcggctgtatgtgaactggaggttcatgaggggcatcgaggcccagttcctggccctgcagaagggcttcaatgagctgatcccccagcacctgctgaagccctttgaccagaaggagctggagctgatcatcggcggcctggacaagattgacctgaatgactggaagagcaacacccggctgaagcactgtgtggccgacagcaacatcgtgcgctggttctggcaggccgtggagacctttgatgaggagcggcgggcccggctgctgcagtttgtgacaggcagcaccagggtgcccctgcagggcttcaaggccctgcagggcagcactggagctgctggccccaggctcttcaccatccacctgattgatgccaacacagacaacctgcccaaggcccacacctgcttcaacagaattgacatccccccctatgagagctatgagaagctgtatgagaagctgctgacagctgtggaggagacctgtggctttgctgtggagtag

SEQ ID NO: 169963 - DNA, 1323 bp, Artificial Sequence
  Description of Artificial Sequence: Synthetic coding sequence
atggccaccaggagctgccgggagaaggcccagaagctgaatgagcagcaccagctgatcctgagcaagctgctgcgggaggaggacaacaagtactgtgccgactgtgaggccaagggcccccgctgggcctcctggaacatcggggtcttcatctgcatccgctgtgccggcatccacaggaacctgggcgtgcacatcagccgggtgaagtctgtgaacctggaccagtggacagctgagcagatccagtgcatgcaggacatgggcaacaccaaggcccggctgctgtatgaggccaacctgcctgagaacttcagaagaccccagacagaccaggccgtggagttcttcatccgggacaagtatgagaagaagaagtactatgacaagaatgccatcgccatcaccaacaaggagaaggagaagaagaaggaggagaagaagcgggagaaggagcctgagaagccagccaagcccctgacagctgagaagctgcagaagaaggaccagcagctggagcccaagaagagcaccagccccaagaaggctgctgagcccaccgtggacctgctgggcctggatggccctgctgtggcccctgtgaccaacggcaacaccaccgtgccccccctgaatgatgacctggacatcttcggccccatgatcagcaaccccctgcctgccaccgtgatgcccccagcccagggcacccccagcgccccagctgctgccaccctgagcacagtgaccagcggggacctggacctcttcacagagcagaccaccaagtctgaggaggtggccaagaagcagctgagcaaggacagcatcctgagcctgtatggcaccggcaccatccagcagcagagcaccccaggagtcttcatgggccccaccaacatccccttcaccagccaggccccagctgccttccagggcttccccagcatgggcgtgcctgtgcctgctgcccctggcctgattggaaatgtgatgggccagagccccagcatgatggtgggcatgcccatgcccaacggcttcatgggaaatgcccagacaggagtgatgcccctgccccagaatgtggtgggcccccagggcggcatggtgggccagatgggcgccccccagagcaagtttggcctgccccaggcccagcagccccagtggagcctgagccagatgaaccagcagatggccggcatgagcatcagcagcgccacccccacagctggcttcggccagcccagcagcaccacagctggctggagcggcagcagcagcggccagaccctgagcacccagctgtggaagtag

SEQ ID NO: 169964 - DNA, 489 bp, Artificial Sequence
  Description of Artificial Sequence: Synthetic coding sequence
atgggcaacaccaaggcccggctgctgtatgaggccaacctgcctgagaacttcagaagaccccagacagaccaggccgtggagttcttcatccgggacaagtatgagaagaagaagtactatgacaagaatgccatcgccatcaccaacatcagcagcagtgatgcccccctgcagcccctggtgagcagccccagcctgcaggccgctgtggacaagaacaagctggagaaggagaaggagaagaagaaggaggagaagaagcgggagaaggagcctgagaagccagccaagcccctgacagctgagaagctgcagaagaaggaccagcagctggagcccaagaagagcaccagccccaagaaggctgctgagcccaccgtggacctgctgggcctggtgtggaggaagattgagaaggagaagtctgagcggcagctggtggaggtggaggagctgaccttcatgtactgcttccccaagaactag

SEQ ID NO: 169965 - DNA, 1311 bp, Artificial Sequence
  Description of Artificial Sequence: Synthetic coding sequence
atggccaccaggagctgccgggagaaggcccagaagctgaatgagcagcaccagctgatcctgagcaagctgctgcgggaggaggacaacaagtactgtgccgactgtgaggccaagggcccccgctgggcctcctggaacatcggggtcttcatctgcatccgctgtgccggcatccacaggaacctgggcgtgcacatcagccgggtgaagtctgtgaacctggaccagtggacagctgagcagatccagtgcatgcaggacatgggcaacaccaaggcccggctgctgtatgaggccaacctgcctgagaacttcagaagaccccagacagaccaggccgtggagttcttcatccgggacaagtatgagaagaagaagtactatgacaagaatgccatcgccatcaccaacaaggagaaggagaagaagaaggaggagaagaagcgggagaaggagcctgagaagccagccaagcccctgacagctgagaagctgcagaagaaggaccagcagctggagcccaagaagagcaccagccccaagaaggctgctgagcccaccgtggacctgctgggcctggatggccctgctgtggcccctgtgaccaacggcaacaccaccgtgccccccctgaatgatgacctggacatcttcggccccatgatcagcaaccccctgcctgccaccgtgatgcccccagcccagggcacccccagcgccccagctgctgccaccctgagcacagtgaccagcggggacctggacctcttcacagagcagaccaccaagtctgaggaggtggccaagaagcagctgagcaaggacagcatcctgagcctgtatggcaccggcaccatccagcagcagagcaccccaggagtcttcatgggccccaccaacatccccttcaccagccaggccccagctgccttccagggcttccccagcatgggcgtgcctgtgcctgctgcccctggcctgattggaaatgtgatgggccagagccccagcatgatggtgggcatgcccatgcccaacggcttcatgggaaatgcccagacaggagtgatgcccctgccccagaatgtggtgggcccccagggcggcatggtgggccagatgggcgccccccagagcaagtttggcctgccccaggcccagcagccccagtggagcctgagccagatcatgcagaagggagatgctgtgctgcagcacagcatcagcgccatctactggcccatgacccgctggctgaagtgccccctggtggatgagagcgcagatggctggcatgagtaccagtag

SEQ ID NO: 169966 - DNA, 1404 bp, Artificial Sequence
  Description of Artificial Sequence: Synthetic coding sequence
atggccaccaggagctgccgggagaaggcccagaagctgaatgagcagcaccagctgatcctgagcaagctgctgcgggaggaggacaacaagtactgtgccgactgtgaggccaagggcccccgctgggcctcctggaacatcggggtcttcatctgcatccgctgtgccggcatccacaggaacctgggcgtgcacatcagccgggtgaagtctgtgaacctggaccagtggacagctgagcagatccagtgcatgcaggacatgggcaacaccaaggcccggctgctgtatgaggccaacctgcctgagaacttcagaagaccccagacagaccaggccgtggagttcttcatccgggacaagtatgagaagaagaagtactatgacaagaatgccatcgccatcaccaacatcagcagcagtgatgcccccctgcagcccctggtgagcagccccagcctgcaggccgctgtggacaagaacaagctggagaaggagaaggagaagaagaaggaggagaagaagcgggagaaggagcctgagaagccagccaagcccctgacagctgagaagctgcagaagaaggaccagcagctggagcccaagaagagcaccagccccaagaaggctgctgagcccaccgtggacctgctgggcctggatggccctgctgtggcccctgtgaccaatggaaacaccaccgtgccccccctgaatgatgacctggacatcttcggccccatgatcagcaaccccctgcctgccaccgtgatgcccccagcccagggcaccccatctgccccagctgctgccaccctgagcacagtgaccagcggggacctggacctcttcacagagcagaccaccaagtctgaggaggtggccaagaagcagctgagcaaggacagcatcctgagcctgtatggaacaggcaccatccagcagcagagcaccccaggagtcttcatgggccccaccaacatccccttcaccagccaggccccagctgccttccagggcttccccagcatgggcgtgcctgtgcctgctgcccctggcctgattggaaatgtgatgggccagagccccagcatgatggtgggcatgcccatgcccaacggcttcatgggaaatgcccagacaggagtgatgcccctgccccagaatgtggtgggcccccagggcggcatggtgggccagatgggcgccccccagagcaagtttggcctgccccaggcccagcagccccagtggagcctgagccagatgaaccagcagatggccggcatgagcatcagcagcgccacccccacagctggcttcggccagcccagcagcaccacagctggctggagcggcagcagcagcggccagaccctgagcacccagctgtggaagtag

SEQ ID NO: 169967 - DNA, 414 bp, Artificial Sequence
  Description of Artificial Sequence: Synthetic coding sequence
atggccaccaggagctgccgggagaaggcccagaagctgaatgagcagcaccagctgatcctgagcaagctgctgcgggaggaggacaacaagtactgtgccgactgtgaggccaagggcccccgctgggcctcctggaacatcggggtcttcatctgcatccgctgtgccggcatccacaggaacctgggcgtgcacatcagccgggtgaagtctgtgaacctggaccagtggacagctgagcagatccagtgcatgcaggacatgggcaacaccaaggcccggctgctgtatgaggccaacctgcctgagaacttcagaagaccccagacagaccacgaggacatcatcctggagaccacagctgtgatcaccctgctgctgaacaagtgcctgccctatgccaagccctag

SEQ ID NO: 169968 - DNA, 378 bp, Artificial Sequence
  Description of Artificial Sequence: Synthetic coding sequence
tgaaaatactatgacaagaatgccatcgccatcaccaacatcagcagcagtgatgcccccctgcagcccctggtgagcagccccagcctgcaggccgctgtggacaagaacaagctggagaaggagaaggagaagaagaaggaggagaagaagcgggagaaggagcctgagaagccagccaagcccctgacagctgagaagctgcagaagaaggaccagcagctggagcccaagaagagcaccagccccaagaaggctgctgagcccaccgtggacctgctgggcctggtgtggaggaagattgagaaggagaagtctgagcggcagctggtggaggtggaggagctgaccttcatgtactgcttccccaagaactag

SEQ ID NO: 169969 - DNA, 189 bp, Artificial Sequence
  Description of Artificial Sequence: Synthetic coding sequence
atgctgttcctgaagctgtctgtgttccgggctgtggagttcttcatccgggacaagtatgagaagaagaagtactatgacaagaatgccatcgccatcaccaacatcagcagcagtgatgcccccctgcagcccctggtgagcagccccagcctgcaggccgctgtggacaagaacaagctggagtag

SEQ ID NO: 169970 - DNA, 1200 bp, Artificial Sequence
  Description of Artificial Sequence: Synthetic coding sequence
atgatcttcaagggcccccgctgggcctcctggaacattggagtcttcatctgcatccgctgtgccggcatccacaggaacctgggcgtgcacatcagccgggtgaagtctgtgaacctggaccagtggacccaggagcagatccagtgcatgcaggagatgggaaatggcaaggccaaccggctgtatgaggcctacctgcctgagaccttccggcggccccagattgatcctgctgtggagggcttcatccgggacaagtatgagaagaagaagtacatggacaggagcctggacatcaatgccttcaggaaggagaaggatgacaagtggaagaggggcagcgagcctgtgcctgagaagaagctggagcctgtggtgtttgagaaggtgaagatgccccagaagaaggaggacccccagctgcccaggaagagcagccccaagagcacagcccctgtgatggacctgctgggcctggatgcccctgtggcctgcagcatcgccaacagcaagaccagcaacaccctggagaaggacctggacctgctggcctctgtgcccagccccagcagcagcggcagcaggaaggtggtgggctccatgcccacagctggcagcgctggctctgtgcctgagaacctgaacctcttccctgagcccggcagcaagtctgaggagatcggcaagaagcagctgagcaaggacagcatcctgagcctgtatggcagccagaccccccagatgcccacccaggccatgttcatggccccagcccagatggcctaccccacagcctaccccagcttccctggggtgaccccacccaacagcatcatgggctccatgatgcctcctcctgtgggcatggtggcccagcccggggccagcggcatggtggcccccatggccatgcctgctggctacatgggcggcatgcaggcctccatgatgggcgtgcccaacggcatgatgaccacccagcaggccggctacatggccggcatggccgccatgccccagacagtgtatggagtgcagcctgcccagcagctgcagtggaacctgacccagatgacccagcagatggccggcatgaacttctatggagccaacggcatgatgaactacggccagagcatgtctggaggaaatggccaggccgccaaccagaccctgagcccccagatgtggaagtag

SEQ ID NO: 169971 - DNA, 1290 bp, Artificial Sequence
  Description of Artificial Sequence: Synthetic coding sequence
atgaccgggaagtctgtgaaggatgtggaccgctaccaggccgtgctggccaacctgctgctggaggaggacaacaagttctgtgccgactgccagagcaagggcccccgctgggcctcctggaacattggagtcttcatctgcatccgctgtgccggcatccacaggaacctgggcgtgcacatcagccgggtgaagtctgtgaacctggaccagtggacccaggagcagatccagtgcatgcaggagatgggaaatggcaaggccaaccggctgtatgaggcctacctgcctgagaccttccggcggccccagattgatcctgctgtggagggcttcatccgggacaagtatgagaagaagaagtacatggacaggagcctggacatcaatgccttcaggaaggagaaggatgacaagtggaagaggggcagcgagcctgtgcctgagaagaagctggagcctgtggtgtttgagaaggtgaagatgccccagaagaaggaggacccccagctgcccaggaagagcagccccaagagcacagcccctgtgatggacctgctgggcctggatgcccctgtggcctgcagcatcgccaacagcaagaccagcaacaccctggagaaggacctggacctgctggcctctgtgcccagccccagcagcagcggcagcaggaaggtggtgggctccatgcccacagctggcagcgctggctctgtgcctgagaacctgaacctcttccctgagcccggcagcaagtctgaggagatcggcaagaagcagctgagcaaggacagcatcctgagcctgtatggcagccagaccccccagatgcccacccaggccatgttcatggccccagcccagatggcctaccccacagcctaccccagcttccctggggtgaccccacccaacagcatcatgggctccatgatgcctcctcctgtgggcatggtggcccagcccggggccagcggcatggtggcccccatggccatgcctgctggctacatgggcggcatgcaggcctccatgatgggcgtgcccaacggcatgatgaccacccagcaggccggctacatggccggcatggccgccatgccccagacagtgtatggagtgcagcctgcccagcagctgcagtggaacctgacccagatgacccagcagatggccggcatgaacttctatggagccaacggcatgatgaactacggccagagcatgtctggaggaaatggccaggccgccaaccagaccctgagcccccagatgtggaagtag

SEQ ID NO: 169972 - DNA, 684 bp, Artificial Sequence
  Description of Artificial Sequence: Synthetic coding sequence
atgaccgggaagtctgtgaaggatgtggaccgctaccaggccgtgctggccaacctgctgctggaggaggacaacaagttctgtgccgactgccagagcaagggcccccgctgggcctcctggaacattggagtcttcatctgcatccgctgtgccggcatccacaggaacctgggcgtgcacatcagccgggtgaagtctgtgaacctggaccagtggacccaggagcagatccagtgcatgcaggagatgggaaatggcaaggccaaccggctgtatgaggcctacctgcctgagaccttccggcggccccagattgatcctgctgtggagggcttcatccgggacaagtatgagaagaagaagtacatggacaggagcctggacatcaatgccttcaggaaggagaaggatgacaagtggaagaggggcagcgagcctgtgcctgagaagaagctggagcctgtggtgtttgagaaggtgaagatgccccagaagaaggaggacccccagctgcccaggaagagcagccccaagagcacagcccctgtgatggacctgctgggcctggatgcccctgtggcctgcagcatcgccaacagcaagaccagcaacaccctggagaaggacctggacctgctggcctctgtgcccagccccagcagcagcggcagcaggaagtag

SEQ ID NO: 169973 - DNA, 1050 bp, Artificial Sequence
  Description of Artificial Sequence: Synthetic coding sequence
atgcaggagatgggaaatggcaaggccaaccggctgtatgaggcctacctgcctgagaccttccggcggccccagattgatcctgctgtggagggcttcatccgggacaagtatgagaagaagaagtacatggacaggagcctggacatcaatgccttcaggaaggagaaggatgacaagtggaagaggggcagcgagcctgtgcctgagaagaagctggagcctgtggtgtttgagaaggtgaagatgccccagaagaaggaggacccccagctgcccaggaagagcagccccaagagcacagcccctgtgatggacctgctgggcctggatgcccctgtggcctgcagcatcgccaacagcaagaccagcaacaccctggagaaggacctggacctgctggcctctgtgcccagccccagcagcagcggcagcaggaaggtggtgggctccatgcccacagctggcagcgctggctctgtgcctgagaacctgaacctcttccctgagcccggcagcaagtctgaggagatcggcaagaagcagctgagcaaggacagcatcctgagcctgtatggcagccagaccccccagatgcccacccaggccatgttcatggccccagcccagatggcctaccccacagcctaccccagcttccctggggtgaccccacccaacagcatcatgggctccatgatgcctcctcctgtgggcatggtggcccagcccggggccagcggcatggtggcccccatggccatgcctgctggctacatgggcggcatgcaggcctccatgatgggcgtgcccaacggcatgatgaccacccagcaggccggctacatggccggcatggccgccatgccccagacagtgtatggagtgcagcctgcccagcagctgcagtggaacctgacccagatgacccagcagatggccggcatgaacttctatggagccaacggcatgatgaactacggccagagcatgtctggaggaaatggccaggccgccaaccagaccctgagcccccagatgtggaagtag

SEQ ID NO: 169974 - DNA, 189 bp, Artificial Sequence
  Description of Artificial Sequence: Synthetic coding sequence
atggcccggggcaaccagcgggagctggcccggcagaagaacatgaagaagacccaggagatcagcaagggcaagaggaaggaggacagcctgacagccagccagaggaagcagagggacagcgagatcatgcaggagaagcagaaggccgccaatgagaagaagtccatgcagacccgggagaagtag

SEQ ID NO: 169975 - DNA, 333 bp, Artificial Sequence
  Description of Artificial Sequence: Synthetic coding sequence
atggcccggggcaaccagcgggagctggcccggcagaagaacatgaagaagacccaggagatcagcaagggcaagaggaaggaggacagcctgacagccagccagaggaagcagagcagcggcggccagaagtctgagagcaagatgtctgctggcccccacctgcccctgaaggccccccgggagaacccctgcttccccctgcctgctgctgggggcagccgctactacctggcctacggcagcatcacccccatcagcgcctttgtgtttgtggtgttcttcagcgtcttcttccccagcttctatgaggacttctgctgctggatctag

SEQ ID NO: 169976 - DNA, 147 bp, Artificial Sequence
  Description of Artificial Sequence: Synthetic coding sequence
atgaagaagacccaggagatcagcaagggcaagaggaaggaggacagcctgacagccagccagaggaagcagagggacagcgagatcatgcaggagaagcagaaggccgccaatgagaagaagtccatgcagacccgggagaagtag

SEQ ID NO: 169977 - DNA, 63 bp, Artificial Sequence
  Description of Artificial Sequence: Synthetic coding sequence
atgaagaagacccaggagatcagcaagggcaagaggaaggaggacagcctgacagccagctag

SEQ ID NO: 169978 - DNA, 291 bp, Artificial Sequence
  Description of Artificial Sequence: Synthetic coding sequence
atgaagaagacccaggagatcagcaagggcaagaggaaggaggacagcctgacagccagccagaggaagcagagcagcggcggccagaagtctgagagcaagatgtctgctggcccccacctgcccctgaaggccccccgggagaacccctgcttccccctgcctgctgctgggggcagccgctactacctggcctacggcagcatcacccccatcagcgcctttgtgtttgtggtgttcttcagcgtcttcttccccagcttctatgaggacttctgctgctggatctag

SEQ ID NO: 169979 - DNA, 270 bp, Artificial Sequence
  Description of Artificial Sequence: Synthetic coding sequence
atgaagaagacccaggagatcagcaagggcaagaggaaggaggacagcctgacagccagccagaggaagcagagcagcggcggccagaagtctgagagcaagatgtctgctggcccccacctgcccctgaaggccccccgggagaacccctgcttccccctgcctgctgctgggggcagccgctactacctggcctacggcagcatcacccccatcagcgcctttgtgtttgtggtgttcttcagcgtcttcttccccagcttctactag

SEQ ID NO: 169980 - DNA, 3156 bp, Artificial Sequence
  Description of Artificial Sequence: Synthetic coding sequence
atgggcagcgcagaagatgctgtgaaggagaagctgctgtggaatgtgaagaaggaggtgaagcagatcatggaggaggccgtgaccaggaagtttgtgcatgaggacagcagccacatcatcgccctgtgtggggctgtggaggcctgcctgctgcaccagctgcggaggagagctgctggcttcctgcggagtgacaagatggccgccctcttcaccaaggtgggcaagacctgccctgtggccggggagatctgccacaaggtgcaggagctgcagcagcaggccgagggcaggaagcccagcggcgtgtcccaggaggccctgcggcggcagggcagcgccagcggcaaggccccagccctgagcccccaggccctgaagcacgtgtgggtgaggacagccctgattgagaaggtgctggacaaggtggtgcagtacctggccgagaactgcagcaagtactatgagaaggaggccctgctggccgaccctgtgtttggccccatcctggccagcctgctggtgggcccctgtgccctggagtacaccaagctgaagacagctgaccactactggacagaccccagcgcagatgagctggtgcagaggcaccgcatccggggcccccccacccggcaggacagccctgccaagaggcctgccctgggcatcaggaagaggcacagcagcggcagcgccagcgaggaccggctggccgcctgtgccagagaatgtgtggagagcctgcaccagaacagcaggacccggctgctgtatggcaagaaccacgtgctggtgcagcccaaggaggacatggaggccgtgcccggctacctgagcctgcaccagagcgctgagagcctgaccctgaagtggacccccaaccagctgatgaatggcaccctgggggacagcgagctggagaagtctgtgtactgggactatgccctggtggtgcccttcagccaggtggtgtgcatccactgccaccagcagaagagcggcggcaccctggtgctggtgtcccaggacggcatccagaggcctcccctgcacttcccccagggcggccacctgctgtccttcctgagctgcctggagaatggcctgctgccccggggccagctggagccccccctgtggacccagcagggcaagggcaaggtgttccccaagctgaggaagaggagcagcatccgctctgtggacatggaggagatgggcaccggccgggccacagattatgtgttccgcatcatctacccaggccacagacatgagcacatcaccatcaactaccaccacctggccgccagccgggccgcctctgtggatgatgatgaggaggaggaggacaagctgcacgccatgctgtccatgatctgcagcaggaacctgacagcccccaaccccatgaaggatgctggggacatgattgagatgcagggcttcggccccagcctgcctgcctggcacctggagcccctgtgcagccagggcagcagctgcctgagctgcagcagcagcagcagcccccacgccacccccagccactgcagctgcatcccagaccggctgcccctgcggctgctgtgtgagagcatgaagaggcagatcgtgtcccgggccttctacggctggctggcccactgccgccacctgagcacagtgaggacccacctgagcgccctggtgcaccacagcgtcatccccccagaccggcccccaggggccagcgctggcctgaccaaggatgtgtggagcaagtaccagaaggacaagaagaactacaaggagctggagctgctgcggcaggtgtactatggaggcatcgagcacgagatcaggaaggatgtgtggcccttcctgctgggccactacaagtttggcatgagcaagaaggagatggagcaggtggatgctgtggtggccgcccgctaccagcaggtgctggccgagtggaaggcctgtgaggtggtggtgcggcagcgggagcgggaggcccacccagccaccaggaccaagttcagcagcggcagcagcattgacagccacgtgcagaggctcatccaccgggacagcaccatcagcaatgatgtgttcatctctgtggatgacctggagcccccagagccccaggaccctgaggacagccggcccaagccagagcaggaggccggccctggcaccccaggcacagctgtggtggagcagcagcacagcgtggagtttgacagcccagacagcggcctgcccagcagcaggaactacagcgtggccagcggcatccagagcagcctggatgagggccagagcgtgggctttgaggaggaggatggcggcggggaggagggcagcagcggccctggccctgctgcccacaccctgcgggagccccaggaccccagccaggagaagccccaggccggggagctggaggccggggaggagctggccgctgtgtgtgccgccgcctacaccatcgagctgctggacacagtggccctgaacctgcacagaattgacaaggatgtgcagagatgtgacaggaactactggtacttcaccccacccaacctggagcggctgagagatgtgatgtgcagctatgtgtgggagcacctggatgtgggctacgtgcagggcatgtgtgacctgctggcccccctgctggtgaccctggacaatgaccagctggcctacagctgcttcagccacctgatgaagaggatgagccagaacttccccaacggcggggccatggacacccactttgccaacatgaggagcctcatccagatcctggacagcgagctgtttgagctgatgcaccagaatggagactacacccacttctacttctgctaccgctggttcctgctggacttcaagcgggagctgctgtatgaagatgtgtttgctgtgtgggaggtgatctgggccgcccggcacatcagcagcgagcactttgtgctcttcatcgccctggccctggtggaggcctaccgggagatcatccgggacaacaacatggacttcacagacatcatcaagttcttcaatgaaagagctgagcaccatgatgcccaggagatcctgcgcatcgcccgggacctggtgcacaaggtgcagatgctgattgagaacaagtag

SEQ ID NO: 169981 - DNA, 3021 bp, Artificial Sequence
  Description of Artificial Sequence: Synthetic coding sequence
atgggcagcgcagaagatgctgtgaaggagaagctgctgtggaatgtgaagaaggaggtgaagcagatcatggaggaggccgtgaccaggaagtttgtgcatgaggacagcagccacatcatcgccctgtgtggggctgtggaggcctgcctgctgcaccagctgcggaggagagctgctggcttcctgcggagtgacaagatggccgccctcttcaccaaggtgggcaagacctgccctgtggccggggagatctgccacaaggtgcaggagctgcagcagcaggccgagggcaggaagcccagcggcgtgtcccaggaggccctgcggcggcagggcagcgccagcggcaaggccccagccctgagcccccaggccctgaagcacgtgtgggtgaggacagccctgattgagaaggtgctggacaaggtggtgcagtacctggccgagaactgcagcaagtactatgagaaggaggccctgctggccgaccctgtgtttggccccatcctggccagcctgctggtgggcccctgtgccctggagtacaccaagctgaagacagctgaccactactggacagaccccagcgcagatgagctggtgcagaggcaccgcatccggggcccccccacccggcaggacagccctgccaagaggcctgccctgggcatcaggaagaggcacagcagcggcagcgccagcgaggaccggctggccgcctgtgccagagaatgtgtggagagcctgcaccagaacagcaggacccggctgctgtatggcaagaaccacgtgctggtgcagcccaaggaggacatggaggccgtgcccggctacctgagcctgcaccagagcgctgagagcctgaccctgaagtggacccccaaccagctgatgaatggcaccctgggggacagcgagctggagaagtctgtgtactgggactatgccctggtggtgcccttcagccaggtggtgtgcatccactgccaccagcagaagagcggcggcaccctggtgctggtgtcccaggacggcatccagaggcctcccctgcacttcccccagggcggccacctgctgtccttcctgagctgcctggagaatggcctgctgccccggggccagctggagccccccctgtggacccagcagggcaagggcaaggtgttccccaagctgaggaagaggagcagcatccgctctgtggacatggaggagatgggcaccggccgggccacagattatgtgttccgcatcatctacccaggccacagacatgagcacaatgctggggacatgattgagatgcagggcttcggccccagcctgcctgcctggcacctggagcccctgtgcagccagggcagcagctgcctgagctgcagcagcagcagcagcccccacgccacccccagccactgcagctgcatcccagaccggctgcccctgcggctgctgtgtgagagcatgaagaggcagatcgtgtcccgggccttctacggctggctggcccactgccgccacctgagcacagtgaggacccacctgagcgccctggtgcaccacagcgtcatccccccagacaggcctcctggggccagcgctggcctgaccaaggatgtgtggagcaagtaccagaaggacaagaagaactacaaggagctggagctgctgcggcaggtgtactacggcggcattgaacatgagatcaggaaggatgtgtggcccttcctgctgggccactacaagtttggcatgagcaagaaggagatggagcaggtggatgctgtggtggccgcccgctaccagcaggtgctggccgagtggaaggcctgtgaggtggtggtgcggcagcgggagcgggaggcccacccagccaccaggaccaagttcagcagcggcagcagcattgacagccacgtgcagaggctcatccaccgggacagcaccatcagcaatgatgtgttcatctctgtggatgacctggagcccccagagccccaggaccctgaggacagccggcccaagccagagcaggaggccggccctggcaccccaggcacagctgtggtggagcagcagcacagcgtggagtttgacagcccagattctggcctgcccagcagcaggaactacagcgtggccagcggcatccagagcagcctggatgagggccagagcgtgggctttgaggaggaggatggcggcggggaggagggcagcagcggccctggccctgctgcccacaccctgcgggagccccaggaccccagccaggagaagccccaggccggggagctggaggccggggaggagctggccgctgtgtgtgccgccgcctacaccatcgagctgctggacacagtggccctgaacctgcacagaattgacaaggatgtgcagagatgtgacaggaactactggtacttcaccccacccaacctggagcggctgagagatgtgatgtgcagctatgtgtgggagcacctggatgtgggctacgtgcagggcatgtgtgacctgctggcccccctgctggtgaccctggacaatgaccagctggcctacagctgcttcagccacctgatgaagaggatgagccagaacttccccaatggaggagccatggacacccactttgccaacatgaggagcctcatccagatcctggacagcgagctgtttgagctgatgcaccagaatggagactacacccacttctacttctgctaccgctggttcctgctggacttcaagcgggagctgctgtatgaagatgtgtttgctgtgtgggaggtgatctgggccgcccggcacatcagcagcgagcactttgtgctcttcatcgccctggccctggtggaggcctaccgggagatcatccgggacaacaacatggacttcacagacatcatcaagttcttcaatgaaagagctgagcaccatgatgcccaggagatcctgagaattgcccgggacctggtgcacaaggtgcagatgctgattgagaacaagtag

SEQ ID NO: 169982 - DNA, 795 bp, Artificial Sequence
  Description of Artificial Sequence: Synthetic coding sequence
atgtgccacaagaatggcttcccccaggagggcggcatcacagctgccttcctgcagaagaggaagctgcggctgagcaagaaccacaggcctgcccgggccaaggtgacagaacatgtgcggggcaccaggcctggccgggccacagctggccctgctgccagcaccagggctgctggcagcctcttctttgaccgctggggcaacagaggccctgctggctgccggggcagcagccacctgccccagcagctgaagttcaccaccagtgacagctgtgaccgcatcaaggatgagttccagctgctgcaggcccagtaccacagcctgaagctggagtgtgacaagctggccagcgagaagtctgagatgcagaggcactacgtgatgtactatgagatgtcctatggcctgaacatcgagatgcacaagcaggccgagatcgtgaagaggctgaatggcatctgtgcccaggtgctgccctacctgagccaggagcaccagcagcaggtgctgggcgccatcgagcgggccaagcaggtgacagcccctgagctgaacagcatcatccggcagcagctgcaggcccaccagctgagccagctgcaggccctggccctgcccctgacccccctgcctgtgggcctgcagccccccagcctgcctgctgtgtctgctggcaccggcctgctgagcctgagcgccctgggcagccaggcccacctgagcaaagaagacaagaatggacatgatggagacacccaccaggaggatgatggagagaagagtgactag

SEQ ID NO: 169983 - DNA, 267 bp, Artificial Sequence
  Description of Artificial Sequence: Synthetic coding sequence
atgaacatgagcaagcagcctgtgtccaatgtgcgggccatccaggccaacatcaacatccccatgggcgccttccggcctggagctggccagccccccaggaggaaagaatgtaccccagaggtggaggagggcgtgccccccaccagtgatgaggagaagaagcccatccctggggccaagaagctgcccggccctgctgtgaacctgtctgagatccagaacatcaagtctgagctgaagtatgtgcccaaggccgagcagtag

SEQ ID NO: 169984 - DNA, 6411 bp, Artificial Sequence
  Description of Artificial Sequence: Synthetic coding sequence
atggctgatgtgacagcccggagcctgcagtatgagtacaaggccaacagcaacctggtgctgcaggccgacaggagcctgattgacaggaccaggagagatgagcccactggagaggtgctgagcctggtgggcaagctggagggcaccaggatgggagacaaggcccagaggaccaagccccagatgcaggaggagcggcgggccaagaggaggaagagagatgaggacagacatgacatcaacaagatgaagggctacaccctgctgtctgagggcattgatgagatggtgggcatcatctacaagcccaagaccaaggagacccgggagacctatgaggtgctgctgtccttcatccaggccgccctgggggaccagccccgggacatcctgtgtggggctgctgatgaggtgctggccgtgctgaagaatgagaagctgcgggacaaggagaggaggaaggagattgacctgctgctgggccagacagatgacacccgctaccacgtgctggtgaacctgggcaagaagatcacagattatggaggagacaaggagatccagaacatggatgacaacattgatgagacctatggagtgaatgtgcagtttgaaagtgatgaggaggagggagatgaagatgtgtatggagaggtgcgggaggaggccagtgatgatgacatggagggagatgaggccgtggtgcgctgcaccctgagcgccaacctggtggccagcggggagctgatgagcagcaagaagaaggacctgcacccccgggacattgatgccttctggctgcagaggcagctgagccgcttctatgatgatgccatcgtgtcccagaagaaggcagatgaggtgctggagatcctgaagacagccagtgatgacagagaatgtgagaaccagctggtgctgctgctgggcttcaacacctttgacttcatcaaggtgctgcggcagcacaggatgatgatcctgtactgcaccctgctggccagcgcccagagcgaggccgagaaggagcgcatcatgggcaagatggaggccgaccctgagctgagcaagttcctgtaccagctgcacgagacagagaaggaggacctgatccgggaggagaggagccggcgggagcgggtgcggcagagcaggatggacacagacctggagaccatggacctggaccagggcggggaggccctggccccccggcaggtgctggacctggaggacctggtgttcacccagggcagccacttcatggccaacaagcgctgccagctgcctgatggcagcttccggcggcagaggaagggctatgaggaggtgcacgtgcctgccctgaagcccaagccctttggaagtgaggagcagctgctgcctgtggagaagctgcccaagtatgcccaggccggctttgagggcttcaagaccctgaaccgcatccagagcaagctgtacagagctgccctggagacagatgagaacctgctgctgtgtgcccccactggagctgggaagaccaacgtggccctgatgtgcatgctgcgggagatcggcaagcacatcaacatggatggcaccatcaacgtggatgacttcaagatcatctacatcgcccccatgaggagcctggtgcaggagatggtgggcagctttgggaagaggctggccacctacggcatcaccgtggccgagctgaccggggaccaccagctgtgcaaggaggagatcagcgccacccagatcatcgtgtgcaccccagagaagtgggacatcatcaccaggaaaggaggagagaggacctacacccagctggtgcggctcatcatcctggatgagatccacctgctgcatgatgaccggggccctgtgctggaggccctggtggcccgggccatcagaaatattgagatgacccaggaggatgtgcggctgattggcctgagcgccaccctgcccaactatgaagatgtggccaccttcctgcgggtggaccctgccaagggcctcttctactttgacaacagcttccggcctgtgcccctggagcagacctacgtgggcatcacagagaagaaggccatcaagcgcttccagatcatgaatgaaattgtgtatgagaagatcatggagcacgccggcaagaaccaggtgctggtgtttgtgcacagcaggaaggagaccgggaagacagcccgggccatccgggacatgtgcctggagaaggacaccctgggcctcttcctgcgggagggcagcgccagcacagaggtgctgaggacagaggccgagcagtgcaagaacctggagctgaaggacctgctgccctacggctttgccatccaccacgccggcatgaccagggtggacaggaccctggtggaggacctgtttgctgacaagcacatccaggtgctggtgtccacagccaccctggcctggggcgtgaacctgcctgcccacacagtcatcatcaagggcacccaggtgtacagccctgagaagggccgctggacagagctgggcgccctggacatcctgcagatgctgggccgggccggccggccccagtatgacaccaagggggagggcatcctgatcaccagccatggagagctgcagtactacctgagcctgctgaaccagcagctgcccatcgagagccagatggtgtccaagctgcctgacatgctgaatgctgagatcgtgctgggcaatgtgcagaatgccaaggatgctgtgaactggctgggctacgcctacctgtacatccgcatgctgcggagccccaccctgtatggcatcagccatgatgacctgaagggggaccccctgctggaccagaggcggctggacctggtgcacacagctgccctgatgctggacaagaacaacctggtgaagtatgacaagaagacaggcaacttccaggtgacagagctgggcagaattgccagccactactacatcaccaatgacacagtgcagacctacaaccagctgctgaagcccaccctgtctgaaattgagctgttccgggtcttcagcctgagcagcgagttcaagaacatcaccgtgcgggaggaggagaagctggagctgcagaagctgctggagcgggtgcccatccctgtgaaggagagcattgaggagcccagcgccaagatcaacgtgctgctgcaggccttcatcagccagctgaagctggagggctttgccctgatggctgacatggtgtatgtgacccagagcgctggccgcctgatgagggccatctttgagatcgtgctgaacagaggctgggcccagctgacagacaagaccctgaacctgtgcaagatgattgacaagaggatgtggcagagcatgtgccccctgcggcagttcaggaagctgcctgaggaggtggtgaagaagattgagaagaagaacttcccctttgagcggctgtatgacctgaaccacaatgaaattggagagctgatccgcatgcccaagatgggcaagaccatccacaagtatgtgcacctgttccccaagctggagctgtctgtgcacctgcagcccatcaccaggagcaccctgaaggtggagctgaccatcaccccagacttccagtgggatgagaaggtgcacggcagcagcgaggccttctggatcctggtggaggatgtggacagcgaggtgatcctgcaccacgagtacttcctgctgaaggccaagtatgcccaggatgagcacctgatcaccttctttgtgcctgtgtttgagcccctgcccccccagtacttcatccgggtggtgtctgaccgctggctgagctgtgagacccagctgcctgtgtccttccgccacctgatcctgcctgagaagtaccccccacccacagagctgctggacctgcagcccctgcctgtgtctgccctgagaaattctgcctttgagagcctgtaccaggacaagttccccttcttcaaccccatccagacccaggtgttcaacacagtgtacaacagtgatgacaacgtgtttgtgggcgcccccaccggcagcggcaagaccatctgtgccgagtttgccatcctgaggatgctgctgcagagcagcgagggccgctgtgtgtacatcacccccatggaggccctggccgagcaggtgtacatggactggtatgagaagttccaggaccggctgaacaagaaggtggtgctgctgactggagagaccagcacagacctgaagctgctgggcaaaggaaacatcatcatcagcaccccagagaagtgggacatcctgagccgccgctggaagcagaggaagaatgtgcagaacatcaacctgtttgtggtggatgaggtgcacctgattggaggagaaaatggacctgtgctggaggtgatctgcagcaggatgagatacatcagcagccagatcgagcggcccatcagaattgtggccctgagcagcagcctgagcaatgccaaggatgtggcccactggctgggctgcagcgccaccagcaccttcaacttccaccccaacgtgcggcctgtgcccctggagctgcacatccagggcttcaacatcagccacacccagacccggctgctgtccatggccaagcctgtgtaccacgccatcaccaagcacagccccaagaagcctgtgattgtgtttgtgcccagcaggaagcagacccggctgacagccatcgacatcctgaccacctgtgccgctgacatccagaggcagcgcttcctgcactgcacagagaaggacctgatcccctacctggagaagctgagtgacagcaccctgaaggagaccctgctgaatggagtgggctacctgcacgagggcctgagccccatggagcggcggctggtggagcagctgttcagcagcggggccatccaggtggtggtggccagccgcagcctgtgctggggcatgaatgtggccgcccacctggtgatcatcatggacacccagtactacaacgggaagatccacgcctacgtggactaccccatctatgatgtgctgcagatggtgggccacgccaaccggcccctgcaggatgatgagggccgctgcgtcatcatgtgccagggcagcaagaaggacttcttcaagaagttcctgtatgagcccctgcctgtggagagccacctggaccactgcatgcatgaccacttcaatgctgagatcgtgaccaagaccatcgagaacaagcaggatgctgtggactacctgacctggaccttcctgtacagaaggatgacccagaaccccaactactacaacctgcagggcatcagccaccgccacctgagtgaccacctgtctgagctggtggagcagaccctgagtgacctggagcagagcaagtgcatcagcattgaagatgagatggatgtggcccccctgaacctgggcatgattgctgcctactactacatcaactacaccaccatcgagctgttctccatgagcctgaatgccaagaccaaggtgcggggcctcatcgagatcatcagcaatgctgctgaatatgagaacatccccatccgccaccacgaggacaacctgctgcggcagctggcccagaaggtgccccacaagctgaacaaccccaagttcaatgacccccacgtgaagaccaacctgctgctgcaggcccacctgagcaggatgcagctgtctgctgagctgcagagcgacacagaggagatcctgagcaaggccatccgcctcatccaggcctgtgtggatgtgctgagcagcaatggctggctgagccctgccctggccgccatggagctggcccagatggtgacccaggccatgtggagcaaggacagctacctgaagcagctgccccacttcaccagcgagcacatcaagcgctgcacagacaagggcgtggagagcgtgtttgacatcatggagatggaggatgaggagagaaatgccctgctgcagctgacagacagccagattgctgatgtggcccgcttctgcaaccgctaccccaacatcgagctgtcctatgaggtggtggacaaggacagcatccgcagcggcggccctgtggtggtgctggtgcagctggagcgggaggaggaggtgacaggccctgtgattgcccccctcttcccccagaagcgggaggagggctggtgggtggtgattggagatgccaagagcaacagcctcatcagcatcaagaggctgaccctgcagcagaaggccaaggtgaagctggactttgtggccccagccactggagcccacaactacaccctgtacttcatgtctgatgcctacatgggctgtgaccaggagtacaagttctctgtggatgtgaaggaggccgagacagacagcgacagcgactag

SEQ ID NO: 169985 - DNA, 1878 bp, Artificial Sequence
  Description of Artificial Sequence: Synthetic coding sequence
atggctgatgtgacagcccggagcctgcagtatgagtacaaggccaacagcaacctggtgctgcaggccgacaggagcctgattgacaggaccaggagagatgagcccactggagaggtgctgagcctggtgggcaagctggagggcaccaggatgggagacaaggcccagaggaccaagccccagatgcaggaggagcggcgggccaagaggaggaagagagatgaggacagacatgacatcaacaagatgaagggctacaccctgctgtctgagggcattgatgagatggtgggcatcatctacaagcccaagaccaaggagacccgggagacctatgaggtgctgctgtccttcatccaggccgccctgggggaccagccccgggacatcctgtgtggggctgctgatgaggtgctggccgtgctgaagaatgagaagctgcgggacaaggagaggaggaaggagattgacctgctgctgggccagacagatgacacccgctaccacgtgctggtgaacctgggcaagaagatcacagattatggaggagacaaggagatccagaacatggatgacaacattgatgagacctatggagtgaatgtgcagtttgaaagtgatgaggaggagggagatgaagatgtgtatggagaggtgcgggaggaggccagtgatgatgacatggagggagatgaggccgtggtgcgctgcaccctgagcgccaacctggtggccagcggggagctgatgagcagcaagaagaaggacctgcacccccgggacattgatgccttctggctgcagaggcagctgagccgcttctatgatgatgccatcgtgtcccagaagaaggcagatgaggtgctggagatcctgaagacagccagtgatgacagagaatgtgagaaccagctggtgctgctgctgggcttcaacacctttgacttcatcaaggtgctgcggcagcacaggatgatgatcctgtactgcaccctgctggccagcgcccagagcgaggccgagaaggagcgcatcatgggcaagatggaggccgaccctgagctgagcaagttcctgtaccagctgcacgagacagagaaggaggacctgatccgggaggagaggagccggcgggagcgggtgcggcagagcaggatggacacagacctggagaccatggacctggaccagggcggggaggccctggccccccggcaggtgctggacctggaggacctggtgttcacccagggcagccacttcatggccaacaagcgctgccagctgcctgatggcagcttccggcggcagaggaagggctatgaggaggtgcacgtgcctgccctgaagcccaagccctttggaagtgaggagcagctgctgcctgtggagaagctgcccaagtatgcccaggccggctttgagggcttcaagaccctgaaccgcatccagagcaagctgtacagagctgccctggagacagatgagaacctgctgctgtgtgcccccactggagctgggaagaccaacgtggccctgatgtgcatgctgcgggagatcggcaagcacatcaacatggatggcaccatcaacgtggatgacttcaagatcatctacatcgcccccatgaggagcctggtgcaggagatggtgggcagctttgggaagagagatgccaagagcaacagcctcatcagcatcaagaggctgaccctgcagcagaaggccaaggtgaagctggactttgtggccccagccaccggggcccacaactacaccctgtacttcatgtctgatgcctacatgggctgtgaccaggagtacaagttctctgtggatgtgaaggaggccgagacagacagcgacagcgactag

SEQ ID NO: 169986 - DNA, 1788 bp, Artificial Sequence
  Description of Artificial Sequence: Synthetic coding sequence
atgagatacatcagcagccagatcgagcggcccatccgcatcgtggccctgagcagcagcctgagcaatgccaaggatgtggcccactggctgggctgcagcgccaccagcaccttcaacttccaccccaacgtgcggcctgtgcccctggagctgcacatccagggcttcaacatcagccacacccagacccggctgctgtccatggccaagcctgtgtaccacgccatcaccaagcacagccccaagaagcctgtgattgtgtttgtgcccagcaggaagcagacccggctgacagccatcgacatcctgaccacctgtgccgctgacatccagaggcagcgcttcctgcactgcacagagaaggacctgatcccctacctggagaagctgagtgacagcaccctgaaggagaccctgctgaatggagtgggctacctgcacgagggcctgagccccatggagcggcggctggtggagcagctgttcagcagcggggccatccaggtggtggtggccagccgcagcctgtgctggggcatgaatgtggccgcccacctggtgatcatcatggacacccagtactacaacgggaagatccacgcctacgtggactaccccatctatgatgtgctgcagatggtgggccacgccaaccggcccctgcaggatgatgagggccgctgtgtgatcatgtgccagggcagcaagaaggacttcttcaagaagttcctgtatgagcccctgcctgtggagagccacctggaccactgcatgcatgaccacttcaatgctgagatcgtgaccaagaccatcgagaacaagcaggatgctgtggactacctgacctggaccttcctgtacagaaggatgacccagaaccccaactactacaacctgcagggcatcagccaccgccacctgagtgaccacctgtctgagctggtggagcagaccctgagtgacctggagcagagcaagtgcatcagcattgaagatgagatggatgtggcccccctgaacctgggcatgattgctgcctactactacatcaactacaccaccatcgagctgttctccatgagcctgaatgccaagaccaaggtgcggggcctgattgagatcatcagcaatgctgctgaatatgagaacatccccatccgccaccacgaggacaacctgctgcggcagctggcccagaaggtgccccacaagctgaacaaccccaagttcaatgacccccacgtgaagaccaacctgctgctgcaggcccacctgagcaggatgcagctgtctgctgagctgcagagcgacacagaggagatcctgagcaaggccatccgcctcatccaggcctgtgtggatgtgctgagcagcaatggctggctgagccctgccctggccgccatggagctggcccagatggtgacccaggccatgtggagcaaggacagctacctgaagcagctgccccacttcaccagcgagcacatcaagcgctgcacagacaagggcgtggagagcgtgtttgacatcatggagatggaggatgaggagagaaatgccctgctgcagctgacagacagccagattgctgatgtggcccgcttctgcaaccgctaccccaacatcgagctgtcctatgaggtggtggacaaggacagcatccgcagcggcggccctgtggtggtgctggtgcagctggagcgggaggaggaggtgactggacctgtgattgcccccctcttcccccagttccgggccggccgcagcggcagccggctgtag

SEQ ID NO: 169987 - DNA, 1788 bp, Artificial Sequence
  Description of Artificial Sequence: Synthetic coding sequence
atggccaagcctgtgtaccacgccatcaccaagcacagccccaagaagcctgtgattgtgtttgtgcccagcaggaagcagacccggctgacagccatcgacatcctgaccacctgtgccgctgacatccagaggcagcgcttcctgcactgcacagagaaggacctgatcccctacctggagaagctgagtgacagcaccctgaaggagaccctgctgaatggagtgggctacctgcacgagggcctgagccccatggagcggcggctggtggagcagctgttcagcagcggggccatccaggtggtggtggccagccgcagcctgtgctggggcatgaatgtggccgcccacctggtgatcatcatggacacccagtactacaacgggaagatccacgcctacgtggactaccccatctatgatgtgctgcagatggtgggccacgccaaccggcccctgcaggatgatgagggccgctgtgtgatcatgtgccagggcagcaagaaggacttcttcaagaagttcctgtatgagcccctgcctgtggagagccacctggaccactgcatgcatgaccacttcaatgctgagatcgtgaccaagaccatcgagaacaagcaggatgctgtggactacctgacctggaccttcctgtacagaaggatgacccagaaccccaactactacaacctgcagggcatcagccaccgccacctgagtgaccacctgtctgagctggtggagcagaccctgagtgacctggagcagagcaagtgcatcagcattgaagatgagatggatgtggcccccctgaacctgggcatgattgctgcctactactacatcaactacaccaccatcgagctgttctccatgagcctgaatgccaagaccaaggtgcggggcctgattgagatcatcagcaatgctgctgaatatgagaacatccccatccgccaccacgaggacaacctgctgcggcagctggcccagaaggtgccccacaagctgaacaaccccaagttcaatgacccccacgtgaagaccaacctgctgctgcaggcccacctgagcaggatgcagctgtctgctgagctgcagagcgacacagaggagatcctgagcaaggccatccgcctcatccaggcctgtgtggatgtgctgagcagcaatggctggctgagccctgccctggccgccatggagctggcccagatggtgacccaggccatgtggagcaaggacagctacctgaagcagctgccccacttcaccagcgagcacatcaagcgctgcacagacaagggcgtggagagcgtgtttgacatcatggagatggaggatgaggagagaaatgccctgctgcagctgacagacagccagattgctgatgtggcccgcttctgcaaccgctaccccaacatcgagctgtcctatgaggtggtggacaaggacagcatccgcagcggcggccctgtggtggtgctggtgcagctggagcgggaggaggaggtgactggacctgtgattgcccccctcttcccccagaagcgggaggagggctggtgggtggtgattggagatgccaagagcaacagcctcatcagcatcaagaggctgaccctgcagcagaaggccaaggtgaagctggactttgtggccccagccaccggggcccacaactacaccctgtacttcatgtctgatgcctacatgggctgtgaccaggagtacaagttctctgtggatgtgaaggaggccgagacagacagcgacagcgactag

SEQ ID NO: 169988 - DNA, 2325 bp, Artificial Sequence
  Description of Artificial Sequence: Synthetic coding sequence
atgatgatcctgtactgcaccctgctggccagcgcccagagcgaggccgagaaggagcgcatcatgggcaagatggaggccgaccctgagctgagcaagttcctgtaccagctgcatgaaacagagaaggaggacctgatccgggaggagaggagcagaagagagcgggtgcggcagagcaggatggacacagacctggagaccatggacctggaccagggcggggaggccctggccccccggcaggtgctggacctggaggacctggtgttcacccagggcagccacttcatggccaacaagcgctgccagctgcctgatggcagcttccggcggcagaggaagggctatgaggaggtgcacgtgcctgccctgaagcccaagcccttcggcagcgaggagcagctgctgcctgtggagaagctgcccaagtatgcccaggccggctttgagggcttcaagaccctgaaccgcatccagagcaagctgtaccgggccgccctggagacagatgagaacctgctgctgtgtgcccccaccggggccggcaagaccaacgtggccctgatgtgcatgctgcgggagatcggcaagcacatcaacatggatggcaccatcaacgtggatgacttcaagatcatctacatcgcccccatgaggagcctggtgcaggagatggtgggcagctttgggaagaggctggccacctacggcatcaccgtggccgagctgactggagaccaccagctgtgcaaggaggagatcagcgccacccagatcatcgtgtgcaccccagagaagtgggacatcatcaccaggaagggcggggagaggacctacacccagctggtgcggctcatcatcctggatgagatccacctgctgcatgatgaccggggccctgtgctggaggccctggtggcccgggccatccggaacatcgagatgacccaggaggatgtgcggctcatcggcctgagcgccaccctgcccaactatgaagatgtggccaccttcctgcgggtggaccctgccaagggcctcttctactttgacaacagcttccggcctgtgcccctggagcagacctacgtgggcatcacagagaagaaggccatcaagcgcttccagatcatgaatgagatcgtgtatgagaagatcatggagcacgccggcaagaaccaggtgctggtgtttgtgcacagcaggaaggagaccgggaagacagcccgggccatccgggacatgtgcctggagaaggacaccctgggcctcttcctgcgggagggcagcgccagcacagaggtgctgaggacagaagctgagcagtgcaagaacctggagctgaaggacctgctgccctacggctttgccatccaccacgccggcatgaccagggtggacaggaccctggtggaggacctgtttgctgacaagcacatccaggtgctggtgtccacagccaccctggcctggggcgtgaacctgcctgcccacacagtcatcatcaagggcacccaggtgtacagccctgagaagggccgctggacagagctgggcgccctggacatcctgcagatgctgggccgggccggccggccccagtatgacaccaagggggagggcatcctgatcaccagccacggggagctgcagtactacctgagcctgctgaaccagcagctgcccatcgagagccagatggtgtccaagctgcctgacatgctgaatgctgagatcgtgctgggcaatgtgcagaatgccaaggatgctgtgaactggctgggctacgcctacctgtacatccgcatgctgcggagccccaccctgtatggcatcagccatgatgacctgaagggggaccccctgctggaccagaggcggctggacctggtgcacacagctgccctgatgctggacaagaacaacctggtgaagtatgacaagaagacaggcaacttccaggtgacagagctgggccgcatcgccagccactactacatcaccaatgacacagtgcagacctacaaccagctgctgaagcccaccctgtctgaaattgagctgttccgggtcttcagcctgagcagcgagttcaagaacatcaccgtgcgggaggaggagaagctggagctgcagaagctgctggagcgggtgcccatccctgtgaaggagagcattgaggagcccagcgccaagatcaacgtgctgctgcaggccttcatcagccagctgaagctggagggctttgccctgatggctgacatggtgtatgtgacccagagcgctggccgcctgatgagggccatcctgaagctgtcctag

SEQ ID NO: 169989 - DNA, 2160 bp, Artificial Sequence
  Description of Artificial Sequence: Synthetic coding sequence
atgctgctgcagagcagcgagggccgctgtgtgtacatcacccccatggaggccctggccgagcaggtgtacatggactggtatgagaagttccaggaccggctgaacaagaaggtggtgctgctgactggagaaaatggacctgtgctggaggtgatctgcagcaggatgagatacatcagcagccagatcgagcggcccatccgcatcgtggccctgagcagcagcctgagcaatgccaaggatgtggcccactggctgggctgcagcgccaccagcaccttcaacttccaccccaacgtgcggcctgtgcccctggagctgcacatccagggcttcaacatcagccacacccagacccggctgctgtccatggccaagcctgtgtaccacgccatcaccaagcacagccccaagaagcctgtgattgtgtttgtgcccagcaggaagcagacccggctgacagccatcgacatcctgaccacctgtgccgctgacatccagaggcagcgcttcctgcactgcacagagaaggacctgatcccctacctggagaagctgagtgacagcaccctgaaggagaccctgctgaatggagtgggctacctgcacgagggcctgagccccatggagcggcggctggtggagcagctgttcagcagcggggccatccaggtggtggtggccagccgcagcctgtgctggggcatgaatgtggccgcccacctggtgatcatcatggacacccagtactacaacgggaagatccacgcctacgtggactaccccatctatgatgtgctgcagatggtgggccacgccaaccggcccctgcaggatgatgagggccgctgtgtgatcatgtgccagggcagcaagaaggacttcttcaagaagttcctgtatgagcccctgcctgtggagagccacctggaccactgcatgcatgaccacttcaatgctgagatcgtgaccaagaccatcgagaacaagcaggatgctgtggactacctgacctggaccttcctgtacagaaggatgacccagaaccccaactactacaacctgcagggcatcagccaccgccacctgagtgaccacctgtctgagctggtggagcagaccctgagtgacctggagcagagcaagtgcatcagcattgaagatgagatggatgtggcccccctgaacctgggcatgattgctgcctactactacatcaactacaccaccatcgagctgttctccatgagcctgaatgccaagaccaaggtgcggggcctgattgagatcatcagcaatgctgctgaatatgagaacatccccatccgccaccacgaggacaacctgctgcggcagctggcccagaaggtgccccacaagctgaacaaccccaagttcaatgacccccacgtgaagaccaacctgctgctgcaggcccacctgagcaggatgcagctgtctgctgagctgcagagcgacacagaggagatcctgagcaaggccatccgcctcatccaggcctgtgtggatgtgctgagcagcaatggctggctgagccctgccctggccgccatggagctggcccagatggtgacccaggccatgtggagcaaggacagctacctgaagcagctgccccacttcaccagcgagcacatcaagcgctgcacagacaagggcgtggagagcgtgtttgacatcatggagatggaggatgaggagagaaatgccctgctgcagctgacagacagccagattgctgatgtggcccgcttctgcaaccgctaccccaacatcgagctgtcctatgaggtggtggacaaggacagcatccgcagcggcggccctgtggtggtgctggtgcagctggagcgggaggaggaggtgactggacctgtgattgcccccctcttcccccagaagcgggaggagggctggtgggtggtgattggagatgccaagagcaacagcctcatcagcatcaagaggctgaccctgcagcagaaggccaaggtgaagctggactttgtggccccagccaccggggcccacaactacaccctgtacttcatgtctgatgcctacatgggctgtgaccaggagtacaagttctctgtggatgtgaaggaggccgagacagacagcgacagcgactag

SEQ ID NO: 169990 - DNA, 1074 bp, Artificial Sequence
  Description of Artificial Sequence: Synthetic coding sequence
atgattgagcagcagaagaggaagggccctgagctgcccctggtgcctgtgaagaggcagagacatgagctgctgctgggcgccggcagcggccctggggccggccagcagcaggccacccctggggccctgctgcaggccggccccccacgctgcagcagcctgcaggcccccatcatgctgctgagcggccatgaaggagaggtgtactgctgcaagttccaccccaacggcagcaccctggccagcgctggctttgacaggctcatcctgctgtggaatgtgtatggagactgtgacaactatgccaccctgaagggccacagcggggctgtgatggagctgcactacaacacagatggctccatgctgttcagcgccagcacagacaagacagtggccgtgtgggacagcgagaccggggagcgggtgaagaggctgaagggccacaccagctttgtgaacagctgctacccagcccggcggggcccccagctggtgtgcaccggcagtgatgatggcaccgtgaagctgtgggacatcaggaagaaggccgccatccagaccttccagaacacctaccaggtgctggccgtgaccttcaatgacaccagtgaccagatcatcagcggcggcatcgacaatgacatcaaggtgtgggacctgcggcagaacaagctgacctacaccatgaggggccatgctgacagcgtgacaggcctgagcctgagcagcgagggcagctacctgctgagcaatgccatggacaacacagtgcgggtgtgggatgtgcggccctttgcccccaaggagcgctgtgtgaagatcttccagggcaatgtgcacaactttgagaagaacctgctgcgctgctcctggagcccagatggcagcaagattgctgctggcagcgctgacagatttgtgtatgtgtgggacaccaccagccgccgcatcctgtacaagctgcccggccatgctggcagcatcaatgaggtggccttccacccagatgagcccatcatcatcagcgccagcagtgacaagaggctgtacatgggagagatccagtag

SEQ ID NO: 169991 - DNA, 384 bp, Artificial Sequence
  Description of Artificial Sequence: Synthetic coding sequence
atgatcctgatctctgctggctgccctgggggcctgtggcccatcgtggtgctggtgggcctcttcatctggatctgctttgctgtgcgggtgtgggatgtgcggccctttgcccccaaggagcgctgtgtgaagatcttccagggcaatgtgcacaactttgagaagaacctgctgcgctgctcctggagcccagatggcagcaagattgctgctggcagcgctgacagatttgtgtatgtgtgggacaccaccagccgccgcatcctgtacaagctgcccggccatgctggcagcatcaatgaggtggccttccacccagatgagcccatcatcatcagcgccagcagtgacaagaggctgtacatgggagagatccagtag

SEQ ID NO: 169992 - DNA, 1230 bp, Artificial Sequence
  Description of Artificial Sequence: Synthetic coding sequence
atgattgagcagcagaagaggaagggccctgagctgcccctggtgcctgtgaagaggcagagacatgagctgctgctgggcgccggcagcggccctggggccggccagcagcaggccacccctggggccctgctgcaggccggccccccacgctgcagcagcctgcaggcccccatcatgctgctgagcggccatgaaggagaggtgtactgctgcaagttccaccccaacggcagcaccctggccagcgctggctttgacaggctcatcctgctgtggaatgtgtatggagactgtgacaactatgccaccctgaagggccacagcggggctgtgatggagctgcactacaacacagatggctccatgctgttcagcgccagcacagacaagacagtggccgtgtgggacagcgagaccggggagcgggtgaagaggctgaagggccacaccagctttgtgaacagctgctacccagcccggcggggcccccagctggtgtgcaccggcagtgatgatggcaccgtgaagctgtgggacatcaggaagaaggccgccatccagaccttccagaacacctaccaggtgctggccgtgaccttcaatgacaccagtgaccagatcatcagcggcggcatcgacaatgacatcaaggtgtgggacctgcggcagaacaagctgacctacaccatgaggggccatgctgacagcgtgacaggcctgagcctgagcagcgagggcagctacctgctgagcaatgccatggacaacacagtgcgggtgtgggatgtgcggccctttgcccccaaggagcgctgtgtgaagatcttccagggcaatgtgcacaactttgagaagaacctgctgcgctgctcctggagcccagatggcagcaagattgctgctggcagcgctgacagatttgtgtatgtgtgggacaccaccagccgccgcatcctgtacaagctgcccggccatgctggcagcatcaatgaggtggccttccacccagatgagcccatcatcgagaccggcttccacagaattggccagggcggccacgagctgctgaccagcagcaaccccccagccagcgccagccagagcgctggcatcactggagtgagccactgtgcccagctgcagacagtgttcatgtgggtgtccatgtctgtgagccccctgctgatcagcggggagagcaagagcaatgcccccttcagcagctag

SEQ ID NO: 169993 - DNA, 849 bp, Artificial Sequence
  Description of Artificial Sequence: Synthetic coding sequence
atggctgtgcctgagacccggcccaaccacaccatctacatcaacaacctgaatgagaagatcaagaaggatgagctgaagaagagcctgtatgccatcttcagccagtttggccagatcctggacatcctggtgagccgcagcctgaagatgaggggccaggccttcgtcatcttcaaggaggtgagcagcgccaccaatgccctgcgctccatgcagggcttccccttctatgacaagcccatgaggatccagtatgccaagacagacagcgacatcatcgccaagatgaagggcacctttgtggagcgggacaggaagcgggagaagaggaagcccaagagccaggagaccccagccaccaagaaggctgtgcagggcggcggggccacccctgtggtgggcgctgtgcagggccctgtgcccggcatgccacccatgacccaggccccccgcatcatgcaccacatgcctggccagcccccctacatgcctcctcctggcatgatccccccacctggcctggcccctggccagatccccccaggggccatgccaccccagcagctgatgcctggccagatgcccccagcccagcccctgtctgaaaatccacccaaccacatcctcttcctgaccaacctgcctgaggagaccaatgagctgatgctgtccatgctgttcaaccagtttcctggcttcaaggaggtgcggctggtgcccggcagacatgacatcgcctttgtggagtttgacaatgaggtgcaggccggggccgccagagatgccctgcagggcttcaagatcacccagaacaatgccatgaagatcagctttgccaagaagtag

SEQ ID NO: 169994 - DNA, 612 bp, Artificial Sequence
  Description of Artificial Sequence: Synthetic coding sequence
atggctgtgcctgagacccggcccaaccacaccatctacatcatcgccaagatgaagggcacctttgtggagcgggacaggaagcgggagaagaggaagcccaagagccaggagaccccagccaccaagaaggctgtgcagggcggcggggccacccctgtggtgggcgctgtgcagggccctgtgcccggcatgccacccatgacccaggccccccgcatcatgcaccacatgcctggccagcccccctacatgcctcctcctggcatgatccccccacctggcctggcccctggccagatccccccaggggccatgccaccccagcagctgatgcctggccagatgcccccagcccagcccctgtctgagaacccccccaaccacatcctcttcctgaccaacctgcctgaggagaccaatgagctgatgctgtccatgctgttcaaccagtttcctggcttcaaggaggtgcggctggtgcccggcagacatgacatcgcctttgtggagtttgacaatgaggtgcaggccggggccgccagagatgccctgcagggcttcaagatcacccagaacaatgccatgaagatcagctttgccaagaagtag

SEQ ID NO: 169995 - DNA, 768 bp, Artificial Sequence
  Description of Artificial Sequence: Synthetic coding sequence
atggtgaagctgacagctgagctgattgagcaggccgcccagtacaccaatgctgtgcgggaccgggagctggacctgcggggctacaagatccctgtgattgagaacctgggcgccaccctggaccagtttgatgccatcgacttcagtgacaatgagatcaggaagctggatggcttccccctgctgcggcggctgaagaccctgctggtgaacaacaaccgcatctgcagaattggagagggcctggaccaggccctgccctgcctgacagagctgatcctgaccaacaacagcctggtggagctgggggacctggaccccctggccagcctgaagagcctgacctacctgagcatcctgaggaaccctgtgaccaacaagaagcactaccgcctgtatgtgatctacaaggtgccccaggtgcgggtgctggacttccagaaggtgaagctgaaggagcggcaggaggccgagaagatgttcaagggcaagagaggagcccagctggccaaggacatcgcccggcgcagcaagaccttcaaccctggagctggcctgcccacagacaagaagaagggcggccccagccctggagatgtggaggccatcaagaatgccatcgccaatgccagcaccctggccgaggtggagcggctgaagggcctgctgcagagcggccagatccctggccgggagcggcgcagcggccccacagatgatggagaggaggagatggaggaggacacagtgaccaacggcagctag

SEQ ID NO: 169996 - DNA, 480 bp, Artificial Sequence
  Description of Artificial Sequence: Synthetic coding sequence
atgcccaagttctactgtgactactgtgacacctacctgacccatgacagccccagcgtgaggaagacccactgcagcggcaggaagcacaaggaaaatgtgaaggactactaccagaagtggatggaggagcaggcccagagcctgattgacaagaccacagctgccttccagcagggcaagatcccccccacccccttcagcgcccctcctcctgctggggccatgatccccccaccacccagcctgcccggcccccccaggcctggcatgatgcctgccccccacatgggcggcccccccatgatgcccatgatgggccccccacctcctggcatgatgcctgtgggccctgcccctggcatgaggcctcccatgggcggccacatgcccatgatgcctggcccccccatgatgaggcccccagcccggcccatgatggtgcccacccggcccggcatgaccaggccagacagatag

SEQ ID NO: 169997 - DNA, 543 bp, Artificial Sequence
  Description of Artificial Sequence: Synthetic coding sequence
atgaacagcgcctctgtggatggccacctgagcggctgccgcctcttcctgttcctgagccccctcttccgcttctactgtgactactgtgacacctacctgacccatgacagccccagcgtgaggaagacccactgcagcggcaggaagcacaaggaaaatgtgaaggactactaccagaagtggatggaggagcaggcccagagcctgattgacaagaccacagctgccttccagcagggcaagatcccccccacccccttcagcgcccctcctcctgctggggccatgatccccccaccacccagcctgcccggccccccccggcccggcatgatgcctgccccccacatgggcggcccccccatgatgcccatgatgggccccccacctcctggcatgatgcctgtgggccctgcccctggcatgaggcctcccatgggcggccacatgcccatgatgcctggcccccccatgatgaggcccccagcccggcccatgatggtgcccaccaggcctggcatgaccaggccagacagatag

SEQ ID NO: 169998 - DNA, 357 bp, Artificial Sequence
  Description of Artificial Sequence: Synthetic coding sequence
atggaggagcaggcccagagcctgattgacaagaccacagctgccttccagcagggcaagatcccccccacccccttcagcgcccctcctcctgctggggccatgatccccccaccacccagcctgcccggccccccccggcccggcatgatgcctgccccccacatgggcggcccccccatgatgcccatgatgggccccccacctcctggcatgatgcctgtgggccctgcccctggcatgaggcctcccatgggcggccacatgcccatgatgcctggcccccccatgatgaggcccccagcccggcccatgatggtgcccaccaggcctggcatgaccaggccagacagatag

SEQ ID NO: 169999 - DNA, 159 bp, Artificial Sequence
  Description of Artificial Sequence: Synthetic coding sequence
atgagaattgagggctgcatcatcggctttgatgagtacatgaacctggtgctggatgatgctgaggagatccacagcaagaccaagagcaggaagcagctgggccgcatcatgctgaagggggacaacatcaccctgctgcagagcgtgagcaactag

SEQ ID NO: 170000 - DNA, 279 bp, Artificial Sequence
  Description of Artificial Sequence: Synthetic coding sequence
atggcctaccggggccagggccagaaggtgcagaaggtgatggtgcagcccatcaacctgatcttccgctacctgcagaacagaagccgcatccaggtgtggctgtatgagcaggtgaacatgagaattgagggctgcatcatcggctttgatgagtacatgaacctggtgctggatgatgctgaggagatccacagcaagaccaagagcaggaagcagctgggccgcatcatgctgaagggggacaacatcaccctgctgcagagcgtgagcaactag

SEQ ID NO: 170001 - DNA, 723 bp, Artificial Sequence
  Description of Artificial Sequence: Synthetic coding sequence
atgacagtgggcaagagcagcaagatgctgcagcacatcgactacaggatgcgctgcatcctgcaggacggccgcatcttcatcggcaccttcaaggcctttgacaagcacatgaacctgatcctgtgtgactgtgatgagttcaggaagatcaagcccaagaatgccaagcagcctgagcgggaggagaagagggtgctgggcctggtgctgctgcggggggagaacctggtgtccatgacagtggagggccccccacccaaggacaccggcatcgcccgggtgcccctggccggggctgctgggggccctggggtgggccgggccgccggccggggcgtgcctgctggggtgcccatcccccaggccccagctggcctggccggccctgtgcggggcgtgggcggccccagccagcaggtgatgaccccccagggccggggcaccgtggccgctgctgctgtggccgccacagccagcattgctggggcccccacccagtacccacctggccggggcaccccacctcctcctgtgggccgggccaccccacctcctggcatcatggcccctcctcctggcatgaggcctcccatgggcccccccatcggcctgcccccagcccggggcacccccatcggcatgcctcctcctggcatgaggcctcctcctcctggcatccggggccccccacctcctggcatgaggcctccccggccctag

SEQ ID NO: 170002 - DNA, 723 bp, Artificial Sequence; identical to SEQ ID NO: 170001
  Description of Artificial Sequence: Synthetic coding sequence

SEQ ID NO: 170003 - DNA, 723 bp, Artificial Sequence; identical to SEQ ID NO: 170001
  Description of Artificial Sequence: Synthetic coding sequence

SEQ ID NO: 170004 - DNA, 723 bp, Artificial Sequence; identical to SEQ ID NO: 170001
  Description of Artificial Sequence: Synthetic coding sequence

SEQ ID NO: 170005 - DNA, 735 bp, Artificial Sequence
  Description of Artificial Sequence: Synthetic coding sequence
atgatggacagccagacagtgggcaagagcagcaagatgctgcagcacatcgactacaggatgcgctgcatcctgcaggacggccgcatcttcatcggcaccttcaaggcctttgacaagcacatgaacctgatcctgtgtgactgtgatgagttcaggaagatcaagcccaagaatgccaagcagcctgagcgggaggagaagagggtgctgggcctggtgctgctgcggggggagaacctggtgtccatgacagtggagggccccccacccaaggacaccggcatcgcccgggtgcccctggccggggctgctgggggccctggggtgggccgggccgccggccggggcgtgcctgctggggtgcccatcccccaggccccagctggcctggccggccctgtgcggggcgtgggcggccccagccagcaggtgatgaccccccagggccggggcaccgtggccgctgctgctgtggccgccacagccagcattgctggggcccccacccagtacccacctggccggggcaccccacctcctcctgtgggccgggccaccccacctcctggcatcatggcccctcctcctggcatgaggcctcccatgggcccccccatcggcctgcccccagcccggggcacccccatcggcatgcctcctcctggcatgaggcctcctcctcctggcatccggggccccccacctcctggcatgaggcctccccggccctag

SEQ ID NO: 170006 - DNA, 945 bp, Artificial Sequence; identical to SEQ ID NO: 148610
  Description of Artificial Sequence: Synthetic coding sequence

SEQ ID NO: 170007 - DNA, 1248 bp, Artificial Sequence
  Description of Artificial Sequence: Synthetic coding sequence
atggccaccgtgggggagtggagctgtgtgcgctgcaccttcctgaacccagctggccagaggcagtgcagcatctgtgaggcccccaggcacaagccagacctgaaccacatcctgcggctgtctgtggaggagcagaagtggccctgtgcccgctgcaccttcaggaacttcctgggcaaggaggcctgtgaggtgtgtggcttcaccccagagcccgcccctggagctgccttcctgcctgtgctgaatggagtgctgcccaagcccccagccatcctgggggagcccaagggcagctgccaggaggaggccggccctgtgaggacagctggcctggtggccacagagcccgcccggggccagtgtgaggacaaggatgaggaggagaaggaggagcaggaggaggaggagggcgctgctgagccccggggcggctgggcctgcccccgctgcaccctgcacaacacccctgtggccagcagctgcagcgtgtgtggcggcccccggcggctgagcctgccccgcatccccccagaggccctggtggtgcctgaggtggtggccccagctggcttccacgtggtgcctgctgcccctcctcctggcctgcctggagagggcgctgaggccaaccccccagccaccagccagggccctgctgctgagcctgagcccccccgggtgccccccttcagccccttcagcagcaccctgcagaacaaccctgtgcccaggagccggcgggaggtgcccccccagctgcagccccctgtgcctgaggccgcccagcccagccccagcgctggctgccgcggggccccccagggcagcggctgggccggggccagccggctggccgagctgctgagcggcaagaggctgtctgtgctggaggaggaggccacagaaggaggcaccagccgggtggaggccggcagcagcaccagcggcagtgacatcatcgacctggccggggacacagtgcgctacaccccagccagccccagcagcccagacttcaccacctggagctgtgccaagtgcaccctgaggaaccccagcccccccagcctgcagcccctgggccggggccctgagagcctgcccagggctgctggccccagggctggctgtgtgcagctggaggccggccacggcggggcccggggcagccctgctgaccatgctggaagaagacaccacccagcccaccgggagcccaggagagctgcccggggcccctag

SEQ ID NO: 170008 - DNA, 270 bp, Artificial Sequence
  Description of Artificial Sequence: Synthetic coding sequence
atgagcagccagcagcagaagcagccctgcaccccaccaccccagctgcagcagcagcaggtgaagcagccctgccagcccccaccccaggagccctgcatccccaagaccaaggagccctgccaccccaaggtgcctgagccctgccaccccaaggtgcctgagccctgccagcccaaggtgcctgagccctgccaccccaaggtgcctgagccctgccccagcatcgtgaccccagccccagcccagcagaagaccaagcagaagtag

SEQ ID NO: 170009 - DNA, 222 bp, Artificial Sequence
  Description of Artificial Sequence: Synthetic coding sequence
atgagcagccagcagcagaagcagccctgcaccccaccaccccagctgcagcagcagcaggtgaagcagccctgccagcccccaccccaggagccctgcatccccaagaccaaggagccctgccaccccaaggtgcctgagccctgccaccccaaggtgcctgagccctgccccagcatcgtgaccccagccccagcccagcagaagaccaagcagaagtag

SEQ ID NO: 170010 - DNA, 219 bp, Artificial Sequence
  Description of Artificial Sequence: Synthetic coding sequence
atgagctaccagcagcagcagtgcaagcagccctgccagcccccacctgtgtgccccacccccaagtgcccagagccctgccccccacccaagtgcccagagccctgccccccacccaagtgcccccagccctgccccccccagcagtgccagcagaagtacccacctgtgacccccagccccccctgccagagcaagtacccacccaagagcaagtag

SEQ ID NO: 170011 - DNA, 219 bp, Artificial Sequence
  Description of Artificial Sequence: Synthetic coding sequence
atgagctaccagcagcagcagtgcaagcagccctgccagcccccacctgtgtgccccacccccaagtgcccagagccctgccccccacccaagtgcccagagccctgccccccacccaagtgcccccagccctgccccccccagcagtgccagcagaagtacccacctgtgacccccagccccccctgccagcccaagtacccacccaagagcaagtag

SEQ ID NO: 170012 - DNA, 219 bp, Artificial Sequence; identical to SEQ ID NO: 170011
  Description of Artificial Sequence: Synthetic coding sequence

SEQ ID NO: 170013 - DNA, 219 bp, Artificial Sequence; identical to SEQ ID NO: 170011
  Description of Artificial Sequence: Synthetic coding sequence

SEQ ID NO: 170014 - DNA, 510 bp, Artificial Sequence
  Description of Artificial Sequence: Synthetic coding sequence
atgagcagctaccagcagaagcagaccttcaccccaccaccccagctgcagcagcagcaggtgaagcagcccagccagcccccaccccaggagatctttgtgcccaccaccaaggagccctgccacagcaaggtgccccagcccggcaacaccaagatccctgagcccggctgcaccaaggtgcctgagcccggctgcaccaaggtgcctgagcccggctgcaccaaggtgcctgagcccggctgcaccaaggtgcctgagcccggctgcaccaaggtgcctgagcccggctgcaccaaggtgcctgagcccggctacaccaaggtgcctgagcccggcagcatcaaggtgcctgaccagggcttcatcaagtttcctgagcccggggccatcaaggtgcctgagcagggctacaccaaggtgcctgtgcccggctacaccaagctgcctgagccctgccccagcacagtgaccccaggccctgcccagcagaagaccaagcagaagtag

SEQ ID NO: 170015 - DNA, 510 bp, Artificial Sequence; identical to SEQ ID NO: 170014
  Description of Artificial Sequence: Synthetic coding sequence

SEQ ID NO: 170016 - DNA, 480 bp, Artificial Sequence
  Description of Artificial Sequence: Synthetic coding sequence
atgagcagctaccagcagaagcagaccttcaccccaccaccccagctgcagcagcagcaggtgaagcagcccagccagcccccaccccaggagatctttgtgcccaccaccaaggagccctgccacagcaaggtgccccagcccggcaacaccaagatccctgagcccggctgcaccaaggtgcctgagcccggctgcaccaaggtgcctgagcccggctgcaccaaggtgcctgagcccggctgcaccaaggtgcctgagcccggctgcaccaaggtgcctgagcccggctgcaccaaggtgcctgagcccggctacaccaaggtgcctgagcccggcagcatcaaggtgcctgaccagggcttcatcaagtttcctgagcccggggccatcaaggtgcctgagcagggctacaccaaggtgcctgtgcccggctacaccaagctgcctgagccctgccccagcacagtgaccccctag

SEQ ID NO: 170017 - DNA, 486 bp, Artificial Sequence
  Description of Artificial Sequence: Synthetic coding sequence
atgagcagctaccagcagaagcagaccttcaccccaccaccccagctgcagcagcagcaggtgaagcagcccagccagcccccaccccaggagatctttgtgcccaccaccaaggagccctgccacagcaaggtgccccagcccggcaacaccaagatccctgagcccggctgcaccaaggtgcctgagcccggctgcaccaaggtgcctgagcccggctgcaccaaggtgcctgagcccggctgcaccaaggtgcctgagcccggctgcaccaaggtgcctgagcccggctacaccaaggtgcctgagcccggcagcatcaaggtgcctgaccagggcttcatcaagtttcctgagcccggggccatcaaggtgcctgagcagggctacaccaaggtgcctgtgcccggctacaccaagctgcctgagccctgccccagcacagtgaccccaggccctgcccagcagaagaccaagcagaagtag

SEQ ID NO: 170018 - DNA, 10989 bp, Artificial Sequence
  Description of Artificial Sequence: Synthetic coding sequence
atgagcagaagagcccctggcagccggctgagcagcggcggcggcggcggcggcaccaagtaccccaggtcctggaatgactggcagcccaggacagacagcgccagcgctgaccctgacaacctgaagtacagcagcagccgggacagaggaggcagcagcagctatggcctgcagcccagcaacagcgctgtggtgtcccggcagagacatgatgacaccagggtgcacgccgacatccagaatgatgagaagggcggctacagcgtgaatggaggcagcggggagaacacctacggcaggaagagcctgggccaggagctgcgggtgaacaacgtgaccagccctgagttcacctctgtgcagcacggcagccgggccctggccaccaaggacatgaggaagagccaggagaggtccatgagctacagtgatgagagccggctgagcaacctgctgcggcgcatcaccagagaagatgaccgggaccggcggctggccaccgtgaagcagctgaaggagttcatccagcagcctgagaacaagctggtgctggtgaagcagctggacaacatcctggccgctgtgcatgatgtgctgaatgaaagcagcaagctgctgcaggagctgcggcaggagggcgcctgctgcctgggcctgctgtgtgccagcctgtcctatgaagctgagaagatcttcaagtggatcttcagcaagttcagcagcagcgccaaggatgaggtgaagctgctgtacctgtgtgccacctacaaggccctggagaccgtgggggagaagaaggccttcagctctgtgatgcagctggtgatgaccagcctgcagagcatcctggagaatgtggacaccccagagctgctgtgcaagtgtgtgaagtgcatcctgctggtggcccgctgctacccccacatcttcagcaccaacttccgggacacagtggacatcctggtgggctggcacatcgaccacacccagaagcccagcctgacccagcaggtgtctggctggctgcagagcctggagcccttctgggtggccgacctggccttcagcaccaccctgctgggccagttcctggaggacatggaggcctatgcagaggacctgagccacgtggccagcggggagagcgtggatgaagatgtgcccccacccagcgtgtccctgcccaagctggccgccctgctgcgggtcttcagcacagtggtgcgcagcatcggggagcgcttcagccccatccggggcccccccatcacagaggcctacgtgacagatgtgctgtacagagtgatgagatgtgtgacagctgccaaccaggtgttcttcagcgaggccgtgctgacagctgccaatgaatgtgtgggcgtgctgctgggcagcctggaccccagcatgaccatccactgtgacatggtgatcacctacggcctggaccagctggagaactgccagacctgtggcacagactacatcatctctgtgctgaacctgctgaccctgattgtggagcagatcaacaccaagctgcccagcagctttgtggagaagctgttcatccccagcagcaagctgctcttcctgcgctaccacaaggagaaggaggtggtggccgtggcccatgctgtgtaccaggccgtgctgagcctgaagaacatccctgtgctggagacagcctacaagctgatcctgggggagatgacctgtgccctgaacaacctgctgcacagcctgcagctgcctgaggcctgcagcgagatcaagcatgaggccttcaagaaccacgtgttcaacgtggacaatgccaagtttgtggtgatctttgacctgagcgccctgaccaccatcggaaatgccaagaacagcctgattggcatgtgggccctgagccccaccgtgtttgccctgctgagcaagaacctgatgattgtgcacagcgacctggccgtgcacttccctgccatccagtatgctgtgctgtacaccctgtacagccactgcaccaggcatgaccacttcatcagcagcagcctgagcagcagcagccccagcctgtttgatggagctgtgatcagcacagtgaccacagccaccaagaagcacttcagcatcatcctgaacctgctgggcatcctgctgaagaaggacaacctgaaccaggacaccaggaagctgctgatgacctgggccctggaggccgctgtgctgatgaagaagtctgagacctacgcccccctcttcagcctgcccagcttccacaagttctgcaagggcctgctggccaacaccctggtggaggatgtgaacatctgcctgcaggcctgcagcagcctgcacgccctgagcagcagcctgcctgatgacctgctgcagagatgtgtggatgtgtgccgggtgcagctggtgcacagcggcacccgcatccggcaggccttcggcaagctgctgaagagcatccccctggatgtggtgctgagcaacaacaaccacacagagatccaggagatcagcctggccctgcggagccacatgagcaaggcccccagcaacaccttccacccccaggacttcagtgatgtgatctccttcatcctgtatggcaacagccacaggacaggcaaggacaactggctggagcggctcttctacagctgccagaggctggacaagagggaccagagcaccatccccaggaacctgctgaagacagatgctgtgctgtggcagtgggccatctgggaggccgcccagttcaccgtgctgagcaagctgcggacccccctgggccgggcccaggacaccttccagaccatcgagggcatcatccgcagcctggccgcccacaccctgaacccagaccaggatgtgtcccagtggaccacagctgacaatgatgagggccacggcaacaaccagctgcggctggtgctgctgctgcagtacctggagaacctggagaagctgatgtacaatgcctatgagggctgtgccaatgccctgaccagcccccccaaggtgatccgcaccttcttctacaccaaccggcagacctgccaggactggctgacccgcatccggctgagcatcatgagggtgggcctgctggccggccagcctgctgtgacagtgcgccacggctttgacctgctgacagagatgaagaccaccagcctgagccagggcaatgagctggaggtgaccatcatgatggtggtggaggccctgtgtgagctgcactgcccagaggccatccagggcattgctgtgtggagcagcagcatcgtgggcaagaacctgctgtggatcaacagcgtggcccagcaggccgagggccgctttgagaaggcctctgtggagtaccaggagcacctgtgtgccatgactggagtggactgctgcatcagcagctttgacaagtctgtgctgaccctggccaatgccggcaggaacagcgccagccccaagcacagcctgaatggagagagcaggaagacagtgctgagcaagcccacagacagcagccctgaggtgatcaactacctgggcaacaaggcctgtgagtgctacatcagcattgctgactgggccgctgtgcaggagtggcagaatgccatccatgacctgaagaagagcaccagcagcaccagcctgaacctgaaggctgacttcaactacatcaagagcctgagcagctttgaaagtggcaagtttgtggagtgcacagagcagctggagctgctgcctggagagaacatcaacctgctggccggcggcagcaaggagaagattgacatgaagaagctgctgcccaacatgctgagcccagacccccgggagctgcagaagagcattgaggtgcagctgctgcggagctctgtgtgcctggccacagccctgaaccccatcgagcaggaccagaagtggcagagcatcacagaaaatgtggtgaagtacctgaagcagaccagccgcatcgccatcggccccctgcggctgagcaccctgactgtgtcccagagcctgcctgtgctgagcaccctgcagctgtactgcagcagcgccctggagaacacagtgagcaaccggctgagcacagaggactgcctgatccccctcttcagcgaggccctgcggagctgcaagcagcatgatgtgcggccctggatgcaggccctgcgctacaccatgtaccagaaccagctgctggagaagatcaaggagcagacagtgcccatccgcagccacctgatggagctgggcctgacagctgccaagtttgccaggaagagaggaaatgtgtccctggccacccggctgctggcccagtgcagcgaggtgcagctgggcaagaccaccacagcccaggacctggtgcagcacttcaagaagctgagcacccagggccaggtggatgagaagtggggccctgagctggacatcgagaagaccaagctgctgtacacagctggccagagcacccacgccatggagatgctgagcagctgtgccatctccttctgcaagtctgtgaaggccgagtatgctgtggccaagagcatcctgaccctggccaagtggatccaggccgagtggaaggagatcagcggccagctgaagcaggtgtaccgggcccagcaccagcagaacttcaccggcctgagcaccctgagcaagaacatcctgaccctgattgagctgcccagcgtgaacaccatggaggaggagtacccccgcatcgagagcgagagcacagtgcacatcggcgtgggggagccagacttcatcctgggccagctgtaccacctgagctctgtgcaggcccctgaggtggccaagtcctgggccgccctggcctcctgggcctaccgctggggcaggaaggtggtggacaatgccagccagggcgagggcgtgcggctgctgccccgggagaagtctgaggtgcagaacctgctgcctgacaccatcacagaggaggagaaggagcgcatctacggcatcctgggccaggccgtgtgcaggcctgctggcatccaggatgaggacatcaccctgcagatcacagaaagtgaggacaatgaggaggatgacatggtggatgtgatctggaggcagctgatcagcagctgcccctggctgtctgagctggatgagagcgccacagagggcgtcatcaaggtgtggaggaaggtggtggaccgcatcttcagcctgtacaagctgagctgcagcgcctacttcaccttcctgaagctgaatgccggccagatccccctggatgaagatgacccccggctgcacctgagccaccgggtggagcagagcacagatgacatgattgtgatggccaccctgcggctgctgcggctgctggtgaagcacgccggggagctgcggcagtacctggagcacggcctggagaccacccccacagccccctggaggggcatcatcccccagctgttcagccggctgaaccaccctgaggtgtatgtgcggcagagcatctgcaacctgctgtgccgggtggcccaggacagcccccacctgatcctgtacccagccatcgtgggcaccatcagcctgagcagcgagagccaggccagcggcaacaagttcagcacagccatccccaccctgctgggcaacatccagggcgaggagctgctggtgtctgaatgtgagggcggcagccccccagccagccaggacagcaacaaggatgagcccaagagcggcctgaatgaagaccaggccatgatgcaggactgctacagcaagatcgtggacaagctgagcagcgccaaccccaccatggtgctgcaggtgcagatgctggtggccgagctgcggcgggtgacagtgctgtgggatgagctgtggctgggcgtgctgctgcagcagcacatgtatgtgctgcggcgcatccagcagctggaggatgaggtgaagagggtgcagaacaacaacaccctgaggaaggaggagaagatcgccatcatgagggagaagcacacagccctgatgaagcccatcgtgtttgccctggagcacgtgcgcagcatcacagctgccccagctgagacccctcatgagaagtggttccaggacaactatggagatgccattgaaaatgccctggagaagctgaagacccccctgaacccagccaagccaggcagctcctggatccccttcaaggagatcatgctgagcctgcagcagagggcccagaagagggccagctacatcctgcggctggaggagatcagcccctggctggccgccatgaccaacacagaaattgccctgcccggggaggtgtctgcccgggacacagtgaccatccacagcgtgggcggcaccatcaccatcctgcccaccaagaccaagcccaagaagctgctcttcctgggcagtgatggcaagagctacccctacctgttcaagggcctggaggacctgcacctggatgagcgcatcatgcagttcctgagcatcgtgaacaccatgtttgccaccatcaaccggcaggagaccccccgcttccacgcccggcactacagcgtgacccccctgggcaccaggagcggcctcatccagtgggtggatggagccacccccctgtttggcctgtacaagcgctggcagcagcgggaggccgccctgcaggcccagaaggcccaggacagctaccagaccccccagaaccctggcatcgtgccccggcccagcgagctgtactacagcaagattggccctgccctgaagacagtgggcctgagcctggatgtgtcccggcgggactggcccctgcacgtgatgaaggctgtgctggaggagctgatggaggccaccccacccaacctgctggccaaggagctgtggagcagctgcaccaccccagatgagtggtggagggtgacccagagctatgcccggagcacagctgtgatgtccatggtgggctacatcatcggcctgggggacagacacctggacaacgtgctgattgacatgaccactggagaggtggtgcacatcgactacaacgtgtgctttgagaagggcaagagcctgcgggtgcctgagaaggtgcccttcaggatgacccagaacattgaaacagccctgggcgtgactggagtggagggcgtcttccggctgagctgtgagcaggtgctgcacatcatgaggcggggccgggagaccctgctgaccctgctggaggcctttgtgtatgaccccctggtggactggacagctggaggagaggccggctttgctggagctgtgtatggaggcggcggccagcaggccgagagcaagcagagcaagcgggagatggagcgggagatcaccaggagcctcttcagcagccgggtggccgagatcaaggtgaactggttcaagaacagagatgagatgctggtggtgctgcccaagctggatggcagcctggatgagtacctgagcctgcaggagcagctgacagatgtggagaagctgcagggcaagctgctggaggagattgagttcctggagggcgctgagggcgtggaccaccccagccacaccctgcagcaccgctacagcgagcacacccagctgcagacccagcagagagctgtgcaggaggccatccaggtgaagctgaatgaatttgagcagtggatcacccactaccaggccgccttcaacaacctggaggccacccagctggccagcctgctgcaggagatcagcacccagatggacctgggcccccccagctatgtgcctgccacagccttcctgcagaatgccggccaggcccacctgatcagccagtgtgagcagctggagggggaggtgggcgccctgctgcagcagaggagatctgtgctgcggggctgcctggagcagctgcaccactacgccaccgtggccctgcagtaccccaaggccatcttccagaagcacagaattgagcagtggaagacctggatggaggagctgatctgcaacaccaccgtggagcgctgccaggagctgtacagaaaatatgagatgcagtatgccccccagcccccacccaccgtgtgccagttcatcacagccacagagatgaccctgcagagatatgctgctgacatcaacagccgcctcatccggcaggtggagcggctgaagcaggaggccgtgacagtgcctgtgtgtgaggaccagctgaaggagattgagcgctgcatcaaggtgttcctgcatgaaaatggagaggagggcagcctgagcctggccagcgtcatcatcagcgccctgtgcaccctgaccaggaggaacctgatgatggagggcgccgccagcagcgctggggagcagctggtggacctgaccagcagagatggagcctggttcctggaggagctgtgcagcatgtctggaaatgtgacctgcctggtgcagctgctgaagcagtgccacctggtgccccaggacctggacatccccaaccccatggaggccagcgagaccgtgcacctggccaacggggtgtacaccagcctgcaggagctgaacagcaacttccggcagatcatcttccctgaggccctgcgctgcctgatgaagggggagtacaccctggagagcatgctgcacgagctggatggcctgattgagcagaccacagatggagtgcccctgcagaccctggtggagagcctgcaggcctacctgagaaatgctgccatgggcctggaggaggagacccacgcccactacattgatgtggcccggctgctgcacgcccagtatggagagctgatccagcccagaaatggatctgtggatgagacccccaagatgtctgctggccagatgctgctggtggcctttgatggcatgtttgcccaggtggagacagccttcagcctgctggtggagaagctgaacaagatggagatccccatcgcctggaggaagattgacatcatccgggaggcccggagcacccaggtgaacttctttgatgatgacaaccaccggcaggtgctggaggagatcttcttcctgaagaggctgcagaccatcaaggagttcttccggctgtgtggcaccttcagcaagaccctgagcggcagcagcagcctggaggaccagaacacagtgaatggacctgtgcagatcgtgaatgtgaagaccctcttcaggaacagctgcttcagcgaggaccagatggccaagcccatcaaggccttcaccgctgactttgtgcggcagctgctgattggcctgcccaaccaggccctgggcctgaccctgtgcagcttcatcagcgccctgggcgtggacatcatcgcccaggtggaggccaaggactttggagctgagagcaaggtgtctgtggatgacctgtgcaagaaggctgtggagcacaacatccagatcggcaagttcagccagctggtgatgaacagagccaccgtgctggccagcagctatgacacagcctggaagaagcatgacctggtgcggcggctggagaccagcatcagcagctgcaagaccagcctgcagagggtgcagctgcacatcgccatgttccagcagtggcagcacgaggacctgctgatcaaccggccccaggccatgtctgtgaccccaccacccaggtctgccatcctgacctccatgaagaagaagctgcacaccctgagccagatcgagaccagcatcgccaccgtgcaggagaagctggccgccctggagagcagcattgagcagaggctgaagtgggccggcggggccaacccagccctggcccctgtgctgcaggactttgaggccaccatcgccgagaggaggaacctggtgctgaaggagagccagagggccagccaggtgaccttcctgtgcagcaacatcatccactttgagagcctgcggaccaggacagctgaggccctgaacctggatgctgccctgtttgagctgatcaagcgctgccagcagatgtgcagctttgccagccagttcaacagctctgtgtctgagctggagctgcggctgctgcagagggtggacaccggcctggagcaccccatcggcagcagcgagtggctgctgagcgcccacaagcagctgacccaggacatgagcacccagagggccatccagacagagaaggagcagcagatcgagaccgtgtgtgagaccatccagaacctggtggacaacatcaagacagtgctgaccggccacaaccggcagctgggagatgtgaagcacctgctgaaggccatggccaaggatgaggaggccgccctggctgatggagaagatgtgccctatgagaacagcgtgcggcagttcctgggggagtacaagtcctggcaggacaacatccagacagtgctcttcaccctggtgcaggccatgggccaggtgcgcagccaggagcacgtggagatgctgcaggagatcacccccaccctgaaggagctgaagacccagagccagagcatctacaacaacctggtgtcctttgccagccccctggtgacagatgccaccaatgaatgtagcagccccaccagcagcgccacctaccagcccagctttgctgctgctgtgcgcagcaacacaggccagaagacccagccagatgtgatgagccagaatgccaggaagctgatccagaagaacctggccaccagcgctgacaccccacccagcacagtgcccggcaccgggaagtctgtggcctgcagccccaagaaggctgtgcgggaccccaagacaggcaaggctgtgcaggagaggaacagctatgctgtgtctgtgtggaagagggtgaaggccaagctggagggcagagatgtggaccccaacagaaggatgtctgtggccgagcaggtggactatgtgatcaaggaggccaccaacctggacaacctggcccagctgtatgagggctggacagcctgggtgtag

SEQ ID NO: 170019 - DNA, 10986 bp, Artificial Sequence
  Description of Artificial Sequence: Synthetic coding sequence
atgagcagaagagcccctggcagccggctgagcagcggcggcggcggcggcggcaccaagtaccccaggtcctggaatgactggcagcccaggacagacagcgccagcgctgaccctgacaacctgaagtacagcagcagccgggacagaggaggcagcagcagctatggcctgcagcccagcaacagcgctgtggtgtcccggcagagacatgatgacaccagggtgcacgccgacatccagaatgatgagaagggcggctacagcgtgaatggaggcagcggggagaacacctacggcaggaagagcctgggccaggagctgcgggtgaacaacgtgaccagccctgagttcacctctgtgcagcacggcagccgggccctggccaccaaggacatgaggaagagccaggagaggtccatgagctacagtgatgagagccggctgagcaacctgctgcggcgcatcaccagagaagatgaccgggaccggcggctggccaccgtgaagcagctgaaggagttcatccagcagcctgagaacaagctggtgctggtgaagcagctggacaacatcctggccgctgtgcatgatgtgctgaatgaaagcagcaagctgctgcaggagctgcggcaggagggcgcctgctgcctgggcctgctgtgtgccagcctgtcctatgaagctgagaagatcttcaagtggatcttcagcaagttcagcagcagcgccaaggatgaggtgaagctgctgtacctgtgtgccacctacaaggccctggagaccgtgggggagaagaaggccttcagctctgtgatgcagctggtgatgaccagcctgcagagcatcctggagaatgtggacaccccagagctgctgtgcaagtgtgtgaagtgcatcctgctggtggcccgctgctacccccacatcttcagcaccaacttccgggacacagtggacatcctggtgggctggcacatcgaccacacccagaagcccagcctgacccagcaggtgtctggctggctgcagagcctggagcccttctgggtggccgacctggccttcagcaccaccctgctgggccagttcctggaggacatggaggcctatgcagaggacctgagccacgtggccagcggggagagcgtggatgaagatgtgcccccacccagcgtgtccctgcccaagctggccgccctgctgcgggtcttcagcacagtggtgcgcagcatcggggagcgcttcagccccatccggggcccccccatcacagaggcctacgtgacagatgtgctgtacagagtgatgagatgtgtgacagctgccaaccaggtgttcttcagcgaggccgtgctgacagctgccaatgaatgtgtgggcgtgctgctgggcagcctggaccccagcatgaccatccactgtgacatggtgatcacctacggcctggaccagctggagaactgccagacctgtggcacagactacatcatctctgtgctgaacctgctgaccctgattgtggagcagatcaacaccaagctgcccagcagctttgtggagaagctgttcatccccagcagcaagctgctcttcctgcgctaccacaaggagaaggaggtggtggccgtggcccatgctgtgtaccaggccgtgctgagcctgaagaacatccctgtgctggagacagcctacaagctgatcctgggggagatgacctgtgccctgaacaacctgctgcacagcctgcagctgcctgaggcctgcagcgagatcaagcatgaggccttcaagaaccacgtgttcaacgtggacaatgccaagtttgtggtgatctttgacctgagcgccctgaccaccatcggaaatgccaagaacagcctgattggcatgtgggccctgagccccaccgtgtttgccctgctgagcaagaacctgatgattgtgcacagcgacctggccgtgcacttccctgccatccagtatgctgtgctgtacaccctgtacagccactgcaccaggcatgaccacttcatcagcagcagcctgagcagcagcagccccagcctgtttgatggagctgtgatcagcacagtgaccacagccaccaagaagcacttcagcatcatcctgaacctgctgggcatcctgctgaagaaggacaacctgaaccaggacaccaggaagctgctgatgacctgggccctggaggccgctgtgctgatgaagaagtctgagacctacgcccccctcttcagcctgcccagcttccacaagttctgcaagggcctgctggccaacaccctggtggaggatgtgaacatctgcctgcaggcctgcagcagcctgcacgccctgagcagcagcctgcctgatgacctgctgcagagatgtgtggatgtgtgccgggtgcagctggtgcacagcggcacccgcatccggcaggccttcggcaagctgctgaagagcatccccctggatgtggtgctgagcaacaacaaccacacagagatccaggagatcagcctggccctgcggagccacatgagcaaggcccccagcaacaccttccacccccaggacttcagtgatgtgatctccttcatcctgtatggcaacagccacaggacaggcaaggacaactggctggagcggctcttctacagctgccagaggctggacaagagggaccagagcaccatccccaggaacctgctgaagacagatgctgtgctgtggcagtgggccatctgggaggccgcccagttcaccgtgctgagcaagctgcggacccccctgggccgggcccaggacaccttccagaccatcgagggcatcatccgcagcctggccgcccacaccctgaacccagaccaggatgtgtcccagtggaccacagctgacaatgatgagggccacggcaacaaccagctgcggctggtgctgctgctgcagtacctggagaacctggagaagctgatgtacaatgcctatgagggctgtgccaatgccctgaccagcccccccaaggtgatccgcaccttcttctacaccaaccggcagacctgccaggactggctgacccgcatccggctgagcatcatgagggtgggcctgctggccggccagcctgctgtgacagtgcgccacggctttgacctgctgacagagatgaagaccaccagcctgagccagggcaatgagctggaggtgaccatcatgatggtggtggaggccctgtgtgagctgcactgcccagaggccatccagggcattgctgtgtggagcagcagcatcgtgggcaagaacctgctgtggatcaacagcgtggcccagcaggccgagggccgctttgagaaggcctctgtggagtaccaggagcacctgtgtgccatgactggagtggactgctgcatcagcagctttgacaagtctgtgctgaccctggccaatgccggcaggaacagcgccagccccaagcacagcctgaatggagagagcaggaagacagtgctgagcaagcccacagacagcagccctgaggtgatcaactacctgggcaacaaggcctgtgagtgctacatcagcattgctgactgggccgctgtgcaggagtggcagaatgccatccatgacctgaagaagagcaccagcagcaccagcctgaacctgaaggctgacttcaactacatcaagagcctgagcagctttgaaagtggcaagtttgtggagtgcacagagcagctggagctgctgcctggagagaacatcaacctgctggccggcggcagcaaggagaagattgacatgaagaagctgctgcccaacatgctgagcccagacccccgggagctgcagaagagcattgaggtgcagctgctgcggagctctgtgtgcctggccacagccctgaaccccatcgagcaggaccagaagtggcagagcatcacagaaaatgtggtgaagtacctgaagcagaccagccgcatcgccatcggccccctgcggctgagcaccctgactgtgtcccagagcctgcctgtgctgagcaccctgcagctgtactgcagcagcgccctggagaacacagtgagcaaccggctgagcacagaggactgcctgatccccctcttcagcgaggccctgcggagctgcaagcagcatgatgtgcggccctggatgcaggccctgcgctacaccatgtaccagaaccagctgctggagaagatcaaggagcagacagtgcccatccgcagccacctgatggagctgggcctgacagctgccaagtttgccaggaagagaggaaatgtgtccctggccacccggctgctggcccagtgcagcgaggtgcagctgggcaagaccaccacagcccaggacctggtgcagcacttcaagaagctgagcacccagggccaggtggatgagaagtggggccctgagctggacatcgagaagaccaagctgctgtacacagctggccagagcacccacgccatggagatgctgagcagctgtgccatctccttctgcaagtctgtgaaggccgagtatgctgtggccaagagcatcctgaccctggccaagtggatccaggccgagtggaaggagatcagcggccagctgaagcaggtgtaccgggcccagcaccagcagaacttcaccggcctgagcaccctgagcaagaacatcctgaccctgattgagctgcccagcgtgaacaccatggaggaggagtacccccgcatcgagagcgagagcacagtgcacatcggcgtgggggagccagacttcatcctgggccagctgtaccacctgagctctgtgcaggcccctgaggtggccaagtcctgggccgccctggcctcctgggcctaccgctggggcaggaaggtggtggacaatgccagccagggcgagggcgtgcggctgctgccccgggagaagtctgaggtgcagaacctgctgcctgacaccatcacagaggaggagaaggagcgcatctacggcatcctgggccaggccgtgtgcaggcctgctggcatccaggatgaggacatcaccctgcagatcacagaaagtgaggacaatgaggaggatgacatggtggatgtgatctggaggcagctgatcagcagctgcccctggctgtctgagctggatgagagcgccacagagggcgtcatcaaggtgtggaggaaggtggtggaccgcatcttcagcctgtacaagctgagctgcagcgcctacttcaccttcctgaagctgaatgccggccagatccccctggatgaagatgacccccggctgcacctgagccaccgggtggagcagagcacagatgacatgattgtgatggccaccctgcggctgctgcggctgctggtgaagcacgccggggagctgcggcagtacctggagcacggcctggagaccacccccacagccccctggaggggcatcatcccccagctgttcagccggctgaaccaccctgaggtgtatgtgcggcagagcatctgcaacctgctgtgccgggtggcccaggacagcccccacctgatcctgtacccagccatcgtgggcaccatcagcctgagcagcgagagccaggccagcggcaacaagttcagcacagccatccccaccctgctgggcaacatccagggcgaggagctgctggtgtctgaatgtgagggcggcagccccccagccagccaggacagcaacaaggatgagcccaagagcggcctgaatgaagaccaggccatgatgcaggactgctacagcaagatcgtggacaagctgagcagcgccaaccccaccatggtgctgcaggtgcagatgctggtggccgagctgcggcgggtgacagtgctgtgggatgagctgtggctgggcgtgctgctgcagcagcacatgtatgtgctgcggcgcatccagcagctggaggatgaggtgaagagggtgcagaacaacaacaccctgaggaaggaggagaagatcgccatcatgagggagaagcacacagccctgatgaagcccatcgtgtttgccctggagcacgtgcgcagcatcacagctgccccagctgagacccctcatgagaagtggttccaggacaactatggagatgccattgaaaatgccctggagaagctgaagacccccctgaacccagccaagccaggcagctcctggatccccttcaaggagatcatgctgagcctgcagcagagggcccagaagagggccagctacatcctgcggctggaggagatcagcccctggctggccgccatgaccaacacagaaattgccctgcccggggaggtgtctgcccgggacacagtgaccatccacagcgtgggcggcaccatcaccatcctgcccaccaagaccaagcccaagaagctgctcttcctgggcagtgatggcaagagctacccctacctgttcaagggcctggaggacctgcacctggatgagcgcatcatgcagttcctgagcatcgtgaacaccatgtttgccaccatcaaccggcaggagaccccccgcttccacgcccggcactacagcgtgacccccctgggcaccaggagcggcctcatccagtgggtggatggagccacccccctgtttggcctgtacaagcgctggcagcagcgggaggccgccctgcaggcccagaaggcccaggacagctaccagaccccccagaaccctggcatcgtgccccggcccagcgagctgtactacagcaagattggccctgccctgaagacagtgggcctgagcctggatgtgtcccggcgggactggcccctgcacgtgatgaaggctgtgctggaggagctgatggaggccaccccacccaacctgctggccaaggagctgtggagcagctgcaccaccccagatgagtggtggagggtgacccagagctatgcccggagcacagctgtgatgtccatggtgggctacatcatcggcctgggggacagacacctggacaacgtgctgattgacatgaccactggagaggtggtgcacatcgactacaacgtgtgctttgagaagggcaagagcctgcgggtgcctgagaaggtgcccttcaggatgacccagaacattgaaacagccctgggcgtgactggagtggagggcgtcttccggctgagctgtgagcaggtgctgcacatcatgaggcggggccgggagaccctgctgaccctgctggaggcctttgtgtatgaccccctggtggactggacagctggaggagaggccggctttgctggagctgtgtatggaggcggcggccagcaggccgagagcaagcagagcaagcgggagatggagcgggagatcaccaggagcctcttcagcagccgggtggccgagatcaaggtgaactggttcaagaacagagatgagatgctggtggtgctgcccaagctggatggcagcctggatgagtacctgagcctgcaggagcagctgacagatgtggagaagctgcagggcaagctgctggaggagattgagttcctggagggcgctgagggcgtggaccaccccagccacaccctgcagcaccgctacagcgagcacacccagctgcagacccagcagagagctgtgcaggaggccatccaggtgaagctgaatgaatttgagcagtggatcacccactaccaggccgccttcaacaacctggaggccacccagctggccagcctgctgcaggagatcagcacccagatggacctgggcccccccagctatgtgcctgccacagccttcctgcagaatgccggccaggcccacctgatcagccagtgtgagcagctggagggggaggtgggcgccctgctgcagcagaggagatctgtgctgcggggctgcctggagcagctgcaccactacgccaccgtggccctgcagtaccccaaggccatcttccagaagcacagaattgagcagtggaagacctggatggaggagctgatctgcaacaccaccgtggagcgctgccaggagctgtacagaaaatatgagatgcagtatgccccccagcccccacccaccgtgtgccagttcatcacagccacagagatgaccctgcagagatatgctgctgacatcaacagccgcctcatccggcaggtggagcggctgaagcaggaggccgtgacagtgcctgtgtgtgaggaccagctgaaggagattgagcgctgcatcaaggtgttcctgcatgaaaatggagaggagggcagcctgagcctggccagcgtcatcatcagcgccctgtgcaccctgaccaggaggaacctgatgatggagggcgccgccagcagcgctggggagcagctggtggacctgaccagcagagatggagcctggttcctggaggagctgtgcagcatgtctggaaatgtgacctgcctggtgcagctgctgaagcagtgccacctggtgccccaggacctggacatccccaaccccatggaggccagcgagaccgtgcacctggccaacggggtgtacaccagcctgcaggagctgaacagcaacttccggcagatcatcttccctgaggccctgcgctgcctgatgaagggggagtacaccctggagagcatgctgcacgagctggatggcctgattgagcagaccacagatggagtgcccctgcagaccctggtggagagcctgcaggcctacctgagaaatgctgccatgggcctggaggaggagacccacgcccactacattgatgtggcccggctgctgcacgcccagtatggagagctgatccagcccagaaatggatctgtggatgagacccccaagatgtctgctggccagatgctgctggtggcctttgatggcatgtttgcccaggtggagacagccttcagcctgctggtggagaagctgaacaagatggagatccccatcgcctggaggaagattgacatcatccgggaggcccggagcacccaggtgaacttctttgatgatgacaaccaccggcaggtgctggaggagatcttcttcctgaagaggctgcagaccatcaaggagttcttccggctgtgtggcaccttcagcaagaccctgagcggcagcagcagcctggaggaccagaacacagtgaatggacctgtgcagatcgtgaatgtgaagaccctcttcaggaacagctgcttcagcgaggaccagatggccaagcccatcaaggccttcaccgctgactttgtgcggcagctgctgattggcctgcccaaccaggccctgggcctgaccctgtgcagcttcatcagcgccctgggcgtggacatcatcgcccaggtggaggccaaggactttggagctgagagcaaggtgtctgtggatgacctgtgcaagaaggctgtggagcacaacatccagatcggcaagttcagccagctggtgatgaacagagccaccgtgctggccagcagctatgacacagcctggaagaagcatgacctggtgcggcggctggagaccagcatcagcagctgcaagaccagcctgcagagggtgcagctgcacatcgccatgttccagtggcagcacgaggacctgctgatcaaccggccccaggccatgtctgtgaccccaccacccaggtctgccatcctgacctccatgaagaagaagctgcacaccctgagccagatcgagaccagcatcgccaccgtgcaggagaagctggccgccctggagagcagcattgagcagaggctgaagtgggccggcggggccaacccagccctggcccctgtgctgcaggactttgaggccaccatcgccgagaggaggaacctggtgctgaaggagagccagagggccagccaggtgaccttcctgtgcagcaacatcatccactttgagagcctgcggaccaggacagctgaggccctgaacctggatgctgccctgtttgagctgatcaagcgctgccagcagatgtgcagctttgccagccagttcaacagctctgtgtctgagctggagctgcggctgctgcagagggtggacaccggcctggagcaccccatcggcagcagcgagtggctgctgagcgcccacaagcagctgacccaggacatgagcacccagagggccatccagacagagaaggagcagcagattgaaacagtgtgtgagaccatccagaacctggtggacaacatcaagacagtgctgaccggccacaaccggcagctgggagatgtgaagcacctgctgaaggccatggccaaggatgaggaggccgccctggctgatggagaagatgtgccctatgaaaattctgtgcggcagttcctgggggagtacaagtcctggcaggacaacatccagacagtgctcttcaccctggtgcaggccatgggccaggtgcgcagccaggagcacgtggagatgctgcaggagatcacccccaccctgaaggagctgaagacccagagccagagcatctacaacaacctggtgtcctttgccagccccctggtgacagatgccaccaatgaatgtagcagccccaccagcagcgccacctaccagcccagctttgctgctgctgtgcgcagcaacacaggccagaagacccagccagatgtgatgagccagaatgccaggaagctgatccagaagaacctggccaccagcgctgacaccccacccagcacagtgcccggcaccgggaagtctgtggcctgcagccccaagaaggctgtgcgggaccccaagacaggcaaggctgtgcaggagagaaattcctatgctgtgtctgtgtggaagagggtgaaggccaagctggagggcagagatgtggaccccaacagaaggatgtctgtggccgagcaggtggactatgtgatcaaggaggccaccaacctggacaacctggcccagctgtatgagggctggacagcctgggtgtag

SEQ ID NO: 170020 - DNA, 3051 bp, Artificial Sequence
  Description of Artificial Sequence: Synthetic coding sequence
atgagccagggccccccaactggagagagcagcgagcctgaggccaaggtgctgcacaccaagaggctgtacagagctgtggtggaggccgtgcaccggctggacctgatcctgtgcaacaagacagcctaccaggaggtgttcaagccagagaacatcagcctgaggaacaagctgcgggagctgtgtgtgaagctgatgttcctgcaccctgtggactatggcaggaaggccgaggagctgctgtggaggaaggtgtactatgaggtgatccagctgatcaagaccaacaagaagcacatccacagccgcagcaccctggagtgtgcctaccgcacccacctggtggccggcatcggcttctaccagcacctgctgctgtacatccagagccactaccagctggagctgcagtgctgcatcgactggacccacgtgacagaccccctgattggctgcaagaagcctgtgtctgccagcggcaaggagatggactgggcccagatggcctgccaccgctgcctggtgtacctgggggacctgagccgctaccagaatgagctggccggcgtggacacagagctgctggccgagcgcttctactaccaggccctgtctgtggccccccagatcggcatgcccttcaaccagctgggcaccctggccggcagcaagtactacaacgtggaggccatgtactgctacctgcgctgcatccagagcgaggtgtcctttgaaggagcctacggcaacctgaagaggctgtatgacaaggccgccaagatgtaccaccagctgaagaagtgtgagaccaggaagctgagccctgggaagaagcgctgcaaggacatcaagaggctgctggtgaacttcatgtacctgcagagcctgctgcagcccaagagcagctctgtggacagcgagctgaccagcctgtgccagagcgtgctggaggacttcaacctgtgcctcttctacctgcccagcagccccaacctgagcctggcctctgaagatgaggaggagtatgaaagtggctacgccttcctgcctgacctgctgatcttccagatggtgatcatctgcctgatgtgtgtgcacagcctggagcgggccggcagcaagcagtacagcgctgccatcgccttcaccctggccctcttcagccacctggtgaaccacgtgaacatccggctgcaggccgagctggaggagggagaaaatcctgtgcctgccttccagagtgatggaacagatgagcctgagagcaaggagcctgtggagaaggaggaggagccagaccctgagcccccacctgtgaccccccaggtgggggagggcaggaagagcaggaagttcagccggctgagctgcctgcggcggcggcggcacccccccaaggtgggagatgacagcgacctgtctgagggctttgaaagtgacagcagccatgacagcgcccgggccagcgagggcagtgacagcggcagtgacaagagcctggagggcggcggcacagcctttgatgctgagacagacagcgagatgaacagccaggagagcagaagtgacctggaggacatggaggaggaggagggcaccaggagccccaccctggagcccccccggggccgctctgaggccccagacagcctgaatggccccctgggccccagcgaggccagcatcgccagcaacctgcaggccatgagcacccagatgttccagaccaagcgctgcttccggctggcccccaccttcagcaacctgctgctgcagcccaccaccaacccccacaccagcgccagccaccggccctgtgtgaatggagatgtggacaagcccagcgagcccgccagcgaggagggcagcgagagcgagggcagcgagagcagcggccgcagctgcagaaatgaaagaagcatccaggagaagctgcaggtgctgatggccgagggcctgctgcctgctgtgaaggtgttcctggactggctgcggaccaacccagacctgatcatcgtgtgtgcccagagcagccagagcctgtggaaccggctgtctgtgctgctgaacctgctgcctgctgctggggagctgcaggagagcggcctggccctgtgcccagaggtgcaggacctgctggagggctgtgagctgcctgacctgcccagcagcctgctgctgcctgaggacatggccctgaggaacctgccccccctgcgggccgcccaccggcgcttcaactttgacacagaccggcccctgctgagcaccctggaggagagcgtggtgcgcatctgctgcatccgcagctttggccacttcatcgcccggctgcagggcagcatcctgcagttcaaccctgaggtgggcatctttgtgtccatcgcccagagcgagcaggagagcctgctgcagcaggcccaggcccagttcaggatggcccaggaggaggcccggaggaaccggctgatgagggacatggcccagctgcggctgcagctggaggtgtcccagctggagggcagcctgcagcagcccaaggcccagagcgccatgagcccctacctggtgcctgacacccaggccctgtgccaccacctgcctgtgatccggcagctggccaccagcggccgcttcatcgtcatcatccccaggacagtgattgatggcctggacctgctgaagaaggagcaccctggggccagagatggcatccgctacctggaggccgagttcaagaagggcaaccgctacatccgctgccagaaggaggtgggcaagagctttgagcggcacaagctgaagaggcaggatgctgatgcctggaccctgtacaagatcctggacagctgcaagcagctgaccctggcccagggcgctggggaggaggaccccagcggcatggtgaccatcatcaccggcctgcccctggacaaccccagcgtgctgagcggccccatgcaggccgccctgcaggccgccgcccacgcctctgtggacatcaagaatgtgctggacttctacaagcagtggaaggagattggatag

SEQ ID NO: 170021 - DNA, 1125 bp, Artificial Sequence
  Description of Artificial Sequence: Synthetic coding sequence
atgagccagggccccccaactggagagagcagcgagcctgaggccaaggtgctgcacaccaagaggctgtacagagctgtggtggaggccgtgcaccggctggacctgatcctgtgcaacaagacagcctaccaggaggtgttcaagccagagaacatcagcctgaggaacaagctgcgggagctgtgtgtgaagctgatgttcctgcaccctgtggactatggcaggaaggccgaggagctgctgtggaggaaggtgtactatgaggtgatccagctgatcaagaccaacaagaagcacatccacagccgcagcaccctggagtgtgcctaccgcacccacctggtggccggcatcggcttctaccagcacctgctgctgtacatccagagccactaccagctggagctgcagtgctgcatcgactggacccacgtgacagaccccctgattggctgcaagaagcctgtgtctgccagcggcaaggagatggactgggcccagatggcctgccaccgctgcctggtgtacctgggggacctgagccgctaccagaatgagctggccggcgtggacacagagctgctggccgagcgcttctactaccaggccctgtctgtggccccccagatcggcatgcccttcaaccagctgggcaccctggccggcagcaagtactacaacgtggaggccatgtactgctacctgcgctgcatccagagcgaggtgtcctttgaaggagcctacggcaacctgaagaggctgtatgacaaggccgccaagatgtaccaccagctgaagaagtgtgagaccaggaagctgagccctgggaagaagcgctgcaaggacatcaagaggctgctggtgaacttcatgtacctgcagagcctgctgcagcccaagagccggggctgcaccagccactgccccaccagcgccctgtgcctgcccctgagcagcttccagggccgggagcaggccccacccagggctgctggcagcctggcctgtgccagcacagtgtcctgtgcccaccagccccaccgctgctgtgccctgtgctcctggctgctgtgctgggacaggatgggctgccaggaggagaagaagggcggcgctgtgtag

SEQ ID NO: 170022 - DNA, 417 bp, Artificial Sequence
  Description of Artificial Sequence: Synthetic coding sequence
tgatttattgtcatcatccccaggacagtgattgatggcctggacctgctgaagaaggagcaccctggggccagagatggcatccgctacctggaggccgagttcaagaagggcaaccgctacatccgctgccagaaggaggtgggcaagagctttgagcggcacaagctgaagaggcaggatgctgatgcctggaccctgtacaagatcctggacagctgcaagcagctgaccctggcccagggcgctggggaggaggaccccagcggcatggtgaccatcatcaccggcctgcccctggacaaccccagcgtgctgagcggccccatgcaggccgccctgcaggccgccgcccacgcctctgtggacatcaagaatgtgctggacttctacaagcagtggaaggagattggatag

SEQ ID NO: 170023 - DNA, 3438 bp, Artificial Sequence
  Description of Artificial Sequence: Synthetic coding sequence
atgctggtgacagacctggagtatgccctggacaagaaggtggagcaggacctgtggaaccacgccttcaagaaccagatcaccaccctgcagggccaggccaagaacagagccaaccccaacagaagtgaggtgcaggccaacctgagcctcttcctggaggccgccagcggcttctacacccagctgctgcaggagctgtgcaccgtcttcaacgtggacctgccctgccgggtgaagagcagccagctgggcatcatcagcaacaagcagacccacaccagcgccatcgtgaagccccagagcagcagctgcagctacatctgccagcactgcctggtgcacctgggggacatcgcccgctacagaaaccagaccagccaggccgagagctactacagacatgctgcccagctggtgcccagcaatggccagccctacaaccagctggccatcctggccagcagcaaaggagaccacctgaccaccatcttctactactgccgcagcattgctgtgaagttccccttccctgctgccagcaccaacctgcagaaggccctgagcaaggccctggagagcagagatgaggtgaagaccaagtggggcgtgtctgacttcatcaaggccttcatcaagttccacggccacgtgtacctgagcaagagcctggagaagctgagccccctgcgggagaagctggaggagcagttcaagaggctgctcttccagaaggccttcaacagccagcagctggtgcacgtgaccgtcatcaacctcttccagctgcaccacctgcgggacttcagcaatgaaacagagcagcacacctacagccaggatgagcagctgtgctggacccagctgctggccctcttcatgtccttcctgggcatcctgtgcaagtgccccctgcagaatgaaagccaggaggagagctacaatgcctaccccctgcctgctgtgaaggtgtccatggactggctgcggctgcggcccagggtcttccaggaggccgtggtggatgagcggcagtacatctggccctggctgatcagcctgctgaacagcttccacccccatgaggaggacctgagcagcatcagcgccacccccctgcctgaggagtttgagctgcagggcttcctggccctgcggcccagcttcaggaacctggacttcagcaagggccaccagggcatcaccggggacaaggagggccagcagaggcgcatccggcagcagaggctcatcagcatcggcaagtggattgctgacaaccagcccaggctcatccagtgtgaaaatgaggtgggcaagctgctcttcatcacagagatccctgagctgatcctggaggaccccagcgaggccaaggagaacctgatcctgcaggagaccagcgtcatcgagagcctggccgcagatggcagccctggcctgaagtctgtgctgagcaccagcaggaacctgagcaacaactgtgacacaggagagaagcctgtggtgaccttcaaggagaacatcaagacccgggaggtgaacagagaccagggccgctccttcccccccaaggaggtgcggcgggactacagcaagggcatcaccgtgaccaagaatgatggcaagaaggacaacaacaagaggaagacagagaccaagaagtgcaccctggagaagctgcaggagaccgggaagcagaatgtggccgtgcaggtgaagagccagacagagctgaggaagacccctgtgtctgaggccaggaagacccctgtgacccagacccccacccaggccagcaacagccagttcatccccatccaccaccctggggccttcccccccctgcccagccggcccggcttccccccacccacctacgtgatccccccacctgtggccttctccatgggcagcggctacaccttccctgctggggtgtctgtgcccggcaccttcctgcagcccacagcccacagccctgctggcaaccaggtgcaggccggcaagcagagccacatcccctacagccagcagaggcccagcggccctggccccatgaaccagggcccccagcagagccagccccccagccagcagcccctgaccagcctgcctgcccagcccacagcccagagcaccagccagctgcaggtgcaggccctgacccagcagcagcagagccccaccaaggctgtgcctgccctgggcaagagccccccccaccacagcggcttccagcagtaccagcaggctgatgccagcaagcagctgtggaaccccccccaggtgcagggccccctgggcaagatcatgcctgtgaagcagccctactacctgcagacccaggaccccatcaagctgtttgagcccagcctgcagccccctgtgatgcagcagcagcccctggagaagaagatgaagcccttccccatggagccctacaaccacaaccccagcgaggtgaaggtgcctgagttctactgggacagcagctacagcatggctgacaacagatctgtgatggcccagcaggccaacatcgaccggcggggcaagaggagccctggggtcttccggcctgagcaggaccctgtgcccaggatgccctttgaggaccccaagagcagccccctgctgcccccagacctgctgaagagcctggccgccctggaggaggaggaggagctgatcttcagcaaccccccagacctgtacccagccctgctgggccccctggccagcctgcccggccgcagcctcttcaagagcctgctggagaagcccagcgagctgatgagccacagcagcagcttcctgagcctgaccggcttcagcctgaaccaggagcgctaccccaacaacagcatgtttaatgaggtgtatggcaagaacctgaccagcagcagcaaggccgagctgagccccagcatggccccccaggagaccagcctgtacagcctgtttgagggcaccccctggagccccagcctgcctgccagcagtgaccacagcaccccagccagccagagcccccacagcagcaaccccagcagcctgcccagcagcccccccacccacaaccacaacagcgtgcccttcagcaactttggccccatcggcaccccagacaacagagacagaagaacagctgaccgctggaagacagacaagccagccatgggcggcttcggcatcgactacctgagcgccaccagcagcagcgagagctcctggcaccaggccagcacccccagcggcacctggacaggccacggccccagcatggaggacagcagcgctgtgctgatggagagcctgaagagcatctggagcagctccatgatgcaccctggccccagcgccctggagcagctgctgatgcagcagaagcagaagcagcagaggggccagggcaccatgaaccccccccactag

SEQ ID NO: 170024 - DNA, 3414 bp, Artificial Sequence
  Description of Artificial Sequence: Synthetic coding sequence
atgagcctgcagagcgcccagtacctgcggcaggccgaggtgctgaaggctgacatgacagacagcaagctgggccctgctgaggtgtggaccagccggcaggccctgcaggacctgtaccagaagatgctggtgacagacctggagtatgccctggacaagaaggtggagcaggacctgtggaaccacgccttcaagaaccagatcaccaccctgcagggccaggccaagaacagagccaaccccaacagaagtgaggtgcaggccaacctgagcctcttcctggaggccgccagcggcttctacacccagctgctgcaggagctgtgcaccgtcttcaacgtggacctgccctgccgggtgaagagcagccagctgggcatcatcagcaacaagcagacccacaccagcgccatcgtgaagccccagagcagcagctgcagctacatctgccagcactgcctggtgcacctgggggacatcgcccgctacagaaaccagaccagccaggccgagagctactacagacatgctgcccagctggtgcccagcaatggccagccctacaaccagctggccatcctggccagcagcaaaggagaccacctgaccaccatcttctactactgccgcagcattgctgtgaagttccccttccctgctgccagcaccaacctgcagaaggccctgagcaaggccctggagagcagagatgaggtgaagaccaagtggggcgtgtctgacttcatcaaggccttcatcaagttccacggccacgtgtacctgagcaagagcctggagaagctgagccccctgcgggagaagctggaggagcagttcaagaggctgctcttccagaaggccttcaacagccagcagctggtgcacgtgaccgtcatcaacctcttccagctgcaccacctgcgggacttcagcaatgaaacagagcagcacacctacagccaggatgagcagctgtgctggacccagctgctggccctcttcatgtccttcctgggcatcctgtgcaagtgccccctgcagaatgaaagccaggaggagagctacaatgcctaccccctgcctgctgtgaaggtgtccatggactggctgcggctgcggcccagggtcttccaggaggccgtggtggatgagcggcagtacatctggccctggctgatcagcctgctgaacagcttccacccccatgaggaggacctgagcagcatcagcgccacccccctgcctgaggagtttgagctgcagggcttcctggccctgcggcccagcttcaggaacctggacttcagcaagggccaccagggcatcaccggggacaaggagggccagcagaggcgcatccggcagcagaggctcatcagcatcggcaagtggattgctgacaaccagcccaggctcatccagtgtgaaaatgaggtgggcaagctgctcttcatcacagagatccctgagctgatcctggaggaccccagcgaggccaaggagaacctgatcctgcaggagaccagcgtcatcgagagcctggccgcagatggcagccctggcctgaagtctgtgctgagcaccagcaggaacctgagcaacaactgtgacacaggagagaagcctgtggtgaccttcaaggagaacatcaagacccgggaggtgaacagagaccagggccgctccttcccccccaaggaggtgcggcgggactacagcaagggcatcaccgtgaccaagaatgatggcaagaaggacaacaacaagaggaagacagagaccaagaagtgcaccctggagaagctgcaggagaccgggaagcagaatgtggccgtgcaggtgaagagccagacagagctgaggaagacccctgtgtctgaggccaggaagacccctgtgacccagacccccacccaggccagcaacagccagttcatccccatccaccaccctggggccttcccccccctgcccagccggcccggcttccccccacccacctacgtgatccccccacctgtggccttctccatgggcagcggctacaccttccctgctggggtgtctgtgcccggcaccttcctgcagcccacagcccacagccctgctggcaaccaggtgcaggccggcaagcagagccacatcccctacagccagcagaggcccagcggccctggccccatgaaccagggcccccagcagagccagccccccagccagcagcccctgaccagcctgcctgcccagcccacagcccagagcaccagccagctgcaggtgcaggccctgacccagcagcagcagagccccaccaaggctgtgcctgccctgggcaagagccccccccaccacagcggcttccagcagtaccagcaggctgatgccagcaagcagctgtggaaccccccccaggtgcagggccccctgggcaagatcatgcctgtgaagcagccctactacctgcagacccaggaccccatcaagctgtttgagcccagcctgcagccccctgtgatgcagcagcagcccctggagaagaagatgaagcccttccccatggagccctacaaccacaaccccagcgaggtgaaggtgcctgagttctactgggacagcagctacagcatggctgacaacagatctgtgatggcccagcaggccaacatcgaccggcggggcaagaggagccctggggtcttccggcctgagcaggaccctgtgcccaggatgccctttgagaagagcctgctggagaagcccagcgagctgatgagccacagcagcagcttcctgagcctgaccggcttcagcctgaaccaggagcgctaccccaacaacagcatgtttaatgaggtgtatggcaagaacctgaccagcagcagcaaggccgagctgagccccagcatggccccccaggagaccagcctgtacagcctgtttgagggcaccccctggagccccagcctgcctgccagcagtgaccacagcaccccagccagccagagcccccacagcagcaaccccagcagcctgcccagcagcccccccacccacaaccacaacagcgtgcccttcagcaactttggccccatcggcaccccagacaacagagacagaagaacagctgaccgctggaagacagacaagccagccatgggcggcttcggcatcgactacctgagcgccaccagcagcagcgagagctcctggcaccaggccagcacccccagcggcacctggacaggccacggccccagcatggaggacagcagcgctgtgctgatggagagcctgaagagcatctggagcagctccatgatgcaccctggccccagcgccctggagcagctgctgatgcagcagaagcagaagcagcagaggggccagggcaccatgaaccccccccactag

SEQ ID NO: 170025 - DNA, 3513 bp, Artificial Sequence
  Description of Artificial Sequence: Synthetic coding sequence
atgaggaactggatgttcctgcagatcgtgattgtgggggagaatgtgtccttcaagagccagatgaggacagagaacctgaagtctgaggagcacctgaagagcagcaacatccggcaggccgaggtgctgaaggctgacatgacagacagcaagctgggccctgctgaggtgtggaccagccggcaggccctgcaggacctgtaccagaagatgctggtgacagacctggagtatgccctggacaagaaggtggagcaggacctgtggaaccacgccttcaagaaccagatcaccaccctgcagggccaggccaagaacagagccaaccccaacagaagtgaggtgcaggccaacctgagcctcttcctggaggccgccagcggcttctacacccagctgctgcaggagctgtgcaccgtcttcaacgtggacctgccctgccgggtgaagagcagccagctgggcatcatcagcaacaagcagacccacaccagcgccatcgtgaagccccagagcagcagctgcagctacatctgccagcactgcctggtgcacctgggggacatcgcccgctacagaaaccagaccagccaggccgagagctactacagacatgctgcccagctggtgcccagcaatggccagccctacaaccagctggccatcctggccagcagcaagggggaccacctgaccaccatcttctactactgccgcagcattgctgtgaagttccccttccctgctgccagcaccaacctgcagaaggccctgagcaaggccctggagagcagagatgaggtgaagaccaagtggggcgtgtctgacttcatcaaggccttcatcaagttccacggccacgtgtacctgagcaagagcctggagaagctgagccccctgcgggagaagctggaggagcagttcaagaggctgctcttccagaaggccttcaacagccagcagctggtgcacgtgaccgtcatcaacctcttccagctgcaccacctgcgggacttcagcaatgaaacagagcagcacacctacagccaggatgagcagctgtgctggacccagctgctggccctcttcatgtccttcctgggcatcctgtgcaagtgccccctgcagaatgaaagccaggaggagagctacaatgcctaccccctgcctgctgtgaaggtgtccatggactggctgcggctgcggcccagggtcttccaggaggccgtggtggatgagcggcagtacatctggccctggctgatcagcctgctgaacagcttccacccccatgaggaggacctgagcagcatcagcgccacccccctgcctgaggagtttgagctgcagggcttcctggccctgcggcccagcttcaggaacctggacttcagcaagggccaccagggcatcactggagacaaggagggccagcagaggcgcatccggcagcagaggctcatcagcatcggcaagtggattgctgacaaccagcccaggctcatccagtgtgaaaatgaggtgggcaagctgctcttcatcacagagatccctgagctgatcctggaggaccccagcgaggccaaggaaaatctcatcctgcaggagacctctgtgattgagagcctggccgcagatggcagccctggcctgaagtctgtgctgagcaccagcaggaacctgagcaacaactgtgacaccggggagaagcctgtggtgaccttcaaggagaacatcaagacccgggaggtgaacagagaccagggccgctccttcccccccaaggaggtgaagagccagacagagctgaggaagacccctgtgtctgaggccaggaagacccctgtgacccagacccccacccaggccagcaacagccagttcatccccatccaccaccctggggccttcccccccctgcccagcaggcctggcttccccccacccacctacgtgattcctcctcctgtggccttctccatgggcagcggctacaccttccctgctggggtgtctgtgcccggcaccttcctgcagcccacagcccacagccctgctggcaaccaggtgcaggccggcaagcagagccacatcccctacagccagcagaggccttctggccctggccccatgaaccagggcccccagcagagccagccccccagccagcagcccctgaccagcctgcctgcccagcccacagcccagagcaccagccagctgcaggtgcaggccctgacccagcagcagcagagccccaccaaggctgtgcctgccctgggcaagagccccccccaccacagcggcttccagcagtaccagcaggctgatgccagcaagcagctgtggaaccccccccaggtgcagggccccctgggcaagatcatgcctgtgaagcagccctactacctgcagacccaggaccccatcaagctgtttgagcccagcctgcagccccctgtgatgcagcagcagcccctggagaagaagatgaagcccttccccatggagccctacaaccacaaccccagcgaggtgaaggtgcctgagttctactgggacagcagctacagcatggctgacaacagatctgtgatggcccagcaggccaacatcgacagaagaggcaagaggagccctggggtcttccggcctgagcaggaccctgtgcccaggatgccctttgaggaccccaagagcagccccctgctgcccccagacctgctgaagagcctggccgccctggaggaggaggaggagctgatcttcagcaaccccccagacctgtacccagccctgctgggccccctggccagcctgcccggccgcagcctcttcaagagcctgctggagaagcccagcgagctgatgagccacagcagcagcttcctgagcctgaccggcttcagcctgaaccaggagcgctaccccaacaacagcatgtttaatgaggtgtatggcaagaacctgaccagcagcagcaaggccgagctgagccccagcatggccccccaggagaccagcctgtacagcctgtttgagggcaccccctggagccccagcctgcctgccagcagtgaccacagcaccccagccagccagagcccccacagcagcaaccccagcagcctgcccagcagcccccccacccacaaccacaacagcgtgcccttcagcaactttggccccatcggcaccccagacaacagagacagaagaacagctgaccgctggaagacagacaagccagccatgggcggctttggaattgactacctgagcgccaccagcagcagcgagagctcctggcaccaggccagcaccccatctggcacctggacaggccacggccccagcatggaggacagcagcgctgtgctgatggagagcctgaagagcatctggagcagctccatgatgcaccctggccccagcgccctggagcagctgctgatgcagcagaagcagaagcagcagaggggccagggcaccatgaaccccccccactag

SEQ ID NO: 170026 - DNA, 2274 bp, Artificial Sequence
  Description of Artificial Sequence: Synthetic coding sequence
atgctggtgacagacctggagtatgccctggacaagaaggtggagcaggacctgtggaaccacgccttcaagaaccagatcaccaccctgcagggccaggccaagaacagagccaaccccaacagaagtgaggtgcaggccaacctgagcctcttcctggaggccgccagcggcttctacacccagctgctgcaggagctgtgcaccgtcttcaacgtggacctgccctgccgggtgaagagcagccagctgggcatcatcagcaacaagcagacccacaccagcgccatcgtgaagccccagagcagcagctgcagctacatctgccagcactgcctggtgcacctgggggacatcgcccgctacagaaaccagaccagccaggccgagagctactacagacatgctgcccagctggtgcccagcaatggccagccctacaaccagctggccatcctggccagcagcaaaggagaccacctgaccaccatcttctactactgccgcagcattgctgtgaagttccccttccctgctgccagcaccaacctgcagaaggccctgagcaaggccctggagagcagagatgaggtgaagaccaagtggggcgtgtctgacttcatcaaggccttcatcaagttccacggccacgtgtacctgagcaagagcctggagaagctgagccccctgcgggagaagctggaggagcagttcaagaggctgctcttccagaaggccttcaacagccagcagctggtgcacgtgaccgtcatcaacctcttccagctgcaccacctgcgggacttcagcaatgaaacagagcagcacacctacagccaggatgagcagctgtgctggacccagctgctggccctcttcatgtccttcctgggcatcctgtgcaagtgccccctgcagaatgaaagccaggaggagagctacaatgcctaccccctgcctgctgtgaaggtgtccatggactggctgcggctgcggcccagggtcttccaggaggccgtggtggatgagcggcagtacatctggccctggctgatcagcctgctgaacagcttccacccccatgaggaggacctgagcagcatcagcgccacccccctgcctgaggagtttgagctgcagggcttcctggccctgcggcccagcttcaggaacctggacttcagcaagggccaccagggcatcaccggggacaaggagggccagcagaggcgcatccggcagcagaggctcatcagcatcggcaagtggattgctgacaaccagcccaggctcatccagtgtgaaaatgaggtgggcaagctgctcttcatcacagagatccctgagctgatcctggaggaccccagcgaggccaaggagaacctgatcctgcaggagaccagcgtcatcgagagcctggccgcagatggcagccctggcctgaagtctgtgctgagcaccagcaggaacctgagcaacaactgtgacacaggagagaagcctgtggtgaccttcaaggagaacatcaagacccgggaggtgaacagagaccagggccgctccttcccccccaaggaggtgaagagccagacagagctgaggaagacccctgtgtctgaggccaggaagacccctgtgacccagacccccacccaggccagcaacagccagttcatccccatccaccaccctggggccttcccccccctgcccagccggcccggcttccccccacccacctacgtgatccccccacctgtggccttctccatgggcagcggctacaccttccctgctggggtgtctgtgcccggcaccttcctgcagcccacagcccacagccctgctggcaaccaggtgcaggccggcaagcagagccacatcccctacagccagcagaggcccagcggccctggccccatgaaccagggcccccagcagagccagccccccagccagcagcccctgaccagcctgcctgcccagcccacagcccagagcaccagccagctgcaggtgcaggccctgacccagcagcagcagagccccaccaaggctgtgcctgccctgggcaagagccccccccaccacagcggcttccagcagtaccagcaggctgatgccagcaagcagctgtggaaccccccccaggtgcagggccccctgggcaagatcatgcctgtgaagcagccctactacctgcagacccaggaccccatcaagctgtttgagcccagcctgcagccccctgtgatgcagcagcagcccctgtag

SEQ ID NO: 170027 - DNA, 3150 bp, Artificial Sequence
  Description of Artificial Sequence: Synthetic coding sequence
atgctggtgacagacctggagtatgccctggacaagaaggtggagcaggacctgtggaaccacgccttcaagaaccagatcaccaccctgcagggccaggccaagaacagagccaaccccaacagaagtgaggtgcaggccaacctgagcctcttcctggaggccgccagcggcttctacacccagctgctgcaggagctgtgcaccgtcttcaacgtggacctgccctgccgggtgaagagcagccagctgggcatcatcagcaacaagcagacccacaccagcgccatcgtgaagccccagagcagcagctgcagctacatctgccagcactgcctggtgcacctgggggacatcgcccgctacagaaaccagaccagccaggccgagagctactacagacatgctgcccagctggtgcccagcaatggccagccctacaaccagctggccatcctggccagcagcaaaggagaccacctgaccaccatcttctactactgccgcagcattgctgtgaagttccccttccctgctgccagcaccaacctgcagaaggccctgagcaaggccctggagagcagagatgaggtgaagaccaagtggggcgtgtctgacttcatcaaggccttcatcaagttccacggccacgtgtacctgagcaagagcctggagaagctgagccccctgcgggagaagctggaggagcagttcaagaggctgctcttccagaaggccttcaacagccagcagctggtgcacgtgaccgtcatcaacctcttccagctgcaccacctgcgggacttcagcaatgaaacagagcagcacacctacagccaggatgagcagctgtgctggacccagctgctggccctcttcatgtccttcctgggcatcctgtgcaagtgccccctgcagaatgaaagccaggaggagagctacaatgcctaccccctgcctgctgtgaaggtgtccatggactggctgcggctgcggcccagggtcttccaggaggccgtggtggatgagcggcagtacatctggccctggctgatcagcctgctgaacagcttccacccccatgaggaggacctgagcagcatcagcgccacccccctgcctgaggagtttgagctgcagggcttcctggccctgcggcccagcttcaggaacctggacttcagcaagggccaccagggcatcaccggggacaaggagggccagcagaggcgcatccggcagcagaggctcatcagcatcggcaagtggattgctgacaaccagcccaggctcatccagtgtgaaaatgaggtgggcaagctgctcttcatcacagagatccctgagctgatcctggaggaccccagcgaggccaaggagaacctgatcctgcaggagaccagcgtcatcgagagcctggccgcagatggcagccctggcctgaagtctgtgctgagcaccagcaggaacctgagcaacaactgtgacacaggagagaagcctgtggtgaccttcaaggagaacatcaagacccgggaggtgaacagagaccagggccgctccttcccccccaaggaggtgaagagccagacagagctgaggaagacccctgtgtctgaggccaggaagacccctgtgacccagacccccacccaggccagcaacagccagttcatccccatccaccaccctggggccttcccccccctgcccagccggcccggcttccccccacccacctacgtgatccccccacctgtggccttctccatgggcagcggctacaccttccctgctggggtgtctgtgcccggcaccttcctgcagcccacagcccacagccctgctggcaaccaggtgcaggccggcaagcagagccacatcccctacagccagcagaggcccagcggccctggccccatgaaccagggcccccagcagagccagccccccagccagcagcccctgaccagcctgcctgcccagcccacagcccagagcaccagccagctgcaggtgcaggccctgacccagcagcagcagagccccaccaaggctgtgcctgccctgggcaagagccccccccaccacagcggcttccagcagtaccagcaggctgatgccagcaagcagctgtggaaccccccccaggtgcagggccccctgggcaagatcatgcctgtgaagcagccctactacctgcagacccaggaccccatcaagctgtttgagcccagcctgcagccccctgtgatgcagcagcagcccctggagaagaagatgaagcccttccccatggagccctacaaccacaaccccagcgaggtgaaggtgcctgagttctactgggacagcagctacagcatggctgacaacagatctgtgatggcccagcaggccaacatcgaccggcggggcaagaggagccctggggtcttccggcctgagcaggaccctgtgcccaggatgccctttgagaagagcctgctggagaagcccagcgagctgatgagccacagcagcagcttcctgagcctgaccggcttcagcctgaaccaggagcgctaccccaacaacagcatgtttaatgaggtgtatggcaagaacctgaccagcagcagcaaggccgagctgagccccagcatggccccccaggagaccagcctgtacagcctgtttgagggcaccccctggagccccagcctgcctgccagcagtgaccacagcaccccagccagccagagcccccacagcagcaaccccagcagcctgcccagcagcccccccacccacaaccacaacagcgtgcccttcagcaactttggccccatcggcaccccagacaacagagacagaagaacagctgaccgctggaagacagacaagccagccatgggcggcttcggcatcgactacctgagcgccaccagcagcagcgagagctcctggcaccaggccagcacccccagcggcacctggacaggccacggccccagcatggaggacagcagcgctgtgctgatggagagcctgaagagcatctggagcagctccatgatgcaccctggccccagcgccctggagcagctgctgatgcagcagaagcagaagcagcagaggggccagggcaccatgaaccccccccactag

SEQ ID NO: 170028 - DNA, 3537 bp, Artificial Sequence
  Description of Artificial Sequence: Synthetic coding sequence
atgagcctgcagagcgcccagtacctgcggcaggccgaggtgctgaaggctgacatgacagacagcaagctgggccctgctgaggtgtggaccagccggcaggccctgcaggacctgtaccagaagatgctggtgacagacctggagtatgccctggacaagaaggtggagcaggacctgtggaaccacgccttcaagaaccagatcaccaccctgcagggccaggccaagaacagagccaaccccaacagaagtgaggtgcaggccaacctgagcctcttcctggaggccgccagcggcttctacacccagctgctgcaggagctgtgcaccgtcttcaacgtggacctgccctgccgggtgaagagcagccagctgggcatcatcagcaacaagcagacccacaccagcgccatcgtgaagccccagagcagcagctgcagctacatctgccagcactgcctggtgcacctgggggacatcgcccgctacagaaaccagaccagccaggccgagagctactacagacatgctgcccagctggtgcccagcaatggccagccctacaaccagctggccatcctggccagcagcaaaggagaccacctgaccaccatcttctactactgccgcagcattgctgtgaagttccccttccctgctgccagcaccaacctgcagaaggccctgagcaaggccctggagagcagagatgaggtgaagaccaagtggggcgtgtctgacttcatcaaggccttcatcaagttccacggccacgtgtacctgagcaagagcctggagaagctgagccccctgcgggagaagctggaggagcagttcaagaggctgctcttccagaaggccttcaacagccagcagctggtgcacgtgaccgtcatcaacctcttccagctgcaccacctgcgggacttcagcaatgaaacagagcagcacacctacagccaggatgagcagctgtgctggacccagctgctggccctcttcatgtccttcctgggcatcctgtgcaagtgccccctgcagaatgaaagccaggaggagagctacaatgcctaccccctgcctgctgtgaaggtgtccatggactggctgcggctgcggcccagggtcttccaggaggccgtggtggatgagcggcagtacatctggccctggctgatcagcctgctgaacagcttccacccccatgaggaggacctgagcagcatcagcgccacccccctgcctgaggagtttgagctgcagggcttcctggccctgcggcccagcttcaggaacctggacttcagcaagggccaccagggcatcaccggggacaaggagggccagcagaggcgcatccggcagcagaggctcatcagcatcggcaagtggattgctgacaaccagcccaggctcatccagtgtgaaaatgaggtgggcaagctgctcttcatcacagagatccctgagctgatcctggaggaccccagcgaggccaaggagaacctgatcctgcaggagaccagcgtcatcgagagcctggccgcagatggcagccctggcctgaagtctgtgctgagcaccagcaggaacctgagcaacaactgtgacacaggagagaagcctgtggtgaccttcaaggagaacatcaagacccgggaggtgaacagagaccagggccgctccttcccccccaaggaggtgaagagccagacagagctgaggaagacccctgtgtctgaggccaggaagacccctgtgacccagacccccacccaggccagcaacagccagttcatccccatccaccaccctggggccttcccccccctgcccagccggcccggcttccccccacccacctacgtgatccccccacctgtggccttctccatgggcagcggctacaccttccctgctggggtgtctgtgcccggcaccttcctgcagcccacagcccacagccctgctggcaaccaggtgcaggccggcaagcagagccacatcccctacagccagcagaggcccagcggccctggccccatgaaccagggcccccagcagagccagccccccagccagcagcccctgaccagcctgcctgcccagcccacagcccagagcaccagccagctgcaggtgcaggccctgacccagcagcagcagagccccaccaaggctgtgcctgccctgggcaagagccccccccaccacagcggcttccagcagtaccagcaggctgatgccagcaagcagctgtggaaccccccccaggtgcagggccccctgggcaagatcatgcctgtgaagcagccctactacctgcagacccaggaccccatcaagctgtttgagcccagcctgcagccccctgtgatgcagcagcagcccctggagaagaagatgaagcccttccccatggagccctacaaccacaaccccagcgaggtgaaggtgcctgagttctactgggacagcagctacagcatggctgacaacagatctgtgatggcccagcaggccaacatcgaccggcggggcaagaggagccctggggtcttccggcctgagcaggaccctgtgcccaggatgccctttgaggaccccaagagcagccccctgctgcccccagacctgctgaagagcctggccgccctggaggaggaggaggagctgatcttcagcaaccccccagacctgtacccagccctgctgggccccctggccagcctgcccggccgcagcctcttcaagagcctgctggagaagcccagcgagctgatgagccacagcagcagcttcctgagcctgaccggcttcagcctgaaccaggagcgctaccccaacaacagcatgtttaatgaggtgtatggcaagaacctgaccagcagcagcaaggccgagctgagccccagcatggccccccaggagaccagcctgtacagcctgtttgagggcaccccctggagccccagcctgcctgccagcagtgaccacagcaccccagccagccagagcccccacagcagcaaccccagcagcctgcccagcagcccccccacccacaaccacaacagcgtgcccttcagcaactttggccccatcggcaccccagacaacagagacagaagaacagctgaccgctggaagacagacaagccagccatgggcggcttcggcatcgactacctgagcgccaccagcagcagcgagagctcctggcaccaggccagcacccccagcggcacctggacaggccacggccccagcatggaggacagcagcgctgtgctgatggagagcctgaagaagcagcagcacggcgtgcagcagctgggccccaagaggcagagcgaggaggagggcagcagcagcatctgtgtggcccaccggggcccccggcccctgcccagctgcagcctgcctgccagcaccttccgggtgaagttcaaggccgcccggacctgtgcccaccaggcccagaagaagaccaggagaagacccttctggaagaggaggaagaagggcaagtag

SEQ ID NO: 170029 - DNA, 3276 bp, Artificial Sequence
  Description of Artificial Sequence: Synthetic coding sequence
atgagcctgcagagcgcccagtacctgcggcaggccgaggtgctgaaggctgacatgacagacagcaagctgggccctgctgaggtgtggaccagccggcaggccctgcaggacctgtaccagaagatgctggtgacagacctggagtatgccctggacaagaaggtggagcaggacctgtggaaccacgccttcaagaaccagatcaccaccctgcagggccaggccaagaacagagccaaccccaacagaagtgaggtgcaggccaacctgagcctcttcctggaggccgccagcggcttctacacccagctgctgcaggagctgtgcaccgtcttcaacgtggacctgccctgccgggtgaagagcagccagctgggcatcatcagcaacaagcagacccacaccagcgccatcgtgaagccccagagcagcagctgcagctacatctgccagcactgcctggtgcacctgggggacatcgcccgctacagaaaccagaccagccaggccgagagctactacagacatgctgcccagctggtgcccagcaatggccagccctacaaccagctggccatcctggccagcagcaaaggagaccacctgaccaccatcttctactactgccgcagcattgctgtgaagttccccttccctgctgccagcaccaacctgcagaaggccctgagcaaggccctggagagcagagatgaggtgaagaccaagtggggcgtgtctgacttcatcaaggccttcatcaagttccacggccacgtgtacctgagcaagagcctggagaagctgagccccctgcgggagaagctggaggagcagttcaagaggctgctcttccagaaggccttcaacagccagcagctggtgcacgtgaccgtcatcaacctcttccagctgcaccacctgcgggacttcagcaatgaaacagagcagcacacctacagccaggatgagcagctgtgctggacccagctgctggccctcttcatgtccttcctgggcatcctgtgcaagtgccccctgcagaatgaaagccaggaggagagctacaatgcctaccccctgcctgctgtgaaggtgtccatggactggctgcggctgcggcccagggtcttccaggaggccgtggtggatgagcggcagtacatctggccctggctgatcagcctgctgaacagcttccacccccatgaggaggacctgagcagcatcagcgccacccccctgcctgaggagtttgagctgcagggcttcctggccctgcggcccagcttcaggaacctggacttcagcaagggccaccagggcatcaccggggacaaggagggccagcagaggcgcatccggcagcagaggctcatcagcatcggcaagtggattgctgacaaccagcccaggctcatccagtgtgaaaatgaggtgggcaagctgctcttcatcacagagatccctgagctgatcctggaggaccccagcgaggccaaggagaacctgatcctgcaggagaccagcgtcatcgagagcctggccgcagatggcagccctggcctgaagtctgtgctgagcaccagcaggaacctgagcaacaactgtgacacaggagagaagcctgtggtgaccttcaaggagaacatcaagacccgggaggtgaacagagaccagggccgctccttcccccccaaggaggtgaagagccagacagagctgaggaagacccctgtgtctgaggccaggaagacccctgtgacccagacccccacccaggccagcaacagccagttcatccccatccaccaccctggggccttcccccccctgcccagccggcccggcttccccccacccacctacgtgatccccccacctgtggccttctccatgggcagcggctacaccttccctgctggggtgtctgtgcccggcaccttcctgcagcccacagcccacagccctgctggcaaccaggtgcaggccggcaagcagagccacatcccctacagccagcagaggcccagcggccctggccccatgaaccagggcccccagcagagccagccccccagccagcagcccctgaccagcctgcctgcccagcccacagcccagagcaccagccagctgcaggtgcaggccctgacccagcagcagcagagccccaccaaggctgtgcctgccctgggcaagagccccccccaccacagcggcttccagcagtaccagcaggctgatgccagcaagcagctgtggaaccccccccaggtgcagggccccctgggcaagatcatgcctgtgaagcagccctactacctgcagacccaggaccccatcaagctgtttgagcccagcctgcagccccctgtgatgcagcagcagcccctggagaagaagatgaagcccttccccatggagccctacaaccacaaccccagcgaggtgaaggtgcctgagttctactgggacagcagctacagcatggctgacaacagatctgtgatggcccagcaggccaacatcgaccggcggggcaagaggagccctggggtcttccggcctgagcaggaccctgtgcccaggatgccctttgagaagagcctgctggagaagcccagcgagctgatgagccacagcagcagcttcctgagcctgaccggcttcagcctgaaccaggagcgctaccccaacaacagcatgtttaatgaggtgtatggcaagaacctgaccagcagcagcaaggccgagctgagccccagcatggccccccaggagaccagcctgtacagcctgtttgagggcaccccctggagccccagcctgcctgccagcagtgaccacagcaccccagccagccagagcccccacagcagcaaccccagcagcctgcccagcagcccccccacccacaaccacaacagcgtgcccttcagcaactttggccccatcggcaccccagacaacagagacagaagaacagctgaccgctggaagacagacaagccagccatgggcggcttcggcatcgactacctgagcgccaccagcagcagcgagagctcctggcaccaggccagcacccccagcggcacctggacaggccacggccccagcatggaggacagcagcgctgtgctgatggagagcctgaagagcatctggagcagctccatgatgcaccctggccccagcgccctggagcagctgctgatgcagcagaagcagaagcagcagaggggccagggcaccatgaaccccccccactag

SEQ ID NO: 170030 - DNA, 2976 bp, Artificial Sequence
  Description of Artificial Sequence: Synthetic coding sequence
atggccggccctgtgtccctgcgggacctgctgatgggcgccagcgcctggatgggcagcgagagccctgggggcagccccacagagggcggcggcagcgctgctgggggccctgagcccccctggagagaagatgagatctgtgtggtgggcatctttgggaagacagccctgcggctgaacagcgagaagttcagcctggtgaacacagtgtgtgaccggcaggtgttccccctcttccgccaccaggaccccggggaccccggccctggcatcagaacagaggccggggctgtgggggaggccggcggcgctgaggaccccggggctgctgctgggggctctgtgcggggcagcggggctgtggccgagggcaacagaacagaggccggcagccaggactacagcctgctgcaggcctactacagccaggagagcaaggtgctgtacctgctgctgaccagcatctgtgacaacagccagctgctgcgggcctgccgggccctgcagagcggggaggccggcggcggcctgagcctgccccatgctgaggcccacgagttctggaagcaccaggagaagctgcagtgcctgagcctgctgtacctgttctctgtgtgccacatcctgctgctggtgcaccccacctgcagctttgacatcacctatgacagagtcttccgggccctggatggcctgcggcagaaggtgctgcccctgctgaagacagccatcaaggactgccctgtgggcaaggactggaagctgaactgccggccctgccccccccggctgctcttcctgttccagctgaatggagccctgaaggtggagcccccaagaaaccaggaccctgcccacccagacaagcccaagaagcacagccccaagaggcggctgcagcacgccctggaggaccagatctaccgcatcttcaggaagagccgggtgctgaccaaccagagcatcaactgcctcttcaccgtgcctgccaaccaggcctttgtgtacatcgtgcccggcagccaggaggaggaccctgtgggcatgctgctggaccagctgcggagccactgcaccgtgaaggaccctgagagcctgctggtgcctgcccccctgagcggcccccggcgctaccaggtgatgaggcagcacagccggcagcagctgtccttccacatcgacagcagcagcagcagcagcagcggccagctggtggacttcaccctgcgggagttcctgtggcagcacgtggagctggtgctgagcaagaagggctttgatgacagcgtgggcaggaacccccagcccagccactttgagctgcccacctaccagaagtggatctctgctgccagcaagctgtatgaggtggccattgatggcaaggaggaggacctgggcagccccactggagagctgaccagcaagatcctgagcagcatcaaggtgctggagggcttcctggacatcgacaccaagttctctgaaaatcgctgccagaaggccctgcccatggcccacagcgcctaccagagcaacctgccccacaactacaccatgacagtgcacaagaaccagctggcccaggccctgcgggtgtacagccagcacgcccggggccctgccttccacaagtatgccatgcagctgcacgaggactgctacaagttctggagcaatggccaccagctgtgtgaggagaggagcctgacagaccagcactgtgtgcacaagttccacagcctgcccaagagcggggagaagccagaggccgacaggaacccccctgtgctgtaccacaacagccgggcccggagcactggagcctgcaactgtggcaggaagcaggcccccagagatgacccctttgacatcaaggccgccaactatgacttctaccagctgctggaggagaagtgctgcggcaagctggaccacatcaacttccctgtgtttgagcccagcaccccagaccctgccccagccaagaatgaaagcagccctgcccccccagacagtgatgctgacaagctgaaggagaaggagccccagacccagggcgagagcaccagcctgagcctggccctgagcctgggccagagcacagacagcctgggcacctacccagctgacccccaggccggcggggacaaccctgaggtgcacggccaggtggaggtgaagacagagaagaggcccaactttgtggaccggcaggccagcacagtggagtacctgcccggcatgctgcacagcaactgccccaagggcctgctgcccaagttcagctcctggagcctggtgaagctgggccctgccaagagctacaacttccacacaggcctggaccagcagggcttcatccctggcaccaactacctgatgccctgggacatcgtcatccgcaccagggcagaagatgaaggagacctggacaccaacagctggccagcccccaacaaggccatccctgggaagaggtctgctgtggtgatgggccggggcagaagaagagatgacatcgcccgggcctttgtgggctttgaatatgaggacagccggggccgccgcttcatgtgcagcggccctgacaaggtgatgaaggtgatgggcagcggccccaaggagagcgccctgaaggccctgaacagcgacatgcccctgtacatcctgagcagcagccagggccggggcctgaagccccactacgcccagctgatgaggctgtttgtggtggtgcctgatgcccccctgcagatcatcctgatgccccaggtgcagcccggccccccaccctgccctgtgttctacccagagaagcaggagatcaccctgcccccagatggcctgtgggtgctgcgcttcccctatgcctacgtgacagagcggggcccctgcttcccccccaaggaaaatgtgcagctgatgagctacaaggtgctgcggggcgtgctgaaggctgtgacccagtag

SEQ ID NO: 170031 - DNA, 2925 bp, Artificial Sequence
  Description of Artificial Sequence: Synthetic coding sequence
atggccggccctgtgtccctgcgggacctgctgatgggcgccagcgcctggatgggcagcgagagccctgggggcagccccacagagggcggcggcagcgctgctgggggccctgagcccccctggagagaagatgagatctgtgtggtgggcatctttgggaagacagccctgcggctgaacagcgagaagttcagcctggtgaacacagtgtgtgaccggcaggtgttccccctcttccgccaccaggaccccggggaccccggccctggcatcagaacagaggccggggctgtgggggaggccggcggcgctgaggaccccggggctgctgctgggggctctgtgcggggcagcggggctgtggccgagggcaacagaacagaggccggcagccaggactacagcctgctgcaggcctactacagccaggagagcaaggtgctgtacctgctgctgaccagcatctgtgacaacagccagctgctgcgggcctgccgggccctgcagagcggggaggccggcggcggcctgagcctgccccatgctgaggcccacgagttctggaagcaccaggagaagctgcagtgcctgagcctgctgtacctgttctctgtgtgccacatcctgctgctggtgcaccccacctgcagctttgacatcacctatgacagagtcttccgggccctggatggcctgcggcagaaggtgctgcccctgctgaagacagccatcaaggactgccctgtgggcaaggactggaagctgaactgccggccctgccccccccggctgctcttcctgttccagctgaatggagccctgaaggtggagcccccaagaaaccaggaccctgcccacccagacaagcccaagaagcacagccccaagaggcggctgcagcacgccctggaggaccagatctaccgcatcttcaggaagagccgggtgctgaccaaccagagcatcaactgcctcttcaccgtgcctgccaaccaggcctttgtgtacatcgtgcccggcagccaggaggaggaccctgtgggcatgctgctggaccagctgcggagccactgcaccgtgaaggaccctgagagcctgctggtgcctgcccccctgagcggcccccggcgctaccaggtgatgaggcagcacagccggcagcagctgtccttccacatcgacagcagcagcagcagcagcagcggccagctggtggacttcaccctgcgggagttcctgtggcagcacgtggagctggtgctgagcaagaagggctttgatgacagcgtgggcaggaacccccagcccagccactttgagctgcccacctaccagaagtggatctctgctgccagcaagctgtatgaggtggccattgatggcaaggaggaggacctgggcagccccactggagagctgaccagcaagatcctgagcagcatcaaggtgctggagggcttcctggacatcgacaccaagttctctgaaaatcgctgccagaaggccctgcccatggcccacagcgcctaccagagcaacctgccccacaactacaccatgacagtgcacaagaaccagctggcccaggccctgcgggtgtacagccagcacgcccggggccctgccttccacaagtatgccatgcagctgcacgaggactgctacaagttctggagcaatggccaccagctgtgtgaggagaggagcctgacagaccagcactgtgtgcacaagttccacagcctgcccaagagcggggagaagccagaggccgacaggaacccccctgtgctgtaccacaacagccgggcccggagcactggagcctgcaactgtggcaggaagcaggcccccagagatgacccctttgacatcaaggccgccaactatgacttctaccagctgctggaggagaagtgctgcggcaagctggaccacatcaacttccctgtgtttgagcccagcaccccagaccctgccccagccaagaatgaaagcagccctgcccccccagacagtgatgctgacaagctgaaggagaaggagccccagacccagggcgagagcaccagcctgagcctggccctgagcctgggccagagcacagacagcctgggcacctacccagctgacccccaggccggcggggacaaccctgaggtgcacggccaggtggaggtgaagacagagaagaggcccaactttgtggaccggcaggccagcacagtggagtacctgcccggcatgctgcacagcaactgccccaagggcctgctgcccaagttcagctcctggagcctggtgaagctgggccctgccaagagctacaacttccacacaggcctggaccagcagggcttcatccctggcaccaactacctgatgccctgggacatcgtcatccgcaccagggcagaagatgaaggagacctggacaccaacagctggccagcccccaacaaggccatccctgggaagaggtctgctgtggtgatgggccggggcagaagaagagatgacatcgcccgggcctttgtgggctttgaatatgaggacagccggggccgccgcttcatgtgcagcggccctgacaaggtgatgaaggtgatgggcagcggccccaaggagagcgccctgaaggccctgaacagcgacatgcccctgtacatcctgagcagcagccagggccggggcctgaagccccactacgcccagctgatgaggctgtttgtggtggtgcctgatgcccccctgcagatcatcctgatgccccaggtgcagcccggccccccaccctgccctgtgttctacccagagaagcaggagatcaccctgcccccagatggcctgtgggtgctgcgcttcccctatgcctacctgcgggaggacctggtgagccccctgaggaagatgtgcagctag

SEQ ID NO: 170032 - DNA, 1563 bp, Artificial Sequence
  Description of Artificial Sequence: Synthetic coding sequence
atgtctgagagcggccacagccagcccggcctgtatggcatcgagaggagaagacgctggaaggagcccggcagcggcggcccccagaacctgagcggccctgggggccgggagcgggactacatcgccccctgggagcgggagaggagagatgccagcgaggagaccagcacctctgtgatgcagaagacccccatcatcctgagcaagcccccagctgagaggagcaagcagcccccaccacccacagccccagctgcccccccagccccagcccccctggagaagcccatcgtgctgatgaagccccgggaggagggcaagggccctgtggccgtgactggagccagcaccccagagggcacagcccctcctcctcctgctgccccagccccacccaagggggagaaggagggccagaggcccacccagcctgtgtaccagatccagaacagaggcatgggcacagctgccccagctgccatggaccctgtggtgggccaggccaagctgctgcccccagagaggatgaagcacagcatcaagctggtggatgaccagatgaactggtgtgacagcgccatcgagtacctgctggaccagacagatgtgctggtggtgggcgtgctgggcctgcagggcaccgggaagtccatggtgatgagcctgctgagcgccaacaccccagaggaggaccagaggacctacgtgttccgggcccagagcgctgagatgaaggagcggggcggcaaccagaccagcggcatcgacttcttcatcacccaggagagaattgtgttcctggacacccagcccatcctgagccccagcatcctggaccacctgatcaacaatgacaggaagctgcccccagagtacaacctgccccacacctacgtggagatgcagagcctgcagattgctgccttcctgttcaccgtgtgccacgtggtgattgtggtgcaggactggttcacagacctgagcctgtaccgcttcctgcagacagctgagatggtgaagcccagcacccccagccccagccatgagagcagcagcagcagcggcagtgatgagggcacagagtactacccccacctggtgttcctgcagaacaaggcccggcgggaggacttctgccccaggaagctgcggcagatgcacctgatgattgaccagctgatggcccacagccacctgcgctacaagggcaccctgtccatgctgcagtgcaatgtgtttcctggcctgcccccagacttcctggacagcgaggtgaacctcttcctggtgcccttcatggacagcgaggccgagagtgaaaatccaccccgggccggccctggcagcagccccctcttcagcctgctgcccggctaccggggccaccccagcttccagagcctggtgtccaagctgcggagccaggtgatgtccatggcccggccccagctgagccacaccatcctgacagagaagaactggttccactatgctgcccgcatctgggatggagtgaggaagagcagcgccctggccgagtacagccggctgctggcctag

SEQ ID NO: 170033 - DNA, 2742 bp, Artificial Sequence
  Description of Artificial Sequence: Synthetic coding sequence
atggctgatgaggccctggccggcctggatgagggcgccctgaggaagctgctggaggtgacagctgacctggccgagcggcggcgcatccgcagcgccatccgggagctgcagaggcaggagctggagcgggaggaggaggccctggccagcaagcgcttccgggcagagcggcaggacaacaaggagaactggctgcacagccagcagcgggaggccgagcagagagctgccctggcccggctggccggccagctggagagcatgaatgatgtggaggagctgacagccctgctgcggtctgctggggagtatgaggagaggaagctgatccgggccgccatccggcgggtgcgggcccaggagattgaagctgccaccctggccggccgcctgtacagcggccggcccaacagcggcagccgggaggacagcaagggcctggccgcccaccggctggagcagtgtgaggtgcctgagcgggaggagcaggagcagcaggccgaggtgtccaagcccacccccaccccagagggcaccagccaggatgtgaccaccgtgaccctgctgctgcgggcccctcctggcagcaccagcagcagccctgccagccccagcagcagccccaccccagccagccctgagccccccctggagcctgctgaggcccagtgcctgacagctgaggtgcccggcagccctgagcccccacccagcccccccaagaccaccagccctgagccccaggagagccccaccctgcccagcacagagggccaggtggtgaacaagctgctgagcggccccaaggagaccccagctgcccagagccccacccggggccccagcgacaccaagagagcagatgtggccggcccccggccctgccagaggagcctgtctgtgctgagcccccggcagcctgcccagaaccgggagagcacccccctggccagcggccccagcagcttccagagagctggctctgtgcgggacagagtgcacaagttcaccagtgacagccccatggccgcccggctgcaggacggcaccccccaggccgccctgagccccctgcccaggaaggcccctggccccctgccccaccagcaccacccctgcctgctgctgcagaggctgctgctgagcggccctgacaccagcagccgcttcagcaaggagcagaggggcgtggcccagcccctggcccagctgcggagctgcccccaggaggagggcccccggggccggggcctggccgcccggcccctggagaacagagctgggggccctgtggcccggtctgaggagcccggggcccccctgcctgtggccgtgggcacagctgagcccggcggctccatgaagaccaccttcaccatcgagatcaaggatggccggggccaggccagcacaggccgggtgctgctgcccactggaaaccagagagctgagctgaccctgggcctgcgggccccacccaccctgctgagcaccagcagcggcggcaagagcaccatcaccagggtgaacagccctggcaccctggcccggctgggctctgtgacccacgtgaccagcttcagccacgccccacccagcagcagaggaggctgcagcatcaagatggaggccgagcctgctgagcccctggccgctgctgtggaggccgccaatggagctgagcagaccagggtgaacaaggcccctgagggccgcagccccctgtctgctgaggagctgatgaccattgaagatgagggcgtgctggacaagatgctggaccagagcacagactttgaggagaggaagctgatccgggccgccctgcgggagctgcggcagaggaagagggaccagagggacaaggagcgggagcggcggctgcaggaggcccggggccggcctggagagggccggggcaacacagccacagagaccaccaccaggcacagccagagagctgctgatggcagcgctgtgtccacagtgaccaagacagagcggctggtgcacagcaatgatggcaccaggacagcccggaccaccaccgtggagagcagctttgtgagaagaagtgaaaatggaagtggcagcaccatgatgcagaccaagaccttcagcagcagcagcagcagcaagaagatgggcagcatctttgaccgggaggaccaggccagcccccgggccggcagcctggccgccctggagaagaggcaggccgagaagaagaaggagctgatgaaggcccagagcctgcccaagaccagcgccagccaggccaggaaggccatgattgagaagctggagaaggagggcgctgctggcagccctgggggccccagggctgctgtgcagaggagcaccagctttggagtgcccaatgccaacagcatcaagcagatgctgctggactggtgccgggccaagacccggggctatgagcacgtggacatccagaacttcagcagctcctggagcgatggcatggccttctgtgccctggtgcacaacttcttccctgaggcctttgattatggccagctgagcccccagaacagacggcagaactttgaggtggccttcagcagcgctgagacccatgctgactgcccccagctgctggacacagaggacatggtgcggctgcgggagccagactggaagtgtgtgtacacctacatccaggagttctaccgctgcctggtgcagaagggcctggtgaagaccaagaagagctag

SEQ ID NO: 170034 - DNA, 2748 bp, Artificial Sequence
  Description of Artificial Sequence: Synthetic coding sequence
atggctgatgaggccctggccggcctggatgagggcgccctgaggaagctgctggaggtgacagctgacctggccgagcggcggcgcatccgcagcgccatccgggagctgcagaggcaggagctggagcgggaggaggaggccctggccagcaagcgcttccgggcagagcggcaggacaacaaggagaactggctgcacagccagcagcgggaggccgagcagagagctgccctggcccggctggccggccagctggagagcatgaatgatgtggaggagctgacagccctgctgcggtctgctggggagtatgaggagaggaagctgatccgggccgccatccggcgggtgcgggcccaggagattgaagctgccaccctggccggccgcctgtacagcggccggcccaacagcggcagccgggaggacagcaagggcctggccgcccaccggctggagcagtgtgaggtgcctgagcgggaggagcaggagcagcaggccgaggtgtccaagcccacccccaccccagagggcaccagccaggatgtgaccaccgtgaccctgctgctgcgggcccctcctggcagcaccagcagcagccctgccagccccagcagcagccccaccccagccagccctgagccccccctggagcctgctgaggcccagtgcctgacagctgaggtgcccggcagccctgagcccccacccagcccccccaagaccaccagccctgagccccaggagagccccaccctgcccagcacagagggccaggtggtgaacaagctgctgagcggccccaaggagaccccagctgcccagagccccacccggggccccagcgacaccaagagagcagatgtggccggcccccggccctgccagaggagcctgtctgtgctgagcccccggcagcctgcccagaaccgggagagcacccccctggccagcggccccagcagcttccagagagctggctctgtgcgggacagagtgcacaagttcaccagtgacagccccatggccgcccggctgcaggacggcaccccccaggccgccctgagccccctgaccccagcccggctgctgggccccagcctgaccagcaccaccccagccagcagcagcagcggcagcagcagccggggccccagcgacaccagcagccgcttcagcaaggagcagaggggcgtggcccagcccctggcccagctgcggagctgcccccaggaggagggcccccggggccggggcctggccgcccggcccctggagaacagagctgggggccctgtggcccggtctgaggagcccggggcccccctgcctgtggccgtgggcacagctgagcccggcggctccatgaagaccaccttcaccatcgagatcaaggatggccggggccaggccagcacaggccgggtgctgctgcccactggaaaccagagagctgagctgaccctgggcctgcgggccccacccaccctgctgagcaccagcagcggcggcaagagcaccatcaccagggtgaacagccctggcaccctggcccggctgggctctgtgacccacgtgaccagcttcagccacgccccacccagcagcagaggaggctgcagcatcaagatggaggccgagcctgctgagcccctggccgctgctgtggaggccgccaatggagctgagcagaccagggtgaacaaggcccctgagggccgcagccccctgtctgctgaggagctgatgaccattgaagatgagggcgtgctggacaagatgctggaccagagcacagactttgaggagaggaagctgatccgggccgccctgcgggagctgcggcagaggaagagggaccagagggacaaggagcgggagcggcggctgcaggaggcccggggccggcctggagagggccggggcaacacagccacagagaccaccaccaggcacagccagagagctgctgatggcagcgctgtgtccacagtgaccaagacagagcggctggtgcacagcaatgatggcaccaggacagcccggaccaccaccgtggagagcagctttgtgagaagaagtgaaaatggaagtggcagcaccatgatgcagaccaagaccttcagcagcagcagcagcagcaagaagatgggcagcatctttgaccgggaggaccaggccagcccccgggccggcagcctggccgccctggagaagaggcaggccgagaagaagaaggagctgatgaaggcccagagcctgcccaagaccagcgccagccaggccaggaaggccatgattgagaagctggagaaggagggcgctgctggcagccctgggggccccagggctgctgtgcagaggagcaccagctttggagtgcccaatgccaacagcatcaagcagatgctgctggactggtgccgggccaagacccggggctatgagcacgtggacatccagaacttcagcagctcctggagcgatggcatggccttctgtgccctggtgcacaacttcttccctgaggcctttgattatggccagctgagcccccagaacagacggcagaactttgaggtggccttcagcagcgctgagacccatgctgactgcccccagctgctggacacagaggacatggtgcggctgcgggagccagactggaagtgtgtgtacacctacatccaggagttctaccgctgcctggtgcagaagggcctggtgaagaccaagaagagctag

SEQ ID NO: 170035 - DNA, 2754 bp, Artificial Sequence
  Description of Artificial Sequence: Synthetic coding sequence
atggctgatgaggccctggccggcctggatgagggcgccctgaggaagctgctggaggtgacagctgacctggccgagcggcggcgcatccgcagcgccatccgggagctgcagaggcaggagctggagcgggaggaggaggccctggccagcaagcgcttccgggcagagcggcaggacaacaaggagaactggctgcacagccagcagcgggaggccgagcagagagctgccctggcccggctggccggccagctggagagcatgaatgatgtggaggagctgacagccctgctgcggtctgctggggagtatgaggagaggaagctgatccgggccgccatccggcgggtgcgggcccaggagattgaagctgccaccctggccggccgcctgtacagcggccggcccaacagcggcagccgggaggacagcaagggcctggccgcccaccggctggagcagtgtgaggtgcctgagcgggaggagcaggagcagcaggccgaggtgtccaagcccacccccaccccagagggcaccagccaggatgtgaccaccgtgaccctgctgctgcgggcccctcctggcagcaccagcagcagccctgccagccccagcagcagccccaccccagccagccctgagccccccctggagcctgctgaggcccagtgcctgacagctgaggtgcccggcagccctgagcccccacccagcccccccaagaccaccagccctgagccccaggagagccccaccctgcccagcacagagggccaggtggtgaacaagctgctgagcggccccaaggagaccccagctgcccagagccccacccggggccccagcgacaccaagagagcagatgtggccggcccccggccctgccagaggagcctgtctgtgctgagcccccggcagcctgcccagaaccgggagagcacccccctggccagcggccccagcagcttccagagagctggctctgtgcgggacagagtgcacaagttcaccagtgacagccccatggccgcccggctgcaggacggcaccccccaggccgccctgagccccctgaccccagcccggctgctgggccccagcctgaccagcaccaccccagccagcagcagcagcggcagcagcagccggggccccagcgacaccagcagccgcttcagcaaggagcagaggggcgtggcccagcccctggcccagctgcggagctgcccccaggaggagggcccccggggccggggcctggccgcccggcccctggagaacagagctgggggccctgtggcccggtctgaggagcccggggcccccctgcctgtggccgtgggcacagctgagcccggcggctccatgaagaccaccttcaccatcgagatcaaggatggccggggccaggccagcacaggccgggtgctgctgcccactggaaaccagagagctgagctgaccctgggcctgcgggccccacccaccctgctgagcaccagcagcggcggcaagagcaccatcaccagggtgaacagccctggcaccctggcccggctgggctctgtgacccacgtgaccagcttcagccacgccccacccagcagcagaggaggctgcagcatcaagatggaggccgagcctgctgagcccctggccgctgctgtggaggccgccaatggagctgagcagaccagggtgaacaaggcccctgagggccgcagccccctgtctgctgaggagctgatgaccattgaagatgagggcgtgctggacaagatgctggaccagagcacagactttgaggagaggaagctgatccgggccgccctgcgggagctgcggcagaggaagagggaccagagggacaaggagcgggagcggcggctgcaggaggcccggggccggcctggagagggccggggcaacacagccacagagaccaccaccaggcacagccagagagctgctgatggcagcgctgtgtccacagtgaccaagacagagcggctggtgcacagcaatgatggcaccaggacagcccggaccaccaccgtggagagcagctttgtgagaagaagtgaaaatggaagtggcagcaccatgatgcagaccaagaccttcagcagcagcagcagcagcaagaagatgggcagcatctttgaccgggaggaccaggccagcccccgggccggcagcctggccgccctggagaagaggcaggccgagaagaagaaggagctgatgaaggcccagagcctgcccaagaccagcgccagccaggccaggaaggccatgattgagaagctggagaaggagggcgctgctggcagccctgggggccccagggctgctgtgcagaggagcaccagctttggagtgcccaatgccaacagcatcaagcagatgctgctggactggtgccgggccaagacccggggctatgagcacgtggacatccagaacttcagcagctcctggagcgatggcatggccttctgtgccctggtgcacaacttcttccctgaggcctttgattatggccagctgagcccccagaacagacggcagaactttgaggtggccttcagcagcgctgagatgctggtggactgtgtgcccctggtggaggtggatgacatgatgatcatgggcaagaagccagaccccaagtgtgtgttcacctacgtgcagagcctgtacaaccacctgcggagacatgagctgcggctgcggggcaagaatgtgtag

SEQ ID NO: 170036 - DNA, 888 bp, Artificial Sequence
  Description of Artificial Sequence: Synthetic coding sequence
atggaggccgagcctgctgagcccctggccgctgctgtggaggccgccaatggagctgagcagaccagggtgaacaaggcccctgagggccgcagccccctgtctgctgaggagctgatgaccattgaagatgagggcgtgctggacaagatgctggaccagagcacagactttgaggagaggaagctgatccgggccgccctgcgggagctgcggcagaggaagagagatggcagcggcagcaccatgatgcagaccaagaccttcagcagcagcagcagcagcaagaagatgggcagcatctttgaccgggaggaccaggccagcccccgggccggcagcctggccgccctggagaagaggcaggccgagaagaagaaggagctgatgaaggcccagagcctgcccaagaccagcgccagccaggccaggaaggccatgattgagaagctggagaaggagggcgctgctggcagccctgggggccccagggctgctgtgcagaggagcaccagctttggagtgcccaatgccaacagcatcaagcagatgctgctggactggtgccgggccaagacccggggctatgagcacgtggacatccagaacttcagcagctcctggagcgatggcatggccttctgtgccctggtgcacaacttcttccctgaggcctttgattatggccagctgagcccccagaacagacggcagaactttgaggtggccttcagcagcgctgagacccatgctgactgcccccagctgctggacacagaggacatggtgcggctgcgggagccagactggaagtgtgtgtacacctacatccaggagttctaccgctgcctggtgcagaagggcctggtgaagaccaagaagagctag
